United States Patent 12,797,487 (ANTISENSE OLIGOMERS FOR TREATMENT OF NON-SENSE MEDIATED RNA DECAY BASED CONDITIONS AND DISEASES) - sequence listing, part 3

SEQ ID NO: 38 - DNA, 197318 bp, Homo sapiens
  source 1..197318: mol_type = genomic DNA
agagtaaaaggtctctgcacataaggacaggaaggggatgctgttcagtgctcaattcttttgaggctaaaggagatccagaattccacaggtaagagaaaattatatatgataaaaaattttgttttaaacagggattgtagcaaccaaactgctgaagactggcgtggtctgtctgtcttcaccctccagaggatagaggacctggtaagtaagaaactgactagtgagggcagtaatcctgaggagaaacctaagaagaggtgagagggaagatgccaggagggagagatgccctgccgtgtgccaggtgtgccacctgagctgtctcctcaaggacatggaggattcaggatcctgataaaattgccagtgcaaaatcagacattgagttcactcattcttcaagtgtcactcctctttaaaaattaacagactttttttagaacaattttaggtttacagaaaagtctatcagaaagtattgagttcccacatcgagtgccctattgaatgtcttaaatatctgtcttcaaaatttttattgagaaataaattgagagaataaatagaaactattttgttaagtgtgaaacttcccaaatttagctttcttgagggatgtgtattgttgggggagaggaggaagtgtattattttctgattaaattgatctcacagtgttttctgaactggcaccactatcatagatttaatgggatatttaaaagaaaggtgtcttacaatgacaggataattttaagatactgagtagaaaaccattccttaccaatgcataagagggagctgactattgttttcatggtgtatcttaactctagtgtttatttgcatgaaaatctgcatcttgatttggatgtgctctgccacttttcatttaccttcatgctttaccctttccttttcaaaatgttcaaagtgcttttgaataaggagttggaatgtttcctcaaaagaatctagctagttcttacaattgtcatcatgttggtagaggggaatggttatatcaaccataaattattccccctctgcactgattgtgttatttaaggtgacccttcttcataaaagcattcctcccctggttcaggctttcattcttatcaatatctcattggtttcttatttatattttcattgcagacttcccaaatcctttgtgtataaaggttggatttttttttttaaataaatgatccaatcccaatgggaggacacaagcactgtgtcacacacattcatcataaccctggcctcgaacatgataactttgcaattccttggccagtatttcttctgtttattacagaagcaccagcgacctgcctcaaaatgtggatattctcatcttgagatttaacagatattttctgttatgataatcattttactgaccacgttggcagaatgttagagatgggtgaagaaagcatagttaaatactaatactaaatgatgatcctctagggaaaagactttaggatataatcttctctgaaggacctgtagaggattgccctctatgtctcctacccagctgtgggaaaccaatccggaacagcaactggggtgttaacccaggaaatgtctccttaaaagctgactcatcttaggaatgagattctttttaagaaatgcaattaattattaatttcgctccactattagattaattcacttctttctcagatatgccattttctgaaaatatcttttaaaatgcattttggctttaaaaaatatgttcgtttacagaatctgcctttcctccagatctgcctaaattgcacttttaaaaaattaaaaatcaaagtgttttgcttccaactggtgatttggagattcaaagaatatctttcagtagacctactcttattcgattattcaagatttagttctccagatagcaatttgtaagtaagaaataaatcagtgagtgaatgtatagttgtacaaacttaaagttatggatgctcagctccaaatgtgtacattgtttgtatggttagcttgcaaaatataccataaccagtagctgaatcaactttcaaatatcattgggataataaattaacaatttcaaatgtaaaattatttaaacacataaataaatgccagtgtgttcaaccaagggagaaatggacacaagtgtattttttgttgcttccttaagtatttgcataatatctttacttaacacatgcccgctggttagcactttgaaattattttgaaaagcgtttgtcaactatctttcacttccctagccaagttttcattggcttctgttatttttctttgtctttctctagtcaattggttttcaaacctggctacacatttgaactacaattgcagagcttttaagcaaatattgatacccagattccgcctcagagaatctgattgaattggttgaaggtggagccaagcattgctcttttttaagttttccaaatgattctaatgtgcatccacagctgtgggccactctgtgaataagctgttaatgttctacccctttttgttttctttcagtatgtttgcatatctctttctctttagctgtgttttttttttttctcctgacatttttattggtgaggtcctataaatctatttttttcttttctcattttgcttttttcttttttacctcctatttactggccaagaagttctcattccaggtatatatatttgatttatattcttatcccatactattcatgctttatgtcagtgtaagagaacacaatatgatggtgaattatatttttgcctgttcttccaaagctaatttaatagtttacattaatttttggtataaatataaaaagatcaatagtagaaactaaggccattgtcaaaaacggatattaaggaaggatttattttaaatgtagttattattggctatgacaaaagacaataaaacagtttagaattttgagaccatacaggtctcaaggacatgtatatatcatatcaacagtatttttccctttcagaggtaaaggacggcaatgtgtttgccctaaattttaaactttaaaaacaaatttcaatagtatttaaagaacagagtggaagtgggaatattacatattgcaacaaataacatagcagaaacaagatatcactagcaacagaaaatagcaatagaaaaaaaagaaaaaaaaagaatcaatgctgctaagtattgtgatgatgttaatattgggaagaaaactagaaatcaagaaggtaatgcatagattcaaggatttgaaatgaaacagactgagcctagactaggagaaaaggaatctgagtgccaatgtagctgtgcttctaaatatggtcaagaggtttcctctccatgcggtttattttccccaactggcgaaaatactggttagattggcaaaaggagaaaaagaaaccttgcaattccttggccagatcctgcctacacatgtgttttattgaatctatctggtattataaataatttgaaatagatgattccatttaacaacagagggaaatatttactaacaatttggatttttcagcttcttcagggaagtcatttgatgtaacagtctcctagcagtgagaaggcgttttccattttaaaaagggcatgcattcactttctagttcctcaggcccaacatgaatggctttactgctttctcttacctactttgcccatgcaggaatttatgttcgtttcttctagaatttattatttaaggtcatgaccaaccattatataaattccatgaaaagaaaatgctcagagtacttgggaacatgtttagttaggcataataaaaacaacttatatggagaaaaataaatgtcacaagcagaaacaccaaggagacagagaaactaacaaacaggtgactagtcctcaaatagaggcttaagcccacaaaacgtgtcctattaaaccttatgcaagaatatgttggactctagaccagaagcgcaatgtcacttgttagaaatatgaattggaatttagtgaattattccagttcaagctctttcttgggaaaggaaaaggacaaaatgttctgtacaaccaaagtaagaataaagtatattctgaaaatcaggagattaaaattcccaaaagggagcttcttggcagaaaatggtcaaagttatttaaagagtgactttgaattcacccattgaataaaacaatattaaaccactatttaataattaagggaccatcatttctctaactttgctccagcacagagtttaatcacatgaagggctccctatatgcagtctccaaaaaaatgaaaacctaattcaattcttacagaaataactccagatttcataaggtttctctgaactaaaacccctgaaaattcatttatacaaccacacccagcatatgtttacatgtgctgtattttaatattgtaaacttgcttgcaagttacttttcagttgttctttattcatagatcttgggtaaaaccttctttaaagttctttccagaatgtcctttatcatttcaaatccttacaggaaagaagtgggatattaaaaaaagtaataaaaaaaaaaaatacttggcacattgaaacttgtggtatccagttaagtaggtattcatataaattttaaagaattattctactttaacaaattatatttctgatgtagattcagattttaggtatccaaagagctggtgcctatcaggaagttaataaaacaaagtatgtctgtgcttagtaaaagagcaagattttatttattgctgtattattaagaggaaacactattctgctccgaaataggtgtctgcacttgttacatcccattaaaatataaacaaagaatgtgttaatttcatcccagagggaaaaatattttcaggtaaagctgaactaaaacagtagcttctcaatcaaagataaatgtgtgaaccgacaatataaagcaagaatatgattttctttcttccaaattttctaactacctcaagttacaattgttcagtctacctcaagaagtaattcagatgtcaggttctatatggatttgccatgaaagttgtttataaggtaaaacgtaagcatgacattttgaaaatgaaagcagttagaattaaaattaatcgaaaatttaaaacgaacctaaaagtacagaaatagagttaagtaattatatttcactggtaggtgggtaattaatcctcacagttttggaaaactggtaaaacaaccattaatattaaggtgcgaatgaataatatatttttaggtgacaaatgaaacatgaattcccaaccttcagtgagttcatgtttctatacataaatgaaaatcagaaaaaagtaatcttcacagctacctatgtaaagaaatatcactatataatcaagtgttaatttcttggtgaaaaaaaatctttaaatgcttattcttatggatgcttttagttatcatcaaccctaaagataagaactcgtaagagctgggagtgacctagaactgagagacagatgagcaacaaattccaagcaccgcatttgtctagttgagaaacactaccctcatatttttaagcctcccaagctcttagccctctcagatctgcctaatcaagagtccattaagtcatcttggctgccatgaagatgaagctgacagcgcagttacttgagtcagtttaaagaggcctagggtggttgaagggaaggattaggaggcctggggtgctgaaaggtcatccaagttctagctcccaaagaccccagtagcacacagctgtcaggagcacgaagctacacttagaaacaacctttggaggaaagcagggattttgcagtccatcaaccattcatcaagcacaatttgcctttccacatcttattgtaccgttaatagaattgaagcattagagagtttgtgagttgatcacatagcaaagactttcctgagatttaggttcagttatctggtggtcttagtagaaattacttggcgtttaaatgtggttttggtgaaacctagattccctttgtgaatctttacagaaacttcgtctaacaggtatatcctcttaaggcaacgtgaaataaggccctttgcctctattttcataagaagaagaaagttttgaagtccgtgataacatattgggcataaataactgtcttctggaaggcattatgagttctataaactctccaggaattgcctggaatgttaacactaagtgatactattataggtacacaattgttgttgtttcagcaagggcatccttccaggatgagaattattcacttttcaggtacataattatttggcagttttattctatccttcctgttgtggtggaagatattatatcaccagcactaacgataacaataataacaatgatgaaaatttatgcctttatgtttgtcctgttccttttgatgtgagttaggatggcagggagagagaggaaggaggttcgtaatcatgttccaggatctataccaagcactgaacagacattattttagttacacaatcctgtaacacaggcattattattcctattttaaagatgatgtaataaaggctcagagagtttaaataacttgtcaggtaatagtggccataaaatgtaacctgccaagctcttgctcttaaccacttctccatgttgtttcctgcttgtttccactacagaaggaactggccaagaaacgcccctatttctctattttaccactttcatgtttagcacatcaatcataatttacaactcagtgagagtcaaagttgtatcttaattaagctgagaaaccaactgaagaaaaatccaaataaatgaggatcagaaaattttaaaaacaaagtattcttatacagctttgattctaatttccttcctttgtaggcaaggaaaatgctcttcagtgatacttggggtcttttctgagacaacaaaactcactagtagcagaacatgaaccagatcccaagactttcagctcagggttcaacctttttatcttcagtactcaaataaatcacagcatttttctcaactttacaaatgaaatcaccactacattcttttaaagagtaagttattcaaatgtgtttgatatatcatttaatcaaagcaggtttaatttccgaaatttttgaaagagcgcattttgtgaagtgaagaactctgagtgtatttgctttttcacatggcgaccacatgtatagatgaataactaagagactgttgcaactataccaagaaaaataaaagctaacatttggggccaaaattaagcattcattcataaatgtaaaccagttcaatcaagaccagctctgatgcttactcagaacaaagttactcacatttagtcacctgtagagaagcatggtgtgtacaatacactcaagttaattaacagccatttctgggaaccctgtccaaagaaatagttttctttatctcctatggtaggaattcttctgaaatagacaagacccagggctctcctctcaggcaaccactattttgaaatgtttttggggggactattattgctactcaatgtaaaatattaagtgagatgtcaatatttttcaacatatcattaggaattacagtttggaggccttaagttctatttttgaagcccttttagccagtactgactggaagccctgttgaaatcagaagtcttcatttcatatagggcacactctatttggagtgaatgtgatgaaatgtttccatgcaaattcctacaagcacttatgcctttatctttgtcctcataagccacattatactacctgttgtgtattttaaaaccctgtatgatttttaaaacttatctttcaattaatatgtatagattttctgtcaataatttcttattctaattatgtggtggctaactgaatgaaacatttatggttatgatatagaatattctaaatacaactacagacaatatggatcatagataaagtaaattattgttttatggctccagtggttcttcctggtaattaataaaaataaacagttattaaatatatacagaaaaacagcaatctatcaagcttatagaacaattaagaatatataataatctttaaatcaataaattaaaaggtaaacatttaatataaaatgaatatattaaaggataaagaagtagcatattatggaacatatagagattattttattttttgaaggttcaacctcttttaaatggttagtattggtgttcttttctctatgaaaacagattttagagaaaaatgatagtgtatttcacaaagccaaacacctctatattgttatcactccctatatgcatggcctctctaaagctgttaaataaaaaactaaagcacaagaatgatagttccaatttcactatacatttatgtttaaaaaatactggacacactgggcatttaaatagatgacatacagccaggaaactcattagactagctttaagtataataaaaaatattttttctgaatacaattaatcataagcatctacaaaaacacaagaccattgatgcctagtatgtaccataaatcaccatttccagacaggctctattttctttgaaagataaagaaatagtaagcagtttacacatcaaacgatgcctttggttcctgtaatttacatttaaacaacactgggttaaaaatagcagcatgaagatgattttaaagtaaggaaaatgacctggtagctaggttctatggtgcagataatgaaatgttttgtcagcttacctgataaaacagagccttatgaattacagcataacaaagcccagcatccaagatggttagggtataacgtgtcttcctctgcagctgttcagcttttttttttttttttttttttgaccacagaggtttacaaattagttacaattttttttctttctttctctgtggataagaaaacaaagagacctttccagaatcctctctgcttatgcctccgcttcctgttctgagattcactctatggtacccaacatatatcagaaaacagctttgaggaaaaaaaaaaagaaagaaaaaaaggccgatcgcactcaaagtggtaccgccatctactggcggacacacacaaaattgagccaaagaaaaaacattcccattatcctctgtcacagggaggaaagtaaacctgcatgaagcatgggtagtcatgaaagtgccccaagatgacagtagagaggtgatgtgagctaaaatttcccaacacactaaaaaaatgtaacttatctactacatataaatatgtatgagaccttttacatattcagttatttgcatctcactaatttttttaaaaaattttatcactttgttgttttgcatgattgtttcacacataaactactaaaattaaaagatatataaattactgtttgaaaaataggttttaagtttacattaccctttacgtgtagagttttgcgaaagctcccttgtggcctgctctagtcttttgaaaaccttttctcttcctgggatgaattattttcaaggtgaggaatttgactccttagagaacagtgtaaacacatactcactgatagtatttttgtgttgctttctggtaaaacatttgcaagaaatatctaaatgtagaaaaagattctatacatcagtgaacctagctaatattatttattaggatattgaagcacacaatacataaagaaaataaaaataatccatcagttattaagatatttctcaatccagatgtatgttattgtttcatctgacctttcatatctactttagagcaaacaactatgattttattacagtttatcatcaattaaataaatacattcatattgacaaaccaactgtatggatggacaaaaatgatgtcaagtattatattagacttgaaaagacacagagagaaacacacagtgcctgccataaaggagctcatacaaagaagaaaaacaaatatagctgataccatatttcccagccatgtgttcaagaactgttaattacatacttcgttttcaattgtggcccccattttgtctaatggcagaaaaataaatctagtcagttccaggtaaactaaattacttgaggcttttcccaatgattttgggtttgcattcaaccaatacatgattttcctcttctatctctccttctcatggagactgatctaagttcaggattgtgtacatatatagagaaagcagagtatgatcccgttccccctttctccacatgggcatccactgaggccaggagtcctgcatgatccatgaccatcattatccctcatatctactaacgtacccacaggcccactgggccccgggaatagcatccctccagctttgcatggcagcatcccctctttgtcacttcttcctctaaggaaacttttgttcctgtcctttaggaggagagaagaaaaagcagcatgttcccagggtcactcttggctgtaattggctgacttaagccttcctccctgccccaggcgcctcacacagccatctctgttctgctgtttgtaaaccatgggatgtaatgcactctgcaggcttcaggcaagcgaggcacaatctctgccacactagaatagtgtaaatagatggaaacttctcatcttttcatctttttagctaatcctagattggcaaactatgtaaggagcccttatcagagactcctttccttcttcataacttccttcacagactcaaaagagtttttgcttgggtctcttctttctgtaccaaaggtaagctggagccacttgttttcccttgaaatctttttgtcttatgtctaatgtatcagtttactagggctgctgtaacaaactgccatcctgaggggcttagacacagaaatcatttttttcacaattctggctactcagaggccagaatcaagttgtcagcatgatcatgcttcctctgaaacctgcaggggaaggatactttcttgcttctcttagcttttagtagccccagatgttccttggtttgtggcagcataactccagtctctgtctctgtctttacatggtgcactccctgcatcactgtctttacgtactcctccctctgtgcatgcctctgtgtcaaattttctcctctttataaggacaccagtcactttggtttagggtccgccctcataacctaattttaacctgattatctctgtaaataccctatttcaaaataagggcatattctgaattactcagaattagaactttttgagaggaggcacaattcaacccctaacacaagaatttaaatataaagcacaagaatttgacaattcttctgtccatctccaacgacaattccacttaggcaataatagccttggctatctggccagaattggggagggtaggggaagagcctcaggtaatgatgaagacatttaataatattagtaacaataacaaaactaacatttattggtactatgtgccagacattgttctaagcactttacatatgttcatttaaacttcacccatatgaggtattattatacacactttacaggtgaagaagcaatgaaatgtgagggaagtaaaacgtagttagtacctgatatggtttggctgtgtccccacccagatatcatcttgaattgtcagatatcatcttgaattgtagctcccataatccctacatgtcatggggggcacctggtgggaggtaattgaataatgggggcgagttttgcccatgctgttctagtgataatgaataagtctcatgagagctgatggttttataaagaggaacgtgtcccctgcacacgttctcttgcctgccaccatgtaagatgtgcctttgctcttccttcacattccaccatgattgtgaggcctccccagccatgtggaacagtgagtccattaaacctctttttctttatacattacccagtctcaggtgtttctttatggcagtgtgaaaatggactaatacagcacctcacatctcatcccaacacaagcagttgtaatcgggtaagatcactcataatacaagcatttgtcagatgctgaaagaacacaaaggaaatcagcttccactaatttagatcattgatactcacacgtttagtgtaaatttataacatttcattgtttcattgtgtacactttctgtcatgaaagattcctattttctaggcacttttaactttttcttctctactcatgaacaaactagccctgctcactgtctctcaactaaatgttcattaagtgccagtccctactgctccacactcattttaccattactagtaatatttaatagaatattaattctatcactcagttttgggtatccagatgctccaaagagttttctgatgacgtcttctgaggaactgatttttcttaggttatactgggccacattttaatgagaactggtttgaacaaaataagaaaagtaaatgataattattgtggcgatattcctcatagaaaaaaagaaaaataaataaatgccagcaaagagagctttactctttgttgctgaagaaactaatttatcttgtcattaaaagtagaaaattatataaaggaagagtgaccagaggtgtggtatcatttgctatgattctaacttcattgtgactttcgtactttttttctgtagacagaacgacaggtagtttgcaaatcttcagtgagtggattctgagagggttaaggtgaaatagtcattgattaccaacataaggtctctggagccttagtggtgtctgaccatatgttgtaaacatatcatgcataaatcacagaaattcacactagaagagagctaatagcctccagctgggactcataggttgctctgtgcatgtctactgtttctgattactcaaggtcttcagagcctttgtgggtaggagctataatgctggtttctatttgattttataagcttcatagccaaagaatactttttgtaacatccatagatctaccaaaagattcccagactctggcccaattttcttgtttcctagaccattatttcccagacagtgattggaggaatactactgttctgctggactaatgaagtgccactccacatccaccagaatggctacaacttaaaaaggcttatcatactgtttgtgagaatctagagctacagaagctgtcagagacttcaggtaggaatgtaaactagtataaccacttagaaaaatggtttggcattaccaactgaacgtgagtctactctgtgagccagcaagtgccactcttaggcatatacctgacagaaatgtgtgtgtgtacaagaatgcctgtggaagcattattgaaaacaggtcaaacaagaaagaacagaaatatcttgaacaggagaatggatataagaattgtggtgtattctgaatctatagtatcatactaacatgaaaatgaaaaactgcagctacccacagaaatatgctggatttcacaaatctgaggctgaggacgaagaaggtatgtaagcaaaacattattaaatttaaaaacaggactgggcgtggtggctcaaacctataatctcaacatttttgaaggctgaagtgggaggatcacttgagcctccaggagttcaagaccagcctgggaaaaatggcaagaccctgtctctacaaaaaaaatgaaaaaaataaaaattagtttggtatggtggtgtgcacctgtccagctactcaggaggcagagatgggagaatcacttgagccagggagttccaggccacagtgagctatgatcataccagttcactgcagcctggacaacaaagccagattcttgaaagataaaaataaaaacaggttaaataaactctaatattggaagtaagagcattggtttctcttgagataagatagagcttttggcaagattggttgagataagggctattctgggtactagtaagatcctatttcttaatctgggtagtagttatataggaattcacttcctggtaattcattgagccaaacatttatgcacttttttgcatgtggattgtacttcaaatttcaaagtaacaggcgagttttttgacagttgtcacctctgaggaagaaaaaagtaatgaaaggtgaaataagtggaatttccaggatttgatctgtatatatctgttctgtttgaactttgtatgcttattagtgtaataagaagtgcattattagtgtaattttcaaaaaataaatttaaggcattaaaagtacagtaaagatgtaccttcatactatttgtacttatttacctctaagttattctctttttaagttgagtctaggatggcattcatcattattttaaattgagtctgtcctggaattcctcttatgccagaaggcctattcaagctgatactcagcttctatgcttctgtcttcagtcatcttagtaacaaagttaactaccactgtgtttgcatgtatgttaaataaacaaaatttacatgtcatctacaatttcacacctctatagtctagtttagatttgtatctcctgattgtaaatactgagactaactcacttttgcccactgcctaatatattatgccataaattacacaatgaaatacatgacctgacaaaagataataaaacacttttacctttgttacatcttcttcctttaaaacatctaaacaagttgagaagggtagataattttcagatttttcaggtgagaaaaattggtacagaaatgtgaaaattacatgatggttaaaaattggccaaataaaacaggataattgccagtttaaaatatatgcattagacaatatgattttatatcaagggctcatttcagatataataactgtcaaatattatttagaaggtgtgcttgattcagcaatattaaaaaattttaacctgtattataaaagaacaatagagtaaaacatactttccaagtggcttccagtatagattaccttctgtgctgtagttgcacagctatgtaatagcaatttttcaaaggtgttgggtcactatgcctttttagttgccattcctttggttagaaattactttcctttattgccattctcacccctatttccctccaacatctggaaaactactatttattcttgaaaatgcaattagggtaatatacttgatagcttgtcctgatctttccaagtgtaaggtatcaacttaactgtactccctgtcatactgctatacacatcattaatggaggaggtgaaaatgattcatccattaaaatgactgaatattcttaggtgcttgtaaacgcccattatttaccatggagtttcatcagaaaagacaggtgtgaagcagataagggcaggtactgggagatacacgtctctctgcttctctcaggaatgatggctggataatctgtttacccatatgcacacacactgtctactctagggctttgtgactgagcaacaggcttttttttccctatacattctttgttagtatgacactgtcagatcatctaagctaaagggaaaaatgtatttttttttcatgagttcctaacaccttttgctaattataagcaagcacgcaggcatttcccttatataatttctcattttatcttctaaaatttggtacatgtgagtagccaactatgtccaaatctttatatgattaggccaatatgaaaagaattaaaattttaatttaatatgctctcttttattttggaaaatatttacttgcatcatatttccagcttatattatatttttattggttgtttagcattctttaatactaaaacaataaaataggaaatcatgcttagaccacgtcttctaaatttcgaagacgtaatatgttgaaaagctttatttcatgtataatacattttcatttagtttatcaattttaaaagataatttcaactaaaaaaatccttcacagtttataagtgcactttattagtggagaaaatcaagggttttaaaacatcagagtaatcatgatggaaattattatacgttcatatttcagaaaataactactctttttttaattttacaaaggtaaattgacaaatgcaactttcccataagctctgaacaaaaagaggggctgttaagataagtatgaacatgggggaatcaggggaactgggaggtgctaatgaagaaaaagctagaaaagaatcaaagaactacattatttaaaaacttcatctattaggaagtggctaagaagaaaaatatggagagagatggaatgttactgtcataaacctgggagaagatgatcttatgcaaaagttaatgtaagcggaaatggacacaagtatatggatttagaagatattatggtttatgttgtagatatgaattttaatctatatctatgtgtgtgaaaaataatagatcaacagtaacttcaacttcagtaattactatagggcacctccactcaatgtatcaaagttccagagtcttgtgtaggacccaggtataaaggtagaggtgaggggctcaatcttttgtcatatatttgcataggttacaaggattcatttatttaacaaatattattgagcatctactctttgccagcaactcttcttggtgcttgtaatgtatcagtgaacaaaacaaagatccctgccttcatgaagcacatgctttgggagtggcacaaatgtggacaataaacaataatattaatgaattagtaagtgatattaaatgtcagaacgtgattagtgctaagtaaacaagtaaaaattaaaatctggttgaagagatcagaatgtttgatggagtggtggattgagatttaagttagttgatcatacggaaggccttattaatatgataatactttaagcctatgaccagtgtagtaagcctagttcagagtccacaacctaggcttataggagatgctacatttccttatattctacaaatatattttatttagattttggtgccccattcgaacgaagtggcaagaaatccaaattatttattttagaacttatgaccccctctcccatcaccagtgattaagtttcccaagtcttacctaatgacattagtcttctctccaaacaatttacttttcagtttttcattgatatgtttacctctctcatacatccgtgtaagatatgccgtgattccccatgaagttggaaactggtggctaaatcccttctacttacgcacatcaggaagcagtcctttggtgagatagtattatctctctagaggtcttccaggaaacaggctctctgctactcagattcctacaggcctatttcttttttcattatttggaagatttttctgaactggagcatcccctcctgcctccaaccacttcttcaagacacacagcttctacccccaaaatccattttttaaaatagactttgagagttcattaaatccttaatttaaatctatggcaactaaaaaactatatccctttcatcattgtcatgggtgtctgtatcttcaaacccttacaagagcttggggaaattatttatcttctattctgcaagtataccaaagaatagaacataatagttgttttcatactaagtatattttcatagtaaaagagtgaaaattcaaattccatcacaatattgaggaggtatcattaaacctgattttgaaactggatagaacagtgagagagaaggaggaataatggtgaccctcaggcttttgacttgaagaaaatagtatctctgtatgctactcatgaagataagtaaacattagctagaccaggtttgtgtctttgaagatgagtcatttagttcagggatttctgtgtttaaactacttgtgggacatccaaatagaaatgatcagtgacatttagaccaatttgtagtttataaaagagatcccaggtgaagagcttgcatcagagaagaaatcatttttccgtttctgttctccctaccattgctccagattctgtttccttcaatttctgctcaaaacttatcctttctattattttatattattgtatctccttccaaccttcaatcattatttcaatcttcaattgtggcataatgcctctgactatgagccgttattaaaaagaaaacaaaataagggaaggaaggagagtaggaagaaaggaaggaggcaggaagagaggaacggcaggagagaggaaaggaagctcttcactaacgtttgacaatttgcgccagcagcactctgtttagtcttgtgccttcagggatgacttttaatatatgattcctcaatatttttccagccttaattttaatcttctgattgtcagtagtgggtcttcaaataataagcatctgtctggctgccatgccaccaccaccaactcaacataatcttaagctgaactggtcatcatgcttgacaaataataaaaacacaaccttgtcttattcttaataataagtattaaatacattccattgctcaggcatggttttattcatgactcccaccagccactttggatcatccatggtccattgctcacttctgcctctgtgcctttacaccattgactttgcccagcctgaaatctatctttttgcaaggtgcagatcaagtttgacatcctctcttacctccattacctagaactaagcacttctgatcaataacatgtctgagagccaatggatttttttcaccatgaacttaacataaactacttttattgatttatctacccttttatactttgggtgttaccttaagaaggacattggaagtttttctatctagtgtgatcttgttgtatgtcttttttacgttcacagtgcctgaaagaaatttttcttccactgaaggcttgatgctatgaaatggagtagctcactgttttttctccaatccatcaaattcctttctctaagtatgaaactcggtaaccactgacattcctattccaaattcaccagctatgtgattttggtcaagttacttgaccacttgaaaccttaatttctgcatctttaaaataaagacaacaccaattcttaccttgtagacttctgagcattaaatgaaaaaaaaatccatgtgaagcatttagcagtgccagtcacagtgtccaacaaatatttagtcataatattcatatggtcatatgtttctaatttaactacagcactctaattatacaacaatggaaaacctagagatgtcttcatttcctcctgctttctcatgtttcttatctgatcaactggtgatcatacaaagtctctaatcagcaccatagcactgctaccaccggaatgaaatctttatgacctctcactagagatactgcaatcattttctgacctaagtgattccccactgatgtcaagcctgcttcctagagcatcattttcaatatcccattctcctaaacaaaatctttaagaagccccagtctcctgctgtagtcaataaaatcaatattgaactcctgaacctaatattcatgactttccacaaaatatccactatccaattctaacaaaccaactagaaaaaggcattttttaggtaagagaggaattttgaatatggactagttattaaataaaaacaaggaattatatttattttgctatgagtaataatggtattgtgttatgttaaaaatgagggtatattttggaaatgtatcctgtataacataaggatgcaatgttataaaaatctgggttttgttttaaaataattcagaaagagaaaaacaaatagatgaatcaagtttggtaaaattttggtaatgagtgcatatgggataagtccattatactgttctttctgcttttgaatatgcttgtttttcacaatacaataagtaataaaatattataaattatataatccattgcatatgctacctgtttcccgtacttctaagagctgtttttccctactctaaatccaaccacattcttttattgctcttttgtcatttattatctgtagatgtgtattataattgttaaatattttagaccatctgttagattataaactttatgaaagctttaatatattacttgtccttgtatcccaaaattttctaatgtattttctggtacacaatagcttacatagtaaataattgtgtaaacaaatgggcaagaccataaaataaattacaaacatctctgaaagaaagggttatttctttgataacaaaactaatgcattttctaatgttgtagcatttctagcctgagacctaattaagcaactgaaaaagaagtggtaaaattaagagccactgtcagcaggagtactcataccataaatttttaattgctgaattttgagacaaataatgacttttaaaaagagtagacagagtttatgaataatgattctcaaaatctacccaaataaaagggtagcaataacacaattgttaaggggacagaaatcccgtagggaaatgttaattgtgttatcatgttttaagcctggagaacataaagacttagaagtaactttaaacatacaaagtttgtttctattggagaaaaaccataacctattatagacatgctcaactgtatggacagattcaaacaattcttttctctccccttataaataacactaagtatttgtaacatcttttggagggcaactgtatatttgtttttcttgcaatagattagcaatacaagttttgttttttttttttaatctctctctggacaaaaaaaaaaaaaaaatagtgcctttactttccttataaaatgtttctctagctggagatataatttgccccaaattggcaacgtgtagtcttacagaaatttctttccctctatcagccagcaagacaggtggccctagctttggtccccattgctctgtgtcactgcacacctggacctaattgttcagtctcaagtggagcaggtgagatgagggtgggctgttgtgcaggaaatgaatggacttaacacagtggtttgcttcggcaccaggcagtcttatttgagtgggtgggcgggcttaggctatgggaggctcgggagggagccacatagaaggacagataatgcaaacacagactttagattccaaaataattcctggcattaaggagggcctggcagcctgcttacatagtagttaaatgctggttaacaccaaggcaggtgctctgcatgggctggacaattgcaagcacttggataaatattagttgttgatttattatcactgttttaagagtgtcggtttcccagccttcaggtagattctactaatttattctatctatccccctgtttaataatttattgagttttaagaacaccgcagaggaagcagccattgttaaaggaaggtttcaggtcacttgacctgggtagatttgtaaacataaataaatgtgtattgcctgtttagctctatttcttaggggcggaagcgtccagataagaatttgtcattcgcgtatgctatttaattattatgacagatcaaagagacatgctggatgtgttttttgtgaaaaaaaatcacataaactcaatgtaagcaggggaattgagacagggaacctcatctttaaacttcaaggaaaaatttgaggctgtaactgtgatgtataaaaaatattaaagctcaggttattcacttagttaacaagtatttactgaaagcttagggtgttccctgcattctttaggatgatgggacataagtgagaataaaatacagtgcctgatcgcaacaagctcacagtctatagaaggggactgacaacacaaacaacatggcagttttaacatggctgcttatctgaagcctgaggtatgcacaggtgctttaggatacctgactgcaaccgctcttcaaagaaaaattatttcttctcttgatgtgaaatagataaagcttcaaagacgggatagaaggctttaagacatgtagatgttctgaagtaaatgactttacacagaatgatttatgcgaagtgcattaattggtactgctagaaagctaatttaaagaaaatcatatggctatattgacacgatgtgaattttagagctctttagattgtaagtgacagaacttcagttcaaaaggattcaaaacaaaggggaaataaaagtctcatggagctaaaaattgtaggagctagaggtactttgggcacgtctgggcccaagtcttcaaatgatggcatctggaatctgttcctctcatcattggcccagttttcttctatgcttccttccttgttagagaggttaccggcacatgacatactcctgcaagtcctggctgacattcagcaagattcaagaacagtgagaatgaatatattttattaccaaatgcttcatcagaaatcccagaaaaacctctaatagcttctgattgggtctggtgtccaaccttggctaatcccaggagccaggacaatgtgagtctctaaataaccaaacctgggtcacattaccatcttttgagaagggaatcaagtcagcccacccaaatcatgttgactgagagcagaagagaggtagttacctgtaggaaattggagagctcttacaaaaagtgagcatggttgctggactttttaattacattttttttaattttaagataattgtagactcatgggtttttactgttaaacatttttcttagatacttaaaaattaaaatctattcactcaaaattactaagctattctctcaaagcctgttttatttttttacatgggatacatatgctgaatgtgcaggtttgttacataggtatacatgtgcattggtggtttgttgcacccatcaactcatcatctaggttttaagccctgcatgcatttgtcctaatgctctccctccactttccccacactccctgacaggccccggtgtgtgatgttcccctccctgtgtccatgtgttctcattgttcaacttcaacttatgagtgaggacatgtggtgtttggttttctgtttctgtgttagtttgctgaggatgatggcttccagcttcatccatgtcctagcaaaggacacaactcattctttttttgtgactgtgtagtattccatggtgtatatgtgtcacattttctttatccagtctatcattgatgggcatttgggttggtcccaagtctttactattgtaaaaagttctgcaataaacacatgtgtgcatgtgtctttagagtagaatgatgtataatcctttgggtatatactcagtaatgggattgctgggtcaaatggtatttctggttctagatccttgaggaatcaccacactgtcttccacaatggttgaactgatttacactcctaccaacagtgtaaaagcattcctatttctccatatcctctccagcatctgttgtttccagactttttaatgatcaccattctaactggcatgagatggtatctcattgtggttttaatttgaatttctctaatgaccagtgatgatgagctttttttcatatgtttgttggccacataaatgacttcttttgagaagtgcctgttcatatccttcacccactttttgatggggttgtgtttttttttgtaaatttgtttaagttccttgtagattccagatattagacctttgtcatatggatagattgcaaaaattttctcccattctgtaggttgcctgtacaatctgatgatcgtttcttttgctgaacagaagttctttagtttaattaaatcccatttgtcaattttggcttttgttgcaattgattttggcattttagtcacgaagtctttgcccatgcctatgtcctgaatggtattgcctaggttttcttctaggtttttatggttttaggttttacatttaagtctttaatccatcttgaggttatttttgtataaggtgtaagaaaggggtccagtttctgttttctgatactaaaaagctatgtgatattaggcaaatcacttgtgttctcatcttcaaatgtaatttttctggttctattttatagggttgttcacaaggttaatacaatgacaatatctttttaaaatggaaattacgactaaaatattgtattgtagcatttctttacaagcatatatttttaaacgtgtttttactcacatttgtataaagttttatttcttttatattatctctacctcttatgtacacagagaaacacttgggtttaacttctaatatgataatttcgcctcttacactttcaagaaaattaagatttggattttccatactccttcattggttcttcattgcttatttgtagattaattagcaagcattatttatattgtcactgacagacagcatgatataagtgatgataactgtcaatcatgcagcttactgggtttttttttttttttgagtgagtggcatgaacatttctcttcactaattagaaatttattctatacaactcttccttagggttgaccagtcctgcctttcactaagagacttctcacaatgaaagggctgcctggggcgcactggaaagcttagtcagcagcggaattaccttcttcctgaaggctgactgaagaagggaatgtggcaatgagcaagaggcttcacaaatgacagctagtcatttgtgctgggcgtagagtcttcttgcctgcattctaagatggtggggatgacaggaagcaggtctgcatcatcagctcagcacactggcatggaaccaggaatggactgggaggcaagacttttgcttaatgtctgagtttccttaaatctttttagaacaaagcaggacaaaaattttaaaataaactagtatatgaccttgaatacattaaacaaaactattctacaatttttctagcttagaacactcttttagcagtcattttaaaaaacaaattaagattaaggaagcagtttatatttcttaaattagtttattaattgttttttcctgagtagtaaagtcttaagcaatgcgtagacaatttggtgagcaggtaacagctataatcataaaccagaattctcacctcctaaggaccactgccagccctccagagtctgacataagtaaaccacacaattaagcaaattcttgatcaccccagtgatatagatagaaaagctccgatagaaaggaaagtctattctgattatgatgggttggtgacatggagaaggattaatgattcagactgtagacaattttggctatatagttaatacatatatacacaaaaatatgtatatttatatattgaaagtgaataatagcttatatatatataaatatagagagtaatatttaaatgacatgtagaaacttaagtcctacaattctatgtgtcactgcaaaatagcaagctaactgttgaagaagaaagtattgacagactccattccatagattataaacctgaaggaaataaatgaggtgccaaggcaagcttctctcccacgtctcttgcataagttgtgggcattgcattttcataacacatctttacaccattttaaatatgaatgtcaattgcaggaaagattaaaggcattgtcctaagagcttaattcacagggcgtgtcctaagtattagcaaaagcgaagtccagtatgggtaagagcaaataaaatgagattgctgtttaataagccatatttgtaattgaacacaagactttcaagtgctagaactaaaactgctttctgagagctatcatatatcagatggtttccctgagcacttgcaaattaaaagatttttaaagatatagtgctattccatttatgtgttttacacagagttagattgatcacattaataatcaataacatttggaaagaaatgatgtttgttaagccagcctcaagttatgatttatttatttttatgtagggactttagttggctgggaaaatgactgctcagttctcgtttgcctgccaaaaagcagacattttagaaacagtgatgtaaaagtcagtaagaattatgtggcttcaagtggcagaatacctacctacaaccggcttgagcatagagagagattattggctcatgatacttgaaagtccagaggctggtatggcttcagacaggtccgcacccagggaatcaaatgaaatcatttggatccatcctctcttccagcttcacattgtacccagatgtgaagaatttagaggcttttctttcctcactcctttcctttcctcactaatggctttagtcatagatacactctcctgtcttgtgccacagtggcctccaggagctccatgtttacatccttacagttctagttcaattgaaaacagagtctgcctttctttaaacagtttccaagctctgatattccaatccactggctctgattgggattcatgtccggtcttgaaccatgtttggtgaccaaaggactacagagtcttaaccaagtctaactacattacgcatttgtgccagaagctaaaggaagtgtcagcatcacctgggcagtagatattggatgcttgagcaagaacattctctagagaaaaattgtggtgcaggcataaggagatgaggggtgtgtgtacagggtttcaagtatagcaagtgtccagtatagatttttgttaccactggtcaatcacagaagaggatagtaaagtgaagggaggttgtcttatggtgacatctaaaagccactaaaatgacattccctggaaatagtttcttgaagaattatgtcttgtagggaatatgtttgtggaagctgaacacacaaataagtggacggcccctctccatgacccaaattcagatacgtctctagcaaaagttctatcacagatactcttactattagtcaatgtcttcctatatcttgctacacctctgattaaaaacaaataaacaaaaaaacttgtctgtatgtagaactatcaatttttagggtgatttcccatttattttttcatctgaaatgttctctaagtgctttctattttattagctaaactaattttactttgtttaaatttcaaaatgatatatagagagtcaaacagaatggcttctaaaatattttagtttgagacttactctgtctgagcagccctaactacatttttctctttaagatacagttttattaaaccctattcacttcatactaaatttaatactagattattatatccaaggaaagaaaaatacttaactctactaaccattctgttttattttctttttgtgagatttgactcttttttccagcatattgaggtattttgaggtcaagtttatcatgaaataaacttccctattcctcaacccatcacattattatgtagattgggttaaagtgaggctgcaatgatttcctcatcctatgcagtagtttcctctacctgaaggtttcttaagcaaaatatctactcattcctagagccagacttgagaggcatgtaccttagagttcttgaagccaggatttatgattcagttctaagctgaagatggcgaatattaattgcgaaaggatacaggaagaaaaccctccagattcttcacatctgggtacaatgtaacataaaaggaggagcaaaggtattaaatttgggtaagaaggaaagaatgttaaggacagtctaaagattgtgttttacctgtgtatatacacttttagccaaattgccagaaataacaaaaggagtgataaatttcctgtttaatcctgactactgcaaattgactgcacccctactattcctcagaaaccaatttctctgggttcactaatgacctaaaactgccaaatacaagaacatattcctgtccttatgttagttgttatttctgttttattttgtaatcttgactcctaattctatgtaattccactccctgatggctttgatgacaacattcatcttaatgacttttctcctatttctgtggtcctgtttctagtctctcatcatccaagtcagaaactgagagtcagactaaagtcatccttcatacatgttccttctccaacacattcactttgatttttaacagcttacgttaagagaacttgcatactgtaaagctcactcatctaaagtgtatgatgcagtaatttttagtgtagtcacagattcatgtaactatcaccacaattaattttaatacactttatcacccccaacaggaagctccatattcattagcagtcactttccatttccccccaactttccatccctgcatccccagccctaggaaaccactaatccactttctgtctttatcaatttgcctattctaaatgttccatatgaatggaattatatatgatgtggtcttttgtgactggcttttttcccttagcataataaactttgaggttcaaccataatataggacgtatcagtatttcattcattttatcaaatagtatttcattatatagctatatcaaattttatctatccattcatcagttgatggttacttaggttgttttcacttttgggggattatcaataatcctactagtagcattcatgtataagtttttgtatgaatgtatgtttttatttctcttgggtatatacctaggagtagaattgctggatatcttttataagggtgctaatcccatttgtgagggcttcgcccttatgacctaaccatctaccaaaggccctgcctcctaataccatcacctttgagattaagatttcaaaatgtgaattttgaggagacacaaatattcagtctatggcacatagtcatatgtattagttcattttcacgttgccaaaaagaaatatctaagactaggtaatctatttttctttaaagaaaaaagaggtttaattggctcacagttctataggctgtacaggaagcatggcagcaactgcttctggggaggccatggggaacttacaatcacggcagaaggcaaagccagagctagcatcttcacaacatggccagggtatgaggaagagagatgggggaggtgccacatacttttaaacaaccagaccttgtgataactctgtcacgaggacagcaccaaagggatagtgataaaccagtagaaactgaccccctaatccaatcacctcccaccaggacccacctccaacattggggattacaactggacaccagatttgggcaggaacacagatccaaactgtatcagcatacctactcttctttccagtttgtgacctctgtcatagtttaggacctcattagttttctttttctttttctttttttttttttgagacagagtctcactatgtcgcctagtctggagtgcaatggtgtgatctcagctcactgcaacctccgcctcccaagttcaagctattctcctgcctcagcctgctgagtagctggtattataggcatgcaccaccatgcctggctaatttttgtatttttagtacagacgggttttaccatgtttgccaggctggtcttggactcctgacctcagatgatccacccgcctcagcctcccaaagtgctgggattacaggtgtgagccactgtgcctagcctaggacctcattagttttcactgggattggggaataaatatttatagacatagtgtgtgtgtgtgttttagtatatatgtatgtaagtgtatgtgggtgtttgtgtgtagtctcttctgtatatacccatatatatattgctgtttgtgtggtggtaaacttcccttttcaaggaagggattactttataaagagtcaaaagtttaaaatgaaaataatctgaaaagcaattcctcactttctcacaaactctgagactgagtccttagaaatcagttttttgctttgttctttaagaagtaaatgataggaagagggctgagtaattgaaatgagggaagtgatcttattaaatagattttgaatcccaattatacttaaattgtgtttctgtagccaaaaatgtaataaacacgaataaatcttctttatcatcatttataataccatctgtacagataatctaataacctctatggaatgtctgctctgttctaggcactctacatttctttaacttaatttcacaaccttacaaggtagttaaagatgagtatcacagaggcattaactgatactagaaaggttaagtgaagtgcccaaggtcacagagctagtttggatctgtgttcccacccaaatcttgtgccatattttaacgaggatttcacccaaggattctcttgctctaaacccacattctttcttaggccaagtacacatcaaagcattattctattatttaagtgtcagaataatgaaaaaaaaacaaaccagcatttcttagagaagaaaggtaatgtgggctgaggctgtcaaggacaggatcagaaagaggtgacttttaagccagcccttaggaggagatggagagagggtagagatgttttgccataaagaatagcatggctatcattgataggagctgaattatgagaacacatggacacagtgtggggaacaacacacactggagcctgctggaagtgggtaggatgaggggaaggagagcatcagggaaaatagctaatggatggtgaacttaatacctaggttatgggatgatctgtgcagcaaagcatcatgacacacatttacctatgcaacaaacctgtacatcttgcacatgtaccctgagattaaaattaaagttgaagaaaaaaaaacgaatagtatggcataaggaaataaatagtctcatagagcattcagtctgggcctcataagagattgctttttttttgcttcatctctttgggacaaatgttcctgcctgatttaatagaaatggtatattctctgcagatacctttgagccatactctgagatgcagagatattttatgttggaaccagctctgtcagcatgcttgaataggcagaatttttcctctaagctatctgaaatggagctgagttaccaataagcaaatcataacacacaagaatggaaaagacgaacatttattccatccaactagtgcttacattaatctgattaattaaagcatgaatgaaaactatttacttgtgagtgttgtgaaagagcagcattaaattagcccttcaccctagcagacacactgtgattgttggctctcattctgtttttagcctcattgctttcttgtatttcctactagtggaagctgggccagtgcatagccagtgaaggctttctcttatttcactggtgaccagactcaaaaaaagcaaggtttttatattgaaattcgtcaagaaacttgccatcagacgagtacatatgcatgaccacaaggtcactacccaaatggaggcaagaaaatgagagttatcttttgcctttttgaagatttttccagaggggtttagttgccagttgggttttatctaatttagtttcctctaaatatttttataaacagcaagtttatttccagttttctattgtttgcattaactagggggtttaataatttctcacatttatcagtggaaataaactatttttattgaatatattctagcaaaagatgctttgaagttttttttggaaatatttaagaacctaaagaatgtgaccaaaaattcctcataaaatagccttttgctcagggtcttatgttggcttggattctggctttgaccttgcaatctctgtctatagtgaccacattaaatgttacttggacttaataagatcttctgccttcaaagatgaagcaaaaagtgttgatagtttttaaaataaagaaatgaaagcaatagggtgcgagaagtgtcttaaaattgaaataaactcaaaataaaattgaatttgtaagtaactggttatgacatggagtgccataaaactgaaaatatttgactgtagagatttcttggtaaagaagagaaatatttggagtcataattttaaatataatgtcaagttctgtttaaataaacaaagtttatttaaaatttagacaagatagaaggccagagaaagaaagggtagctttatttagtaagtcaaaatatatgttatagcatttatcaaattcataagatatttgaccaagtgataaatatgaagcttatgttctgaaagggtagacaaaaaatgcaaccagctttgtggtagacagttgtttaagtatattgataatatcctttttaaaatttgtccacctgaagcctctcttgatcacctccttgcctccaaccttggaaattttgttagctctgcccctaatacttggctctctctattacatctttaatacttggctgtattaggaagtatattccactcagtggtaatcttggttttgtctccttcttatctattagaaggtgagcaacttgaagcagaggcttcgctttgtctttgtgtctctagcaccttgccaaaggcctgctaataaataattatcatattgaatgggtctacacaatgttctcagtatgctcagacatctgtgatcacctttacttacagagacagggcagatttgaaatatttgcccctatctttgaagctaatacctggaggtgcaaactaggtggagcagagcccaggagctatttctaggaagaaagcatttctctgatcctttgcttctgcccacagtgttaataacattttgttctgcacccacactctcaatttcattccagctgggactcttctgattagcatcctgctctttgccttcccagagacagaataaaaggagaaggagccacaataacagaattagacaaattgtaacggtgtcttatgtcaatgtcaaagggagaaaatataaacaagttcaaaacttgtcttgggataggttttttttttttttttttttttttgaggtggagtttcgctcttgttgcccaggctggagtgcagtggcatgacctcggctcactgcaacctccgcctcccatgttcaagcgattcttctacttcagcctcccgagtagctgggattacaggcacccgccaccatgcccggctaatttttgcattttcagtggaggctgggtttcaccatgttggttaggctgggtttcaccaggttgggtttcaccaagttggtttcaccatgttggttgagataagtctcgaactccttacctcaggtgatcctcctgcctcggcctccaaagtgctgggattataggcatgagccaccgtgcctggcctcaggagagttattaagcatagcctgccaataacttcaaaataactttgtattagtttgtgatttcagaaacaccttcacaaaccttttttttttaaatttgattgatccttatagcaacattgtcagtttgggtgggcgagggagttataatgctgtatccacacgaaggaatctgctttagttggttggtaaagtcttcacaggacctggaatttacaagattggtagcttgatatacagaagatattggaaagggaaaaatgttaccaatagagataacaatgtgagaatgaaacagaggcataaaaatgtatgttataattcagaatactcagtagtacagaaactaagggtacatggtggagaggggatggaacctacaaaggtaaagcagccaggaatcacatcagaaaggatcttgcttgccatgctaaggggcttggacttcatccttggacagtagtgagtcactgaatgctgtttaacagaagacagctgtgactatttctgtgcttcataaaaattattcagaagcattgttgctcatgattagaacagaagcatgccctttttttctgcttcaaaatatattctattcacacttgaaattcaattgcatgatcctacccaaggtgaagggcaattaccaacctgttcattgtaaatctcactcttctccaaagaaagagtctccagatgaaagtgagggggacctttgctattacagggataatctcagatacatttaaattttattaaaaatcatttgcaactattagcccattatcattattagtaaattaaatatgatattctttatgtttaaaacactgtgtctgatcagaaagaaatgacagtggaagaaggaaggcagaagaacaatcagagcactaggtggagaaccaggagagagacctgacttattggggcatggcagagaacctgagctttgttcctgtaaccacaactgctactgaatttatcccaacagcaaaactcccactcttatattttaagccttctctgctggtaccctgttctaaacttacaaggctggatgactcctaacaagtgttaaaaatacttgactgtagcctagggacatattttttttaatgtgtgggtaaagagttttccttcttcaacaagttcaattgaagaaagcttcttatgcctatttcaaaacacacgcacaaatttaggagcagtgagatgaattctcttgcagctattttgatttgagttgtttcccccttggaatttgtggatagaaactgttatattaggctccacatcattagttatatttcaacttgaactttaaaagtagggctggagacctgaggtaatgattacccccaagaatccttttatccttttaagggcagatgaggtagatgagtccctacttttgtaactagaagaacttgataggctaatgtttctgatgatatcttctgttaaaaaaaaaaactaaccctgagatactctttagaaagagttctgttgtccaatacttattttaaattattcttataaaaagctctctattaaagaatcataatacacatcagtgatttaaatatcttaagaaatccttcagtaacaaaattaatctgtttaacattttattgcttgccctctacttcctatcttcctataatgggtcagaatgtggacatgaatgtcagccaacctcaaatatgaggccgaggaaaatgccctaagagcgaacacaatagcaaaatgggtccctgtccacctcgcaaagcatagcctgcctttcaccctagacttttatggggagatcattgtttgtcctgttttagtgagggtttttaagtttcatttgttgtaatatctcagcttatacactcttatactcaacatacttaaactattttgaccacagaaattgtcttaacggttttattggaaaatctgctatcaataacatcttgaagactacatttctaaaaaagatattttaggcaacactgggcataccaaaggattctttaattctgatttcttgattaacaatccttgctctgtgcatggcttgttccatgattttcctattctctatttcctggttggcacttctttaattgctgacacaggacccatatttcacctatctgatggctcctgagaaccctccactgggtcctctggacctggccaggatacaggggataaaagagtatgtcgaagattacttgagaagtctggggcaccattatgcagcaggtgaacatcactcttgcttaatactgtattggttgtaagtcagtcatatggtcctattaactgccagggaactgggagatgtagtttagttgcttgttagggaggaaggtgaaatcattcgatgaacacagagagttgtctctgctctccttgaaaaatatcagagattcccatctttaattcaactctttctagttgttttctcttttggaaatacattaatgcttcttcaaggagccaggcaaagcaatcagatcactcactgtaatccttatgaggaagtgtatatccttttcatggtcaaggttgttttgtttagtggaaagaaagttggttgaagaataatgtggtcagatttctagttctctctcttgaagttatagcttttttttttttttttttttggtgagacggagtctcgctctgtcaccaaggctggagtgcagtggtgcgatctcggctcactacaagctctgcctcccaagtagctgtgaccacaggcacccaccaccatgcccggctaatttgtttgtattttttttagtagagacggggtttcaccgtgttgccaggatggtctcgatctcctgacctcatgatcctcccgcctcggcctcccaaagtgctgggattataggtgtgagccaacgtgcccggcccctacattatagctttcttaagtctctattttagtcagggttctccagagaaacagaaccaataagatagatagatagatagatagatagatagatagatagatagatagatagatgatggatggatggatagatagatagatagatagatagatagatagatagacagacagactatatgggatttgttagagaaattggcttaaggagttatggaggttaagaagacccaggatggaccatctgcaagctggagaaccagggaagctggtagcgtggatcaacccaagtctgaaggtctcagaatctgggaaaccaatggtgtaattctcagcctgaagtcaaagtcctgagaactaagggggccactggtgcaagtctaggagtccgaaggccatagaacctggagttctgatacacaaggacaggagaagagggatgaccctcttctttttgttctctctgagtctcagccaattgaatggtgctcaccaacactaggtgagggtggatcttgcttccttattcaatccagcaagtccaatgctaatctcttccacaagtgacctcacagacacgcaaagaattaatactttgccggctatctgagtactccttaatccagtcaagtggacacctaaaatcaatcatcactgtcacctaccttttctgaggatcaatctcctgatatatagaataagagagaagtttacatattcactctgatcatagtatcttgttatttaagagccaaagtggatgtaagaaccagctgtccctacatcagactctgtatcagaagccatttgacaacacctctgacaggtgttcaaattctagtagaattcagagaaatatctgtctgccaaggcagctctatttattgccatcagttatcattaagtcctttctagtaatgagcaaaaatgtaatggtaaaatcagctagagcttagagatttgagtcctccttcttcacctggtcacatgtgagtcaactggcagtcctcattattcatctttccactaaattttaccatttatctttataatttttcagatattatcctgcattgttcagcaatctcatcttcaagtgtttgtttctctttccatccactcttccaaaaactctgtcccatcatcttggggaacattgaaagtcactgctggatatttgacatctggtgacagctttatcttctgtatgggtgaaatttggatttcaacattgatatcttttattcttgactcaccgttccatctactccacttgtacatgataatgtggcttcaatccctgctataaacatggcttaggatgctgcttctgcatattttgccccttcttgctccatagccacatatgaaaacttgtagcttggaccctagactccttttatccaaaaaaggagatgggttagatttccaaatatgcaggcatttccccacaggtcttctgcatacagaaaagataaagataaaaatggaaacttaaactaacctctggcaattcaatgggactctcttgtgtacatgatcacaagcatctgaaaaatgctagatgaggtattagatctgggagatactggttttatcaagcatatcttgtcatttccaaggttttctagttactgacaatgagtcactgctaatttttccatcctttttgtcacaattactgacctcaagaaggcaaagagtttcatgtgttctttgaatggaattgaagccttgtgcatccaaagattctgttgacttccaccctgcaaactgactttgatgtaccaatgactccagcaggctgggaagatattacttccccaggaaaactctgccccatttctgtttatgcaagtagctgtccttgctgaggtagtaggatcaactaaacaacaaaatcttctttgaggcctgagcactttcctttggggccaccttcttgagttcagcctgcatcactcactaaccttggttggtcacaggaacagttatgacagtacatctgcacagatgttgaaggcatgactagcttaagggccttctatgtcccttcctttaccactaaccttaggatagagtttatttctgatagttccagcctggtggtggtattctactcctttgcagaacacatttaagctactactctgatttcaattctcctctctacttcagcatctcagtgatgaactacattcttaaaacaatgttagtccacccagaggattctgtattgctagtcaatttttagaacaaggagatactcactggagtcaaacccaagggaagaacaattaggctatatatatatatgggtatgtgtgtatatatattgtgtatatatatatatgtatttgatagatttatgtttatttttacatacatgttaagtacaaatttggaagcataagatgacttctctgcaattattttgctatgtgttgctttccctttggaatctgtggatagaaactattatattaggttccacatcactagttatatttcaactaaaatttcataactggagctgggtatatatgcgtctctacttgatatagctgcatcatccaatgatgggtatatatgcatcatccagtgatgctgggtgctggaagatcgccatttagtacccaggtggcaattaattttgtggtattgtatttctgggtgttccctccattcctgacattctttatcatctatgattcaattatttgcctggctcaagaaagcacctttatttcccagtgaaccacgatgtgatagaggtgactttaagtaactggtttattgtgatcaacatgggtcaaaggaataggtgtgcagtgccactccagaaacttaccagagagtacttttgtcttctagaaagtgaacctggaggctcagtttctccagaattcatcttcctctgcccactccaccaacagaacagttggcatcctttagaccaggggtcccaatcccaggctgcagactaatatggtctatggcttaggctccatcattctagggtttgatttttagtttacttttcttgtctgccatactggaatttgctaatatagctgtggtccctgtaccttattatggtgtaacaaatgcaataaggataggggcttcttctgataattaagacttccatctgccctccgtaggttcaactttaatgcttcctacagatgggcaacagggctatctgctcagtgcaacccccagaattccaattgtctgtgctgtctccactccataccataactaagcctaggaagcgcctcctgaagttcttcactgggctgaattaagaacaggatcatcgttctctatctgggtgttttctaccccactgagagaggtgaaattgtcagaacaaaaatttaggaatttaccaaatgcagtttttttttggctgataattactattattaacaataatgacaatgataagcttagaaaaattaaacactaaacaatggctgccgtaagaacactgaaatgactttatagtttacaatcagtctttcgtctttcagggatatttttgtggacatctggtgccacattttagtatggggttcagagaatatcaatttacctgtttcttcatcatgctatattgagttatttactccacaataaaggtagacctactgatgagaaatgtcagggcaacctttgtgtatttcagttaccctcagcaaggtgctaccagctagcattagtgtatttctggtgttggtaacaggatcatgtgagccttgtagatgagaactccttgttgctcaggggatcatggaatgctgctctctttcagacagccatcttcggggaagagaagggtctctggcagagctctatgggtcctgcacttctctttcacctctctgccttgttctttcactcattaatttcttgacaatttattttccttaataactctagttccttctgtttatcttcttctgtcaatccttgcatccattgcaaatccatcacctgctctgaaataccacactgaagggaggtactcctaaagaccttccttcttttccactcttgttttacccttggcttacacaactgttgaacaactggagctgaggacaaaaagcacataaattccaaaggtcaacggaatcacttcttcatagtttacatctcctgtgtcttaagtagaactcaaatagaacataagcattgagaacagaggtctgagttggaggtcaagacatcgtttactagctgagggactttggctttatttttctcatctctaagagggaaaagataaaaatctacttcacagacctgttgctgggaataatgagataatttatgtacagtacttagcacattgcttggcacataaaaagtgctcaataaatgttatatatttataacattatttgtaacacctcgtctttcaaggaattatgggaattattctgtttgtcagactttgtttatggaaattatgtccttttgatggcccaatttttcttttccttttcttcatcttttgataacatactattaaatgtcaacaattcatactaattggaactagtgtaataagctgtcctcctcatcagtattagcagtctttgaacatggcataaaaatatgcccattttggcttacaggtccttgattctctaatgataatagtgcaggaaaaacattagatatggagttcaactttttaaaactgtcttgatgttggtgaccaataatttaaaagaggttagcatattttaaggtgactaaaactgtacaaatgaaattgccatttaaaaatgtctgttcatttgcttttctccaatgcagatattttaaataagaagaagtgaggcaagaaaaatgtaaacaaatattaggtataaactaggaacttagtcttttattttctgaatcagatggatgatatttaaaagtctgggtgaatgataaatggtagaaaaaaattaaataacagtcaatatgcacaacttaatggaggtaaaataagacttacttacttttatctctataaattaaaatgattttgaaaatcaagctgccaaaataaaggtgtggattttatcattaaagcaatgcccaagagacatgttattgagaaattatgtggcattggtttgttgttactagcgaaatgaatgcctaactgaagttgatttcataaagatttagtgtgtgtatgtacttgtgtgtctgtgtgtatatatgtatatatatatttgtatacacacgcacacatgtctaccatgtgacatgttgctatttttacaacttattttaaaacagctaaaattttctagatgagattaaacattttccataaaaataaaattacaatagttacctcaaagtttgtttatcctggaaaaaaaagtgctaacataagagttgttcaataatattttaccaaaattttgtcagaactccattaaaaacaattcaagaccacagtggtctaatttcaacactggcatcattaacctaacatatttatggaatattcactatatgttctgttttctgcttaagtatatgaattaaacatagtttaaatagtttactcaaagaacatgccatttgcttcattgatttcacactctctgacgtatgtattaataagaacataggaatccacacacagaaataatagcattcctatggtgcattaataaaaatgtatgaattttctatgtctaggacatgtattcattatttgggtgggtcttatatttcaggtactgttctgtgaaccacgtttatggaagtgatcaaaacaggcaaacatctctgccttcatggaatttacatttttcttggaggaggcagacaatagacaaaatatttagtatgtcagctaaatactaaagggaaaaaccagaggaggggatagtgtgtggtattgagggtcaaggccagtctcagtaagaaggcagctgtgagctgtgacaagaatgagggaagtgagccatacggagcccatgtaagagatttccaggcaaagagattaaaaggtggacgcctcctaaggaatggacatacctgccatgtttgagtaatgagaaagaagataaaatggctaaagtagagtgagtgagggcaagaataacatcagagaagtaaaggagtctagattgtgagcattgtgaacactggggaaggcatagactattcacaaggagatgggtagctactaaaaagttttgagaagaagagtatgtgatatgatttagggttgaaaaggattgctccagtttctgtgtcatataaccctatggtcttgaaactgggatattgtatccctgggggcatgaggtggcgtgcctagaggtacacaaaatcccaggatcagttagtcacatcttccctaaggataaaatttaccctcaagactatggggaaaaatgattactgtgttaagaaaaacatttaaattttatataaattattgtaaaattcccgtgattttaaaaataaagtatcaataatatttcatatttgtggcatcttaggctttaatcttacaggtttaagcttcttggccatcaggagtaatttgttgaaattgcaaattaatttggcaaaattatcataattatgtgccctgagagcttatgtatcttatgatagtgcaggaaacttgtgagatgaaatagttgagtgtatacattaaaataatttgatctaccaagtcactttaattatttatttgttcagtgttaaaaatatattttcataaccaaactaatacatcttaataatgttgtagaaatggaagtaaggtaaaatttaagaaactgggtttgttcttctgacttgcttattaatactggataagttactgaagagtgggctttggtttcctcgtctatttaatagtgtgggaacaaccttatgttaaagcaatctattcagtataactttagcacacagaaaataaaatattatgaatccaaagaaagtgtagcttgcaatcatgtattttattaaatgtatttatcagcattttggcttctgatggacatgtgtatatacatattttgtggataaaaaaattacttaactatttttatattagatactatcaattattctggctgatctggggacttttaatggtaaattttatatcaaatctgacaaagacagtatttcagacccgtttaagacctagaactcaccatgagttctaaaattggttctcagcaccatggacagcgttactgcaataggaaattaaagatcgatttggccccaaattaaaatggtgttgtaaaaaagtgggagaaaaaaaatgcctatccttttacttcaaattttaaaaaaatgatcctggccttcacaactgttcataagaagaataattaattaaacaaacatatattgagaacatcatatgctcagtaaaactttgattctataaatggtgtcatttaccaaatggattcttttgacaatttaattttctcttatctctctaagaagatgtaactacacactatagtatactactacaattatcaaatttcatgttgcatgtaacttgtcgtctgtatttttgtagttagattagattaactaaagatttttcaagtttgcctttaagtcatttaattttcctgccttatctttaacctttcaacattcctccaaacaatagcaacacaagtgttatgtgttaacttctctagtgacaaaaacttatacttctccacaaagagatgtgatgttcattatcaataagcttgacatctaaaattgttttataggagatacatattactttttcagatggtatataaagttaaataaatcttaagttttcaatgatgggaaaagcttccatttagtttaaacataatgtaaagaaatttgaatccccaaaatagaattataattctaaaaattcatactataattcttcttaaatgtttaaattacagttaattaaagtagttgatttcaaatagagtggaattatgggctgtacatcatttaattttatgtgctgactgctacatagccaaaggaacgtgaattaagatggttccacttttgaccaggagatggagctgtcatgtaagatgctgcctttatttatttatttttctaatttagcatgctgttttctaacagacattgggtaccatcgaatgactgtcagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcaggtaagccagcatgattctatttttgacttatccacggattgttatctatgttaagaatgacatttaatataagatgtgtgctttgttagcttgtattcagatctaagagattcaaaagctctaattctagctgttgtgcaatttaaaatcttcctaggctgaaatgagctctgactatgacataccgtgttttattatttctttggctttctagctgttggtctctgtctctggctgtatttgtttaccttttaaaggtaaagctttcaaagtgaaggatgggttttcctttcacaagggaaatactgctccttaatgcagtgaacaaattgtagagatataatgaagcagattaacatggcagtggctctgccaaagctcagggctgagccttctgattgcagcctcagaggcaagccaatattctgagtccaaaggccttttgaacgatttctgctggctatgatggtacagattgtttatgtctttatttttacctcttagaaataatacgtaagtcatttctcccacatgaatcaagatttatgtaatgtgtttaatagacttggaatgagactatagaccctccctcctcccccagtatggatgtgaggagtatgctgaacacaaattaattgccatgaaaattgattttttctgtattttattggatttgggataatagaaccgtggccattttaaatagttgatattatagaaggtgctcacattttaaattattttaggtcatgtgacattatctgtgttaaagagtggaatgactcaggaggtggaagttgcatgcaacagccttgcttctctctgctgcttctcgtgatttcccttaaatccttgcttgattattattagaataacaggaataaagacatatagaaatcctatatttaaaaaccactgattttcatttagagaaatttaaagagattttacaaatattttaaaaatagttttgtaagattgtttttaaatgcctcacttctttctcctgtggaaagagctgtgtgtgtgtgtgtgtgtgtgtgtgtgtgtgtgtgatggtggaggtggcaggcggtggaggtgcatcaggatgtttttatctcagtcattgttttcctgtaaagaggtagttttgccatgtcagaggttgtgaaagctatggggaatgattttataaaatggtttggacaaaccatgaaaaaaacatgttttttaaatgtgtggaatctatagagtttgtagttctacatggctccatatacatggagatttttagaattacagatatttaaccatttatccccattatcatttaaagaaaagcaattgtaattgagagataaggtggatttcccagagtcacgtactaaattacaataaggcaaggctagaacagtgattgacagttccacatcttccatagcagtaacacaattcacctctagtgtgaacatatcaggatggcatagaccaggtatgatgatattcactgtgcgtgtgtgtgtgtgtgtgtgtgtgcatgtgtgtgtgtgtttggttatattctgtaaaatagagtttctttcagtatactgttgctcaatggcatattatatgcagtgctcaattttcttaggtttcttgtcaaagcatccaagaaaactgaatgacaactatggaaactctgtttcttagtatgcctttttcattattaggtggtgtatactcttctaccctatgctcatgaatgatgtggatggccacatggctttccctcctacctaatagaaaagattgtacatataggttaatctattgacaactataagaatatcatctcatgtccaagcctttcctcctttgttcacttactaggcacaggctttaccctacttcttcaatatcttgagaaaagaaagggattaaaatgtgtcatgtctacatatatttgtggaataccacgtaccaaccaagtgtccatggtagagataaagaaataattagtcaaggagtttacctcagggaggttaacatgcaaatatacatgtgcagataccactatatctcaaaataaggaatgaagaaagatgagaaagtgaatgggacaggaatatcagcacctatcttgtgccaggcaccatgttacatcctgggattcagaacaaaacaataatgttaatttctgtccatggggggctcagaggaaaagattttaggaggatgtgacagttaaattagatctttaagagtgagttggatataaataaagaaaaacagaaagttgcttattccaggtacataggtgaggcaagtaaatacaagaaaatggagaactataggcatcgtatagggaaactgtagagaaaggtaaataacccaatctgtttgaagcttttgttgtcggtgttgttgttgcagttgttattttttttcccctggggcagtaaaagtaaggataatgaatttggcttttggtgttatgcatttgacatactgacacatactcatacactggggtgttttataaggagctgaacatgttatatccatgtatcagattagtggttaaggctgaatgtatagatctgcatgcagttgtgggacaaaattaggtcatacataattaaacattaatggggaacaaaagagaagtgaagatgactgggggcataatcttaagattaggagagtaaaaaagtgtagaaaactattattaaattgtgtgaaaataatgtgagaagttgacggaataacaatatcataggaggccaagcaggtaaattgaatatcaaaatagggatcagaaacaatagaaaacccataaaggggttggttcataagaggatagagtaaagatgatggatttagttatcattattaggtcataaattaattttaagagaagaggtttagttgaatggcagagacaggggctctgaggactaaattggacatgagaaatctggggagtatatttaagttttaagaagtttgccagggaaaggtaggagagataacattttatacctggagaaagaaggtactgttgagggaaatttaactttagtgcagattagaaaaacctaagccctttgtagagtaaggtatgaagtcagtagagagaaaattgaggaaagaagaaacaaaagtacaccaaggtcgtggaagagacagaaggaaggtttgaaaatgcttttccttgacacaggaagaaagggtggttgatgataatgagcaaagctggtgtaactcactttgggtggcctgtttttcgaaattaaatccttgtttgtaagatgaagtatctcctctgattaaatcagtttgttcctcagtaaaggctattggtggcatatggactttctggaagaaataattaatcctcagtagcaaaacactttcctgcagaatatattttagtcacattaattcttgaattggagactaataacactgtttcacatgaagcttttacatacttcagttatcaatttcttattcataaccacctatttaaaaacaggttctatttaaaacttgtattgaattaggccaacacatatctattatacatatctagtttgattactaagggctggtttgccagtatctaaattaattattcaagttctttccttttttgaatccttcagtttcattagcacgttcaccaggacttgtgtagagagagtcaatgtcatggccgggtgcagtgacttatgcctttactcccagcactttgggaggccgaggtgggcggattgcctgaggtctggagtttgagaccagcctggacaacatgctgaaaccctgtctctactaaaaataaaaaattagctgggtgtggtggcaggcacctgtagtcccagctactcgggaggctgaggcaggagaatcgcttgaacctgggaggcggaggttgcagtgagctgagattgcgccactgcactccagtgtgggtgacaaagtgagactctgttaaaaaaaaaaaaaaaaagtcaatgtcaggaagctcctttcccttagggaactagcttccttatgaagcttcctaccagaagttccttttttctccatttcttctggcagttacagaatcctcttggggctttcttagagccaatctcctctaaggtgaatgcattttcttgcattcacctgtcatgaaatggcagtggaaagacttgaagaaggcacaggcgttggtgagtcatatatatattttgctgataataatgaataccattggcaatataatagtggccattgaaatattatttctattaggaaaagataacttgcatcaagaatatgagatgaaattctattaaaaaatgaaaagtagatgggccaccgtggctcttgcttataatccacttcgggaggtcgaggtaggcagatcacctgaggtcaggagttctagacaagcctggccaatatggtgaaaacctgtctctagtaaaaatacaaaaattggccaggtgtggtggctgacgcctgtaatcccagctactccagaggccggggcaggagaatcacttaaacccaggaggcggaggttgcagtggactgagatcgtgccactgcactccagcttgggcgatagagggaaactctgagtcaaaaataaataaataaataaatagaaaaggaaaggaaagaagaaaaataaaagctgacctctctataacactcatacgttagtgttatctcctctttatccatttgggtttagtgaaattggaggtcagtggaaggagaggtagaagtggattttgcaaatcagaagtataatttttttttctggtaatgttccattaaacttttcagtcaaaacctttatgtggaagaagacataattactaactacattaataataataatgaaaaaatcttatcatgtaatatcgttttgtttattagtgaaacattttagagaaatgatttaagaatcaaaggtatttaagtatattttatttattggaatgtgataaaatatttttgagggtaaaaaactataatttcagttaactgtttgtacttactaaaataacatttagggggataaaatgatcttaggaagaaattgcccacaaaaagtgttttgaattgtttagattatttttatagttttaagttgttaagtcttttgctggtatctaggattagttgggagtataatatgctttgaacatgaacatgtcttggtgttattagcaaataggtatacaattatgtgattgtgtaattactcagctacatcttgtgttgtgtgatatgtatggggaaatgacaacaaaataacaacagttctcttaagcatatatgaaggtagtgcttgaaatatcatgaaaaaaagaaagggagattatgataatgttatgataagagaagactgacactatccctcttctctgaataactgatatcaaaatgtgaaattctaaggaatgaagcaagctggtcagggcaatggtgatgctgtctctgtatcagcccagcatttccagctaggatattttccttcttttctgtgtgatacagtttggctctgtatcctcacccaaatctcaccttgaattgtagttcccataatctccacgtgttgtgggagggaccctgtgggagataatttaatcacgggggtggttaccctcctgctgttcttgtgatagtgagtgagttctcactcgatctgatggttttataggggtttttctccctttgcttgacacttctctgtcctgacaccttgagaagaaggatgtgtttgcttacccttccgccatgattgtaaatttcctgaggccttcccagccatgcagcactgtgagtcaattaaacctctttcctttataaattacccattcttgggtatttcttcacagcagcatgagaactgactaacacactatgtctcccctggattgagcaaatgagggagcccagcaattgtcaggcagctaggatctgtgaggagtgcttagacctacacttactatttcctgaattaacagtctagaagacaggagcctagttatacagacagggtgaccataaaatgtgtcatctaaaccaggattcagtttgttaataatttctccacaacgacaggtataaatcaagatggttccaggtaaactgggatgcacagtcactccacttctaagggtcaagaaacttctacatttaatcagtctattcaattaaattgttcatgattttgttgcctaagtgttagaaagttaaaatgtgaaatgacctatcaattagacaaagggcattcagctaagctgctccaattactggccttgataaatccatcaaccgaaatctctaatgattcttgttgaatccttagttatatcaccaggaatgatgtcactccaataatgttaagcctgacttcccagggaattcaactgtgtgcaaaaaaaaactgttagtaaattatgctgttattacaaacctagactcacagcatcataaatctattcaaatataaaagcaaaagcaggataaaatatggattcaaattatttccacatttgggtatgcatcttttaaggagttttcatgaatgtgtaatccttagaagataggaatttagctccaagaacactggaattttctccactggcactttatacccaaatcttggtaatgtcaatatgcatatgtatggcctcttaacagactatcctgtaaagtagttaaattattttcctccaatgatcatgttttttttacccttcttcagacatccactcccatggttttatcttgaaactcttcatggccagtaactgtggcctgcccataatccttccttcatacatcctacaccacctttctagcgcatttcatctacaactccaattcattcctttaatcccaccaggcctctaaatcactgatctcgtcatactttgattatctctcactaaatgtcctctttcctttcattagataaattccacagttattcataaaagtcactccttgtatatacatacatacctcacaaactcctccgctcagtgtttttttgtttggttggttttttggtaactgtctggctaaatcttcatcctcatattcagttcccaccttacttcctgcctgcacttttgcagctggacgcatgcaaaagtgggtccttcatgatgcccagcaatcatgccacatgtccctagattgatgcccagcaaccatgccacatgtccctggatcacttactctcccaggttcttgtacttagatttcataccctttcttttctcctcaaaccaccaatacctcctaccttgacctcactctcagttgacaactttgtttcctaaatcagtgagaaaattgaaacaatcaggagagatttttccccacaggtttctatcactgcatgtgccttcctaccaggttctgcacccacataacctgacctcccacccattaccttaaatcaactatccctgtttctatctaaaatcattcctgcatctgtgcactagatcctattctttcttacttacacaagggcatctctagagcattttatttctctgtctctcctgcattagtaattttagctctttattatatttgcatacaagcattttattattgctcttgtatttgaatttttttacttccttcaactatcttttttttattttttgttgtctttgcaataatacttaatgaaagtgtttgctgtattctctgtatctatgactctctttctattctcttttaaatttacgttagtcaagtttttactcttaccatttcaccaaatcagctcctgatagaaatctgatgaccaccctattgccaaattcatcagtccatcctcagctttcatcttacttgaccatccagcaatattggagacagttcattgctgtctcccccttgatacactgccttccgttggatttcaggatagcacacaattttgactcttctcttagcttattgttcactccttcacagtcactttactctttactctgccttcccagacttcattatttgggtgtccctgattctgtccctgattttcttttcttctttatctactttcttttgatcccattgagttttatggcgttaaatgccatataaatcatgatgacatccaaatatttacctccagttttctgccaaactgaacttgtgtgtctaactgcttatttggcttggatatctagaagacactgaaaagttaacatccctaaactaaatttcggatagttcttcccaaccaacctgctccaatcctcgctttccccaccttacttttttcaggagataactctagttttcctcatcctcaggctaacaactctagtatcatccttgattattctttttctcttatatctgacattcagtccatgagaaattcctgttgatttcaacttcagaatatacccaggatctatgtgctgccaccttcacactgctaccctgctcaagccaccatcaagtttctcatggatttctgccttaatttcctaattggactttattcttctacttctccttacaatctattctcaatacggcaagacagaagtaagattacgccacatccctgctcaaaattctgcaagtgatatccagttttctcagggtaaaaggcacctgacaatttccaaaaagtctctatttagcctggtctccatcccattacagtatttctctgaatttgtctccagtttttctttccctcattcactttcactatttcttgaatattgcaggaacacttcaatcctttgggctgtttcctctgcctagaaaccttttgcctcaggcacttgcatgactaacctcctcacctgtttaaaatctgagctcaaatgtcgtttctaaataatacctactcttaactatcccatttaaaaatctcagcccccttcctctaacttcattcttatcgtctcccacattcttctatactttcttttctttgttatcatttgctttgctttgttctttttttccttttctttcctttcttttatttccttcccttctaacacatcacattatagcatactgtatacattgcatttctcttgttggtaatttaagccccaaatgggcagagattatcatctgtttggtgcactgatgtttcacaaatgcttagaacacttcctgatctatagaagagactaaaaatgtttgtagaataaaataatgaatcttagaaacttaaatttattcctttaagcatactaaggggcaccatgctttctctttcactttattgggctgattcacatttacaaatgacccagtgcaatctgcctgatttttcattcagtatttacaccaatagaaataaaatgcatattagtgttataaaatcaaaccttaaatgacagtaaatgtatcattaatagttactgaagaccttttcctgatatatatgacatttaatgtttttctcttgtgacttcattgttctttgtttgcttgttcatcttctagattgtgagctcctcaaagtcaggaacttggtcatcatatctgtctcccaaataccacactcaatgtctggcacataagaagttttacaaatatgctgttttagtcataggatgagcatacacttaaaatttaatactggtcctgcatatgctgtgtcctgagctttcgctatgtaggttgctttaattcttacaaccgtgtggagcaaagcactggtctcattttacagatgtgataaagctagttattttgtccaggacttaatcattgcagtattctcactgtctaatctctagtgaccatatcacaggaagttaattatgctctttttttaaagataaattgaaataatgctaacaatgccagatttcttggaaatgttttgtttttagtttcagttagaagcacgccttagcttagtgaataagggacaatgaatgttatttattttcctgctcaattcagttgggaaaattgacctcatcgttttgtgttttcaatcccttaagtgtaataaaattatttactaccttagtttatataaatcaccaagatctaatggaagccacccagttaactctcctaaagagtcttcaagcatgttttgttctaaatctcagcttaagtattttccattgtttaccacctaatgtctatactacttgatttatagaaagtcttatctaatataaatatgctaactagctatgataaaattgatcactttccacataatcatatactgaaaaaaaattccactgaatatatttctgccctccatagattccaggatttcagtgaatttttcttaataatctctgcttcagaaatgtatataaacttttgtcctaatcaaatctaactcaaacgtcacttcctttataatgttctctctgttttcacatgcagcatatacttccattctactctgcacctatctctacacttgtaatgtgaagtagccagatatatgtggacctgggtcatctgtcatatttaattgtgtactatataaggacagatattgttttgtatggttctatcaagctacccagtatctacatatactgccctccataggaggtaatacatatgctgagctctactcatttaaaacttcaatcaaggtactattggaatttcttagttttacaacataactatgtcctacttcaagtgacctattaaaatagctctcaatagtttgctttaatacaactgcctttaatagcttttaaatttagtgtttgtttgagtagactttatggtgatttgtaaaatgatatggatatagtatatagaaaattttaacagaaatgtaaataataattataatttagggaaacggtgccctcttgctctatttcacacacacacacacacacacacacacacacaggcacacatatacacacaaaaaaaatctctatttccaaatcttgttcacaaggagctctctaactccatgagtaatttttacaaccaataacagattaaccaacaatagtcacacgaacatgtacacacacatatacacagcctaacttccccacatcattattatctatctatcgtcaagaatgcagcttataaaatacaatgacctggctgctataggaaaggataaaatgtaggttgcagtgatcttctgacattgagatggcaaggaatgtgttttttgcaggaatttcaaaacctgaattgtagaatgatttgagatactgccttaactaccaacaaatttgatcccatgttcttcatcatttttctgagattctggtttcccagatttctgaccttaattgactcaaccaaaaaaatctgcttattattaaagaccataaggagtaatcaacagaacaaaatatgatttaatataatattaaatatattttacaactcaaaacattctaaaagatgtgatggtttctgactataattcagtatatactattttagttttagtgacaatgtttctaacaaatacaggaaaacgtttcagaacctagtgtcctttacagcaagtagcaaagatggactcaggaatatgtaagcaaaatctagccaaaccaaaccaaccaaccagacaacaacaacaaagtgtgttgctgagtggctcatagacaaggacaagtatttgtgatgttctaatataataggtggtaagaaccaatggaacatctgtgattcaagtgagagtcgtggtggtagaaaacaaaacaaaagaaacgataatatgtgtagaaataataaaagaaaaaagtcaaagggtgtatttttacaagtacacgttcaaatatagcgtgatgatattttatctcaggaatttcatgcaaagtgctgcgtatgttgatatgttaggtctcttctggcccagtgacgattatcttgtgtggtttaagttctctatgccatgagtgaggtaagggcatttattccccagatccttccctgccagattactgtggttgaatgtaaacaccacaactcctgccaagtggcccctactccctctgattctaattattatttcctctttttgcctcctgctgctgctagccttggggtgcactctgctttgtttcttttccttaaccctaatatacctttgtaaataatccttttttgttttaatctctcaattaaaatctcctcttggggtgtgtcatctgttttctgctaagactttgattaatataatagctaacatttatgaaatatttactataatacaggcactgttggaataattcacatggatccaatttttttatcctcacaacgatcatgtgaattaggtactattatgactaaatttaaaatataaggctactgaagaacatagattttaaataccttcatgatcatatagctaaaaactaagacaaaataaaatccaggagtctgactccagagcagagcttagatgtgaaagtaattaatatgcttttaaagaaaatcttatattgttggtgtctgtataaatcccatagacaagatctaagtacgaaaaaaaaatagaagcaagtcaggaaaacttagttcacaggtaataaaactagacacagatatctaaatttagaaatatcccatgcatatattctgcatatctgaatgcatcaagatattaataagcatcttaatactttggaaaaagtatagaggggactttctgtcaacatttgaagaaaacatttaactagtataaatatatcatacaagttaactgaaaaatctatctgctgtctatcctcatgttcagttatcaagtatatatcatttaaatttaagatgaacaaaacactacttaaatcccaaagactcattaaagtaaaactagtaaatgcattttatttatcaattatttccctgaaaatgcacattctttttaaattaattttttatttaaaaaagagcatcatgccattaaacaaaaaaaggaaaattttatttactgggaaattcttgctgatttttacatgggattgtgacaaaaaaaaggtcagatttttatttttattcacagtaaggagagattttatcttcagggatgattacaaggtggggaaagggcaaggatctcaagagttaggcaaagatttctcttttagagagaggagtaaacaaggctagaatgaactggatggggagaagagggatttaagggtggtatgatctgacagagaatgttccactctgagaccagcctgctaccttgagggactatgtaaggggagggggggtgtggctgcttcatcttgaaagtaagtcaaaattcagggatttggggaaagtagaaaatcttaaccaaaatttggttaataggcattttgttcccattggtcagtggggacgggcagtttagcttatcatttatgaggtaaagaatgggaattttgaagttctgtgttgggtctcatcacaggtgaatgggggacatttgtaagttttgcctgtgctatatggggaagggtcattctttacagtaatttcctagaacatgaaaggataggggggttcttattatttcatctacataaactggaacagaagatgatttcactggtttattaaactcctcaggatcttctacctgcccttcttaacctttacattccaaattcacttctatctcctttctagagctggtaatctttcttccatgaagtttatgaaattcttcatgacatgcatagactttgacagttctgtttctgatgtgcataatacctaccagattgatttgtgataatatcattgagaggccacttatagcctatttatgactcagcaaaccatggtcttttacagcctcttttaagatggtttggagagataaagaataatacttcatgacatgtaaaaattatattaagtttgaagtttaatgtccataaataagttttattgggacacagccatgcttatttttatataaattttccatgactgttttcttcctacaaggtgagaactgtatacttgcaacagagacaatatggcccacaaagccaaaattatttactaaatcatcccttgtagaaactaagttgcagactctggtctatatagtcacattacactacaatgatcaagtatagatgtttgacagtatttaagtttctgaatgaatgaacctatatagagaaatgtataggtataactatattactgatatatcctattaattttattatttttctgttgagtttttagcttttctaggtacataattttgtctgaaaataattaggacaattatgtcatgcctttctttgctaatatttctaagcaatcattcctttacttatttctaactaatgtttacccccagttatattgtcagattttcctggaaaatattaatagtgcaaatttcctgctgtttcctaactttgacataaatatttatagtggctcttcactaaattacatttacatcaatatccttagtgatatattgatgtaaatttgatttgagacagatcaacttcataatgtaaggatatttctctttatgaagagaatttattataatttataaataaatgtgatatctgttagatgacttttaagcatctagatgtagttcatattctgttttggcccattaatgtcatgtatttcattaatatatttttaagtactgcaccattttttcattactattttggatcttattttggggcattatgttattaagtagttgtatgttttatttaagaagtttataactgtattcattaatgatattggctgtagatttcatttttgagggtgttctttcggaaaagtttactatcaaatttatatttgcttcaaaaatatttttgagtaattttcctatttttctatcctttgaatgtgtttacaaaatgtggaaataagttgtttctagataatatcaatatttatttgctagaaaataaaaactcacctgtaaacatgttttattgttattttaaagtggttttgcatatttcttttaactcatttccttattaatttcctgatcaagttttcacttcttacatcattttgacaatttcactttcatagacgtacacattttgtagaaaaattcaaagattttaacatagttaataattttgtttgcatacttttcatctctcaaaagctaagaaaaatgaattcatgtcttctacaattaacagctttgcataataacgtactactattaactttatgattttatgaccagtatatatttattagaacatttacaagtacaaaattaccttacttatccatttaagttatttgtgttgagatatgttttctctctaataacattggaaaacctaaatttttgtttgtatttgttgatatatttttgtccattttttatttttaattttggcaatctgttctatgcttctttcaaataaacatctgttcaacttttgctttgtgatctaatttggtactttgtgttggttaattataaattaaccaattcaaaatttattattttaaatatcagataatatttgatttttcttctcataacttgttttgtggtttctacttttcttatatttttcttgattttcccataggggtatatcaactgcagtttttcccatctttattttttcttcttctattttttctagctttttggaatgcatgtattgccttatttcattccattattttaaaagaaaccatcagcctcataaatgaaactatctattaactacccttacataagataaaaatattgttttttctttcccttccaactattttccagtttaaaaaaatgtacatgatttggtattcacgttaatttaaaaatgttctccataagcgtattattttataaccttactaaccacgattattaaaatatggctctatggtttaactccatatcctaacaattattaaaatatggctctatggtttaactccatatcctaacaattattaaaatatggctctatggtttaaccccatatcctaactaaggatgttaccattattaccatgtattaccatttcttctagcatcttctgtagagctgaagtgtatcttagagtcacctcttcatgaaggagatattgatgatatattttctcagctgctggtagatgaaaatatttctgtaatgccctcatgtaataatgataatttcagttgatacgcaaatatttttcttaaaaatatattttgttcttttatcctcagacatctaatatgcagaagataagatacagccagatttttcttccccgcccaccccccttggaaacaaaccattttcccctaccagaaacttgatggatgtttttctttatcctttgaccttctctagctcaacaggaaatgttttcatttggggctcttttcttttttttttttttttttttggtgatggagtctctcgctctgtcgcccaggctggagtgcagtggcgcagtctcggctcactacaacctccgcctcccgggttcaaacaattctcctgttttagcctcctgagtagctgggactacaggcacctgcccccacggccgactaattatgtatttttagtagagatgggatttcaccttgttggtcaggctgatcgcaaactcctgacctcaggtgatccacccacctcggcctcccaaagtgctgggattacaggggtgagccactgcacctggcctattttctttaatgtaaatactattccataatcctgtttgatttacagactctttttgttaaaagatttcatttgttcttgagattagaattcgttgcaacaactgtggtagccttagtttttccttttcaatttactatctttaatgatagcatcctcagggcttttgcaccatgtatatctttacattcttaataattatttccatctaattaactttttactctgagatattgggaagttatcacagacttccatttaacaaacttaatttctgcattttcaaatatgcttattactgtttatactgaacttatgaatttaactatttttacaggtatccacgctatatccaactggactcccttgctaactgtcagctttcctttcataattaaagtgtcctctttaatcttaatcagagtatatcctaaaattaaaatgttctcttctgcttcttattttgaacaatggtatcttttcatatgtttggcgattttttttcctgcttactcatcattacagaagatactctatgctgtataacatttgtattttagatgattctatcaaatattgcttatttcctgtaaacatctaaaagtcttttaggctgaggagaagctataactttgttttaacagttactagttcaacttgtaacaaagttaaaacttttttttttaactttgctcatttaaatatacagtggcctaaggaaactaagaaccaatcacagcagagtttgtgtaggtttgatggctaggaccaaccatgggaactgacgcatcatttcctgaatttagttgcgttcaagggtagtggtattcctgttctttgtctgacataactgtccacacctaaaagctgggcacagactttcccatctggtgggaaatatttcagaaacattagtgacacttgcagtgtcctgctattgctgcaaaacttgctcttccttcagcccttgccatggaattcaggtataattgtggtcttctattggcacatcctttatttacagacatacctcagagatattacgggttcagttccacaccaccagaaaagcaattatcacaaagtgaatcacatgatttttttgacttcctagtctataagagacttattttttcactttttaatcatagccattctgactggtgtgtgagatggtatctcattgtggtttttgtttctgtgttttgttgttgttgtttttgttgttgttgttcttgttgttgttgtttttgagacggagtcttgctctgtcacccaggctggagtgcagcggcgcgatcttggctcactgcaagctccgccttccgggttcacgccattctcctgcctcagcctcccgagtagctgggattacaggcgcccctcaccaggcccagctaatttctatatttttatagagatgggttttcaccatgctggccagggtggtctcgaactcctggcttcaagtgatccacccccctcggccttccaaagtgctgggataacaggcgtgagccaccacacccagcctcattgtggttttgatttgcattctctaatgatcagtgatgttgagttttttcttcatacgtttgtcccatgtatgtcttcttgacatgtatgtcacttgaaaagtgtctgctcacgtcctttgcccacattttaatggtggttttgttgttgttgttgttgttgttgtttttgttttttgttttttgcctgtaaatttgtttaaattactgatagattctggatagtagaactttgtcagatgcatagtttgcaaatattttctcccattctgtaggttgtcagtttactctgttgaatttcttttgctatgcagaaattcttaaatttaattacatcctatttgtcaatttttagttttgttgcaatcgctttggcatttttgtcatgaaacttttgccagatcctgtgtctggaatggtatttatgagcttaccttctagggtttttatagctttaggttttaagtttaagtatttaatccatcttgagtttattttttgtatggtataaggaagtggtccagtttcaatcttctgcatatggctagccagttatcccagcattgtttattaaacaggaagtcctttgtccgttgcttgctggagagattgcagagaaaagggattgcttatacactgttggtgggattgtaaattagttcagcaattatggaaaacagtgtggtgattcctcaaagaacttaaagaagaataaccattcaacccagcaaccccataattgggtatgtgcccaaagaaatataaatggttctaccataaagacacatgcacacctatgttcactgcagcactgttcacaatagcaaagacatggcatcaacctaaatactcatcaacagtggactggataaagaagatgtgatacatatataccatggaatactatgcagccataaaagattataagattatgtcctctgcagggacatggatggagctgggggctattatagtaggcaaactaactgaggaacataaaacccaataccacatgttctaacttacaagtgggagctaaacagtgagaactcatggacacaaagaggggaacaataggcactgggacctacttgagggaggtaggtgagaggaggaagaggatcacagaaaagtgcttattgggtactaagcttattgcctggatggcaaaataatctatatccctgttacatgcagtttacctatataacaaaccttcacatgtacctctgaacctaaaataaaatttaaaaaaagacctatgtttacactatactatagtttattaagtatgtaatagaattacatctgaaaaagcaatgtacataccttaatttaaaaatattttcttgcttacaaatgcaaataatcatctgagtcttcagcaagtcataatctttatgtgggtggaggatcttgtctggatgtcaatggctgctgactgatcaaggtggtggttgctaaaggttgagtggctgtggcaacttcttaaaataagactacaatgaagtttgttgcattgattgactcatattttcatgaaagatttccctttggcatgcaatcctgtttgatagcattttacccacagtggaactcctttcaaattggagtcaatcttctcaaaacctgccactgctttatcaacaagtttatgtaatattctaaatcctttgttatcatttcacaatattcatagcatcttcactgggagtagattccatctcaagaaaccacttactttgatcattcatgagaagcaatccctcattcattcaagttttatcataagattacagcaattgagtcacattttcaggcttcacttctattctagttctcttgctatttctaccgcatctgcagttacttcctccaccgaattcttgaacccctcaaaatcaaccatgacgactggaatcaacttcttccaaattcctgttaatgttgatattttgacctcctcctatgaatcatttatgttcttaatgacattcagaatggtgaattctttccaaaagttttccaacttactttgcccagacccattcacggaatcattatgtatggcacctgtagccctaaaaatggatttttttttttttttttttttttttgagacggagtcttgatctgtcactcaggctggagtgcagtggcatgatttcggctcagctcgctgcaggctccatcttctgggttcccgccattctcccacctcaacctcccgagtagctgggactacaggcgcccgccaccatgcccggctaattttttgtatttttagtagagacaaggtttcaccgtgttagccgggatggtctctatctcctgacctcatgatccgcctgcctcggcctcccaaagtgctaggattataggcgtgagccactgcgcccggccaaaatggatttcttaataagacttgcagatcaaaatgactccttgatccatggagtgcgggcatgaaaacgttaatctccttgcagatctccatcagagctcttgagtgactaggtgcattgtcaatgagcagtaatattttgaaaagaatagtttttttctgagcagtaaatcttaactgtgagcttaaaatattcagtaaaccatgctgtaaacagatgtgctgtcattcagactttattgtttcattcacagagcataggctgaatacatttagcataattcttaagggccctaggatttttggaatggtaaatgagcactggcttcaactgaaagtcaccagctgcatacagttatccctcagtatgcatggaggattcgttccaggactcagatgaataccaaactctgtgcagtccctgatataaaatggtgtggtggccaggcatggtggctcatgcctgtaatctcagcactttgggaggctgaggcgggtgcatcgcctgaggttaggagttcgagaccagtctggccgacatgaagaaacccccctctctactaaaaatacaaaaaaatgagttgggggtggtggcaggcacttgtaatcccagctactcgggagtctgaggcaggagaatcacttgaacccaggaggtggaggttgcagtgagctgagattgtgccactgcactccagcctgggtgacaagagtgaaactccgtctcaaaaaaaaaaaaaaaaaaaggtatgtgtggtatttgaatataacctgggcacatcctcccatatactttcaaacatctctacattacttatgacacctaatacaatgtaaatgctatgtaaacagttgtcatattgtaatgtttagggaatagtgacaagaaaaagttggctgtacatgttgggtacagatgcaatttttaaaaaatatttttgatccatggttggttaaactcacagatgcagaatccacaaatatagagagccaactatacttctaaattccataattctcaattttatcttttgtagaagaactggactagattatctctaaagtgtcttccacttctatatttcttccagtccacattaataggatcattgttaggctggtatctgtttctaaagtactacagagtaaatcaacaaggaaagcaaggttgtcttctcattcagaaggccagaggttgctaaatactccagttctgaattgtaagtgaaacagggaagttatatactaggtgattggtgtgctgttaaatgttttaaccttggctttgctctattaactttatctgtcctttttaaatcactttcagaaataaaataaggtgaatcacctcaagtggggtacaccaatgagttgagatcaatttgggacgtccttcatattgacctttgttgatacaaattatctttgtcacagaatattgctgtgattccattacctcctgttgtacttgcctgagcttcccattgttttagtcactctgcatcactgtgtacgatgtcaattgtgttttagatggttaaaaaaaaggaaaagaaacatttcagtcataccaaagtgttgatttgcaataaagagtataatttactgtggctctgggtattgattaatctatacaatgaaaatggcttttgagtgctttggttatcagttgaaattatctctattttttaagctgataattactgaaaaatgtcacaagtggaaaaaagggtgcaatacaaactagtgttttatccagatatctattctgcctgggaaaggtaaaaggatacacattatggttgcaatacggtctggatgtttcacttctgtgtatgtgtatttcttgcccatctcaaataataggtgggactttttttcacttttattttaagtgaaggggcacatgtgcagaatgtgcaggtttgttacacaggtaaacatgtgtgatgagggtttgttttacccattatttcttttttaaaaaaatttcaataggtttttggggaactggtggtgtttggttacatggatgagttctttagtggtgatttctgagattctggtgcaccctgacccaagcagtgtacactgtacccaatgtgtagtctcttatctctcaccccctcccaccatttcccctgagtcctcaaagtccattgtatcattcttatgcctttgcatcctcatagcttagctcccatttgtgagtgagaacttacgatgtttggttttccattcctgagttacttcacttagaataatggtctccaattccatcaaaattgctgagaaagccattatttcattcctttttaagacaaagcagtattcatatatatttgtatatgtataattatatatgtatatacacatagaataatatatatattaatcaacaagtgattaatgggcgtttgggctggtgccatatttttgcaattgtgaattgtgctgctataaacatgcgtgtgcaattatctttttcgtataatgacttcctttcctctgggtagatactcagtagtggaattgctggatcaaatggtaatatctacttttcgttcttaagaactctccacattgttttcagtaatggttgtactagtttatattcccaccaacagtgtaaaagtgttccctttttaccacatccatgccaatatctattattttttgattgtatcaattgttgcaggagtaaggtgatatctcattgtggttttgatttgcatttccctgataattagtgatgttgagcattttttcatatgtttgttgcccatttatatatcttcttttgagaattgtctattcacgtccttagcccacttttgatgagattgtttgtttttttctggctgatttgtttgagttcattgtagactctggatattagtcttttgtcagatgtatagattgtgaatattttatcccactctgtgggttgtctgtttactctgccaagtatttattttgctggtcagaagctttttagtttaataagtctcatctatttattgttgtttttgttgcacttgcttttgggttttgaagtctttgcccaagccaatgtctagaagggtttttctgatgttctagaagttttatggcttcaggtcttaatttaagttcttgatccctcttgaattgagttttgtataaggtgaaatatgaggatccagtttcattctcctacatgtggtttgccaattatcccagcaccatttattgaatagggagtcttttccctactttatttttttgtttgctttgtcaaagctgtaaacattgggctttatttctgaatcctgtattctgtcccattggtctatatgctgacttttatgccagtacctgctgttttggtgactatagccctatagtttgaattcaggtaatgtgatgcctccaaatttgttctttctgtttagtcttgctctgactatgcgggctctttttattttcatatgaattttaagattattttttctagttctatgaagaataatggtggtatttttatgggaatttgttgtgtttccatttgtttgtgttgtctatgatttctttcagcagtgtttgtagttttccttgtagaagtctttaatctccttcgttaagtatattcctaagtattctattttttttttttgcagctattgtaaaaggggttgagttcttgatttgattctcagcttggccactgttggtagtatagcagagctactgagttgggtacattaactttgtatcaaaactttgctgaattcgtttaccagttgcaggagctttttgaataagtgtttagtgtttcccaggtatacaattatgtcctcagcaaacagtgacagtttgacctcctctttaccaatttagatgtcctttattcctttctcttgtctgattcatctggctaaaacttccaatactatgttgaatagaagtggtgaaagtgggcaaaatcctgcactaaccaaatcccacagcatatcaaaaagataatccactatgatcaagtgggttttgtaccagggatgcagggatggttaaacatccacaagtcaataaatgtgatacactgcataaacagaattttaaaaaatcacatgatcatctaaatagatccagaagaaacatttgacaaaatccaacatcactttatgattataaccctcaacaaaatcagcatagaagggacataccttaaggtaataaaaagccatctatgacagacccacagacgacatcatagtgaatggagaaaagttgaaagcattccccctgagaactgttgtacagatgatttcatcacctaggtattaaacctagtatccattcgttatttttcctgaccctctcctcctcccaccttgtcacacaccctctgataggccccagtgtgtgttggtttcctttatatgttcatgtgttctcatcatttagctcctacttatgcctgcaaacatgtcatatttggttttctgttcctgtgttactttgctgaggataatggcctcgtgctccaaccatgtccttgaagaggacatgatctcattcttttttttgtggctgcataatattctgtgttgtatatgtaccacattttatttatccactctatcactgatgggcatttaggttgattccatgtctttgccattgtgagtagtgcagtaatgaacatatgcatgcatgtgtctttataatagcgtgatttatattcctttgggtatatacctggtaaagggattgctggatcaaatggcatttcagtctttagttgtttgaggaatcaccacaatgtcttccacaatgattgaactaagttacgctcccaccaacagtgtataagtaagtgttcctttttctccacaatctctgcagtatctgttatttttttaccttttaataatagctattctgactggtgtgagatggtatctctttgtggttttgatttgcatttctctaatgataagtgatgtagagtttttttatatgctttgttggccacaacatatatattgttggccacatgcatttcttcttttgagaagtgtctgttcatgtccattggccactttttaatggggttgtttgtttgtttttttttcttgtaaatttgtttaagttccttatagatgctggatattagacctttgtcagatgcatagttggcaagtattttctcctattctctaggttatgtgtttactctgttgatctatatatatatatatatatatatatatatatatatatatatatattgctgtgcagaagctctttagtttaattagatcataatcttttatcgtatcccttaactcaaaaaaatattgaacattaaaatattggtagcttttttcccactatcaacctccatagtaaaactatagttaggctttccttcaaatgaaaatccattcattttttatactgtttgcctgaaacaacacagtattctttcttaatagtattttcatgttgagctaaacaaacaacatttaaataaggaaaaaatattattatttcttttttattatactttttttccttcttctttctttctttcttcttttttttctcttaatatatggggtctaactctatcacccaggctggagtctagtggtgcaatcatagctcattgcagtcttgaaatcctgagctcaagtgatcctccctgctcagcctctgagtagctgggaccataggtatgtgccaccatgcctggctctttattacatttctgttataatattttctctattatatttcattttagttactaaagaatatgattttgaacttttttggaaagatcatcattttactctttgttgtagaagaaaatctatgatggtctaatgaactacggaaatattaacataattttaagaataatacatatatttgtattaccaaaggctatgcttattagtcattcaaacttcaactaattttttctttcatgaaatactcagaagtatctattcaccaccaccaacactccctccatcatttaatttcaagcagacttgggtttattcctggaaatgattttttactagtgttcttaattttagtcttcttctttctccaatatcttaaggcagaataatttttcttaaatgcaactttcattctttctccataaatttgaggtatcttcacatgaaattgagcttcaaagaagatgaagatgagtaagggccgggaaagccagggaaggtttctgtttcctgtgtatcaagtttcccaaacaagaatcttggagtcctcttcagcttctgcaactccttctcgatcaacatgcagtcaaacttcaaattgtattgacggaaactcagaactgcttagatcattttcttactctcattatttctgcgtggatttagacattcattgtcttttgcctgggctcttgcaataggcttttatcttatatcctaccgtaaaaggtttcagatgctacacatcctccatactaccaaagtaataggtaaaaaataaatctgattgtgtctgtacaaaaaaacctgttagaactaataaataaattcagtaaaattgcaggatacaaagtcaacatacaaaaatcagtagtgtttctaaacactaagaatcaactatttgcaagagaagtcaagacaacaatatcattttaaagcatcaaaaatattgaggaataaacttaatgaggtgaaatatctgtacaccaaaaactataaaacatggattaaagaaattaaataagacacacataaaaagaaagatatcccgtgttaacgagtggaaagaattaatgttcttaaaatacccagagtacttaaagtgatctgtggattcaatgaaatccgtataaaaattccaatgacataatagatattttttaaatcttaaaattcatatggaatcacaagttaccccaaacagtcaaagcaatcttaagtaaaaataatgaaacttggttgcatcacactgcctgatctcaaaatacattacaaagttgtagtgatcaaaacagcttggtactggcataaaaatcagcacacaaatggaacagaaccaaaagcccagaaataaatccatgcacttatggtcaataaatctttgacaaaagtaccaagaacacaaaatgggaaacgaacagtctcttcagtaaatgatgttggaaaaacttggtatccacatgcagaagaatgaaattggacccttatctcacactatatacaaaaatcaactcaaaatggattaacaacttacagaacacctaaaactgtaaaagtactagaagaaaatataggggaaaactctatgacattgatctgggcaatgattttttgaatctgaccccaaaatcacagaccaaaacaaaagaaataatcaacagaatgaaaagacaacctacagaatggaagaaaatatttgcaaaccatatgttcaataaggggttaatgtctaaaatatgtaagaaactccaacaactcaatagcaaataataataataataataacctgattacaaaatgggcaaaggacctaaatggacatttctcaaaagaaggcatacaaatggccaacaagtgtatgataaaattcccaatatcactaatcatcaggaaaacacaaattaaaactacagtgaaatagcacctcacattcattaaaaatggctactatcaaaagaacaaaagataagcgttggtaaggatgtggagaaaacaaaagtgttgtacactgttggtgggattgtaaattagccatcatagaaaacaatatgtaaattcctcaaaaaagtaaatacagaactattgtatgatccagtaattctacttctgggtatatacctagacattcaaagaagaattggtaccaaccctactgcaactatttcacaagatagagaaagaaggaatccaccctaaatcattctattaagtcagtatcacccaaataccaaaatcaggaaaggacacaagaaaaaagaaaactgcagactaatgttcctgatgaacatagatgcaaaaattctcaacaaaattctagctaagcaaatccaagggcatataaaaaagataatacatcatgatcaagtgggtttcatacccgggatgcagggatggtttaacatatgtaactcaataaatgggatacatcacataaacaattaaaaataaaaatcatatgatcgtcttaatagacacagaaaaaatgtttgataaaatacagtatccctttatggtaaaaaatcctcaacaaaattggcataggagaaacatacctcaaagtaataaaagccatctgtgacaaacccagaaccaatatcatactgaatggggaaaagttgaaagcattccccctgagaactggaacaagacaaggtgacaaaattagtgtgataaagagatatttacactgtcgtgtttattgcagcattatttccaatagacaggatacggaatcaacctaagtcttatctgtagatgaggaacggataaagaattgcacacacacacacacgcacacacacacacacaatgaaatactcttcagccttaacaaagaaggaaattctgtcacttgtgacaacatgaatgaacctggaggacattaggttgagtaaaataagccaagcacagaatgacaaatattgcatgatgtaacttaggtatggaatctaaaaatgtcaaactcacagaaacagaaagtagaatggtggttaccaggggctactgggtagggctgtaggggtggaggaatggaaaatgttggtcaaagggtacaaaagttcagttaaacaggaggaataagttctggatatctattgtactatgtaatgactgtagttaataatactgtgttgcatattcaaaaattgctatgtgtcgattttaaatgttctcaccaccaaaatataaatatctgaggtgaaggagatattaattagtttgatttaatcatttcacaatgcaaatattaagttgcacactgtaaatatatacaatttttaattgtcaattaaatataattgaaaaatagaacataataaaatattggattattaactctatcaggaaatgaagctttgagtaacattttactgtttatatttatggttttagccaccaagcaaacatggtggtcaagaacttggactcacattcaggttgccatagtccaaattcaggcttccctactcactaatgtgttcttaagcaagaaataaacttattttggcttcctttggtaaaatgggattaataattgttcctatcctacattttattgtgaagattgaattaatgaaatatacacgtaaaacacttaagacaattcctggccttagtaagatttcaacaaaaatggtcattattatgatgctttattctgttacatttatggattattagacagataaaattggacctcatatgtgaccattctattttcctttattcaaatggaaaaagaatgtcaattcaacatagggaaatactatatatgtataaattattacttaaatttatgtttttacttaaatatatgtttattaaaatcaagtgtttaaatttatatattaacttttacatttataacatcttatttcttctgaaaacaaccaacacaacccatttcttatcagtgataattcaaatggcctctttattctttcctgaatttttcaatcccaattcttctcttctgttctttttcagcagcatcttgcacagggctttatggaaaagactgaggtgctgtggtgaatttaatctcctctgttgtttactttaatctcttcatccagttactctgacttttctccatgcttaatgttatccctcttgatttcacagcttaacaatttcttctttgttcttgaccccatcctagccttcttatttcaaaagtcccctcaagcaagtttcttttcacattcttaatttcttattcttaataactccttttttatgccttcaagcaagtatggctctctctcatactgaaaatgtgctcttccgttctattttgctactgtttttattcacttaacagtaaatttcaaacaagttttgtgcacctaattctttcatttctttacaacccacccattgcttatccactcttacagctgtactagaattgtaatttaaatatgtatcatatcagtttttttgtaacattgataatttataatatttaacatattttgtaatagagttttcttcttaatattttactttccttttaaaaagcctcagcaagttgccattgactttcggcattgtatttgatacctctggactctggctactatcgccctttctgtataaaatctgtaacttgaccaaggcaagaacctccaccccaggccaactaattttctcatctgctattgtcccaacctgctttggtttctcctataggtcagagtcaggtcctgcttgggtttgggcctttgctcataattttcccttgcaattgaaatattctctcactccaggccagcctttaaagcctaacgtaagtaccaccacatccacgaagcctctgcacatcaacttcagatctcaatgctgttaaccttttataaacaaaaagcaatatagaataaatcctttttgggagcaggagtcaaaatgctagttgcagtcttgcatctgtcacttatttgcttggccagtgacgtagccttattaaaaactcaatttctttatccaaaagatgaggatgtttatacctccctgatctaccttctaagattgttgtacatgataagtaaaatactgtgcataaaaacatttgtaaaaattttaaaaatctgttcaagcttgtcattgttaccacagataaatcgggtactaccttgctgtcttggattgcttttgtatgttgttctcttatgttgttactggactcggtgttattacttaaatttctctgtatttattttgacaacttaattaggttttgaattctttggaagcggagagtatgaatggtattatgagcaaagacccagaaggagccacctcctaattattttggagagaattatctaagaggcctaattggacttgtgcttcccattaaagtatgattcatatcagagaagcttacagtcttattgctggccacatggagatagtacataggagatactcgatgggaattctgtcaactgaaagagagtcagcaagacagtgtaaacatggttagcgtgtctcagcttacccagcctggcttggtgtaaccaatatagactatggaaaataggaagtagacaaaaggtagtggagattgggctcatgccattttctttaattgaaatacaatttccataaaataaaatacagatatttttaagtgcatattactttgagttttgacaaatgtattcccctgtctggcaactgctccaattaagatgtagaatatttctatcaccccagtacccttttcctgtcaatccctccttctcccagagacaatcactgttccaatttctatcactatagcttagttttaccagttcaaaaacttcacataagtagaatcataaagcatgttactttttttcctggcttttgtcacttaacagtttttttttttagatttaaccattttgttgcatatgtaagtatatcataactttttgttgttgagtagcactctcctatataagtatgttataataatgtttcatttacctattgatgagcatttgagttgttcctaagttttaactagtataaaaaagtttactatgaacattcttgcataggtctttttgtgggtgtatattttcactactcttaagattgtcagactggataaagagcaaagttcagtggtatgctgttttcaacacatattttaaatataacacagacaggttgaaagtaaaaaaatcagtaaaagatacagcatgaaaacactaagcaaaagaaagctgatatggctatatgaatatcaaaaaagtagattttaagacaaaggatactaacacagataaaaatggtcattttattggggaaaaaaaggccaatttgtaacaaggcatgacaatcttaaaagggtataacaaagtagaatttcaaaatccaagaagaaaaaaatggcagaataaagtaaaaagcagagaaatccacaataattgttagagattttatcaattttatcccagtagttgctagaacaagaagacaaaaaatcaatgatatagacaacttgaataacattatcagggatcaaacctgcagacctaactgacatttatagaatattatacccaacaacttcagaatatacattcttttcaaatacacatggaacattccacaggtggtgttatgctaggccataaaattagtgacacttcatttcaaagagtatttgactacaatggaattaaattagaaatcaattacaattagatatatagaaaaggcccctttttacaaaattaagcaacagacttctaaataatcaatccatggatcaaagagggaaatcacacacacacacacacacacacacacacacacacacacacaaatacagtgcgctatacggagtgataattagaatacaacatgttaggaatctctgtgttcatgcctttaaccatttcatattatttcataataatcaagaacttattaatcaaattagcatttaattatcttcagatgaaatgagaaagagggtgggcaaaatgtagactgaaggctgagaattataggaattatggtcacaatcagccagtgttttaactctactgcaattgtaacaaagtcattggatcttggttcaaccaatgggaatagatcctttcaaaatgccaataaataaaatgctaaataaacattttggcaattttctcttgataaatctcttatagcaatgtgcataatgcttccattttcatccaatgaagtactagtgaaaatagtctagatagtgttaatattgatagaaattataactaaggaataagttagatggtgattaaagagttgaataagcactcaaagaaagttgtgaaatctctgttctgagatatgtgacaaaaccatctgtctctgattttagtttaatccttaatgaatataagaagcctgactaaatgatctcttgggaggcccccttccaaacacaaaacccattattttaatttgcattggttatagtgccaacacaaagaaaaaacacactcaagatcttttttataaagtagggatttaattctaaatcttagtcatatcttacaatttataaattctttaatgttgaaaaatattttctttgtagaactaaaaccattctctctctctccctccctccctctctctctttctctctgtctgtttgagaacccaaaataaaatgtagtttataatttgtgattatgatttgaacttttcaaaaaatgtatgagtcatttcttgccctttgataatttccaaatgatgatgctttgcttttgcttttagagatcagtctttgcttttaattatttccatatattttggttgggagtgagaaaaataaacggaaaatgtcactcatgagtgtcagcctggtaatgaatatatagaatgcaaatggtcactttactgggggagacggtaagtttttctgagccttttgcccttttatcttctccagcctgctgttttttctgttttcatttgtagattaaactggtgcagcaatatggtggggtagaaatcacatgaatctgacatatgtgggctcctgtatctgtgcacatggatagagatgctggtcaaaatccaaccatcttatgagttccagacatacttttaaaattcacatgcatgaagctatacaaaatattttaaaatacagaatccaaaataaaatttctttttgtataaaatactccttctcaattcattcctgtaggcaaaacttgatatttaataatattaagaaaaagaagaaaatgaattcgaaatattttattgctttacaacacaaaaaaaatggtttacttactcccaataatctgaatttattccaatagtatatttatggatttaaccaggagagggattatccttattctaagtaggggagaaaaaattaaaaaaaaaaaaaaagaaaggaaggaaaaactccagtggtcaagagattgagtgaaccgaggaacagagtggttatttgttctctgtaatgtattaggaatgactggaagtaatggaatatgctagtgaatatagctacccctatattgaatagaaaaatacattaccaaaacacttttcacacacgaaaacaaaagaacattttgtacaaatacctgatgtgtagctatatcatttagttgctactattgcctagtttaaaaattgtaccctggttaaaaacagaatcccttttctaatcttttaagatttcaacaaatatttccaggcattaaggacaggcagtattttgccttgtccacttctctgacgtctagctgtttctagttgctaaatttggctgctgtacttttcatatccgtaaagctgttcttgggtccaccctgcaggcagccatccaggtttggatttttccgggcagcccgggcttggctatcctgctttcatcatcctccttctgttctcaagccaaggacatagaatggcagagagctcccctttatttctggtatgattgttgcttctccgggtctggcttgggctctgatcttgacatttatgtcacaggtgtcactggtgaaactgctgtgaaaccagatggcaggcctaactgaggttggcagcaactgctgttgtccccagtgtcactgctacctgctctactttcttattcctgttgatgttctactgccttgttttattgcattcgttcaatgttaccttccaacaggccttttcaaatgtgaacaccattccataactcttctgatgcattaattccccatggaacccattcatctagggaggctcatgacttggctagattctccactttccttcagggcttttgttaaacctcatttcttcagcaagcctctccatgaccaccctatctaaaattgcaatacatccttctcctccccaaccctgattattttttctctctttttcataaattttctttccctggagcaatttgtaccacatgtcagaatctatatttgccttacttgggcattatctgtatccctccactgggttacctagaatataagctccacaagggcaaggttttgtctgtttggttcattactgtatcccaagcatctggaagaagactggcccttagtagacatttcaaaatttttgttaaatgattagctggattgtaaatactgaaagattaggtttattgtttttgatttggtttcattcattgtgcttagtacagtgctatatgtaagagcttgaaagacagagaaaagagcattagtagtatctgttatgtatactggatgttttacttgagttatacccttttttttttccaagacagagtcttgctctgttgcccaggctggagtgcagtggtgtgatctcggctcactgcaacctccgcctcctgggttgaagcaattctcctgcgtcagcctcccaagtagctgggattacaggcacccgccaccacgcctggctaatttttatatttttagtagagacaggttttcaccatgttggccaggctggtcttgaactcctaacctcataatctgccctcctcggcctcccaaagtgctgggatggcaggcatgagccactgcactcagccaagttatactctttaatcctcacaataatctaggtattttgaccaaagaaccacagctagaaagtaggagagtaagatgtaaaccagttttgtctggctctaaaattactgcctttttttgtttgtttgttttgctcagaagaattggtcatgccaaatagtaataagagttcttcaaaatgaatgatatttcataataaggtgtagctagaaacagtttgccaaaaatacttaggaaaaaaaaaagatttgtgaattagctccctaaaaatacaaacgcaacaattccaaaagaaggaattccaaagttattgggccatagtacttttgtgttaagtgcctggccctccaaggtaactaattttaatttaaaaaaaatgtctggacacatattttgacatgttttgctgaaaatatatttataatatgagcccaacaaagacaaatagattcattcttggtgctaaaaaatgacaagaaaacttctacgccattgctctcgaatgctttcttcattgtagtccaagaaaatttgattagttgtattttaaaagtaagccagatttcactggtaaggtctttccttacttcatcttctcccttgacaccttttgatttggttgtacaaatgcaggttaggccccattattaattcagtaccacatatttatgaagaccccacatgatgcaatcagcactagagactggaagtttttcatcaagcccagtaagcccacagtaaaaaggaatcagtctcaatcactcatcaggaagctaacatgttctgtgaccaccttctggatgttgagttatctctaatccagagtttatgtcaatgatcttaaaaattagttcaattctggatgggcgcggtggctcatgcctataatcccagtactttggaaggctgaggtgggcggatcacgaggtcaggagatggagaccatcctggctaacatggtgaaaccccatctctactaaaaatacaaaaaattagacaggtgtcgacagagcaagactccgtctcaaaaaaaaaattagtttaattttgtcttcattttttcttacttagtaaaagataatgtaatgcctggtgtttttttaaggcaatcatagaatctggaggttgaaaatatttggggaattatacattctaattattcagacaggcatccttactgcagtatctgctagtaattgaggattatttcatatttaaaaatactcatatttttatgcaaatctcagaatttgaacattgttacttataattgttaaaaagtaaattgagaaacaataaaatgttaaagagcttatttgagcaaatggtaattcttgaatcagctccaaaccaaaagtggttctgaggccacttgagagaactcaaagagaaagcttttatagggagaatgtagaaataaagcaaaggaaatatttaattggttgcaattatatagttgccttatttggtctatcttgctgaaaagttcctacttgtattactacatgagttggcagcttctgattggttagccttaagtttcatttctctttaggcatttataagaaatagttcaagttgagttttgcatatgtttgcaaatcaagcaaagtttaggttacttctgagggccacttggatttgtctgctcagaacttcttcaagcctggtctgttttaatttacttcaacatattttatcaacattttgctttctataacattcatagtaaccttagatctgccctctagaatcgacagaggctatttcacccccagcctcttttcaacatgagagtttgctcaatgctgcttctatttgaaatcttctgttattcagctcttttaatgaatatctactttctgcaaggcattgctttatgtactgcaagagttacaaagaggagtacatcataatcttacttgaaggcaattacttaaatagaaaaaatggtgtgtgaaaaacaaatgttcttaagcttgaaaaagtgaaagtgtgtacccagctggaaggatgtgaaagtgtgcatggaaaatgtatttgagatttaaactgctgttgtcttctgggttgaattggtgtcatgaacttcaggtagtgaaaatagcttaaacaatacccctgaagtggaaacacagagattagtgtgaaaatttagaagaccgtgagcacattatattttgtgtgtaccataagacactggtagagtatattagtccattttcttgctgccataaagaactgcctgagactggaaaatttacaaaggaaagaggtttaattgattctaagtttggcatgactggggaggcgtcaggaaacttactatcatggcaaaaggcaaagaggaggcaaggcacctttttctccaggcggcaggaagaagtgctgagcaaagaggggagagccccttataaaatcatcagattttgtaagaactcactcattatcacaagaacagcactggggaaaccacccccatggttcaattacctccacctagtctctcccttgacactcggggattatggagattaccatttaagatgagatttgggtggggacacaaagcctaatcctatcgtgggggttggtaagagggaagactagaaaggaaagctggactaggcaaagtggctcatggccataatcccagcagtttgtgaggccaaggcagggggattacttgagccaggagaccagcgctggcaacatagtaaaaccccatctctacaaaatgttagaaaattagacaagtatggtggtgtgcactatagtcccagctacttaggaggctgagatgggaggatctcttgggcctgggaggtcaaggttgcagtgagtctttatcacaacactgcactccagcataggcaacagagcagaaccttgtgaaaaagagagaacgagaaaagaaaaagaaagaagtcaagaaagaaaggcaggcaggcaggaaggaaggaaggaatgaaggaaggaagcagggaaggaagcattctttacatgccaggaagaggaatcttagtgatgagaaaactgagtctctgagagtttgagcctcactcaaggtcactgagttgctaaatggcagaactggatttcaatcccaataatttgattcaaaacccatactctttcccatataccacattatctaggaggtgtcccaagagttctgaagggggagttagcttccatctcaggagacgaagagagtcttcttagaccaaatggtatttgagataattttgataagtttatgttgaattcattggttgagatagggaagacaattcatttcaaatggaagaaactgagcaaaggtacaaaggggaggaagtggagagattgggaacagaaaataattaatctttggttgaacatcatcaaaaaggtataaaggatggaaatgaaagctaagatcagagcacaaaaggataacatatttgaacttttacttggacttaaatgataaagtttttagacagattattattataactacagccaagtttttaaaaatattatattagtaattatatataaaatagatggatgggaaacaaacggaagaatggagattatctgtttagagtaacccagttaattataataaaatattgaatctgcatgttggcaatggaatgagaagggaagagatagatatgtaatttcagaagcacaattcacagaacttgatagagattagtggaaggaggagggagatagatgacattaattctgtgatatggtttgcctgtgtcccacccaaatctcattttgaattcccacgtgttgtgagagggacccagtgggaggtaactgaatcatgtgggcaggtgtctcccgtgctgttcttgtgatagtgaataagtctcataagatccgatggttgtataagggggagtttccgtgcacgagccctttttctttgcctgccaccattcacgaaatatgtgacttgctccttcttgccttctgccatgattgtgaggcctccccaaccaacaggtggaactgtaagtccactaaacctctttcttttttaaattgcccagtctcaggtatgtctttatcagcagcgtgaaaacagactaatacattctgtaaatttgaatgcaggagatagaacctttaaaagcaatggtaatttgtcttgcaaggcctatgtttatctctactatgtactcagactattgtacagcctggaccatagaaggtatgcaatacgattatttatctatgtactcaatccctactctgtgccagggattgtcctaagcactagcgatagagtaaaaagaaaagaaaaaactcttgttctcattagtaaaataaacatcacgttgcttcacccaaactagatcaccttagtcccttttattgttatctctgtgtcactctcctggcaggtgagtgtttctgcttttaagaatctgtacctgtgtcttgctttagataactgtcttcagattatctgagtcattttttccacttcagcaccaagtctgaagtgccggtgagtttacgtgcccccacccatatccttagcgaagactgactattgcagtcttgtgaaagtacagatcccttgcttcatatagggacaaactcaaatacataatttgtactccaaagttgtcctgtgggatcataataaagccacttctgtagggctttgtttggaattacaccttagcttggctccttccccatccagacctgcagctttacccactcctttcctgattgatcctaggagtacctccttaactaatcactttcccattaagccacatctcagtgtctgtctctggggaacctgacctaagacatgtagtttacattgcaatgtacagagacaaataataaacaatataaataattattaataagtttcatactaggccgggcatgttggctcatgcctttaatcccagccagttgggaggccaaggcaggagaattgcttaaagccaggagttcaagaccagcctggccaacatagcaagaccctcatctctacaaataaaataaattagccaggcaaggtggcatgtgcctctagttctggctacttggaatgctgaggtgggaggatcactggagcccaggaggtcgaggctgcagtgagctttgccactacacactagtctgggcaacagagcaagaccctatctctaaaaaaatagatattttattaggggaagttgaagttatagagggaaataaggaaggagatgtggttagagtgtgtgaaagtgtgtgtgtgtgttttcagttgtaggggatggtgttcaattttatatagcatggttggggaaggcatcactgggaaggtcctatttgagcaaagactagtaggtgctaagggaatgagccatgcaaatttctgggaggaaagcatttcaagcagagatgaaagcaagtgcaaagccatgagctgggagtgtctggagtgcttggtgagaagtagccatgtgagaaagtacagggcaggagacgacatgagagaaggaagtgaggggggtgggcagaccttgcaggccaacacaagccatggctcatactttgacttttcctctgagtaaatagagagtcactgtagagttctgagcagaatagtgactcgactgtttttgcgtttcaaaggaatctggctaccacattgagaataaactgaaggaggccaaaaattaagcatggagaccaatttagacattattaccagggctggcttcgtgggcagccacacaaggctccatgctaagaagggccccacacatggagcctaatgctctgcagtcaccatcttgataattttaataatttgtgtttgaatttaggttttgtaagtgaaagtcatgggactgtggagcatgttctgggtgctcagtgtctggtacttcctgctgtggataggttcaacactacctgcacccctgctccctgcccaggccactcagtgccccctttttcacctttttccagcaactattgccaccctccaacagggagaatgctgggctgctggtgggaagatgtctgtgttctgctgcccttaagcctgtcggggatttgatcacaagctcaggtcaagttgcagttaggaatgcacctcaggctggaagtgccaaggcaggtgagagactcagtgggagagagcttctcacccacctctaatccaggcatgtcaggtgcagagttccaatgctttggggggttgaccttccaccagtttgggtggcaggctcatgggaagggtagattgacttctctgaccccaattgagggcaggttgcttcagtccagcaactggtgggaaggggaatttggcagtgggggatgggggcagacattatcttctgctctgaatcagggacactcatatggctctgtgtttgccctgcaagtgtttccctgctccaatgagtacaacattaaatagcaaataaaagccatcagatcagtagacagtttgcataaataagaaaaaagctatgttgcataatcttttaatggcccctttttcctgctacttaaacaagtgtcttcctcttttttttagagacaggtcttgctatgttgctcaggccagtctccaactcctagcctcaaggaatcttccagtttgagcctctggagtagctaggattataggtgcaaggcactactcgcagctggggcctcaacattatcagttttgcactgtacttcataaattactggccctagcaattgcagtaatctaagtgaatgatggtggcaacttgaaccagtgtgctaatggtagaggaggtgagaaatgattggatccaagatatattttgaatatagaacaaaaaggtcactagaggttatgacatagtgtatgagagagagaggaaggaatcaaggatggctgtaaggtttttcacctgaggaacttgacattatttgttgaatacataaatgatgtgtcctgttatgtatctgttcatgaaacacattgatggtaatgaagatgcagtggcagaagcaaatcatagaagtatttcctagcggtagaaatattaagacttggtgacaaagatcataaattaaaggaaagggagtgaaacaactaagtcaggaaaaatacttctaacttaggaaaaaagaagaaaaaggaaggaaatggaaatatttaacaaatggtataaatttctaaggaagataagttcaattttggaaatgttcacctgaggctccaagaacctacagcccaggagaccttagctataggttgttgggaatatgtgataggatcctgaatgagcactcaggactagggatctatgttgagggcatcatataagtgtaagctggagtcacaagaatggttaactcatcaataaatgaatatgaggagagatgtatacagtattgcagaagagagttccttgtaaatgtgtaagctcatcctccatgcctgggataagagtacattcattatggtgcatgtgaaggtattgagaaaacaacttccgctttctggcagaggttaagctagtcccataatagcaatagcaagattataaggggaaactatgttatttgtactgggtcacaaatttgtctaatagcagtggacctgtgggattctataaacatcttaggtatagaaagggatccagtgacttttagaaaatcagacttatatcatatttcccttcttaacttgtagctcagtggtgcatttcttaccctgggggagaaatggaacatggactatatttagtatttgaaatcagacacatgtgaatttaaactctggctcagagtggcaatggcaaattattcaacatccatacaccctgatcactcccacatttgaaaagtgacaacaatactacttccttcacaaataatgcaaggatcaatgagataacaaatcaagaagccagtagtgtgccacaatttaggtagtgttgacattacatgaagaaatgaacccatggtctcctatgctctccttcactcctctctagttctctctctctctctttctctctctctctctgtctgtttttctctctctctcatacacacaggcatgcatacatacactttggaatgtagctattttttgagcattgttttattattatttaatttatttatttatttattttttgagacagagtctggctctgtcgcccaggttggagtgcagtggcgcgatctcggctcactgcaagctccgcctcctgggttcatgccattctcctgcctcagcctccctagtagctgggactacaggtgcccgccaccacacctggctaattgtttgtatttttagtagggatggggtttcaccatgttagcaggatggtctcaatctcctgacctcgtgatctgcccacctcggcctcccaaagtgctgggtttacaggcgtgagccactgcgcccagcctgttattattattatttcaaagaccttctgatcctggctctacctgctcattcatggggaagatgcccagacattcagatctactgttccactgaggagtttagaggctgctttttctcccccataaaagagaatggggactgatggaaaaattttaggtagaagtctttgatgaaaagaagaaatgaggaaaactgagctggaaatattcaggtatatcaaacaagtggaaatacctcaccctcataaagagaaccatatcctgggaaattttctttcttacctgattattaaaatccagaattggaattctgtgattccagtataatccatccatcaaaaccaaactactatgtaatcagattagaggtggccttcctgctgatgagccatttagagacggttgaatgagttcttggaagtctgctaacatgcacttaatacatctgaagattttaaaacgttgcagcaatgtattgccagtctacctacagtaaaataaaaatgcttccattaaaatacaggtatatttcttttatatagttaacttatttttcctaggaaagttagatgtaaagtgattatctatacactgaatcatatttcccagagatcatcatagtaagattggtatgcatttctgttaaagaaaagcaaaatgtgtcttaggacataacaatcatttaatggaatatctaaagaatgttggtcaagcattttgaacaagatgaagatggaaccagggctgggtgtgggcagtagactgttccaccaggagccaaagatgacagtgaatatacacttgacatcagtcaccaatgacaacctaattctacgtggcatactggcctggatcaatgagtctcctgaagttgaatttgacaaagatggaacaattgtgctcaggggctgcttattgttgctttatggtcatcctcttccctggctccattgccttgaagaaggtgaaattccatgaatacattcataacttcaaaatactacaagcagtatttttaagagggtgggtgatgacaaagtaatttctgtggacaattaggaaaaggaaactttcaggacaattttgaattcattcagtactttaagaagttttttgatgcaaactgcaatgaaaaagactataaccctgtggctgccggacaaggtcaagaaactgaagtggctccctctattgttgctccagttctgaataaaccgaagtaacctctcagctctagcaatccagctccacataggaccatttccacaaataactgcagcttctaaggctgcagcttctaaggccccagggtggtattaaaaaatcctggtgtgggcagtaggagtgctgcagggtcaaattgatgctagcaggtcagtgtattgaaacttggcattgaagccttggagaaagagatttctacttcagaaagctaaggaacaatgaattgatttgccagcagaacgaggggcaaaatgaccctgtattgcagaggactgtagacatgctctgtgccacagatgaagacttcgtgatatccgatgaaaggggcccacaggaggaacaagaagagttttaacaacccgaaccaggagagccttatccgaattctgcactccaaatcttgtgcttaactgttaaatactcccttttattattcttagaagactcactggtttctttttatgagcatgaagtacctctttttaaagtgcattttgcagagtttcactccttttttggtgagtttgagttgggagttttactgtgcagcagagcaacattaacatctggttagttcacctgggaaacaaagaggctgaacatggggctcaccatgtgcatgtaggtaacattgattgctggagaaggtgtttggtaatatgccgaagtggagaccttggtacagaaatgtgaagactgaattgaattttaacctaatgtgaaatcttggtagagaattttgtaataagttaatgcctaaagaatatttaaaatatgcttccatattcaaaatatcaaatgtaacacatcagaacatcttatgtgtttgacattgtatgttggaaggaagggccagacatcagaacctttggaacctggtgtcatcacaggccttacagggctgcttgcaacctcacaggcctagactttggccccaaaggaaagttctaaatgttgctctgtaaatccatttggtgtcattgaccaactgcatccaggctaaaaagcaagaggtattgttgcctggatgaacacagggtgtgtttcagccctgagatttttgggttgaagagctctattttcattgaggatttctctggaaatttttccaattatctctgaaatttctatgtattacgcttttttgggaaatgaggtgtgtccaattctttcatctaacaacgcttttggggatttgctcacatctctgagatttgaatggaggttgtttcccattttaccatcctttagttttacatttaacatgtcaccagtggtgaatccatagaggtctgcagcaaacttgatccttgcctcgttggaggaaagaatttggctgaggggaagaagtaggtttaaggtagagggagagaccgaggcaagttttagagtaggagtaagagtttattaaaaagttttagagcaggaacaaaaggaagtaaagtatacttgggaaaaggccaagcaggcaacttgagaggtccaagtgccctgtttggcccttgacttgaagttttatacattggcctagttatggcctggttacggcgtttgcatctctcttccctttattttcttttggagcaggctgtacacatgtgcagtgatctgccagcacttgggaggggcaatatgtgcagtgtgtttactgaagttgtgtgcatgctcacttgaggcaattttcctttaccagtagagtgttcctgagaaggtcatatgccagttaaactctgccattttgcctcttaatgtgcatgcttgagctcactcacccaattcctgagaacttatcaggaagcctctgatcaccaggttcaggtgttttttttttttaagccattaggggactgtctttacctggtgctggctaagaccaattattattttagacagtttagtaaccacctgaccgtcatctgatggttgcctgacattcctgagggaggggctctctactgccttgctcatgtctgcctaactacctactctaacattgcttctcttctctgctccccttgcccactggggacacctctttgggttcttaaagtttgcagcttggagttggaagtgcagcaggcaggtgggcacactgcaaattctttgtggacctctggcaaagggaataatcagggaaggctctggttacctctgcaaagctgggatgtttttggtatctgctgtccacagctctccagttctctgaatactttatcagtacactaatctcttaagagataaaatttattagtgtgttgctaaatgttcattttcttttacagaaaatacagtaccatgtctgaattattcatatttaaaatttgttattccttaactctccctcatttgatttgtgcacaacctattccatccttttgtttggcagaagtttgcaaaatatgtgtcactcactgagattgttcagcccctgatgcatttgtattgatttgtgtctggtgatagcttgtcctaaaatgtgtgtaaaaagtaaacattttataacaaaattgttgtttaatggatgctttgtgtggaattcagagaaaaatccagattcagtgattaacaatgccaaaaaatgcaagtaaatagccattgttcaaatgacagtggtgctgtttctcttttgtggttttttagacttttgttacctaaaattctgctttattagcaactcatttttcacctgatgtttcttgacaggctttttttttctattttaagtagtttctaaataatttttttttatttcaagaaagagaaaaaagaatattgctcaatgcacctaatataaaaataaactataaaaaataagttagtttcatattggaactaaacctagcattaaaaaaaaaaaacagcttttctcaccagtaaacactgaacgtgagttcttcatattctactattctctgtttctactctacagcagaaaaacacgtaagtctggttgttcagaactgtctccccattatggaaattgttagttacagaaatgggctagtggattcaggttaaaaagagaaggatacatatacatgtgtgtgtgtgtgtgtgtgtgtacatatgtgtgtgtatatgcatatatacaaatatatatcacagcaagtaacaatcaaaaagttgataagaaaatagacttgaacctatggaataagaaagctagaatatctgaaaaataagtattcaaataatatttagcaaatcttttattggtttatgtttacattactgtaatgtaccaaagaacccaaaaaactacaattgtagaacagaacttaaaaggccacttccagaaaaaaagactttccttagtgttttcagctttcttaattcttgggcacaaaattttctaagtctttgcgcacttatccacaaccactaattacaatataaactaatataaaattatgtcctcatctatgaaatttaatatgccattttcttagtataaatttatttctagagcatgtattattaatgtggatctttgtagaaaaaaattgtggtacaatgtttattactacatacccttatttttttaaattgtcttatctttcatataactttttgctgatgtcatcatgtgtaataacatgattttttaaaattttaatttagaaaaaatatattcctcttgtataaatgagaaaactaaaggaaaagagtatcgaaaggaaaacattatagaaatatcagaatttagaatcccaattcttaagattttttattttctgactacttcaaataatatcgtttgcctttctcattattcatgggtcttccaaatatagtgtctggccttaaaagttgtaacacaaaatcttctgtctgaaatgtagtacaactgaatgaaatttaaaaccttcacgtaatatatgtcatatagaactctcataaaatatcagtatgatgtgataacaaaggtcagaacaaatggaagaaaaaccaatgtatgatttctgaaaaccttatcctgggaaatgagaaacagactataattctttacttacatctacattatgcaaaagtatctttgatgtgaaaaaatactcagtgttgttcattcgatgttttatatgttttggtaaaacattttgtgttcacccttttaaatattccaagacacactcactggctagaatcaatgggagagaaagaggtgactctataactaatataatgttaaggaaactgcacatatcttggtatgtttctgatagtgcataattccagaaaatgtcttaagcattgcataattgttagaaacatgaaatctgcagccagcaagcatgagttccacatctgaccctactctttccagttgtgagaacttatttgtattttaaactactgaatttcaggatgcctctgtttattcctgtttctttattttttaagttgacagtatttgtacatattcatggggtacatagtgatatttcaatacatataacatatactgatcagatcagggttattagcacacccatcatctcaaacatttagcatttctttgtattgggaacattcaatatcctcctcctacctatttgaagttctataatattgttaagtatagtcatcctacagtgctatagaagctataacttatttctcctgtctagctgtaattttgtatcctttaacaaatctctccctatcttccccagcctctagtatcctttgttccattttttacttcttcctcatgttttaaagggaaatgattacagtatctatttcattaggttgctataaggaataaatggtttcatagctcttaaaatagtgcttgacaaaagtaggtactatgtgtagatttttattaaaaaaagtagatactatgtgttattattatgactaatcttctcccaaaaatatgtttggtaaatcatttcataaatttgtttattcttaatttattttgaattagaatcatttgtataacaagttggtatattgctgagcacatctgtaaagtaagacctgaatatggatttgataattgaagttgacactcatcatagagatttatgaaatattgtgcgcttgattgcagtaggacaacttactatggggaaggaatcttgtaagtatcttgcctggccagtatacatggaagttggtacacatggaagatataccatatgtatatatcccgatattgataatgttactttccaaaagtggaggcactgcaaatatgatgagaatgtgactagagcacgcacttgtttgttctttctgtccagcattaatttcccccttattccagtaatagtaactcaacaactctgctctttgtcatttcctggtgtttttttcttttcttttctttcttttttttttttttttttttttttgagactgagtttcactctgttgcccaggctggagtgcagtggcatgatcttggcttactgcaaactccgtctcctgggttcaagcgattctcctgcctcagcctccccagtagctgggattgcaggtgcccatcaccatgcccggctaattttttctattttttagtagagatggggtttcatcatgttggccaggctggtcttgatctcctggcctcaagcaatctgcctgcttcggcctcccagagtgctgggattacaggcatgagccaccgggacttgtctgtcgttcgttccttccttccttccttccttccttccttccttccttccttccttccttccttccttccttcctccctgtctgtctttctttctctttctttctttctttctttctttctttctttctttctttctttctttctttcttttctttctttctttctttcttcctctcctttctttccttccttccttccttccttccttccttccttccttccttccttcctttctctctctctctctctctctctctttctttctttgtcttgctctatctcccaggctggagtgcagtggtgtgatcatagctcactgcagcctcaaatgcctggtctcaagggatcctcctgccctgatctcccaaaatgctgggattacaagcaaaagcaaccttcccagctccaactccacttttcagaaatgcttctgtaccacaatgataaccctgactactcataggtttcaaatgaggactcttccgtgtttcaaggctacagcatgtggcttaggagaggccaatcaaagacggcattaccctggacagagtaattacttcaggatgggcatgtgacccaccaggtgtcagtgagatgcaatgagtttttcggagtctttcttcccactgaattgaggtctggaaggttgggaggctagagctgctacagcatctagctgtagggaagctacggctaagagaagaatctttaggaaacttatcactatgaaagtcagaacaaaaggatacagcataactatgagctggtaacatcagctgagctcttgaatcatcatatgcctaagactagccctggacaaaccatgaaccaataaactcctgtctttatttattttttacttcaattagtttgagacatctttttctcttacaatcaaaagttatctgctaaagtgactaaaatattattttgggctacatcttccccttgctcatttccaacaaacacattttcttcttttctccaaatcctttattttagattcagtgggtacctgtgcaggtttgttatgatggtatattgcatgatgccaaagtttgagggcacgattgaacccaccacccaggtagcaagcatagtacccaataggtagtttttcaacacttgcttcccccaccctatacccacttatagtccacggtgtctcttgttcccatgtttatgtccatgtgtacccaatgtttagctcccacttataagtgagaagatgtggtattttgttttctgtttttgcccaacaaatacattttccaatgaaaatgatgaagccagaaagtatgaaatacattgatttaacaattagaactgttctaattataattgataccggtgcctgttttctttttatgattgagtaatgatcacagatttttgctatcagattttgagtttgaatcctgcctgtatgatcttaggagacttttcctaatctcagtgtatgtccttacttcagtttgcaaataaggataatgaaagcacttatccaatagggttgtgtggaggatgaaataatacagggcaaatgtcttagccaagtgactggcacttagtaagtcctcaaatcttcactatgatattaattgaaagcctagcattcacaatctcactggtttatcagttcttttttctggttgctttttagtgacttaaatcagagataaataagattggtgtctcactgggttaatattttttctggagagagttaacttgtgtggcacaggccatctctttattgaattagcaaagaactacattggatttaagattatctggggctgaggctaatatcaaatcctactctatgtttgtagttccttggctacaagcctacatacggtaattgctgtttaatatgaatttttatttttaacccttacatatagtaagggttaattgctatttaatatgagtttttatttttaacccttccctatttacgtcatgctttgcttaaggaccaagatatattctgagaaatgtgtcattaggtgatttttgtcattgtgtgtacctcatagagtgtacgtaaaacctagatggtagagcctattacacaactaggttacatggtatagcctattgttcctaggctacaaacctatactggatgttactgtactgaatactacaggcaattgtaatgcaatggtatttgtgtatctaaacacgtctaaacatagacaaggtacagtaaaaaatatggtattataatcttatgcgaccactgtcatatatgtgatctgtcattgaccaaaaatgccattaagcagtgcactactgtactttctctttactttaaatttgaattctttatatgggttgaatgactttctgacatagcaaataaaaagcatgaggagaagcattatctgttaacaaaattaacacttaaaatcaacaaagttttaatgtttcgttccaagaaaagcctgtggaagatcagttccacaactgagagctttgggctgcttcagacatatgtctgtgtgtacgctgtgaaggtgtttctcttcacagttccccgccctctagtggtagttacaataatgccattttgtagtccctgtacaggaaatgcctcttcttacttcagttaccagaatccttttacaggaagttaggtgtggtctttgaaggagaattaaaaaaaaaaaaaaaaaaaaaaaaaaaagatttttttttttttaaagcatgatggaattttagctgcagtcttcttggtgccagcttatcaatcccaaactctgggtgtaaaagattctacaggggtaatgttttattattcttattatgcttattctctgtgatgcttctctacctttacagtagtagaatccttggggaaatctgcagagggaccactttcattttgaagctgctggctgcatgttttagcatgtctcttctattagagaatccaggcatggcagtttcctcccccagtgtgcaaggaccatcttcatgcctatgtctgtcgctaggcatgagggtctctaggaatgggtgaaaaaaatgagggatgttttggaggcactataatactggggagggcagtctgctagctggtagctgaaaggtcctggtttacttcaacattttttttaaataaaactgtgcagtagtttttgttattttaggtttccctctgttttatctggtgtatgctgcagaagtgaactgcataacacatttcactcttagaaaatgcatttcatatatttaaatgacaactctgactcctatagtatgggggtgaaatagattgattttttgaaaagatggaaaaaatagattaagtgtcatttaggagtcaagatgttgattgtattgtttcaaatagcatagaaactcctgccactggttcagaggtaacatttggaatgactgatgtgctcttttgagttatctactttagtctggtgaaatatgatttgaataccagtaaaaatctatttaggttattgcaaagactcatataataagagtttgcttgaaaagataaactatcgtaaacttattattttttctcaagtccaaattctgatatggacactaagactgtgatgctacgtttttatgaaatgggcataatttgaggaaattggctatctctacagtatttcctaaggtactgcaaatgtgttaatttaagaagcaattacactagctagcagcaggttgctaagccagggggtccgagctacagacctctgatgtggatgacttcctgcccggtttggcaggagctgggtcccttcctgtgcagcttccgagcagttccaaacacaaccaggcatcttctgctccttcccactccctttctttcaagcaggatctacctatgtttccatagcctggcattttaggatttccagagatttttacccagtgaattgacttggaataaactcttaaatgtgataaagtgagccaaagggcacgtgcaaagacttggagagatatgtgcaagatcctcagctcaggttctacaatttaatatgatgtttcatctcttgttttggatctctgctattttttcagaaagaatgctgaaaaagatggctgccaaaatattcacacaagtgaaacagcaggcacaaaccagtatcctccatttctgagctctgaattgcatattttcccacaagtagcacaatcacttaaaacattttgggagtgggagattagattacctcatagacacctactgaatgtgagagatagatctccatgtgagcaaatggatgcacatatgagattccctgaataccaaatacagctttctttgaaaatattatagctatctgagtttctatgctgtatctcagtgctcagtgtcatgtaactgacacaatcaccttttattctaatggtcattgctttttttccctccctgtttctgtagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaagtgagttcttagtcaagttgccttcactgcctatttactaattggttctgggctagtcccagggatgatggtgaagaaggctggcctccttccctctgtctaaagtatcactaagatgctggatgggcctgaccgtgtaatggaccaatgatcctagaagtcttttggaagcactcatttgaacctgcatttgtgagacaggcagagaactggtgaggcatcctccagcgcgggaattaaggaaggacaaaagcctattcaccttcttgaatacaaattatatgcttaaaccagtgtaaattgaccctgattccctaataatgttgagaagcaaaaactgtaaactaggagtctatttaaattttattttttatatttgcaggagtagtatctaaattcctctttatagtctctagctctccataagtcactttgatcttcagtgggtttaattattcctttataccatactttctcctttctattgctctccacagaaggaataatagcaggtgacttgtaggtgccaaataagattctgagcaaagaacacacctggaaaaccttgaagttctcatgagaaaattttctaaccaaaaaaaaaaatcaaagcctcaattttgtgctttatgtgaattataaatgcggttttaaaatacttacattaaaacttgataaagttgctaagaattcctatggcattgatcacaaattttcttaataatcctcatgtcatttatcaaatttaggaaagtttatagtgctcagaaaaaaaaagcatctatcttcatgtcatatgatggtaattattatgttatacactattttacagggcaatatttataaataatggttttacttttctcttaaaatattcttaatatatattctaagttttattttatgtgttgtgttttctttttcagacgtttatagtattgaataaagggaaagcaatctctcgattcagtgccacccctgccctttacattttaactcccttcaaccctattagaaaattagctattaagattttggtacattcatatcctttttcaaatcgtcacttaatatgattttcttctttgaccaagttattgagctacacattttccaaaatatctgtggttggcaatgttatgtgttctttctttttctttccttttactcaatcgttagcatgttgcaaaatgagatcacaggtaagtgaattactttcccccgtcttctaagtgtttcttctctacccaactcactattacttctttcttctcttttcttctcccttacgaattgcttgccacatcccaagcctttctcattaattttgaccatgttaccaggctttcctcctgtaagtcttcaatttacaatgttaggtaagggagtaaactccatgagctaattttctttactgcttttacatttggaaaataaatatacataatctgaattacaattttgtatgtttttggtctgaattttatgactttcttctattttagcatttaaaagctttgagttagtaagcgtttacaattgtgtctgtaggtataacaccctttcaaatacttttccaaatttgtttcgcaacagccttcttattgatcttttgctttctattcttttcctttctttttctttttatcacttgttcctatgttttattgaagtcacaagtcttgctacaattatccctctccaaaggattaatgtctatctatccatatacattctcattttattttttatactccttattgaagcacctgctttccaaaaatgagattgatgacatcttggtgggagatggcaatttgattgattccttgaaattaaatagagtagttggaaatgagagattttattctaggccagaaacaagtcttgttgacagccagtcttgggaatgccaatgaagcaaaggcttggaagactgaagctgtgtggggcaggggcatttacacgaagaacacagaagtcatgggaggaggagtgatatgcttcaggaatcagaggtaaggcaggggaactgaaattaagcaaatcctcagattaggacagcatgttatttcttcttcagaaagaatcgttgcttggaattccatgatgtggttagcccagggcctggtattaaggctttcagtataaatattctccacctttagcaggcctagaaaatatttgaattagataaggtatggaactaaattaagtagggaattcaggaaatgggataagcctggtacagggtacttatgtcatttctgggtggaggggatgtaaagcatgtccctagacttgcctcccagtatggcaaatgttgtctttagaagtgtaacattctgtaaagtctccttttaacctctaggttgttcctcttccccagtttaggtggatatcaacatcttttatttgatgtttatgtttcatgttttaagatttcctagtttcttggcattaccttaagcaataatgttttcttacctctctctgttttccaaataagagaacccagtagcatgtggggaaaaagatgtctttgagttagcattagaaataaataataaagttggaatttatatttgggtctcatgattataaattatgatctattattatgtttcaagcatttgtaatctgtgcagtgaataaatctctgcataaactattcattatattttaaaataattgtatgttccttatgcaaacgtaatttatatataaaattacgtggaaaattctagcctagaactagacttctgttcctagtagacattgggaaaatattcattaaataaataagtgactagtaagtcagagattagagaatcagatacaaaaaaagtgaaaaaataagtttgaatggatcagaaaaaatctttcttgtcgtgcatctgaatgatgagatggagttaagaaaacccaatatatttgttttttacaaaagcagatttttgttttaaaacttttgtaatagaccatggaaaatctcatgaaaactattgtccccacttgaaaaaaaaaatcctaggagattatgaatccccatttaaaactccctggaaaagagactcctggtggtagagggtaagggcagtttaagaaattctgatcagagaatatgagtactaaggacacagtttgtgccaggacctctctagatatccagatacaacttgaatctgtgggcttgtatttgcttcctgggggaaagaactcaccctccacaggctgaagtcattgggaggcctgaggagatgcaggttgaaatgtgaagccagccaggcaaatctattaaggtatgccaagttgagctgttgattctctgagaagtttacagatggcttagagtcacaaatttattccaatgtagaaaattagattttaaaaagtctctaatttcctgacttaaagtgttatatttcagatgtctcaccttggagcagagatataacaaaaggcagtgaggctaatagtctaagatacatgaatccttccatgttttggtgatgctggtgcaattgatcaaatagcccagtaaagttagaggtatatagatgctgtagttagtaactgattttcacaataattttgtcctttattcctcttgttgcaaaccctagacttaaatcctgattttctgacttcaagtacagtgtcttttactgtaagttaaaaatgcttggagagatggtcatggttgtttggccacagttgggaggtcattgtatatttattaccactagtttataaaccaacaaggagccattcatgttaaataagtttttattttaaacttggactaatacctctatttcaaacaaaaaccttgacttgtttctcaaagagctgttatctattaggagctattgtgtatcaaattagcttttttaaaaatttattttggctgaatgagaaattatgcttgtgatatttttaccagggtgcattctgaaaactgaaaattcttttgatgtgcctagtgtcttatttgatatttaaataaaacatgatttattttctagataacaaacaagttaaaaataatctatgttcctaaagttccctaccaagcttttaaatgtgtttcctgtcagcttttattattttaagttaatatatgcacactcctctaatttattttgcatttgttactcatttgttcatttgcaagtacttactgagtatctaccatgtggtagatattcttgtaagcattgggatgcaacattgaacaaagtgaagttcctactctcatgtagttacattcatgtgagtgtgtgtgtgtgtttggaagaagaaagacaataaacaaatacgtcgattgggagctagtgataagtgttactaagaaatataaattagtgtcaaagggaggagtgacaaggtgttgttttagattgtatggccagtaaaatcctttctgaaaaggtaccagttgagcagagatccgaaggaagcaaaagagtgagatatgggaatctagggataaagtcagttcaaggagaacagcaagtatgaaggtaaagtctgaaggtggtggtgcaactagtatgtttaacaatcagcaaggagacctgagtggctggagcagagtgggaaaggcaggaagcgagaggatgacatcagtgggagtgaaggtcaggggctaaagttgtaggcgaggtgcagtgggtcattgtgaggacaccacatttactctgaatgagactccaggagggttttcagtagcaggatatcatgacttgactcacatatttaaaagatcactctggctgcttcatggagaatagactgcataaggggaaagagtggaagcaaggagactgggaccgattgtcattatgaaggcaagagagcatggtggcttggagtatggtggaaacaatgaggatggtaaaatgtcatcaaattttgaggtattttgcagaagagctgacaggatttgctgagcaattggttgtggtgtataggaggaaggcagggactaaggatgattccaagcatttagtctggtcaagaaagaaaaatggagttgtgttgactgagcttggggcaacttgagcaaaccaatttggtgggtaagatcaagatcttggttttgaacatgttatgtttgagacacctattagacatcattggaggagttgaggagttaggtggctgtgcaaatctggagttcagaaaagggctgggctggaggtgttcaactttgggagctgtcagtgtacagctggtatttaaagtcatgacattggactaggctgccaaagagctgagaccctccctccaaatcacactagtaatgctgaactacctatcatttgaaaatggtaggaaaatggaaaacataggttttggtatcagaaaacgtagattcaaaccctatctctaaaatttactttttagctatatgatcttagtccaagttactccaattctttcgaatctcagtttctctatctgtaaaattataatcacagcttagacattaataatgataaaatgtatgacaagtatctagcaccagatcccatgctagtacttagtaggtactcaataaaggatatctatgacagtaatagctaaaattctagcagcaactgctgtaagattagcaaaaaggaaactctcatattccttaaggaattgcacaaagaactttatagaaatccctactctgactctgcaaacaaaatctttatatagcaccagagtttagacctgcaactgacccaaacaatgtggtcagttctgtctcattttgtagatgagttcactgaaacccagagatatttagttttttctaaggctacattttctatcagtggcagagctaaaacttcagaccaggttttttgattcttggctctttgcattttgcatccaatagaaaacaaatgatttttaaaccctcggatttaatatacttggggcattgccagtgttcttgttttatgcatttcaaaggtgcttcttagttgctccaacttactgattcattaaatagtgtccatactgagatataaaatatcatggttttccatgaaaagaaatatacaggtttatatgaaagcagatgacacaacaatttctctttcttttgttttcaatgctcatatgttatcatttagttatctactggcaaataggagtttgttcatattaaaattaaacaatccaatatttaacactgtatatgtgacatttactcgatttttctgctggctcagaaatatgcactggtatgcagaaaaagacctattctattctacttcaaattatccatttttacattagaaaacctctaacatcaggctatcttctacttctagtttatatataggttaaaaactcctctgcaacttctctggatattatacattattacaaagtctctgaacagagcataatgtcttttccttcctatagaataacaaagaaatgtcctataattttatactctataaatgagttattaatggtaagaaaccaataattattatcttagtggataatgactgtatactgtaagaaaagtattatccacatttatataagaaaactgagcctcaaagaattaaacaaattgctgaagcccacatggctggtaagggatgtatctgaccatggttcattgctctaaatctcatggtgcttcatcctcgctccacggagacaggggtgggtgtgccagtgttatgatgatccaggctccatgtcaagggctacttaaacaattttcactaaaaacttgaagaagtgtttcttcataatatacacaaaggaaatattttacatttgccaactcgcaggttagtatcaatcaacaggtttacccactgttatgtatacctggcataaagaaattaatagattaaaaaacatctttgtcccctgatattataaaaggtttatctgcctctattttattttacattgaaaagttcttaaagcaatattgttccaggatacagtgttcttttgaaaaatgtactctatgacttggattacacatttaaaaaataatataggatgtatgcattttgctactagtttgagccttttgaaatctgctttgacgtggggtttctatacttttttgatgcatggcatcaccaatgcaaaatccatacctacattaaatacttttgtatttgagtttttgttatttgagtttttttttttttttttttttttgagacgggttctcgctctgtcgccctggctggagtgcagcagcgcaatctcggctcactgcaagctccgccttccgggttcacgccattctcctgcctcagcctccggagtagctgggactacaggcgcccgccaccacgcccggctgattttttgtaattttagtagagacggtatttcaccgtgttagccagggtggtctcgatctcctgacctcgtgatccgcccgcctcggcctcccaaagtgctgggattacaggcgtgagccaccgcgcctggccatatttgagtatttttaagatcatctgaaactatttcagtcactcaccagaatccaggaatttgtaaagtatgtgactgatgaaataaattaacaatgatttagaaacttagtgaattttaagcctttctatttagagatacctatcaaaccacaagcgtaaaaacttgaccctagttatctactatttttctattaaaagcaaaattgttctttttatgtatcagaagttttaacttaagtgtatacttttattaaaatgatagccatgaaataaggaaaatgcctgttttcgacttattatcagtgactaattagaaaataattatttctcttgttaatgttgaaatatatattttacttttttatatataactaaattataccactataaagagtaagtttttaagtgtcataaaaccattgccgagtccataatgcagcataattgcataaggctgttaatttccaccttatatttttcttatatttttaccctcaaaaaatgtagaaacttgtgtaaacaatatgtatatatattttagacagagtctcactctgtcacccaggctggagtgcaatggcgtgatcttggctcactgctacctctgcctcctgggttcaagtgattcccctgccttagcctcctgattagctgggattacaggcatccgtcacgcctggctaatttttgtatttttagtagagacagagtttcaccattttacccgggctggtctcaaactcctaacctcaagtgatctgcctgcctcagcctcctgaaatgctgagattataggcgagagccatggcacctggccaacaatatatttgaagacaaactttatgctgtatttttaaataatttatcagaaattgtttttaaaaactccatttagtaacaaatgaattgcaaaattaatttcattagtcaactgacactgtgaaatagcaaggctataatggtgaataatatagacatgattcctgtcctcatgacgctcagagagtagttgagaagatcatcattaaaatttgtcattagaggaataatataagggctgctggggtatataactggtaataggtcaatctgagtactaaagaaaaagagaggtgacatttccaagaccctaaagtcagaaacagcatataaaacattcataacatttgacaacctaaaataattacagtattatccaaatggggataatgcaatgaagagaaaagaaaatgaaactggagaagtagacagggatcagacctcctagcgtcttgactctgtgttaagacatttgatcatcatcctaagagtaatagaaagctaccaaaatgatgcatattacatttacaatggtcgtgttagcacagtatgcagaatggattaaatggagccaaacatgaatttggaaacatcagtttagaggagactgcaataatctagatggactattagatttgatgctagtcttgacagacacttggaccatgcagtgatatggggatggaaaaaagtaactgaatccagagatagcaggcagaattgacaatatttgatggttaattagatatgaacgtttaaggggagacagaaatctaagatttctcataggtctctggctatattatgcacattttataagacacagagacgtcaaaggagtaagtaattagcaggaatggaggggtagattaaaagatacttttcaaaagttcagttttagaattcaaaatttgaagtgttgataagatatgtaagtacagatgtcctatggacaatcaagtatgtggaattcagaagagcggtctcacttggagagaagtatctgagaatggtgggtatataatggttatgtttgttgagcaatgtttgttgatggactacactaggatgaggagagtagaagagaggtagatggcttacataccttatgtctttcttttcaaaaagaaaaatgccacatttcaaagaatacagagaaattggtgccctgaggcatgaagaagccagggaattggaacctcctgaaagcagagggaagataacttaatgctaaggggaggaaccatccttgttgaatgctgcttagaaagcatgtcaaatataatctcaaattatccttttgtttttagtgacaaaacgtgaagatgttgccatctttagaaagaaaagctggtaggctgaatatatgatagatatataagaaaaggaaagataagcagctctttcaaaaagtttggccatgatatggaaaagggagataaggctgtagtagttaaggagggttgtgagtcataggagagaaatatcctttcccctatgccaggacaagggagacgtaagcaagtttgtgttgctgggaaaaagccagtaaggtgggagccattaaggataagaaaagagagagataagagattgctgaagtcttctggaatggggaaggtgtccagaataccggtggagggattggaaacctccccactgtaacaggaaggaggaaagaattggtctcaatgtggaaaagtttgttgatttgggggtgggaagtggaggcggggcattgtgatgctgtctcttctctgtaaagtagaaaataagttttcagcttgaaatggagccggaagaaagaagagggttggaagctggaggaaagtggagaatatttgaaatttttctttgcagagagtgggagatggagcctagtaggaaaatacaggactgtgttgaggaccactgaggtttgtgaccataaatttagaatggtgccaatctgccacggggtgttatttttccccaatagggctcagcagaccaacaagcacaggggaccctctagttttatataccaatagcaagtcattctttatttaatttagttttttgtttgttatagcaataaagaaaaattgtgtttctttgaaatggtattttgtgtgtgtgtgtgtgtgtgtgtgtgtgtgtgtgtgtgtgtgtgtgtgttctctagattatagtgccctcacgtggctgatgcacatcatttacttatgagtgttttcatatggatgaaaaaactgagaattaagcatgggccttacagcacagctactaaaattaaaaaataataattattattattgttttgactaaaaccagtactagatgcaaatgaactttctttctagatcaacacaacattgtccagttgtaatagtgttgatatttcattatgtgtaagtaatgtgatcatttatagtaaaaacattaggagtgagaaaagatatgaagagcacgtatttcctctctggaatttctataattgtgtccagattcacaatgataaagagtgccactttacataatggcaactaaatctttattatgctttttattaaatatgaaagtcattactattatctgatactgaatattttcttaaatagttgttttggtttttgtcttttgctgttttttaatgtcaaggaaagtgaagggcattggctatacctgcaaagacaaagtgggatagggtgaaaccaacccaatatttgtaataaactgtgttctgtatgatccaggaagcaattcattgagcatctattacgcactagggccattaagttgaaggagacttacatattttaacaaatttgatcttcatagcaatcctgttacatgattactttttcttacttttataaccaagtcaattgagattcagggaacttaataagtaattttgccttagttacaaaccccagaaatgccagtgctaacacctgccatcttctctcatagttcaggattttatgagcaattacagtatattataccctctgtttagaaaggaccttattataagacattccaccagggtaacttttagaatgatgttataatacatttaattaattacttgaattgtcttgttgaatttttgccagggtttacatatgtgctgaacttgcagttttaatgttcagttgagtctgtcgttaagaaaatttaagttgataaattattcactgatgaactactttctttgcatttaatctttttaattgctaaaggtacctaaatagcctcaaaatagttgatggcttggcctgaagacaagatctaaatatgaggttgctgagttatagaaatggcaaaaaaaagggtcaataatagaataataagcaacaaaataatagtaagcactaaagttttaaacttcatggtggtgaaggcatggtagtgcataaaagtaagatttttccattgaactttgtcttccttgacgatattctactttattcaatatgctcattatgtgcacgattcttaccaactgtgtatttatgaccatgagtaaccctccagactggacaaagaatgtggagtaagtataaatatttttcaatattgacctccctttatgtttcatattgtgcttttaacaccttgagacctcctcaatttctttaacaaatcatgctagctactgttaaccagaccctgattcaaattcatttctgtcactaaatgtcttctaggacaaagcttgtagtgggctcacttagttgtgtaaattactgcagtagtttgactgctattatctgcagccctttatcttctttgtgagtcttatgttcttttgaagatcaccagtgatttactaatatctactgataaaaagtatacctagtttttatgttccttttttaatgactaccacagttctgtgttactagtatatgtttgatggcttttaatggtgcatattttatgaaatacaaatgcttcactcatttttgtattaatacctatttgctcaaatcggactgaatgccagtgtatttcagattatgtcttcatatagagccacattatttggatcctttaaattaattaatgtggaaaatgcaatatacatttatttacagtcaatgagaatgtcttttggaatttaatgtttcttttttgacttaagccccacctaaactctatatcgtagggggaccaacctggaagtgtctaatttttgtttgctgtttatgtcatctttaagatatgtacttgtaaattaaccactagatttttaatgtgagcttggctattttctctcaggtatacctttacaggaatttatacttttgaatcacttattaaaatacttgcaaggggcttttgtttagaagatttcacatttttacgggatccatggaattggttggatttcacagtcattacttttgcgtaagtatcttaatacattttctatcctggaagagtaaatcactggtgggagcctatactatattttccttggtggcttgccttgacagaccaagcatttttcttagtaatcatagttttcttccaatcaaattatccagtttggagaaattaggaactatcatagtaaattacatggctttggtttcaattagcactgtaaagtaataaagtttcccaaataacagagattatgattgatgacaatgccattttcctcttaattgggaaagctgatggcgacactcatgaaattaaaaaggtcttgatgaaagaccaaggaagacgtagatttccctaaattctgaataactctgatttaattctacaggtatgtaacagaatttgtaaacctaggcaatgtttcagctcttcgaactttcagagtcttgagagctttgaaaactatttctgtaattccaggtaagaagaaaatggtataaggtggtaggccccttatatctccaactgtttcttgtgttctgtcattgtgtttgtgtgtgaaccccctattacagatatgtgacagagtttgtggacctgggcaatgtctcagcgttgagaacattcagagttctccgagcattgaaaacaatttcagtcattccaggtgagagctaggttaaacaccgaggctgactttagctacagtggtgctacaatcacagcttttgtgcagaagccttgttgctagttgcatattgcaaataaatatgtaaaaaagcaagaattggtacatcattttttggatggatttgattctttgctttttactcgttgctttctttaaaactattctaaatcagcctttgagtttaacaagtgttgcatgaggcatttgcagtaacaggctacatggtttgcatcctataacatcaagctttccgcatagaagctagactaagagacattcagactgatgcaaatttgacagtttaggcctaaaactggcaatcttttaagctgcagataaatgaaagagcaagggatagcatgagtgctgcatggggctcagatttcagatgtcttcctttttttaacccatactcaagcttgcagaattcacaaatatataacctcataattcatcgacttcaagatttcttactactctattcacatagacttttctaaaaccaataaggggttagggagtaagacatctgcaaataaaagcaaaatatttacacaaggttgatgtttaagcatgaataacaaaatcattcttttgctctaaagagtgtttggaaatacacatttggttcatttccattcacagttttctaatgaacatacaagttctgctttcattcattttcaccagctagcaggcttttcatgaaaatgttattcaatcacaaacattaaactaatattgttggcattctgcatgacatttttattttccaggacaagctcatgatatttttgccggtaaaatagctgttgagtagtatatttaaattcccccttctgattttgtttgtaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtaagatatactctataaaccattaagttgtttagttctctaaatattaaatattatatataatggaaattatctcaatttagatgtgaatcaagtgacttagactaatttaagatgatttaatacatataaaagagatatcaaatgataccttattctatttttcttatctgtccattgatatagtaaaagttctcatttgaaaatgtgttgtcttatactcatgttgaaagtaatttcatattatgccatattaaaaaatgtttatttggtagacattaatcaggtttttcagtcattttaataaataagtcagtagtttgaactattcagtgtattccactgaaatgtgttaagaagactgaggggaaataatttggccctatttggttgatgcaacatatgtattgagtacatatgctatatctgaaaatagagaaaccatttatcaagatgaaataagaatttgtgtgctcctcagaaggttaagtaaccctgatttagccattcacttattcatattctaattagtccctttagtgtcatcattgtattgtagttaccagtttagtttgattatatttaaggtatgaacatcagaataagcttatgccatatacttcagcatgatttcttaacattgagcccagcccctctgtcatttttcatatgtgtgtgcatgtttgtatgtgaatataaaaatacgtatgtttgcatgtgtgtgcatgttttctgagatcatctttgcaacttactgaagttatatgtcatgccttaaaaataaaaactagatagctctccatagcttaaaaataaaaactagatatactcagacaacatatctctccaaagaaacaagtttattttcttcatttgaaaggcagaaatcaagcaaaaatttcaaacaaaacacttatttacagtatcataagagggaataaatacctaatcccacttctcacaggaaattaagttaaaattggcgggaaaaaatgtctgaatctattttgagcctggggagaaaagtatatgtaaggtaaaatttatttgcatgaaaacacctagaaacaacaaggctttcttctttcttactttttgtgcccagcaatagactggcagctctttcttaatgtatcccatgcaatttgagcttatatttgcaatgaatgctgatataagaatgttatcatagtaattccttctgaacatttttctttttaacatagatttgctaaccatttgtataatcaaaaatgttatatattgatatttgttcaatattgtgaaaaatctctttagccatatatatttattagtttatccatctcattatgattgaaaacatttgtgagctttgccacctaaacagggtggctgaagtgttttacaggattttaatgattctttctattcctttctctttaaataggtcacttttattttttagaggggcaaaatgatgctctgctttgtggcaacagctcagatgcagggtaagtgatgcttcctactgagtttcagtccacactgctccatcagtgtcaataacctgccacctcccactcatccagtcccactcactcctcactcaaaaccctccataaattctacttcacggtgactctcagaatagccaggataagtgtagattctcacctctttcacacagtcatttactgcaattatttttctatgctaggtcacatctaatcttccaaattagttcaatgtaaaatagagaataaagcagtataatatgcatctgaagcttaatagaattcttaagcacatactttttataagtgtcatattttatatatactaatgtgttctccatagcttaaaatgtaagatctctgaaaataatgttaatatctgagacatggggagtatttagcatattttagcaaagtggttacaaacataaactggagagtctgcatagagtcagactttgactccatcatataatctcatttcttcttgccttcgtttccttatatgacaaatgggtataataatagggtttttgtgatgatgaagtggattaataaatgtatagctatttagatcgctcaataagtgcttgtaattgttattattgggatcatgcaaatgtttgctattaagaaacatggagctaaatcctaggaaaatttaaaaacacagttaattttctttatttagcaagattttagagccacacacaaaagtctaatgcactttctttggacgatgatactgtggacattagtagctaatacctgtagcaaaattcccagtgataataggctttccatttggctcctacgatcagtgctatgctgcctttatcttcagattccaatgataagtaaatcaattgattttcattccttgtttgtactgtactaaatgcgttacatacagtatcttcttcaatgtttgcaaatttgtgagacaggttctcttattagcccattctcacatgcgaggtgcctgaagattagcaagttaagtaacttgcccaagatcgttcagctcagaagtgtcaggcaagacattgaagccaggtctgcttgatcttcaaggtcctcctatgacatttttaccacacagtgtcattcactccttgcagcatgccccacctatccttttctcacttctttaccctgttcccacacttacacacatttctgcctcaagacatcctcagtgaaaatcaactttttccttacagacttttttaactgcccttaagtcccagaagatattaatcatgatatgattgcttttatatggagacataataaatataataatgacaattatgaatcacagaggaatccacaaagtagaccttatagattctgttattatataaatcagtccacttagtgctgagttaagtactgggtaaggtgagagaaatcggcttttttctagtgcctgtataaaacagacattggcatatattaaaacaggaaaaccaattagcagacttgccgttattgacttcctttctttcctctaacctaattatagccagtgtcctgaaggatacatctgtgtgaaggctggtagaaaccccaactatggctacacgagctttgacacctttagttgggcctttttgtccttatttcgtctcatgactcaagacttctgggaaaacctttatcaactggtgagaacagataaaatcatttttctgagaatcataaaacaccgaactcaagagaattgctgtagaatattttattacttagagtgtaagtttgtaacatcctatataaaatttattaaaatctctcttccattttgcagacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggtatagtgaacaagcatacggtcctttgtttttctttatctaaattctttaacctaaatgttgaggtcagtggcaaggtagttgacattagaaataggtcatatgtgtttggtaagtgctaggagcctgtttggttattaagaagttattactttattgcaatgatctctgtcaatagtgtcaatagtaatggcatcaaaaaatggataattataattgctttactgacatttttttctcccttgtgactccttgaggaaattaatgattaacaaaggcctcatgtactcaaacttgcagagtagataaacctacatgtcctcagttgaagtattttcttaggggaagaggaattcagttacacttgcttcttcattgcagtatcaccagaggtggtaagggtcagaaaaccagaatcaaactaagaaaattatttcattgagtctggaaaggcaaaggcttattcaatatttgttctcttttatataaagtgtacaaatgcaagtttgtgggttacatcagtaaatcactagtgtgtaaacatattaaaacattagcactctctgcctcctactctacaaatcctttaatttggacttgacaagccttcaaaataaggcaagaatttctctaattatatttgcttgacttaatggcattaactaatccaattgcctatttttgtcttttcatgtatggtgaatacaattcccttttattaccgagtattcctaaatatgtaataaaggtcaaagtatattgctgtaatagcaacaaaactactgttatactttacaagttcatgcagatgccatgatctaggattctcaaataaacactctgtattatgtctttgctgtgcatttcttagtgaaatacccaatttaaatcacggagaaaaatgtcattaaaataaaatacttgactgaattacatttaataattcagactagcactaaatttctttattgtgtgaaaatggaatcaaaggcaaatgtctaccaggtttaaataggaagtctttaattcccatattatttccttcttaaaatattgtttgaattatagaacatgttattatgatctttaagtgtcttgctcatattattagataattagatatcatagtgtgaggacagagcttgaaggttctcataaaagtcgtatgtatcatcttccatatgaatgcccattttactctttgattggtctaataacaatgtactgttttctaaaacacagaataaaatggagaattgtttttcaagattatcttcatgatattgaagctcaattaagcagtaacatgataattactttttaagtttatatgcaacttccacatactttgcgcccttctaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtccgaaaatcggaatctgaagacagcataagaagaaaaggtttccgtttttccttggaaggaagtaggctgacatatgaaaagagattttcttctccacaccaggtaaaaatattaaattacatgaattgtgttctcataaattttttaaaaaaatatgccagaatttaatggagagaaaaccgccttccacctggatggcacaatgctttcagagtagtgatgattatcaagtgttttggctatcacttcagagaatttgtgagttttgcaactttttggaatcccaggaaggaaattttagatccctctgggtttggaaaaatttgcggttttgaggttttcttaaagactgaaaaatcttggagaaattttccacatcaggaattatcagcagatggttcccatctcttcttaactattgtgcgtggatctagtgaactttgggttttctgagtgacaaattcccagaagtggaccagagactcttttaggccacctgcggggttgttcccataaggtgcaaacatcacttgccaagtgcattcttcatgcctttgtttcaaaggggactgaaacaaaatatctctaaaagtagccaaaactctcagataggcaggtactgagggagatttatgacacgaaataaaaagtggtgtttagttgtacttgattatctgtgtttcatgttaaacatgggacttgcatttgaagaatactgtgatttataaactgcaacaaatattcactggatgcctctgccttttgtactcatgcaagttgttgaaattttaaaatttagaatcttaattgtctttgaaattaccaagagaattcacaggaatacacagtacctcagaagacattttcaccaggagtgaaaccttaatacctatacagtaacaataacaattacaacaacaacattgataatggctaatatttatacactgtgttgttatttgcaatattaatgcattaagcctttcactgcaaccctaggtaagttctaatttagttaatatccccaatttttatatgtgaagagaagcagggggctgcattctttgttgagtacctattttatgcttggcattctttctacattctcataattaatgctaacagttctgtagaatagtattattttcattactataatgaaaaagctattttggatcagtaaagttaaatagttgcacaatgtcatatagcaatagaaaaagttattatgatctttgagtgtcttgttcatattagggttgttggtattcaaattttgcctggtactgaaaaccttaaagtttccactttatcaagttgcctatgaagaatgcctttaaaaactgataaggaaatttacaatataactttatttaaaatacacaatggcattatactttctcttttacctttttataatatagacaagctcacataacctcacatgtgatatatataaatttttttaggtcagccttattcatttcaaatccaaataacatcataagattgcatacttggggattaattcaaatttaacataggatctttaaatatcaaaatttacttggtctctttcattttgttgtcacaatcatgattccattagtagaaacattaatcaataaataggaatcctttaaaaggcaaaccccctgtttacagtattagtcattctgaaaaggaaggaagaaaaagaaagggagggagggaggggggagagagagagagaggaaaaaagggagcaaaggagggaggaagatagagtatttttgcctacatttttacctaagtttgtctgaatttttgcctgaagttgtctaagttttggccaaaatttgcctaaattttggcctagatttgaaacttcatatcaacttcatatcaaacacttaccacagagattctcttcaatttgccttatttctaattgaataaaactaattctaggcaaaatagtgaagcctgataaggctaggctctgtccttcctttttctgtacattttgttcatagatatgatattctcccagcagcctcttcttcatacctctacatacctccatttcccagctagttgggtattataagcaatcactgacttagaagacatggcatggctggctcatattgatacttgtttcttaagcagtctctatataaaaatagagttaaagactttattttgcttgataaagaaatagtcaaacaaatgtctaagaggatggagagggagacagaaaaagacagagggaaagggaaagaaagagaaagagagaggggggaaaggagaaaaggaagaagagaggagagacagaaaaccctgaaatcacaccaaccccacttggcaagccctgaaagtaatactgaaaatgtcaaaccagatagaagtacttaatcttggtatagcaatggagggcccatcgtgtctgttagatttttaagagtttgagaccccaaaatattaggaattattgttttgtgatgacatgattgtgttggtaaccatctctgtgtttgtattgaaaaactatacaatgcaagcctttactgcaagattataatttctttagtagagtaagtggaaatatgaattgtttctcagactctgatttgacttgttagtgtggtaaagaggggagaagaaagtcaagaatgtaatctctaaacaagtttcaagataatctggatttttttgaaacctttataaggtacaattgaccttaaatcattactttattatttatttgtgataagctaggagtttaggagttttgctttttaaagattggtttggtatggggaatatttcttactggccatcttttttgtgtgttacagcatttgattactatgcatttatgtaatgaatgtcagcaaaagaagttgatgctaacggatggggcacaatcatttctcatatagctgtcacatgtaaactacgtttttgtatagcttaattcatccatgatccttgagaaacatgcaaacttataacttattttcttccaacccttctatggctccagctgaatggggtactggcagttaaaatataaactcttactaaaagcgatagaaacattcttcattgcaaagcatgtattgtttgcctttcttttttagctaatgaggagcagtatgtcacacatcctgcaaatcccgtaactgttatttcctcatagctaattcgaagtcccttgttagaggagagaaaggagacacgaaaaaggatggatagtctaagaaaggctttaaaaaataactacttgtatggaaaatgataaaagaaaagaatgaatgttactaatgtagttaataggattaaaaagcatgggaacaacaagaggagagatgacttctgttgtgggagcagtaagtcttcttagaagtagttctaggccgggtgtggtggctcatgcctgtaatcccagcattttgggaggccgagacgggcagatcatgagatcaggagatgagaccatcctggctaacacggtgaaaccccatctctactaaaaaatacaaaaaattagccaggcgtggtggcaggtgcctgtagtcccagctgctcgggaggctgaggcaggagaatggtgtgaacctgggaggtggagcttgcagtgagccgagatcacgccactgcactccagcctgggtgacagagtgagactccgtctcaaaaaataaataaataaaaaaaaagaagtggttcttactgtaaataatgaatagaatcacataagatagtgtttaacatttacagacatttaatagaaactaacagatattattgagaaaaagtaattctttagctggaaagaaaataaaaagcatacttattggtcagtgtattactctgttttcatgctgctgataaagttatacccaagactgggcaatttggcaaaggaagaggtttaattggacttacagttccatgtggctggcaaagcctcacaatcatggcagaaagcaaagaggagcaagccacaccttacatggatggtggcaagcaaagagagagtgaaagccaagcaaaagaagtttctccccatataaccaccagatctcatgagacccattcagtaccatgagaacagtatggggaaaacccctaccatgatttaactatctctgaccaggtccctcccacaacagtgggaattatgggaaatataactcaagatgagatctgggtggggacacagagaaatcatgtcattccacccccggcccctcccaaatctcatgtcctcacatttcaaaatgaatcatgccttcccaacagtcccccaaagtcttaactcatttcagcattaattcaaaagtccacagtccaaacaaagcctcatcggagacaaggcaagtcctttccatctatgagcctgaaaaatcaaaagcaagttagttacttcctagatacaatagggatacagacattagctaaatacagccattccaaatgggagaaattggccaaaacaaaggggctacatgccccatgcaagttcaaaatccagcagggcagtcaaatcttaaagctcaaaaatgatctcctttgactccatgtctcacatccaggttacgctgatgcaagaggtgggttcccttggtcttcagcagctccacccctgtcactttgcagggtacagcttccctcctgactacttccatgggctggcattgaatgtctgtggcttttccaggtacacggttcaagatgttggtggatctattattcttgggtctggaggacagtggctctcttctcacagctccagcaggcagtgccccagtagggaccctgtgttggggctctgaccccacatttcccttcctcactgccttggcagaggttctccatgagagccctgcccctgcagcaaacttctgcctgtacatccaggtgtttctatacatcctctgaaatctaggcagatgttcccaaatcccagttattgacttctgtgcactgacaggctcaacaccatgtggaagctgccaaggcttgaggcttgcaccctctgaagccatgggcctagctctacatttgcccctttcagccatggctggagccgcagagatacagggcaccaagttcctaggctgcacacagcgtgggactctggacccggcacatgaaaccactttttcctcctaggcctccgagcctgtgacgggaggggctgctgcaaagatctctgacatgccctggagacattttctccattgtcttggggattaacattcagctcctcattacttatgcaaatttctacagcctgcttgaatttctcttcaggaaatgggattttcttttctgtcacattgtcaggctgcaaattttccaaacttttatgttctgcttcccttatgaaactgaatacctttagcagtacctaagtcaccacttgaatgctttgctgcttagaaatttcttctgccagatactctaaatcatctctcccaagttcaaagttccacaaatctctaggacagggccaaaatgccaccagtctctttgctaaaatataacaagagtcacctttgctccatttcccaacaagttcctcatctccatgagagaccactttagcctggaccttattgtccatattgccatcaggcttttggtcaaagccattcaataagtctctagaaagttccaaactttctcacattttcctgtgttcttccgagccctccaaactgttccatcctctgcctgttatccagttccaaagctgcttccacatttttgggtatcttttcagcagcgtcccactcctggtatcaatttactgtattaatctgttttcatgctgctgataaagacatacctgagactgggcaatttaccaaagaaagacatttaattggacttacagttccatgtggctggggaagcctcacaatcatggcagaaggcaaagaggagcaagtcacatcttacatggatggtgtcaggcaaagagagagtgagagccaagtgaaagggatttctccccataaaatcattagatctcatgagacttattcactaccatgagaacagtatggagaaaactgccactatgattcaactatttcccaccatgtccctcccccaacaatggaaattatgggagatacaactcaagatgagatctgggtggggacacagccaaaccatattagtcaggcatataaaaacctagatattagtaggtataaaataatggttttagttagttttgaacctttggagaggaaaagatcaaaccaataatacttaaatgatgaagttagtattctttccaataataattacataaatccaatgcaagctggctgaagtaaaaaagagaatgtattagatgatataaattatgtctgtgagtagctttaggcatggatggatccagaagctcaagacatgttaccatgaccatgtctttctccatatctgaatctaggttcctcccacatggtggcaagatgtcactgcagctccaaacttaaagccaatatttttagcagcctcaagtgaaaaagcaccatttcctcaacagttgtaaaagacagggatatctttcaattgaccaagcaggatttcatgaccatctttaaattacgtatcgaatacactgattggctaggcctaggacagtgcctggaacactgggagacccgagcctcaagtcctgctgcatccaggagttgaaattagtgtctcccagataacctggtctgagagttgaggattatttctcaaggctgaacagggtactgatttaaaaaaacaaaaaattaaatggttgtgatcagcctcttagtgaaaattaagtttttgtaaatattgccctcagatttcttgagacagagacaaaggggtgaaaattggggaataaatcatacagttatttcagcttgatttaatttattcatgaagaccatcataaaatatgcaaagggaagtggagaagctgccccgtgtactataattaaacatccctactagcaagattaattatatttcctccatggtaagatttgcatcagggtgtggtcactagcgagctcttactggctacatttttgacctcagaggatctaaaggtagatttgtgtttaattgttttccattgggttgttaactgaaattaacttctaaagaagggtctatcaacagtatcagttctagatgcccgtaacaggacaaaacattatggggacacttctgactatgttgaggtgtgggtaaagtaggagaaaagagagcagaagatggaaaatggaggaaggagaaaaagcgagagtgaaatagaaaaggtgaaccttgtagaaagtgccaaaatgccaccagcagtcatcagaggggtgctttcttccacatgtccaatgacttatccttgagtaagtcaatgactatgacacaatgaatcaaattctgtttttcagaatgccagctcttaactctcttcatctcatttttgtttcttctcttgttattcatagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagaggtgaggccaattaaaattgcagctgatgtgaagagagttgtgactggtgcaggcaggagtgtttttccatttccacatctaagaatttgttgagtttgttgcccaaaggctgggagtttgttcaatcaagctgttaactgtcttgtgaaactgttctattcagacttttctacaaagtaattaaaaacctaggttggctgtcagagaatataattagaagtaatctttcatcattattactatggtatgaaactcgccaaaaagcaaagcaacaatttatcaagcataatgtttgattaatatagttaaattaaatccaaggaaattaatgctcactaattaaataaatacttaaggattttgtgattgttgttcatttaaaaggagatttgaatacttccacttgcagtagatactattactaaatagatttaaatcccatagtacaacattgcctctctttgcaggtcagagtgttgtaacctttttagcatccactctaatgatctcaaccattgtaaatttatacatgaagagccattcaaaaagtacctggtttggaatcatgggctgtcatttttagagcagattccaatttttatattactgtcataaactcttattgtaaacaaagtggcccaaaaccaatcacatggaaaaggatttcagctacatactagacacttacagggctatattattgaaatttacttcataaaccataagaagcttttaatgttggtattaaataaaattccattagctatcaagacatattttggcaatgtcacttgattgtattttatagcattcaaaatgtcttcttatgatttttttttcacatagctccatttattatcattgaacaagctctttgagccacattaaaatgatacggagttcgttttcagttacctaatggaggagcttcttatcttggattataaaatagccattatcttcttcacattttttgcatggcctctccccacctccttctaccagagaagtgtccaggtatcctgcagtcaggttgaaccatgagaaaagtagaactttatagtggaggaaccaggaagaatgaagagaggacatcagctcttcttaaaaaatgatcatagataaccatgtaccagacactgtccagaacactgtacatgtgttaagaatcatttaagcatcataacaaccctttttgatagttagtaacattatcccaattttacagaggaggaaactgaggcttgtgcgtggtggagctaagatttgaccccaggtatgctggttactgaacctacattctatcaacagtgaaatattgcctcccactgagttatttttaatttctttaaatcaaaaagaagagatggttaaggaaataaacacataaacactttcattttaaccaatgtttctcaaaatatacttcactttcatactacttacatcagaatctcatgggaggcttcttaaaactagagattcctgtgcctacccagaccttttcagaccaaaccactgaggagaacaaggtctgggaatcttcttccttaacaagcatcccacataattcttatacataataaagtatgtttatcactgatcttgataaatgttaattgggtaaacaaaagcaaatctacaattaccatgcaggaatacagacagactgtcagtctgtcagaaattatttagcatttatcaataattatcataaatctcctgtcctatcagagatgatgggacaaatcgctgaaggcaaagttggggccagcttgaagcaaagctttgtgtggtccctttatttcctgcttcctcaacttcattctttaatcttacaatcttaagtgctttgaggcagggcactgtactattgcaaagttgagctgaaggtgcaaacaaatgaagtaggcttttggagaatgcagaggtgaaatgacaatagaaaataaatagctatgggcaaatgacacccttgaaagcacatcatttcctgtactttacacataaattcaatcgagtaatgtcattagcagttttggaatctatttgaaaattagacaaatctaggtttgtacatgtgcttctgtgtagaacagaagggactagatgatcttcatgtgactattttttttttccttaaaactttgcctctttctgacaagctgaaatattttaaattctaagaggcaccctttggattaaaagacttttatttttagagataggttatttcttttcttactaattttacttgtttttttaccttaaaattaattttagaatgacctatatgaatagttatcaccattagtgacaatcatatgcaatgagtggaaattttggttttgaatatgtatgcattaaaataattcaacttacaaaagataaaatactgctaattgttcacatcataataggatgtgaccaaaataaataatattttgatcatattattatattttgatcatattgttcttttagaaatagggaaagtcctcaaaggaatgaaactttttaatttattattaacactcagacctgcatttgaaattctttagctttacctttttttttcctgtgataattgacatcattgtttgatctcctgaagtaggaataaatttccacccatgttgaaatcctgatgagtttattctggagtaggagattatcagatcattgtatcattactaaaaatcacagtcccccacattggtattatctccttaaattatagtctcagtgccaagggtggattgttttgtggattaagttgtttttcaaatataggacaaagttatagactagttctaaaatttagttttgtaattaggaatgttgggaaatattacctgtgtctaatgaatgaaggcattttgcaactggaattcacattttaggggaactgttactgatgcatatgaaggagactttcaaacctttttgttcatatattaaactacctgaatatatgtctataaagatctaaaaactcaacctgggtgaaaattaagaaacaatatgttttggtctgaagtcctaagtgggattggctgaaatgctaaaaggttatctgtccagtagtggacctggtccctccagcccaaatccctgggatagaggcataggaaagcccaccttgacaaacccagggctccccaaaagctgaaaatctgacagacttttaaacaacccccaaagaattatcattccaacaatatcttagtgagctttttacatctgagaaagcatggtgtatatttagttaaataacacctgttgtaggaatgctttgggctttgctgctttcaaaaatagtggttatttcatctgaaattctacttctagggcacaactactgaaacagaaataagaaagagacggtccagttcttatcatgtttccatggatttattggaagatcctacatcaaggcaaagagcaatgagtatagccagtattttgaccaacaccatggaaggtatgttaaaagtcctgcgtcacagttacttggtgctttggtaatgatgaaaaaacacttcataaatttcaataaaatacttcctgacttgatattgtatcattattacacattttactaaataacagtaaaatccgtgcataactcatggattctattatcttccacagattttttttttttatatttagcctccagaaagctgctgcaaatgtaaggtatattttgaacaccactttcatacattaaattctaaacattgaaacttgtgtgcatgacgttgaaaagagtgtaatgataaatgcttatacttatgatgatgctaagccatttggattatattaactgcttgagacacaagttataaaatcctatgacttaaccagaaatataaattaaaaatgtgaattagggtttgatattaacttccttgaagcaaagtgtttaaaattttgtagtcctacttttgcctttctctgaccagattcttacaatatatcagctttctctttagttgcagattttatctgaatagttaacataatgtgtagcagtctggatctcagaatgccaaaataaagactttggggacagcttaatctgtgatcaatttctggctctgccatatgttaaatgtgttaatttgtgactttgaatttcagtctcctcatcagtaaaatgtggatgatgatgtttaggcataaggttgttgaatggattaaataagccttcttagataaaacactgatgtatttggcatgcagaagacagttaataaatattatcaatattagttgttttgttgttgttatttttgttaattcacatgtttttgcctttccatactgtaagtgaattcaaacaactgtcaacttcaactacttggaaaatattttcatgtaaaatgtattctatcccccttccttgccctcctattccctcctctccctatctctttacaaaccttctcccttgtaccccttcccaggtatgtgtgtgagtgtgagtgtgtgtagatgtgtcaagggagaagagaaaaggagaatgaaagcaaaagagagcaagcatacacgtccctttcttattgataattagattttctcttgagattggatagattcctggaataattcttttcctgtctgtatgcaaagatcccataatattattaataccaatacgaaaagcctgaaaatcacagccagaaaaaattcacagtgtagacgactgtgtacatcacagacaagtcagtattacaaaacccaattttcatagtgtcctatttcagtatcctaatgcaattcactgatttcaattgaatattaaactctagtacgttcttccccaacctcgcctgcgttagcttgcactccctcttccccccagctgccagtagcttgctcctccctgtccctccaggtaaatcttttgaagattgtctggccttccgctccttgccatagcaaaaccactgagaggaagctgccagtggttctgctaccgatgtcagcagcatgtctgctccctaaagcaggaagtagagaaggagacagggtaagtctaaatcaacagtcatgctttgcacttctgatagcattaagtttgagctaaataagacattacttaaaaaacctcaaatatccacaagattggacttgccaactaattaagatttggagttcaaaataaatgcacccacacctttctccatggaactatgtgacatggggttgcttaggatggaaaggatgttctaggaataagtgcaatctaggaagctgaagactgagagtgttttcgttttattatctgcagagcttttgacttgtgtatttgtgagaaataatggccaagtttttattctgtttttaatcagttatctagaatgaaaactgacttttctttattcaattgtatgtagacacattgagtgtgacatttgtcaaggttggttgttagcaatatcacatacatgcatactcaagcagacttaagatagtcctttttttttttttttttttttttggtttctgataatggtgcaaagttttcctggttgacataatctcttttcttggggatcctttcttctatgtctgattattgtttatttcacctttcctttttatgaaccaggcttgttgatccggttggcaatttttgttctccttctttttaactacagccaagtctccgttgtccagggtaatggatagcctcatgcttaatgaagcagtagtggataagcaaaaatgaaccatttgcgtttcaaatttttaaaagtgcaaaatcacatagaaatgttttctggtcacacctttgtgaaggatggtgggagggtgagttagaagcgcctgaagaatcaaggtgagccagcaaaagacacagatttactgtaagtgattctatgtggataacccatgcaggaataatggagatgtggctgcagttctctcctgaatgctttgctttgttttaaagtgtgagattccccccttttttttggaatgaataattgaatgattttattttagaacttaaacaactttgctccggttattcctactgtcaagatgagccacacctgctgaatttcattttttaaacttttctccagtttattttttttctatccagttcctgtttgcttctcgttatttgctaaatgacagctggcatggaaagaaaaaaccatattatggcagtatacagacaaaattaaattttgtagtttcttttttgttatttactgtaaataataatacctcctttttaccttcaatgtaaatataaggttatttgggagtttagaagtatttacaaaataactagtgcataataactatatttttctctgaattataaatcaaatattatttattgtttacaaagttatgtattaagggaaatggaaacaaactgggcacttgaagaatttcaatatccaaagagacaattgacaaatctatttttagtggaaattttaaaaacaataagcaataaattaatttacttaggaaaatagtattatagaattaattagtggcaaatgttgattagtagaagaaacattatcatctgtggttgtgattgtccttttatatgctggttccacctttacaaggtttagttcatagcaaactgtgccagatatggacagatgttccagttgccacaatagtattaaagtgactgactagagtcaactatgccatggatttaaaaagaagaaaccttccctctatttcagtgctaagaggtggtggccacattttggcagaacaggtaatagggtgtacagcaatgatattgacagaaaacaacaaattctgcatatttttccactcataagttgatgaagagattatcttgccaaaggaagatggtagacagtttttcacttcctaattccccaaatttctttgccaatattcaccaaatttcagtattttgggtgtgaccttaaagatctgtgcatttctgtcttctctcccaatgtttggttgaaattcttcttgacatcattgtacattttccttgaataaatgcattttaatataaaattttatgtcatgtttgatatgagagttatatatttaaatacatttaaataaatgtttaccatgaaaatgtatgaattatatgtatgtttcacctaaaatcctttgtatttttccagtaataaatgagttccactttgtgaaatgttgatttgtaacaacagtgaggactccagttccttaggctggggtattttctcttcttttatgccctctagttaaatgagaaatgtagagagatggaactttgttgtgtctaatatgcaagcctataatctaataaaatttaatttgagacttttaaactgagattggtgacactgacaaaattatctaattagaagatcaccaaaacatatctaatccaagaaactgacattcagtgtgactgattaaggttcttaggacatctcctgagatatctctgataacatatatacttcttgctctacctggaacatggatgagctttaagtgtatgcaatgcaagttctacccattagtttctagcagccttgaagataagtatcagacagtttagtgttgccaatagaatcttggaagctatgtttagccaggatacatttggaaagcttactagcctttctgtactgatcctttctatgacagcaaacccattgtaaaattttccctgttcctccagcagattaacccataatatcttttaacaactttagattttttaaattccttttaatttaaaccaaatctgcttaatagaaagtaagcagttttcatgaggattctaactttttttcttccagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtaagcctcactgagagtttctcttcctcttgaaagagtttataattgccttagtgaattttacatattgctctcaaattaaatatcaactaattggccatgtatatcttgacatcaaatgtttagcatcccttttaaataacaaaaaaatgttgctaccatagtgcaaaagagtcaaagaatttatgtacaatttgatttagaattgaatttaaattgcttatttattagaagatgattctgaattgtcctccaaggacattgatctatagcaaaattctgacatatttttaagaaccttagaataggttctttaggacatgtctgtgtttactaaacaaatgataaaatatgcccaagtcagataattttgaaatatcacttgtaagtacttgaagatggactatgtagggaggggacatcatctgggggattattattttttgtttttgtttcttctacagtcttagcaatattaaatttagaaattatttatttaattttgttaaaatatatattagcatttactggatacatattgatattataatatagtatactatagtgatagattttaaagtggtcttatacagagagacaaaatgaagaaaatcacgcaaaaaagtatatttatacaagtataaaatgcttattaagttcccagcttgataaatgaacatataagcaggttatatagagattgtaaataatacggtctaaagtataatatacaatatttttaggctctgaagtaaccactatattttcgaattatatttcaggtaggacttaactgaattaaatgataaagttggcatatgttggcctcttattttgtatcagatattggactaaatggtttacattaaatctctctctctagattcccacaaaaccagtcttaagatatttactataaattgtctgtatttcgcagttgggaaactgtatccatgagaaattaacagagaaatggaaggtctgaatgctgtatcagactctgaaagctatttcagagactatcataagctatgggcaaagatcacagacgcttagagtaggaaaggataataattttacctagttcaaatttagagctatgtaagaatttcttcaacattatttctaaaaaaaagcagggtggtggggtggcaattgaaacaagaaagcctttggaggtaatatattgtgatccaaattgaatgagcttaagcaaaaataaagggaattcattacctcactttactgaagcccatttggaactagttctaggttctaacctggctagattcaggttctcagccagcatcattgggaatcagcttcttgtctctcttcttcccaatatgtgaccttcctctctggctgggcattttcctactattgccaagattctatcaacttttattctactaatgtagctccatgtacagaaagtttgtgcctcctaactagtagctttaattaaggcccacaaattgaatatcattgacctggttggagttacatggccatttctaaaccagtcagttaccctagctcttggttttaatgccatattcgcctaaatcagaatcatatcttatcactggaggcagagtaaatgagtgaaattatgaagacaataattaggataccattaccagaaggaggatggattctagaaagaaataaacaataaatagacaactcaagctggggctggtcttacgtgttaaggaatgtaggatctgtatctaaggtgaattatggaatagtagaaaatccataggcaggatacacattcttctcaaatgcctataggatattccctaggataagttataggttaggtcataaaacacacatcaataaacttaaaaaaattaaaataatacagaatatttttctgataaaaaataaaatgaaattagaaaccaataacaagtcaatgtggaaaatcacaaatatttggaaattaaacaacttgctcttaaataaccaatgagtcaataagatgtcatgagagaaattagaaaatactttaggatgactgaaaatcaaaacaaaccaaactgaaattaatgagggcagctaaaacaatatttaaagacaaatttatactctaaatgtctatagtaaaataggagatttcccaaattgctaatttaagctcctttttaataaactagataaagaatagcaaattaaacctgaagttaacagaaaagacaaatattaaagaagagaaaaacaacagagaaaaatcaataaaaccaaaagttatttctttgaaaaaatcaacacaattgacaaatctttagttgggctaaccaagaaaaaaagaggaaagacactaattattagaagtaggaatgaagagaggatattaccatggatcttttagaaagaaaaagggagcataagaaataaaataaaattaaacgccagcaaactagataacctatgtgaaattgaaaaattcctagggagtaacaagcgcctgaaactgactcaagaagtaatagactatctcaatatacttataataagtaaacattgaattcacaattaaaaaaaagaaaacttcctgccaaaaaaagcctgagcccagatagtatcactggtgaattttgccaaatgttcaatggagcgttaacatcaatccttaacaaactgttccaacacatagaagagaagggaatacttctcacctcactttctgaagctagaattaccctgatattaatgccagacaaaaataatgcaagaaaagaacacagacacaaatatagaccagccatatcccatatgaacataggcacaacaatcctcaacaaaatactagaagccaaatcacataacatatttagatttttagattatgtactctgaataagtgaaatttatcccagtgatgcagggctggaccagcataaaaaattaatgtaatatatcatattaattttaaaaaactatacaatcatctctatagatgctgtaatcacatggaaaaagccaaagtgtttcatgataaaaacactcagcaaacttgaaatagaaaagaacttcagcctgataaacaccatctcaaaagaccccacacctatcatcattcttaatagttactttagatgcttttatcttcaggtcaagaagaaggcaaggatatttgctcttgctacttcttttcaatattgtactgaaagttctaaccagggaaataagacaagaaaaagaaattaatggcatctagattggaacacaagaagtaaattctattaacgaatacataatcttgtatttagaaaatcctataaaatacacacacacacacacacagctgttagaactaataaataagattgcagaatacaagatcaatatacaaaactcaattatatttctaaacactactaatgaacaatcagaaaataaaattaggaaaattctatttataacaacatgaaaaataataaaatacttaggaataaatttaataaaataagtgtgagatttgtacactcaaagctataaaatattgttgaaagaaattaaagaactactaaataaatgaaagcacattttatattcatagattagaggaaaatattgttaagatggcaatactcaccaaattaatctacaaatttaacgctattcatatcaaaatcccagctacctattttgcagaaagtgataaattgactgtaaattttatatgaaaatgcaagagactatatgccacacaatcttaactagaaaaaaaataaagttggagaactcaaacttccaaattttaaaacttactacaaagcaaaagtaagcaagatagtttggtactggcataaggatagctatatacatcaatggaataaaattgaaattccaacagtaagtcttcatatttatgttaaattaattttcaacaagaccactagacaattttattaaggaaagaagccttttcaacaaatggtgcttggacaagtgaatatccacatatgaaagaatggaattgaacccttacttaataacatatataaaaattaagataggtcataggcctaaaggtagagctaaaactatgaactgttagaaggaaatttagaagtaaatcttcatgacctattattaagcaatgatttcttagatatgataccaaaagcacacacaatagcaataagaaaaaaaaggttcattggactttatcaaaattagaaactttcatactgcaaacaatatcatcaagtaaaaagacaacttaaagaatggaagaagacatttgcaacccagatatctgatcatgatttgtatctaatatatgtaaaggattattataactccacaacaaataaaatagataactcactaaaaatgatcaaaatatttgaatagacatattgaaaaaggagttagacaaaaggccaataagcacataaaagatggtcagcgtcactggctaattttaggggaaaggcaaatcaaaactaaaatgagataccacttcacacacactaagatggctataatcagaaagaaagccaataccattttttatcaaggatgtggaaaaattagaatggttatgctttactttgagaatataaaatgatgcagtcactttggataataatttagctgttccccaaaaagtttggggtagagttaccacatgacctggcagttttactaatttcttcggatatatatatctaagagaattaaaaacatatttcaacatgaatgcttatagaatattattcataatactaaaaattaaaaacaattcaaatgtctatcacttgatgaatggataaacaatatccatccaataaatgttattcatccataaaaaagaatgaagtattgctacaatctacaacatgaataaaccttgaatatattatattaagtgaacaaagccagtcacaaaatttacatatcatattgctacatttatatgaaatgttcataacaggcaaatccatagagacagaaaggagatgagtggttgccaggcagtagggattagggtaaatgggagcaacaactaactaatgggtatgcagcttctttttaaggcgatgaaaatgttctaaaattcaataatggtgatgattttacaagtctgtgaatatattacaagccactgaattgcatactaatatttcatagtatgcatgtatcactattttttcttccaatcacctattgatggatgttcaagttgattccagatactttacccccatgttgcagtaaatgttcttgtatatatcacctttcataatgctgtattaacttctagaagatagatttccaggattgaagtattcccaatattaaacatattcatgtcacataaaaattagatgatatgcaacgaaatagggaaatgtgactcatagttaatagattaaagcggtacatagaaatagatctggacaggaacaaattgttagaataaacaaaaaaggactttggaggcactattgtaaatatgttgagcaatttaaaggaaaaaaaggggtcataaggaataaacagagaacatgagcagaaaaaaatgaaaactgtaaaaaggaataactcagacattttataattgaaaagtacacattctaatatgaaaaattcactggatgtgtttaaaacaaaattgcagatgtcagaagaaatagttgttaacttggagcacattaatagaaattatccaatttgaacactagagaattaaaaggaaaaatgaactgagtctaactataatatgggataatatcaagtagtctaaatatttatataatgggagaatcagaaggagaaaatagaaagaatggaacagagcaaatatttgaagaaacaatggccaaaaatttcccaaagttggtgaaaaatagtaacttacagaccttaatgttaccttataaaatgttagtgaacatcaacaggataaatataaagtaagccatacttaggcacatcttagtcatgctgctgaaaacaacaataacaaaaagctttggaaacaaccggaagaaaaatatttactatatacatgagactaatgtcttaccagaaataattcaggccagaagaaagtggccagataaaataaagaaataaaagcccattattctacagaaagtgaaactatccatcagaaattaaaatgaaataaagaattttaagataaacaaaaacctaaaaaagctgttaccaccagaactacactacaagaaatgttaatggaagttctttaggccgaataggaaaaatatcagatggaaatttgtttctgggaatgatggtcactagatatgaataaatgtgggtaaatacgaaagactatctttttttccttaatttttttcacatttattttaggttcaggggtatgtagacagctttgttgcataaataaattgtaaatcacaggggtttggcatacagattatttcatcatccaggtaataagcatagtactctatagatagttcttcaattctcatcctccttccaccctccaccctcaagtgtctgttgttcccttctttgtgttcctgtgaactcaatgtttagttcccacttataagtgagaacatgcagtatttggttttctgttgctgtggtaaattttttaaaaagacaactgattgtttaaagtggggatttataacataggtaagtgtaaaattatgaaaagatttgaacttttttttttttttttgagacggagtctcgctctctcgcccaggctggagtgcagtggtgcgatctcggctcactgcaagctccgcctccccggttcacgttgttctgctgccttagcctcccgagtagctgggactacatgcaccagccaccaagcctggctaattttgttgcatttttagtagagacggggtttcatcgtgttagccaggatggtcttgatctcctgacctcatgatccgcccgtctcggcctcccaaagtgctgggattacaggcatgagccaccacgccgggccagaacattttatctaaagtgttacaatattaattttacatagaaaattacaagaaagtatccctcatgaacacagaagcaaaaaatcattagcaaaatattatcaataaaatctagcaatagagaaaaaagtaataaatacttcttaaacatgtggggattatctcagaaaagtaagattcatttaacatttgaaaagtgatcaattaattggccatattacctctaaaagaataaaggaaagcctaagatcatctcaatagatgcagaaaaggatctgacaaaactcaacagtcatttgtgagaaaaactgtcagtaaactaggaatagaaagtagctatctcaagttgttaaggacgtttcagaaaaccctacatctagccgggcgtggaggctcacgcctgtaatcccagcactttgtgaggctgaggcagtggatcacttgaggtcaggagttcgagaccagcctggccaacatagtgaaaccccgtctgtactaaaaatagaaaaaattagctgagcgtggtggcaggcgcctgcaataccagctaacagggaggctgaggcaggagaattgcttgaacccgggaggcggaggttgcagtgagccgagattaagccactgcactccacacttcagcctgggcaacaagagtgaaactctgtctcaaaaaaaaaaaaagaaaaagaaagaaaaccctacacctaatattttacttatcagtgaaatgttgaggtagtgaattcttgccccttagaaaaattgagtgctttccccttaacatagacaaatatgtctatttttaccatttttatttgaccttgcactggaagttttatcaactgaactaaaggaaaaaaaaacaaaacaaataaaatgcataaatattgaaatgtggtaaattatctatttcatcaacatgatcatattgtagacaatcctaataaatctttaaaactgattagaaataaacgcgatattaaatattttatttaccataatatcaaaaaacacgaagaatatagtaataaatttaacaaatcatttcgagacacctattactaaaaacctcaaaacatggctgagaataattacagaagatttaaacaaatggaaatatatatgccatgttcatgcaatggaagattcaatattattaagaaattaattctacccaaatgtatctatcaattcaacccaatcccagtaaaaatgtcacagattttctttgtagaaattgatgaactgactttctatgcaaatacacagtgcttaaaattgccaaaacaatactgataaaagaataatgaaaacattaacctacctgacttcaaggcttgttataaagctgtactaatcaagaatctacagtattggcataaacaaagatatcaatggaacataatgctgagttcataaatagatccaaactacatgtcaatggattttttgaaataaacactacagaaaggaaatagaagaaaggaagtgttttcaacaaaatatcaggaacacataaataaatgtatggaaaataaatgaacctccacttcgatcttatgccaagtgccagaatcaataaggattgtagactaagcagaaaagctaaatcaataaaacatctgaaataaaacacaggagaacatctttgagaccttggggtaggcaaaaatttattggaaaacagacaaaaagtgctatctattatttaaatgtccatgaaatttcaaacaatggagacctactgaacaaaaaagaaaagtctagtaatatacacatgggtgaatttcaatttgaagtattcaagtaatatttggaaaagtcactaagactgtcaggtctctgaggtaaccacctaggtagagagagattccatttactgagttagcaaatatcagaagagaagcaaaactgtggagaaaaagcagtaagatgaattttggacctgttgaatttgagatgcctgggagatagtctttcaaatgtaggtattgaataggcaggtgggtatgtatttctagagactaggaggtatgcttgaacagaaaaatagattttgaaatatgaactattataaaaatgtaacttattataaaaggaaaactaaagtaagaggggtctagacagagagagttctgaataaatccagtatcaaatgatttgttagaggaagaaaatcaggtgagtagcatccagggaggtgtggatcacagaagctaagggcagaaaatatttcaatgaacaaggaacagaaaacaatgcctgaaacttctaaaagggcaagcaagcaagataattgtttaaaaaatttcgtttggatttattggtgatgtcggtcttgttggtgaagtttgttaaagccatttggtgggttgtggagtaaggtgaagaaatggaactggcaagtgtagacaagtatgcaatcttcgaaagaaatctggccataaggaaaggatagatggtggcacctggaaggggaaatagagtgcaaggagagtttctcttatgacagtggtgatatatatattttttgtttgtttgtttgttttttgagacggagtcttgctctttcgcccaggctggagtgcagtggcgctatctcggctcactgcaagctccgactcccgggttcatgccattctcctgcctcagcctcccgagtagctaagactacaggcgcccgccaccgcgcccggctaattttttgtatttttagtagagaagaggtttcaccgtgttagccaggatagtctcgatctcctgacctcgtgatctgcccacctcggcctcccaaagtgctgggattacaggcgtgagccaccgcgcccggcccacagtggtgatatttttaagggagagaaggactcggtaactgttactttctataaagaaacgggaagtagccagtagtagaaatgttggttaattgagaatgaattccttgcaaagtccaaaggaaaacacataacacaatttgagagattagctcaaaacaggggcacttctttcattttaacaagaagagaaaggcaaagcacagttacggatgtaagtagtctagtagataaagggaaacaaagttcaggctggctgactttcatcacctctaagacgctgaagtactgagactgtgcttctcagatgggaaggcataagcaaaaatggctgaggttatgtgcagaagagaaagtttgaaatagttttagataatagaaatggagaaaggaaaatactgcttccctttcgccaacaaaaggaaatttttttaagagttcttactatctgtagagctagccgtgagcatgtttattacagcttacatgacatcttagcaccagtctcatctgcagggccaagggaggggaccaatccatttggcttggtgatggaagcccgcactgctaggtaatcatttggtaagtttttggagggctagaaagatcagagacagagccaaacagttgatcacaatgagtcagttgcacctttcatatgaaaataatattaattttattgacttaatccgtgtactctttatcatttgataaacattatatatagtgaacaattattgatttgaatgcaaagcatttgtagatactaagttgttggacctaaaccaattttttaaaatcagaatttaatttatatttgttgggagtaaattaagttgctcaataattattcgtgtttcaagagtatttgctcatataatgaactacacttctcatttaggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctggtaaattaactgggagtgttcataaaatgtactttgtaattaattagtcttcattctcatctagtaaaaatggcaagatttcccatcattataatattatttgaatacacttctaaaacaaattggattgccataccaccaaatggtagtttcttcttcatcatagctttaataaagttcacttaaatgaatagtctacacttctcttcttagttattgaatggaaggctaatagagaggaggaaacagggagtcacagataaactcgaatcacaattaaacaacaccatagtcaactctcagttatctgaggtttgcataactgcgtacaaagcttccttgggacctaggatgagctcccctttctgccaggaactaaagaattatggaattgttcattgctcaccttgtccccgtagaggaaagagttaagacaggggatagtgtacaaaggagaaggataagcaaacagagctccccatatgactgctgccacatcagaaaatcaccaaatcactctttgaaagagttaactgtactatattttgttaattttaaagaaagtatctttctttgatcttttataaaaactattagatcttaaaattcagagataaaatatcacttgacacatttccagtgaaagtttgatatgttttgttatactattactttgagttggctctaagttagtgatttattttcaaataacagaggctgtacacggttactaaggacacgttcctatagatgatttaccttagtagtgattaggctgaagactttttcatgaaatctgtttacaatttccctttctgctttcaatgttcaaatttgagttgtaatccttagaactatatttccttccctaatcctcaaagatagttatgaatctaatttgaatctagaaggatgcaaaaaacagaacaaaaatttaaaatgataaaacaagtaatatgggcaagaacttaaaaaaatatatttagtaaaccttcatgatagtgtgatgcagttaagggaaataggaagcatagtatcactagaatcttacttagtgtgtcaggctcttttgcataaattattctctggaataaattaaatactttggtgcatgtatttactcctttgggtcactttgatgccattaaataatgcactactttcagcctgacatttactgaagcatcagaaataaaatgctgctgctctttaaccataaatggtacttcagtgaactctaaagctaatacaaccaatatgtcaaacacaatgagaaagacatttacacactacactgaattaagtctatgaagatataaaggttaaaaagaagcctagcgttttacttaagtttaagtatttttgtatttgaatataatatatgtttaaaatatagcctaaagttacagcaagctaaagatatagctagattaaaacaatctaaagacaaagaaattagttcatttctgcttccactttatgtaatttaagtgttgatattattctcacctgtgcatttcagcatatttaaagtacactgaaaactatatctgctttggccttttaaaaataatgagagttcctacttctctgaaactggatctctgctaattaaccaccattaatctgaaatatcttaattccttaaggagaaacaaaagtgtatattacatatgcttatgtaggatacttgaaaatttggtgtatcttattaaactgccaatttaaaaactgtataatttaattatttcatttacagtatggaccatttcaaaatgaaaaaaagaatgctctatggtagcaagtcactgctatatttgttagtgatcatttgacaaataaataattcatcattctataattgagacagttacctgtacatttgccctgttaataaaattacagatttttcccttcctgtgtccatgtgactaacctgcacattgtgcacatgtaccctaaaacttaaagtataataataataaaataaaataaaaataaaaaataaaaaaataaaaataaaataaaattgcagatttttttagaaatgcagagcattaacactgttcttgcttttatttccagctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggtatgtagcaaaaacattttcctcattttcattaaaagataatgtaatcattaaaaagtgtgttcaactgaagaatattttgtattttttaaatcaaggccacttcctattgtctattactcatgactgtaagagccatgtatagtttagaccattgtaatccacacaaacccttaaactaccttttgaaccaaagttattctttctttcattatccttcttgctacaaggagagaaacttttctgttatttatctttcagttcttgtactagagcatggaagtgttacttagaacactcattttatttataagtactagcaataacacctgaaaacgtttcagatttggttttctacaaatttaaaaactagcaacaatctcagtttattaagagctcatggggttttcggtgcctagaaactatggtatgagcaagtaacattgtctctaaaaacattaattgtcatttctgcataaaattaaccacccctaacaccatatatatttaggatagttagctcttcttgttgcattgatcccttttaccattatgtagtgtctttctttgtctttttttaatctttgttggtttaaagtctgttttatcaaagactaggattgcaaaccctgctttttttttttctttccatttgcttggtaaatattcctccatccgttttttttgtgcctatgtgtgtctttgcatgtgagatgggtcacagcacaccgatgggtcttgactctatccaatttgccagtctgtgtcttttaattggggcatttagcccatttacatttaaggttaatattgttatgtgtgaatttgaccctgtcattatgatgctagctggctattttgctcattagctgctgcggttttttcataatgttgatggtcttaacaatttggtatgtttttgcagtggctggtactggtttttccttgccatatttagtgcttccttcaggagctcttgtaagtcaggcctggtggtggcaaaatctcttggcatttgcttgtctgtaaatgattttatttctcctttgcttatgaagcttagtttggctggatatgaaattctgggttgaaaattcttttctttaataatgtttaatattggctcccactctcttctggcttgtagggtttctgccgagagatctgctgttagtctggtgggcttccctttgtgggtaacccgacctttctctctggctgccattaacattttttccttcatttctaccttggtgtatctgacaattatgtgtcttggggttgcttttctcaaggagcttctttgtggtgttctctgtatttcctgaatttgaatgttggcctgtcttgctaggttggggaagttctcctggttatcctgaagagtgttttccaacttggttccattctcccagtcactttcaggtacaccaatcaaacttagggttggtcttttcacatagtcccatgtttcttggagactttgttcgttccttttcattcttttttctctaatcttatcttcatgctttacaaatttaactcaacatggattaaagacttaaatgtaagacctaaaaccataaaaaccttagaagaaaacctaggcaataccattcaggacattggcatgggcaaagacttcatgactgaaacaccaaaagcaatggtaacaaaagccaaaattgacaaatgggatctaattaaactaaagagcttctgcacagcaaaagaaactatcatcagagtgaacaggcaacctacagaatgggagaaaatttttgcaatctatccatctaatatccagaatctacaaaaaacttaaacaaatttacaagaaaaacacaaccctatcaaaaagtgggtgaaggatatgaacagacacttctcaaaagaagacatttatgtggccaacaaacatatgaataaaagctcatcatcactggtcattagagaaatgcaaatcaaaaccacaatgagataccacttcacgccagttagaatggcgatcattaaaaagtcaggaaaccacagatgctggagaggatgtggagaaataggaatgcttttacattgttggtgggagtgtaaactagttcaaccattgtggaaaacagtgtggcaattcctcaaggatctagaaccagaaataccatttgacccaggaatcccataactgggtatatacccaaagggttataaatcattctgctataaagatgcatgcacacgtatgcttattgcagcactattcataatagcaaagatttggaaccaacccaaatgcccatcaatgatagactggataaagaaaatgtggcacatatacaccatgaaatactatgcagccataaaaaagagtgagttcatgtcctttgcagggacatggatgaagctggaaaccattattctcggcaaactaacacaggaacagaaaaccaaacactatatgttctcactcataagtgggagttgaacaatgagaacacatggacacagggaggggaacatcacacactgaggcctgtcgaggggtggggggctaggggagggagagcattaggagaaataactaatgtagattacgggttaatggatgcagcaaaccaccatggcaagtgtatatgtatgtaacaaatctgcatgttctacacatgtatcccaaaacttagagtataataataatttaaaaaaattaaccatacccaacactagtgtcctgaatcttgaaggcatggagaagttgggaaggcatgggaagataaatataacaaagtgatataacatgtactcaaatagaattaaaaataggaagtaactaatatgtgtccaaaaatatgaaaacaaagtgccatgtgtcaagtttacaaaatgtaaaccttgctttacaataggaaggttgatcagggaagtctttgtcaaagagtttggacctaaaatatatttaactgagatgtaagatttagcttggtaggaagaaagaccatcccaaacaaggaaacaaggtacccagtgactgagggatacaggacagtagactctgtgagaagtatcaggctcttatgctttaaatatgaagtaattacaccgagttgcttaattagaacccaaaccaatggaatagaaaaatgactaccataacaagtaatttaatgtatatactcttgccaggctcagtggctcacgcctgtaatcgcagcattttgggagactgaagtgggcgtttcacttgaggacagtagttcgcgaccagcctagtcaacatggcaaaaccccatctctactagaaatacaaaaattagccaggcgtgatgatgcacacctgtaatcccagctacttgggaagctgaggcacgagaattgcttgagcctgggaggcagaggtggcagtgacccgagattgtgccattgcattccagcctgggtgaaagagcgagactctgttgcaaaaaaaaaaaaaaaaaagcatatactctttagacatgatttcctctcatataaaggtaacctccaagtccccaaagatagagaaaggggaagggaaaaaggcaaagtattattttatttttattcattgccaaatttcagcctcttcaacattacttttgataattctgatctatttttaaagtaacaagaaacataaacagtgtacaatctagaattataaacagtggcttaaaacaataaacactgattacttcatagtttctgtgggtcaggatttggggaataagttagctgggtggttctggtttaggatcagtcatgaagttgctgtcgagatgttagctgaggttacagttatcttgactggggctggaggatcagcttctaagaaggctcaatctcatgattattggaaggaggtttcagttcctttttggcagttagttgaaggtctcagtttttctctgcaggaccttttccataggactgttgagtgtccttatgatatggcagctggcttcttccagggaaggtgatgtaagagagaaggcaaggagaaaatcctctttatgttctactcttgaaagtcactcttcaccacttctgccatattgtattcattagaagctagtcactaagaagagctcaagctactataatccccaagacaactttaaaatgtttgctttcagaaaagtataagatcacatagaacagaaagtgccatagggttacatagaacagaaacaaagaaaagataatataattatgttatagatttgatttcattttctctgtatgtatatttggtatatgttggaagaagaaaagaaaacgcagagaacagaatcctttatgacaacatgaatgatcagacagcaatggggaattaagaaatataagtttgggaccagattgggtagaatttaatttatgaaaaggctgactgtgcataataaaatgtattttcctttaggcaattcaaagctacagatgattttttatcaggaaagtgacagtgaaccagtgatatttttcagaaatatacgtagcaggagaatgcagaatagatttaaagaggatgaaactcagcccaccacatgttatctattagtttactgaaattaacatatctctctaatgtataaatgtgcagaaaattgaagttgaaaagagaatttcaggaaatatcaagtacttatggttgacatcagtattaatttagattgtgatgtatgcataaaaagatatagtttataaaataatcatttccatctactgggtgtaaatttaatttttgttcttttaagagagaaaaattaaaggttctcctttctttttgactatcagttaaaataacttctttgtcttgtgataacctgggtatgtttctggagtagctaaggtagtcatatatatcatgtttaccactattaaggaaatgtgcttatataacatttgcttaagactgaatgaacttgatatactcactccttactacaattcttccttcctattctcactggaaaaatgggaaaggtgtcccaaagacaaaatggcataacttccttttaacacacatgaactatcagatgtggctccacccaaatagatgtagtagtcacaatggatgggactgccagcctagtctacagacaagacagagctgggaccacaaactactgtttcccagaccaggatttttatgagccattcttagtttccagacacgatggcaagagacccttcattggttgaagataggtgctgcagaaaaagaatgtgactttctgaaaactgatagttctagaagcagagaagacaacttcctctctccctaagtgaaggtgaggcaatagcacacaggagggatgtgaaggttttggcttcctctcacaagttgggaatcaggatggagaaacaattaaaatatgtaatatgtttcaaccttgaattcaaaatggaaattatggtaacatttccattccaagaggctaatttgagacacaagaaagagttgatttcatttactgagctagcacatttgtgaaacaggattcaggatttcagtccctgagtgagcttgctgaactgttttctttcttttttttttttttttttttttttttgagacggagtctcgctctgtcgcccaggctggagtgcagtggcgggatctcggctcactgcaagctccgcctcccgggttcacgccattctcctgcctcagcctcccaagtagctgagactacaggcgcccgccactacacccggccaattttttgtatttttagtagagacggggtttcaccgttttagccgggatggtctcgatctcctgacctcgtgatccgcccgaggcctcccaaagtgctgggattacaggcgtgagccaccgcgcccggcctgaactgttttcttaaattgtcatggatcacaccaaacacctgtgccagctgttatgcgcatacccttcggtaacaaaggaagtccagaaaaagagaataacttgactcacacaaatatttctagggaaataaggtaaataaaaagatagtgttgtggaggataagttggataatagtaagtgataacagctaaactttctcaaaggttcactatgtgccaagaactgtgctgaaagccacatgaattctgtcactgaatcctttcaacaaccttgtaagctgggcactagaaaaacgattacatttattttatagatgaggaaactgaggctcagattggttatgctacttagtaggtaacagaaaatcgattcttacctagcactcgaattctaaaatatgtgctcctctatgtcaagtaatctatagaactaagataaacatgctgatgaaagttagtgtctagtgggtattaataaacgcggtttcaaaactgtgtcaccacgggtagattggctgctttaaaaaaaataaaaacttcaatggatttatgagaaagaaaagtcatatgttccagggatatttatttattttcctgacagtggaatagcattgaattgagttatcaattcataaaagatcagagaaacaattcgaaaattaatagtaaaccctattatactgactaaatatggtagcagttcaaagaaaggaagtatcggtaagagtaaacatggaatactgtttcctcacttattctgcaaacatcacaattaggagaaaagaccttgtagttagactttcaaaaaaaaaaaagcttctctacttattaactgtggtcttggacaagtcatgtaagttgtgcagaagcattttcatctgtaaaatagtaataattcctgccttatagagttgtgagaaataaatcacataaaccttgaaaatgctttgcacaataactggtatttactaagagctcaactaaaaagctggttttacttttattgttattatgatctggtattgatactgctctaggacttggctctaaggcatgtttctgaccaaaagatctcccaatctatcagtaaagctgtgcttgttttttttttttttttaaagaatccaatataatgtgatagggatgtggatgagaaatttaacaggacagaatgagaaatgggagcaggctatataaatgtcacagtaaatgacatttgtaaatagagtatttgtccagtacagaggcaatataattggctcccgccctggggaaggattgatggatgtgtatcaagaaaaatttccaaatagacaaatgacagaactttaatatactttaggaaaataagtctaggaaatagcaccaaaatagataaaataaaaattttacatgcaattttttcttcctttgtctgtttttttaatccaaataataagttcaaaagcaaattacaataaaacataattttattggtaaattccagaggcaaaggagcaggtctggtcttaatgtgattatcaggagtcatagtatagagactgacagattgtcagtacactctcaaaatcaaacgtggtcttcattggatcttacatatttttactttaaaaaaaatcaccattggttagactaacttacaactaattagacaaaggtgctgtaagcctcattagcatgatagaagcatgagaatatagcaagaatgtagaatcctttttattgaagttttacttaaaaattttcctaagattctacttttgtactacagtttgagcatccctaatctgaaaatttgaaatccaaaatgctcggaagttcaaagcttttgagcaccaacctgatactacaagaggaaaattcacatctggcctcctgtaatgaatcgcagttaaaccacagtcaaaatgttgtttcctgaactaaattattaaaaatattgtataatattaccttcaggctatgtgtatgtgtatgaaacttaaatgaattttatgtttacacatgtgtctcattctcaagacttgtcattatgtacatgcaaatattttaaaatctaaaatccaaaacacttctggccccaagcatttcaaataagggatatgcaacttgtatttactttgtgcatttgcccccctttactgctatatctttcttttgttctgtatgttatgtgtgcttaaataatcaggaattcattgatattgtcaatcaaatcctgaaaaaaaattatatgactcagtcttgtacccctgagaatgtctgatttcttcgtaagttgtctttttttttttttccacaatagtgagtttaatgtcatgaatcttttcactcattcatactggtggagcctatttttaaagacccaatttgcagactgattactgtccttattcatggcaatacttcaactccacaatctttaattcaacaataacatcataattattgtataataaccattttatagtatttctcactattgtataattatagtagccataattgtcttaataaaaattgggacttttcatccagcaataaatacgtttttgtctgatttgtccagttatctaggtacaaaaaatggtacaaaggcacaaaaataaaatcatatttaaatatattgggataattgttgattttaggaataaattatcagtgtttccggaaatccaaattacatagtcaaaatagcatctgtattaggccattcttgcattgttacagataaatacctgagactgggtaatttataaagaaaagagatttaattagctcatggttctgcagtgagcttggtgctggcatctgcttggcttctggtgaagtctcaaagagctttcaatcatggcagaaggcaaagtggagcaagcatttcacatgatgaaagcaggaacaagcaagagagaatgtgggcaggaggcactacaaacttttaaataacaacatctcatgagaactcactaacatgaggacagcaccaaggcatgagggatctgaccccatcatccaaacacctaccaccaggccccacgtctagtgctggggattacaattccacatgagacttgggagggggcaaatgtccaaaatatatcagcatcccaaataaaagggttttttttgtacagttgtctatatttatcttttggaactgagcttaatagaaatgtttcatttagcaatgatttcagtattttctgcaatgactaaaaagcaaatagtgataatagtattattttatattgaccaagcatttttatttcattcactttttttcagaatagtgtatcatgaattagcagaaatgcatgttagaataaaataaggtgtcaagaacaatcttagaaaactaatgatggaaagcaattgaagcaatagaatgttttgatcacctgtttttcctgctgtgtttcaggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagaggtaaaaatgtttaaataaggagatattttggtgttatataattctgttgtttaaaattatcaggtgtttttaaattgcgtgtttccttcctgttaagaaaatagaaaatatctgtctagcaatatattttccatggaaaagttggtaataaataaattaatgatagattaaaatatagctagattaacaatatgctgacttatgtttccaatactgacattttgaattcttgacagtattcttgatatgaattttttcagtatttataaataattttaaatttctcaaaatgcctcaatttctccactttcttccttgtaatttgcccacaacagtgttttttgtacgtactggaaaaatatctgatgagagggtagttgcaattctcatcttgctatgttcttagttcttaattcttacgaaatacgtcataaaatagtattgtattttgtttgcacagacatatttactcaaggaagatctgattgggatcttggcttgatatttatgtatagtttatctttcctgaagtcagtcagtttttttgaagagaaggtattgatgaggaatcacactaaaaacatatttaaccctactgagctcagtgttcactgtttaaagaaacaaaaatccttaatacattatagaatgtaaaattctgaatttaccaactcagtaagtcctggtaacttaatgtattctttgatttacaagaagggtatgagcaacagaatatattttttgttttgtttgctattaacctgttgctcaataagtacagagttggaggtaaagagaggaatttaaaaccttgatatttaattgtttatacaaaaatgaagacaagatttccagtaattaaagtttgcactaactaacaaaaataacaaggaaaaacaaagattcgttccttcctcatacgaactgtttggcgaggaagataaaagcttctattcctgatgtcgggaaagaaagaatgacgacatgggggagtgtgggcactgaaaggtaaaatttaagtagcacaacatgatcatgataattaacaatcagccaaaattatgagggaaaatatagttataaaaaaagaacaaagatgggtggatcacgaggtcaggagttcgagaccagcgtggccaacatggtgaaaccctgtctctactagagattcaaaaaaattagccaggcgtggtggtgcgtgcctgtaatcccagctactcgggaggctgaggcaagagaatcgcttgaacccaggaggcagagattgcagtgagccgagatcaccccattgcactccagcctgggcaacaggatgaaactctgtctcaaaaaaaaaaaaaaagaactagctatttcagacactttttctgtatttatttgataaaattactaaagagtatgttattttccattttttcttgtttgtaagttacgtagtattgctgttagtgattaggtagaagtagatgtttaatgggaaattcagacaatctttgaatataggaaggtataaataacagggacataggtatcagtttcacaagaaataactgatgagattcaagggaaaagtaataaaaccttctgtcctggggcaaagaattactttaattggttgaacttaaatttttactaactagattattgtttgaaagttgaataatatcttaaaatcttattaacaaaattttgaacaagtgttgttacaatagttgggttatgctggaagggtggagtggcccaatttcatatacagtgtactgctcttatagaagctgaagtcggcatttataaaatagaattcggtcatttgaattttgatgtatattcccctctcattattttgaaattatgcctaatggtgaatatttccctaatagtaaaaaaagtcaatttttattttcacacatgtttagttttaggctgtcatataaactaagaatgaattatacagtatcaaacgttgaagccattggctagtttaatcttttagctaagtttcagtatcttttgaggaatgtttaacttgacatccagtcttcttaactttaagagattttacagccgtgggttttccaaaagagcgtgtattttgccttaacttaagccattatgtctgaagtaagagggaagtccagtgatgtggggtttagagtagggacatctcttgtttctcttgttatcattaagctttttgatttgttttcccattaagttagctctgagttaaatactctaaaataatatttgtgaattcagtatttcagaattggaggaagagaactgacctgccaggtggaagcagacaggattattttattgcttgagttgtggagtccttccaataccttcccagcatagagactgttacttcagtgttaacattatttggaggggtttttaattctggctttatatcaaactttctagacataaatttataaaataataaatgatgagggttatcgccgtgaaagaggttatgtgtaggttttgatctttcagaattttacctggtagctctacactaaaaaactagagaattaaaacaattattgaagaatttcagacactcgcatttgaaatagcatttcttgcctgccttctagtcatttttgtctggtcatttttctaactgggggacaggattacattgttaaatatcacaaagtagtaagaaacatcatgaggcttattaccaatcctttctaaattaattttttaattaaagaaaaaatgaggcttttttactggaatgtctaaatgaatttttttataaggcagactgagtggactcagaggttttttaggtgttcacagtaagtcctctgcaatgtctttgctaaatttgtatgattcttcagtagttttctgtagattctctagagtaggccatttaaaatcatgtcataatcccctatgctttaattttaatgttatttcgattatattaatgtaattccttttgtgattttgaatgattgttttttcttttagagtatttaataatgtggaagccatgcttgaatgactatttttcgaagtgaaatttagtagtgcgatatggtgaccttcaccgcttaccattcttacttctcacaggagtaaaatcaagctggagccatcaagaatgcagctctggtgttttttaaccagccagaggctcgtgccaccacttttacccaggttacccaagcaagttgtacatctataaatataatcagtttctaaatgacttttgactggcctgcatgttactcagctacgttccttgcccttccattggcagtaaaataaaaacatgcacagctgctattatgctgagtcatacaaagcatggtcaggcaagtctgacaaccctaacttaaaaaaaagtgatttagctgctaattttcttacatagattttaatagaaattttattcaatgaaaagtaaaagtgcatgcctttatggattatttaatttccttttaatgttacagagttttgaacatattaggagcccaaaggagaaatgtaggtgctctttgaaaacttgcaaaaatgctttttatcctctgtctttaaaaaaaagatagcccagttactgtacttaagtcttgacagttttttatttagtgtaatgtttttctgaagggtaatcttcaaattaaagcaatcccttattcatatgcaaacttcccaaaggatgttttaatgtgataataatgtaaatgaataggaatgtctgtgtttcagttgctagcagcatgggtataatatttatctgcttcattttagggaaaatggcactgctttatttaggagttgaccaacagtattttgtatttagaatataatttctttggaaagtctgtttatatttacccttaaaactcttagactgaaagaaaaggaaatcatgtcttttgtataccaaataataataataatagtgataatgagagacttatagatggtatgctccttctaaaaatagatttagagtccatcttcttcattttcttggctcctctgtgctttctctcccctctattttattgagacctgctggaaaactttctcccgaagaatattatttaaatttatcatgatccacaaactcctgtataggaaaagaatcagaaactcttgctcctagggtgtttttaaaatgaagagacttccctatcatgtgacaatagcaataaacgtaacatcattctatgggatccattagtcgaccttcatttcttaatgttgaaatcacagttttatgcacaaatatttaaccaaaatgcctaaacccaatttaatcatttttaagaaatgttaattattttgtcacttagatacagtttcctctccttttgccaataaaactataaaacagcactaatataaaagtgtagttggctatttggaagaagcaataatcatgccattcctggagcattcttttatactttggaacaaaatattccatcactggctctccagattcatgagctataatgcctcatatattggaggaatgggatgtaaaatgggatccaagatgcgtaattgtttacagttaaacacagatgcgcatatacacagggactacagataattactttttcctattatgtattaattcttcagaaaagcatgagatttaggcactttcggataatagcttgtttctcggaaagaggcaagggtagtttccttattctctgagtatcccattttgccaatttcctgtttagaaagatacttgaggcatattatccatcaacgtatctaggggattcagctggagtaaaggtggtagaatagaagctaagaaggaactggttcgtttattttcaatcctcacattatggcaatttttgatttccttgtaaaagtctatgattctccctcaggaaacattgtccacttcctaaaaaaatatactaatttctaatacaggggtttggaaaggggacaaaaatgtgcagggaaggtttgcgtaagcaatggtggaatgggttcaacagacacctgtctatgactttatcctggagaatgtgtagtcctcatgggaaagttttccagtgggatagtgattaagatggaaaaaaatgcccaaaatatctttaatataagaacaaaatgggccaaacacgtgtctttgggtcactggtaatctactgagcagtaggacatcatgacataagagttccttttgccatccgaagaaaaatatttaaaatcctattatttgtggttttaaaaatgttataatgtattcattataaacactaaaatgactttctggataatatagtatactgtgagtaattattttgattttaccatattcttttttagttctcagaaaccaaaattgtcagatatgggatacttgatttaatctgtatttgaagttttctcttttttaagtgccaattttttaattaaattaaattaaaatctctctctcttttcccaaattatatacaatatctactaattatgttttcttcgaaatgtatcttagcttcataatgagaagtgagtgtgcccatgaaaaatttaataggaagttatgttttctcttccattttctgttgtgattcattatttttgaaaataatttactttcatttgctcacatttgctgtctaaagaaaaactattcatctggcacattcatatttagtagtattattaaagcagaaagcataagttggaagtataatatctaaaaatacaaaatgaagtattgtaccttgatgtttattagatcattaagcaaaatatgattctgccctgcttaaatcatttgattataattatccagcatataaaagaatcacagtagattttcaataggaagagtcctataatattaggtatccaccaaaaacattgttcaagtaatatttccacctgaaagtaaatgattgccaatgctttttttcagagcatataaaattggctattcctatttgatctcgttattgtcctggcatccttattttgttaaattttaactaggcaagggctatgctacaaacatcagttagtccgctagtttcctgataaataagtacaggtaattaaaaagtgaacctaaatatccaaattataccaaagggacatatatagaactttttaaactggatctgcttctagccagttcatattttggtcacttactaatgtagtatttcaccataaattatgcctagattggagcatttacaggcactctttatctgaaaattcttaagtgcatgagttgtaacagtttcacatagtgatcatctcactgttctaattggtgactatgtactacagttaggttgatcgtaattatgaccttaaatgaagctgaatatttttatattcctaatttgattaattttattttatgggcttttacacattttaactgctttagtcaacatattttataatattatgacatttgcctagaatgtaattttaagaaagtcatttaattgatgttatcaagaagggttttataaatcagaatttcctgcctatgtttcaagatcattgcttaaagaaaactttttgttcatgtaatattccaatgtgtatttagctttactctacattaaaatatgttaacaactatgaatataacttgaattaatactaaagttcatggttttgaaacatggaaatcaacaatatcataagcactatcttgaacctacaatatttgattacatatctagtctactaaatgttttaaattgataaacattgggtttacttttgaatcatcaaaaagattctttagagaagcttggcagaatggggtgcagaagatctggaatccaaccactgattcgctataacttttcacaagacgataaaactcacatttccttctctaaataaatactggattggctgacattaaggatcaatgtgctgcctagattctttgttatttgtaaatcaagtaccacaagtggaaaagtattcaagtaacacatgtgacagatcctgtgctgctccgcttcagaagacagtggggaaggataagattgcattccttaaagaggccccattcatcactggagctatagatccttgtatacagagtgaaaagagggaaaacactgtcaaaatgatttagtaatagttttcctgactccacagttaaactacagttcacctcatacactcacattaggtccgaataattggcagactggttttaagacaatactcctagttctaagagttgttcgtcattgcccacacaattcagaatcttaaaagatttgtgttactctgcaattaagagaaaatattgtgtgtattcttttgaatgtgaaagtaaatatcagataggaagtgttagtagttagtggttggataaaagagtcctcgcactggtcattcattcatttacccaaaatttattaaacacaaacattggtgctagagatacaagggtgacgaaaacatgatctttcctccaaaaaattaagtctgatgagatgcattttctagaaacacaaaatacttttgaactgaaccttggaaaaagtaaaaacttgacctttcaatagataaatatttggctttaggaaaaaggtatcttaattctacatcagaactaaggtagtgcactaaaatgaaagggagcaatgttaattcttctacttttaatgtgatttaaataagagaaaatacaggaatgtcttttataatttgaaattccagagaaaatgaataaaaaagcaattaaaaaaaacacctcaacatgcttctcattttcagccaagtacagcaaactctgtttgatattctctgattttaaccttggatcaaactatttggcaaattgctaatttgaacaggctattgaaaacagacagtgtatctagcaattcattcattcattcaatacttaatgaacagcattttggcaattcaaagcctgttccttgtattgaactatattggtgtattatccatatggcctagagtacatgtgtattattcatattatccatattggtgtattatccatagggcctagagtacgtggcttctgcccccaaatgtcttacaagcatgttaaagtacccaaaatccatccaactgaaataatttgacccatacattatcaaggttcaagatgtgtgataagccatgaaaaggttggtgaatagcctagggtgcatatggtgagtgaagatggatggaagaaattaggagtccagatttattggggagactttatgaaagcaaggaatcatgattgttgcaaaatagacagtgaagaaagaaatggtgtggtggtgaaagtcttcccaaagtcatttaaagtattggcaacccagatacttggcagcaggagtgataattgatgttacaggaatcctatgtaaacttttgcacattttaatgaagattttctataatatgctgtctggtgacttctcccaatcactgtcaagggctagacttcattattttaagatgtctttcattcatttattcactcactcattcttttttttaagcaaaatttattaagacctgtaacatacttagcactgatgtaagctctgatacagtcattcagtaatgtcagcctgagcatttgcagaaccctgaatatggatcctcatttttcccttggggtcacccgaagtcttaccccgttctgtgtttacagtgtgaaccttattcttataaggaatattttttgtttcttattgtggattgtctgtacttccatcagatgtgactcagcttcagtttttctgattacctgtgttattttccaacatgttgcaagtgataagatcagtattatcaggtccctaatagcataacaggttcgtgtgaattagatatattaaaatgagaagatttttaagtcattttttagtcaattacgtgtatagaaacatagttatacttatctcagaaagattccaattcaaaggataggaaattagaaaaacatgtaatgtttcttctgagaacaaatatattcaaattttaatgacaaagatattaggattatttttctagtaatttgatatacctgataaattaaaataagaaatcatcaaccttcaagcaccttataatatataatctttgatttaacttttttggacaaattaaaaaataattctctaactcaaagcaggcagaagtatctaatatttatgcttccatcattagtatttttaaagtacaagagacaaaagcatttttaatctcatgtatatcatacatcaatattttttaagtcatcagcatcactatgctaaggaaatattttatataaagaaaattattttcataaaataaagaaaccatctttctagagaaaatccacataatcctatgcccaaatataaatataacatttacagtactgactacagcatccatcttattctagtttaacatacttcagtgtgcattttatcatgtgcttacctcatcctttttataaagtatctcttatcagctcaaccatttcctaatgttatgcactaatggtaataacattgtaacaggtccgagaatgctgtggcccaaactactctgattcctgtgtggcactcacacctggccctgcatcatttctagagcattttaagaccaggttaaagactgggatcccttcatgtatgctgatcccaagaatggaccgacctggctaaagtttattgcatttcaagatataaaacaacttctattatatttttcttttggtgatatttgatttaacctaaaggaaaacaaaagaacaactaaatattcatttctgcctgtactaacagggcaggtaagagtgccagagtaacaagtagtttccaaatgcacaatgaaacacaggagtgcattggccaaagagaatgcaaaatatcagctcttgctatatagctaacaatgtgctgctctttttggaattagaaaattatagaatatatttaataacaatctggtatatgttttcatgtcaatgaaaagtggataaatttagatggttgctgtttatgtgcatttgatcaaatcttttctgaatttgacatgaaaatacacttgtgcagctttcattggttgggtcacaattttagaataaaacaaactatttgaaaaccatttgcaaactaatgtacaaaagcaagatcgcagatgattatatgactctggcagcttacataagctttctgcaggattttctttcagaatctctatacataggctcaaacagaagttatttccgttgttagcaccatattttaaagaaaaaaaatactatggtgttgtatctaatcttgtgacccctgacctttaccaaagcggattggcattatgtttaagttcttaaattacagatcaagaaaatgcatacagaagatggggggggggcacacctaattaatttttatatttagattaaagaaaataattaaatgtgtttttttgtgggattgattttcagaagctaaatgcaactagttcatctgaaggcagcacggttgatattggagctcccgccgagggagaacagcctgaggttgaacctgaggaatcccttgaacctgaagcctgttttacagaaggtaagcaaaacaataacatatgtggtcttgagtatcctcttttctacccattttttcctatttatttaaatgtctgtttatttgtctaccatctattatctatctatctgtatctatctatctatctatctatctagtaatcatctatacctatccaacaactgtacatttatttgtttttttttgcatttgctgtttgaaaaaaaatgcaactttttaaaaggcaaagtttaatttatgtaattagatattttcatttttatgaatcatttttaactctaagaaattattaactggcttttctgtggccttctaaaatatcttacaggagagaaagccaaatcacacacatctctctttagtttaaaaattcaataaataagaaagtgagagaagtaatttattatgtactattttgtgatattataatgggtaataattgataagtgtacatttaaatttgtccttgactgaaacagctcctatttcagtcaaggtcaaatattttttattatttctgaaaaaagatagatcataaaaatgccaaaatatactatgagtcatatgatatggggcaatatgtcactggagtaatcgcaaaaggattttctgaagaaagctaaaattatgtaatttgaggtatggatcagttatatattgtaatagcaatgctgtgtatcaaaccaccaaaaaccctgggctctaagctgcttttctagttttgactcctatttccttctgtgtaactcacagactttcttgtcactaagttttacttgtatcattgtttctctattcttacagcttcattttctacatatgtctcttatatatccttcaagatctagtctcaaatccatttcctccataaagctcagaaattaaagtttaccagaaaactctcataatactttgttttgtgataattgttgctttccataactatagaattgtagacaaattgccccaacttaaaatgtacattctttgaggacaaggctatgttttacatgttatagtattacaatttgttctatgcaattttttgacaatagtagatactcaataagtatttgttgaagagcctttgatctagcaatccagaaattatacaaaggtgtttattggattgttattgataatggccagatttaaagcaaacgaagtattcaataatggtggaattgggctgggcacagtggctcacacctgtaatcccagcactttgggaggccgaggcaggcggatcacttgaggtcaggagttcaagaccagccaggcaaacatggtaagaccccatctctaccgggcgtagtggtatgtgcctgtaataccagctacttgggaggctgaggcaggagaatcgcttgaacctgggagacagaggctgcagtgcatgagccgaggtcaggccactgcactccagcccggacaatagagtgagactccctctcaaaaaaaaaaaaaaaaggtggaatagttatattaattatagtaatcatatttagagaaatattatgaaatctttcacaaatttatttacttataataaagatgggaaatagttataccattaagtgaactaatcagaattcaaatatgtaaagtgtccatatagagtggaattacactcataggataaggacaggatggaaataccaacttttggtaagtttattttctttttggttcttctattttttatatattgtgtttttgtaatgtaatccattatagtagtgctataaacataaaaataaatatttattaaacaaatgattaaaaagccatatagatgattttaagatagcttttgtaagcggaagctatcttaaaaattaatgttatttacaatgtattatcaggtaataatgtaaatgaatctcccaccaacacaaatatacctaatcaaagagtaattttttgtcttcatttttttcccacatattttagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggtaggtgatgcatgatccactccttcacctttcatctgaaatcttttccctttcccttcaatcaactcatattacccacttttaaattaaggtgtttgtaagaatgagaagaaatatgtgtgacgtgtttagcacatatgagaggcttagtaaatagcaatttttgtcactctgtctggagtagccctcgggtggaaccaaactcagatcattatggtttcttataatgtttaaagaaggatctttctgactttcagtcatcagaggcagttcttattaagactggttatgtagacatgatgtaggattatcagctaaatatcagactgaagcacgatatttccctgacccctttgcaggtgagaactagagtgcatgggtgccggtaggagcgaactccactcactcactgctccacccctcacaggagggggagcgcaggtgactgggtgcaggagccaaggcaaatgcatttgggcactgcaagagtgaactccataccggccccacaggagcgtctaggggagggtgcctgcgatccttgaagccctagaggaagtgttacagtgcccttttagctttgccatccatggatggcttaaatgttaacagttcagtggagggtcagagtgacagccttttgcacccacacttgtggtacccaagttcatgtccggcgtccaggaggaatgagtttgtacaaatgacttgaagatggtaaatacaggggattttattgccagcgaaagtggctctcagagggaagaggagctgaaaggagatggagcaggaaggtaatcttcccctggagtctggccatccccagccagactcctctccgaagctatgctgtcaagctgtccctctgatgtcaagctacttctctctaatgtccaactgtagtctctgatgtccagctgttcctcctgtctgcctgctgagttctgggctttatataggcacaggatgggggcagggtgcaccatgggtggttttggaaaaggcaacatttaagtgagaaaacagggatgtatattctcactttgggccacggttccaggcttgagggtggagccctcgccaggtacccgtcctcttctgcccagaatttctctgcctcttgttcctgtcaaaattgcttaacataaactccatgctgcaggggactcctctgtcttcttcacactgattcgctattgccaaccacagtgaatgataagaagtagactcacttaattactgactagcaaaaaaatgatggcattacaaacttatgtctgatttcattcaatgaaatgatcaactggatcaaaatattaatataatgaaaatgatatgacctattttcttaattggtgatacaaatgtggttgcattccttttactgtttcaatttaattaataactagagtgtttggtgagttgatttcattaggagaattactgcattggatctggaggcctctaaggcgaattctgatttgactaagaatcctgtgtcctgccatatactcagtttaaagaggatcagccatgctttattttctttacctttattattattattattattttttagacagtcttgctgttgcccaggctggagtgcagtggtgtgatctcgactcactgcagcctccatctcttgggttcatgccattcttgtgccttaacctcgcaagtagctgggattacaggtgtgagctaccacacctggctaatttttgtacttttagtaatagagactgggttttgccatcttggccaggctggtctcgaactcctggcctcaagagatctgcccgtcttggcctcttaaagtgctggaacgacgggcgtgaaccaccgcaccttgccagacatgctttctaaagccaagtagagagagaactatgaagtctcattagtgactagtacctttgctgtaggagctctttgttctcagttacacccagtcagtgctcaccaaattgcacaacgtgctggcacagtggctggctcctcaggggtttacagcttcagctataagcaaagcccagaaacctttaggtccttgtatggagctctggttacaagccctgattcttgttatctaaaaaagaaaatgttcctttgtctttaatccaggctgccaggttttcctgataatttttccgataagaagatcaagttagataaatagtcttttcattctggaagcctcaggagttcctgcaaatgagttacccactctttcccaagggctctggaaaattctgtcaaagggaatttccaaacgtacacccacccgcctccacacacacacagacacacagagagagggagagagacaagaaagtgagcaatgacaatcctttcctttttctgtaggctgagggacctccctgctttatatctgcattactagaggatgcattccattgagtctgcactgaatgagaccaatctactcccaggcgttccactgcctcctgatgtagagagaagcagctggcagtctctcaaaaattttaagctctttgggggtacactgagaccaaaatttaaaaattactgaaacccttggttgactgaaatgcccagtcagcagtcatttatgatcagataatgataaagtaaaattcagccatgggaaacattaaaccttccagccttaggcacctgataagagcttgcatcgtttccttttttaagaaatcatcaattagagactgtttctgatcataaaatttaatagaattttttgacttacaggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtgagtatgctgcactttgctgctttattcattggcatatatgtaatagttctagcaatggtgcctgacacagtgtaggcactcagtaacactgtatcagcccaaatataaattatgtttctcatttcacagtgagaggatgcctcaaaacattttttaccaatttaaatacatatacattcatagataaaaatcaaatgccatcatactatacttattcacttaatttcaaattaatatttaaaatctcaagttatgcaaaataaaatatgaatttagaaattttgctttttgcacactcacatttcgcaaaataacttgtatttaaatttttcacaggcatctttgacattagtatgtttgtcatcactaaagcctgttgagtttaggtcacacagatgaatcattaattacaaagaaatttgaaagtccaaaaagcaagagacaccacttgatttgtatgatatagaagcaaattggctattgaccaagtagccaaagattttattaaaccacattggtgttgaaataaaataagatagagtactaaaatatgagggtttttatataattgaatatgaggcaaatctaccattaaatgtactactactattaaatgtataaaggttacatgcagaattacattaacagtctctggcaataaaggaagacaataaataatatttagaactacataagtgtggacattacaaacaatagaaaatgcaccaaaactataaccattcttttatttgtataatgggattatgcatgatactatttcttttctctattttctgtatgtacttatcataggttggtaaatccataataaaaatatctgatacttgatatatctatgttaggataaaagtatcaagtcagcactgcttgaatataaggaaactcttcagagaaatctagttgtcctgcagctaatgatcatattacccaaagtactctgatatttacctttttagatttaagaaaactattatgatagtatatgaaactgatcaacactttgccttaaatcaaatatgcttattgctcatctatttcattatgaaagatacaaatataaataagtcatttttctagtcctgcagtagcttacagttgaaaagtgaggacagctgcgtacacagtaagtcgacacctgtattacaagtgccacctctttacttgaggaaggaggaaaggcttcaatagggaagtggagtgtgagctggagcttgagagatgtgaatgctagcaggcacagctgagggaggaacacggattcgttaaaacgttggtgcatgacatgcagggcgggttccagaaacaagtagatagggtgaggtaagcctttgtaatgggatgataaggtaagaaagataagttagaaaagatctgaagaacctgagatgccatccaaggaaatttggacttattatttaatacagaggaagctattgaagaattacatatagggaagtgacaagacctgcttgttcttttagtgagggaagttaggtggaggtgagaatgacggaatagaaaggagatttatttagagatcaaaacaccaattaggagattgctgcaatgtcccagaaagagaaggcctatatgtatcttcttttccacatttagctacacaagtcacataaaactgaatattttacaacttcttttcagccagtaaatactaccccattcaaaatattttcctctgtctaacttttatctttcatcctttaacttatgcttatctctttttggttctgtcttcagagaaggtaaagtactacaggtccttatatcttaaatacagaaaagcttcacaactcatgataattcagtaactatttttcaattatctgttaaaaagggacttacaaagcctaagagtttggattttaagggaactatatgaactatgtaagacataattttacaactcattgttttctgtattcaagaggcttcactttcaaattgcatgtgcaaaattattttgaataagttgttttttgtaacaactttcaatgtgcttcacttattttccttaaaaaatatatttttcaaatatattaacaccatactcttaaaagctgtattgcatatttatttttatttatctgcttttgaaattcaggtgtactttagaacaaaatagcttatataattttaataatttttctatatgttttcaaggaaattggacatgtgtatgtcccccgaccgtttttctttttctttttagctaagactttataatttttctcaactacattagtcaactgtatgaataactaaagacaacattgttcttgcaatttctaatttatcataaaatctcaactttttttattcactaattttgtctgacctaattaatgatattatgcccttcaaactgaaatttacaaaagtcaaagctgctttttagaggcctattcctttttaaatgtgttcatgctcatattcaccagtggtttgtatagtttacttgtgtatcaaatgttactttccatttcagatctgctcaatattattagaaatgatacagaaataagttttacagatctgtagaggaagatcacatttctctctcttttttttctttacttttaattttttaaaaacatttcctaccaagaatcttgaaaaagagcacatatatgggcttcttttttataagtgttcgcagactagtatcattaacttcaccctgggaacctgtagaaatgcaaattcttaggcctttccccaaacttactaagtcagactctgctattggtgtttttaacaagacccctgggtgattttgaaactcatgaaagttcgagaattactgattcattgcatagagcaaggctgaactgtgtagacatttttatatgtaaataagaaaattgtgttgctttttctgtataggtctcactggttagcttaactgcaaatgccttgggttactcagaacttggtgccatcaaatccctcagaacactaagagctctgaggccactgagagctttgtcccggtttgaaggaatgagggtaagactgaatgccttagagtttgtcagaattattattgagagcagactgacactttgtaccatggaaatgtcaaatttatggagaatttgtgtcttacacattcatactgacatagctaatcaatcaaaaataatatttaccagatgcccataatacttggcactgctggagtcactcacagagtagtatattgccagagggattgtttctgattagctagattttcacttcttggaaaatctctatagttatgctgctgatttgaatcaagattatttatgttcacttcatttataaatgtgcaggaaatcctactcgctgtagtttaagcctaccaaatcattgctcatcatttcttcactactccgctgtgatacactttgagccttttgatgtttgaatcaggccttttagttcttaaacacaggctgaaatggctaaaaagtaggtcaactggaaatctaacgctcatttagaagggtggtacaaaagaacagaggagtttgtgctgacatttgtcgtcccctgaggcacaaaacctgagaccacataccctcaccacctagaaaatgatgatgccttgtctcagttgttttagctggttcaaagaggattttaaaaaaatgatactttttgtgatatttgaaaataagttgcttagactttatctgcatgttatagtgatactagctcatattttctaactaagaaaatagttacttagactttatctagtgttacaatcacaactagagatgaatggtgtgtgtagatgtgtgtctgtatatgcatggttacatagaaaagtgttattagcggtaaaattctttttactttaccaattagaaagaacagtttttgcagtagaaggcttaataaacaaaaggtatcaatctttcagtaccagaatactgtttatattttctgtgtggaatttgatccccaagtggtctcttttactctcaaattttggacagcaaattgtatggtttgtatgattttttgaaagtgatgttcacttctatattcatgccactgtttatactcttaattatttttggcatttgctgttagttccatcctttgaggtaaatttgctacatgtgtgttattacctcttgagaaaacattctccaatataaaattcgttgtatactcttctgatttataattttaaaattcttagttggagctaccagagtctagtttctacccaatattcaactttgaaacagatttttttaatcatttgactgttcttttaataatgtttaaaaataagtaaatatttgttgttggcttttcacttatttttccttctcatcctgtgccaggttgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagtaagtaatcactttattattttccatgatgtgtaattaaaatgagtctaaagtttttcttcctcataatgagatatccacctgttagaatggctattatcaaacagataaatgacaataaatgctggcaagaatgtgaagaaaagggaacccttgtacattgttggcagggatgtaaattagtatagcttttatggaaaacagtatggaggtttctcaaaaaactaaaaatagaaccactatgtgatccaacaattccattactgggtatatatacaaaggaaattaaatcaacatgtcaaagagatgtctgcactctcacactcactgcagcactattcacaatagccaaaatatggaaacaacctaattgtccatcaacagatatgtggataaagaaaagtgtgtgtgtgtgtgtgtgtgtgtacatatatgtatatgtatatatatacacacacgtatttctatatacacacgtatagatatacactgtatatgtatatatctatacacatatatagacatacacagaaacagtgtttgtgtatgtgtgcgtgtatatagaagtagtcagggaaggggcagagcctgtggcactaagaaactgagaaaatgtacaagacttttgttttcagaattactatgtccgcacaacagaaaaagtatttcaaaaagtaaatgcgcttgaatgtatttgttttcagtttaggaaactgcttctttttgtagagtgccttaaaatagtatgttcaacaatattaaaaagattttcaaaaataagccctcgtgattgatgattggtaataatcatttaaaaacttattggatgtatatatatgtgtgtgtatacacgcacacacacacacacacacccctatagacatacacaatgaaatagtattcagcctttaaagaagaaggaaatcctgtccttttatacaacattgattcacctggaggaaattaagtgaaataagccaggcacagaaagacaaatgacacatgatgtcacttatatatggaatctaaaaaacacaaactcacagaaacagaaagcagaatgacaatcaccaggggctgggggatgatgggagatgttggtcaaaggatacaaaattcaattcgacaggaagaatacattctgtagagctattgtacagcatggtgactatagttaataataatatattatatacttgaaaatagctaagtgagtagatatgttttctcatcagaaaaaaataagtataagaagcgataattatatattacttagcttgagttagccatttcacaatatatatatatttgaaaacatcattttgtacaacataaatatattcatttttatttgtcaattaaaaaatgaatatatttttgaaaagcaattaaaataaaaatgcatatacattttaggaactctatatagatgcactaaaactatataaaaatgatataatactatacaacaataaaataaaatttttcttcctctgtgtttacaaatacttccttaggcccatctgcctagattcctcttaccatgattgaactatcttttctgccccacgctggaaacatgatggttctaaaaactttattgtctccctgactatgcatttggtagcatagccaagtcctttgttactgggagtttaatctaggcactcattgttttcctcccttcctactctgaggaaagaagtgctggccccaaggggggttgaaaaggggtgtgtgtgtgtgtgtgtatgtgtccacacgcgtgtgtgtagatagagaaagagagagagactttcaaataggaaaattgctctcttgcaaatgaaaactttccaattaagactattgtgtctgctatgcactcataataattcattcagctattcaactgactgcagtattaaatctccactagctcctggacacaatccacttacacgatcctcaagactattaaaatagtcaggaaaggggaagagcctgtggcactaaggaactgaaaaaatgtacaagagttttattttcaagatcattatgtcaacggagcagaaaacaaatatttaaaaaaggaaatgcagtagaatatattgttttcagattaggaaactgcttcctcttatagagtaatcacctcaaaatagtatgatcaacaatattaagaagattttcaagaataagctgtcatgattggtgattggtgtaataatcatttagaaaagaataagtagaaaggaagcattaagataaataatgcagcatacttttgagcttgtctcatgctgctactatacacatgaaattttttcatcaaagttcatgatatatttttatataaacacatcagagtcaaagattgttcatattgtttttatgatagcatattgttacagtagatcattatttaattatatatgctaaatatccacataagatgttatagaggaatataaatttgaagtattttcaatgcatatcgcaaaacattgccccaaaagtgaatacaaatttcaagcttatttatatgcctgtattgaatacatgtcaaatagaattttgatcaattattcaatttattttctaaaattataattttgggaaaaaagaaaatgatatgacttttcttacaggccacgtttaagggatggatggatattatgtatgcagctgttgattcacgaaatgtaagtctagttagagggaaattgtttagtttgattaaatgtatatttctacaatattgtaatttagtgatattgtcaataaaataaaattatgtgcttaatttataaaacccatctatattataaggataaaatatttaatcatactatttctttcaaaattatcataggatgattttctctaatcactctgtatcttttaacatatcttttctagtatttagcaaggcacctgacacaaaactttattgtatgtattttcaaaatgagacattttatttttggctctgatagtcctggtcatttgtgcattagaagttctcacaggcaatattttttatctgtaatatatttcctccagcttttgatcttccttataataggaaggatatgactaaaaacggggacaaaaataaacaatttagtgtttctcttgggaaagtgagattaagtggtagaagggagggacttccctaatctactttatacataccagtactttgaattcttttctataattttcattaatttctcactatttaatgaggaatgaagtcacattttgaaaaaaaaaaaaaaagagattgatttctggtatgccagagcatgataataaagctcaaaatgctctttccctagcaccagcagctagctttctgagtgaagaattcctgaggtttttttttttcttttttccacttcataaaaacagagagggagcaagaaagcatgaaaagccctgcattgtatctctataagtgctatcaggaattccagttatgagatttttctgaatagtaataataatttattgattatcactattcactgtgccaaggactttctcacattatcccatttaatcctaaatgacaaccttattgtataggtgatactagctctattttactactgaagcaaagaggcttaatgcgttaaatgggaaaacaagtttttgaaccctgaccacaaataatggctcatacccactttccacagtggttcttacctttttgattaattaattcaatgctctctccaccttccttatcaatagcttatatgccatgaaacattttcagtttcttctttaataacttagcagaccttttccgctgcaaaactcctggaatttccagcacattacaaaagatgaaagccaattgagcactacatttatgaaaagttgctggatcttgaactttaattagtaaattgcatcagataaatgcaaatttaaaccaaaataaaacattatctacacacctaccagattggcaataccaaaaagtctgacaataccaagttttaccaaggataaacagcaataagaacactcgtacaatgctgataggaaaaaaaatagttaaataatcctttaaaaacagttgggtatgatcacattatttgagaaagttaaagatattttttaatactgcaattctactttgaacaacgtatcctaaagaaacttatgcacatgtttaggataatctatgtacaaaaatgaatataacttttttttgcacttgcaaaaaactgggagcaactcaaaaacagtagaaataggcaaataattgaatactatatagtgatgaaaatgaatgaataccgccatatacaaccacatggatgagccttaaaaatacaacattgagttaaagaaactagacacatactataattctacttatataaagttcgaaattgacaaaactaagcttattgttcaaaactgcatactgaggtgttaacttgaaagaaaaagcagggacatcattaccataaaagtcaggataatgattacctccagcagggatgatggagtttatgtttgagaagggtacaccaagggtttctgaagttgtagcaatgtcctgggttatggatttcacttataaaacatattatattttgcatttatgtattatgcactttcctgtatgtatattgtcttttaaaaattttaaaaatataattttacatcactgttaactaaactcacatacacaaataaaatctcatcgaagaatagcagttttacaatattcctgatattttccattttgctgtatttccttagaaacaaaattatgctggtcataatcctctaaattgatttcataacacagtgggttataacttgcatctattatcatcatcagggattggttaactgagttggttagaacaatgtcctattagacctgtgaaagcttacagctaaggcgcaaacctactatcacacagttttctaaacaaaagtggattagacaagagatagtatcattgttacagaaacagtccctactgaataggataaagcaatagattcattttcagaaaggaaagatcaacctatatacctacatgcagacctactacaatgattcttgcctatctaaagaaatgtattataccaaacccttacacttagcaattactactggccgccactgttctaagcatatttatatgttaatatagttaatcttcacaaccacactatgaggtttaagtttgattattttcatctcacagatgagaaaactgagtcagagaaagtaaatcttaaaagttttgacatagaataatgtgacgctgacatctcttttgtaagaagaggaaatctttaatttgcatgctgtgttgggaactttgcttagaaaggaaagtgcattcataatctgggcatttgttgggtgaaattgtctataatcattcagacttctatatggttatttcattttcccaggtaatgaatagtcttgcagaactcttcaataagcatgtgagatttgaaggttcataaaatctgtttagtgtttggtttattttcattccagagattaaaacatgcttagataattaaaaactcactgatgtactttttgtgaaacaagtactagatataatggttacaattcttcatattctttaggtagaattacaacccaagtatgaagacaacctgtacatgtatctttattttgtcatctttattatttttggttcattctttaccttgaatcttttcattggtgtcatcatagataacttcaaccaacagaaaaagaagataagtatattaaaacttcatccttgctctgaaatatgaactaaatatttcatactctttcctttagcctccaaaatgcaatcaccaaaaaaagaatataaaattcagaaattattttgagacatttgataatcgataagcttttaagcaattaataattcagatagcatgtttttgatatttttagtctagaaatatgactaatatggcataatttatatattgaataaaggcatctctataaatacagatattagtaacaatagaatgaaatgtgggagccaattttcacatgattactaaggtggattttatagccagcaaagaacacaattttaacaagtgttgctttcatttctttactttggaggtcaagacatttttatgacagaagaacagaagaaatactacaatgcaatgaaaaaactgggttcaaagaaaccacaaaaacccatacctcgacctgctgtaagaataacatattttcattgcctgttaaaactatattacctaaccgtttcacagcccgaatttctagaaactagttatttttgtggatttgtaacacaaagttttttaccttaacaatgggactagctagcctaaatagcttgaaaaatgtactttacatatataatatgtataaattatataatgcataacatattttatatgtaaacatataaaatacatagaaataaaatttgctatacttaagtgccagtggtatcatacaagctgatgtcattaagacacttctaataacatcaaaaataaaatacatacatacataatgtgaaaatattaaatgttctcagagtacagaggagacagatcggaataattggtacgtcacagattggcctcagtttttgtccaactctgcagattgaatggaatcattaatgaaacaggccacaggttttgcttttttctggttaaacaaaaaaaagacaaacctcatattttcccctactatcccacccttaaatgagatgatatcattctttgtagggctttttattggctcttccaggtgtacatttgccagtgatactgttcgttcagtttggctgctgcagggagttgctgccaggagaatcgctaagtttttctatcactcctgaaggactagctcatatattaagtctcagaaaatcttccccaacgtatacgtggtataaaacacttcagtgtttctcagaaatcttgactctataaatctattggtgacaatataaaacagaccgtaattaagtgttcagttggtaagccggccaataactcaaagaaaatggatagctatattgggtcaaacacaaagggtgtacaacttgagcctagtctttaggaaataatacaatttgaatgaatagagagagaagcagagaacatttactgtatgagaaaatgtatacttcatagccatatagacaaatatatcagtgcagaatagtgatgcatttgaattagtgagtagtagacactggttttccgagttacatgagacaaggttaccatacgagtctgaagaaatttgttctaattaagcaatacaaatgcaatatagttaacagaacagcctagtaatgtgaaaagaaagattttagagagtttaacctagagactggtgtggaacaatattagaggcaaaataaccctcggccatagacaagaagataaacccttacatacaagaagatagtccataatctgtgtccaaccagcaggactggaactactccaggagtgaagttagccaataagaagactcaattgggatgaaacacaggaaaagagggaggatgcaatgaaaaaactgggttcaaagaaaccacaataacccatacctcgacctgctgtaagaatagcatattttcattgcctgttatgaaacacaggaaaagagggaggatatgtaaataacagagaatctaaaatataagctagttgatattttgtgaaactgttggttccactatcatatactgaagtcatatgaaggcactgggaaaaatagtgttagagcctatgaaatgtccagactgaaataaggattttagcattgtcagaacaaaattcaattgagctctgaaacacagattcatttttgaaaaataattagaatagagaaaaaaacaaaattctcagaatgaggccttgcatacttcatcaagatataggaagaaataaatcaatgaagaaatgagcttgagtttgtttccatcaaatgacatggatttacctgtagtggtaggggtgtgtggaaaaagttcaacacattcagctagaatattatcagtgtcaatttggcaatttagcaagtaactagtaaaatccatttattcctgcattgacaatatgtactatgtagtatgctaagcatttgaacttaaatatcgaacagtatggagtctagttaatgcaacggatagtaatcaaatagtcctgccaaaaaatggaagtatcccagaaaaaaagggatactttcagctgtgagagctgattagggggaaggggctgattaatcagggaagttagggaaggctttattaaaaaaatatactagctgaggatggaaaaagaatagaaagcatcaatagccagagtgggatgagaagagccctgtagaaggggaatgaatttgtgaaggtccttatgtaggagggctggtgagactggagtgcagaaagtcaaggttcatttgggacacactgagaataaagaggttaggataagcccaaacttttctgggccttggaggccgtgttaaggagtagttttcatcctaagagcagtaagaaaccgttaacgtggacccagtcagtctgggctttgtggtgatcactcaatcagtttcacagaggccgtgtgaatacattgtagacttgttttggagctatttcagagatggtaggtagcctgaaccatagcaatgtgcagattaataaaagtggatggatttgtgagctatcaccagagtgaaatttaaaagtttgtctattaattgaatatgggaactaaagaaggaaccaacaagaatgactggtgtctttctgctttgcacaactggataaatactgatgtcatgcaggaaatgaagaagggacagaaagtggtgagaaaattggagatgctagtttgcagaatttggcaaacgagtcagagtgagagagtgagaggaaggaggaagggagagaaatgatgaatatttagaagtagcaaaataaaggtttcttaagattcagagattaggtttaaaggaaagcaaaaggaattttagagaggaaaagatcgaagacagagggaataattacggcataaaaatgcacaagatgtgggacaaggacatagtggtctagggtagctttagaaagaaaaaggggctgagtcctctaatgaatttggagtaatatatgaaaagaacatggaaattaaaataatatgaaatgcaaaaggaaacagaggagtttatttaaactgtttaaatttaatgttctaaaaaaagtaaaaatagagggcaagagaatggaaatttatgagaagtttggaattatctttggagcaaatgaaggacaaaggattgctaattgttaaatctgaagggccaagatgaagttagagaacataaatttttggtgaataagatcttcagaattatacatcttgttccagcatatttgacaccctaggatttaaatgggagaacagaacacagagactcgagactggagttgtacattgagatgtctgtctcattggacaactctatgaacagggaatctaaacagttttttattagtcatggtgatattaaaattaagaccaaatttctgcttttaagatattttgaacttactatactctaggagccatatctgagagaaaaatgatactgctcctgcttttgaggggcctcaaaacaagtggaagggaaagaaaactaaaattgaataagagcaaaccatttgcaatacaatgccatacattttatgatcaatgaaagcactcagttttctgagagcactaagtgctttaaactcaaaactgagttagaattcatgagacagagaaggagtgggggacatgtgttttagacagaatagtagacagataaactatgtaaaatgatacagtagaacctgcctaagcttctaagagtggtaggcaggaaatatcagagggtggaagtaaggggaagatgccagacttggaaagttaaactacagtaaattaataattaataaggaagggtttgaactaaaagtagacacatttattgggttgaaaaaggccctgagaagacagatccagctggagtaatagaaatctagttcagcaggccaaatacgcattcagagaaaagagcaaaacaaaatagaacaagtagtgtttgatgtccaaaaatcaccattggaagtaatagaagcctcccaatagaaagagggcagaacactaagatgtagaatccaggccactaaaagtgtcaggatctgggaaagcaagccattaggtgtatatgtagcagagtattagtcattctagttgagaaggtagagaaaggcagcccaacagaggttaagtcaagaccagatccctagattacctgagaaacaaagcagatacgtgcaaaatggaacaatacagaaaccaatgatcagaactggtttacaagttggggacttcatttcataagcaagacataaggcaattagtacttggaaataaggtccaaatagactagggcaaagattgaatatttccattgtgactttttaaaagataattttattcttacagaagagttactcataatgaatactctaatgaatctatacacagtgtcctcttgttttaacatcttatgcaaccatagatcagttctcacaactaagaaattaatcttgatataataccattaaataaaatacagaactgagtcagatttcaccagtttttccactgaagccttttctctagaatgatgatttttaaaacatcttagctgaactttaaaatgaaatttaagatgctgtagctttagtgagagaatataaagtcagaaatcagacgaaaaatttaaaaagagagaggaaaacttggagaagtatttatttattagttgcttaaagtaaaattaataccctcccaacacatgggataaaaaattttattacatgacaaatatttactaactgtccgtcataacatgatggtgttctgtgcactgagaacataatacgtgagtttataaaacctggtatcaatgtgagtataaataaaacaaatacatttgaatacagttgaatatacaatatacaaaattttcttccaagtataaaacgaaaataaaatacactactttctttaatagaatagaacattgtaataatgttccattgcatttgaccctcacataaatgctatgaggtagcattaagagataagatttgaggctgggcatggtggctcatgcctgtaattccagcactttgggaggtcgaggtgggcagatcattaggtcaggagtttgagaccagcctgaccaatacggtgaaatcccgtctctactaaaattacaaaaagtagtcgggcatggtggcatgtacctgtaatcccagctactcaggaggctgaggcaggagtatcgcttgaacccgggaggcagaggttgcagtgagccaagatcgtgccactgcactccaacctgtgcaacagagcgagactccatctcaaaaaataaaaaaaattaaaaaaaagagagagagataagatttgagatctgacatggagcttccctatttacactacttacctgctttgtgacctaaggcaagttacctcagctctccaatcactggttttgcaaggaatttttttttttgtaaaatgttgtgaggattaaagatgtgtttttataaaagctacattttttgttgctttcttaaaatcagaagaattgaattcgattttttttaaggtttctaatggaacttttacatattatttgttccagaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggtaagaagaggtgcttttattcagttaaggaatatagtggtaaaaatatgtgttttaaaactttagaggtgtttttcactaatctttctcattcatcccaaactcccaaataaaaatctaatagtccattgttttagttttagtttgccatttctctaattgcatgctgtgcttgaaatgatgagtggaatacaaggaatttatattttcagctttcatttattctcatttaatattttcatctgttctcatctcagaagacaataactgcaactttggtagaatagtcttgtacctggtcatactcctgtggtattgacagttactgctttgaataaacaatcaatccacacacatatatacataaatcatttgaagtagtcacataattcataaatatgacctcttaaataattggaatagtgtatatgtgcagttatatatataataacacatatataagtttcatgttatctttgggtgcagacagttttctgtggtttgcaatatctctttttggaagcagatagtttgtttgaaaatccaaaacagatttgttatcatcaatgatacattaatgttaggatacatacatacattaagtcctaggaatgcaaaagatttattggaaaaaatatatatatacagtgtttatgtataagatattaaatgaggtactggaagtaaatataagaagatttaagagaaggttctacctatttggggaaacagaacattcacatggaggggaaaattatatagcactctttaaactactttctttagtcgaatagaacattgtaacaatgttccactgcatttgattctcacataagtgctatgaggtagcattaagaggtaagatttgagatctgacctggagcttccctatttacactacttaccttctcagtgacctaagagaagttacctcagctctccaatctctggttttgcaaggaatttttctgtaaaatgttattgtgaggattaaatcagattatgtatatatatgcacttagcactgtgcctagcatgaagaaaagacttagtaaatgttcagtttgaccacaagaaaaagttgatattatcaccatttactcatgcataaaagcaagtgccaggattcagtcccaagtacatctgtctccaaagcctatgttttcttctgtacatcacgctgcctactcccaaataacatagaatctcagaaagtaaagaactctcatattcctgacccaaaatcatacacctttagttcttatgcaaatactagaactagtattttggacatataaattaatttctgtacttggccactgtatgcttcatgatgtctttggaccttccagggttgagtcatttttttgatagatgctttccttgaactaggaaaaatggcccttattatcttcatttaatataaagatgtaaatgttataacaccaaacataccagtttcattttgctcaacaaacattgcagattatttgcatatatacatgtacctaactgtcctgttcacattttgtaaaactaatgtacttatgtaaactttcatttgctactattaagtataacaatatttttgttatttgttgattttctacaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgtaaattcaacatgtgacacttgataatagtaattgtcaccagtgtttatgttttaactgccacacctgccatatttttacaaaacgtgtgctgtgaatttatcacttttctttttaattcacaggttgtttactattatatgtgactatttttgtaaatgggtttgtgtttggggagagggattaaagggagggaattctacatttctctattgtattgtataactggatatattttaaatggaggcatgctgcaattctcattcacacataaaaaaatcacatcacaaaagggaagagtttacttcttgtttcaggatgtttttagatttttgaggtgcttaaatagctattcgtatttttaaggtgtctcatccagaaaaaatttaatgtgcctgtaaatgttccatagaatcacaagcattaaagagttgttttatttttacataacccattaaatgtacatgtatatatgtatatatgtatatgtgcgtgtatatacatatatatgtatacacacatgcacacacagagatatacacataccattacattgtcattcacagtcccagcagcatgactatcacatttttgataagtgtcctttggcataaaataaaaatatcctatcagtcctttctaagaagcctgaattgaccaaaaaacatccccaccaccactttataaagttgattctgctttatcctgcagtattgtttagccatcttctgctcttggtaaggttgacatagtatatgtcaatttaaaaaataaaagtctgctttgtaaatagtaattttacccagtggtgcatgtttgagcaaacaaaaatgatgatttaagcacactacttattgcatcaaatatgtaccacagtaagtatagtttgcaagctttcaacaggtaatatgatgtaattggttccattatagtttgaagctgtcactgctgcatgtttatcttgcctatgctgctgtatcttattccttccactgttcagaagtctaatatgggaagccatatatcagtggtaaagtgaagcaaattgttctaccaagacctcattcttcatgtcattaagcaataggttgcagcaaacaaggaagagcttcttgctttttattcttccaaccttaattgaacactcaatgatgaaaagcccgactgtacaaacatgttgcaagctgcttaaatctgtttaaaatatatggttagagttttctaagaaaatataaatactgtaaaaagttcattttattttatttttcagccttttgtacgtaaaatgagaaattaaaagtatcttcaggtggatgtcacagtcactattgttagtttctgttcctagcacttttaaattgaagcacttcacaaaataagaagcaaggactaggatgcagtgtaggtttctgcttttttattagtactgtaaacttgcacacatttcaatgtgaaacaaatctcaaactgagttcaatgtttatttgctttcaatagtaatgccttatcattgaaagaggcttaaagaaaaaaaaaatcagctgatactcttggcattgcttgaatccaatgtttccacctagtctttttattcagtaatcatcagtcttttccaatgtttgtttacacagatagatcttattgacccatatggcactagaactgtatcagatataatatgggatcccagctttttttcctctcccacaaaaccaggtagtgaagttatattaccagttacagcaaaatactttgtgtttcacaagcaacaataaatgtagattctttatactgaagctattgacttgtagtgtgttggtgaaatgcatgcaggaaaatgctgttaccataaagaacggtaaaccacattacaatcaagccaaaagaataaaggtttcgcttttgtttttgtatttaattgttgtctttgtttctatctttgaaatgccatttaaaggtagatttctatcatgtaaaaataatctatctgaaaaacaaatgtaaagaacacacattaattactataattcatctttcaattttttcatggaatggaagttaattaagaagagtgtattggataactactttaatattggccaaaaagctagatatggcatcaggtagactagtggaaagttacaaaaattaataaaaaattgactaacattttaa

SEQ ID NO: 39 - DNA, 116546 bp, Homo sapiens
  source 1..116546: mol_type = genomic DNA
accatagagtgaatctcagaacaggaagcggaggcataagcagagaggattctggaaaggtctctttgttttcttatccacagagaaagaaagaaaaaaaattgtaactaatttgtaaacctctgtggtcaaaaaaaaaaaaaaaaaaaaaagctgaacagctgcagaggaagacacgttataccctaaccatcttggatgctgggctttgttatgctgtaattcataaggctctgttttatcaggtaagctgacaaaacatttcattatctgcaccatagaacctagctaccaggtcattttccttactttaaaatcatcttcatgctgctatttttaacccagtgttgtttaaatgtaaattacaggaaccaaaggcatcgtttgatgtgtaaactgcttactatttctttatctttcaaagaaaatagagcctgtctggaaatggtgatttatggtacatactaggcatcaatggtcttgtgtttttgtagatgcttatgattaattgtattcagaaaaaatattttttattatacttaaagctagtctaatgagtttcctggctgtatgtcatctatttaaatgcccagtgtgtccagtattttttaaacataaatgtatagtgaaattggaactatcattcttgtgctttagttttttatttaacagctttagagaggccatgcatatagggagtgataacaatatagaggtgtttggctttgtgaaatacactatcatttttctctaaaatctgttttcatagagaaaagaacaccaatactaaccatttaaaagaggttgaaccttcaaaaaataaaataatctctatatgttccataatatgctacttctttatcctttaatatattcattttatattaaatgtttaccttttaatttattgatttaaagattattatatattcttaattgttctataagcttgatagattgctgtttttctgtatatatttaataactgtttatttttattaattaccaggaagaaccactggagccataaaacaataatttactttatctatgatccatattgtctgtagttgtatttagaatattctatatcataaccataaatgtttcattcagttagccaccacataattagaataagaaattattgacagaaaatctatacatattaattgaaagataagttttaaaaatcatacagggttttaaaatacacaacaggtagtataatgtggcttatgaggacaaagataaaggcataagtgcttgtaggaatttgcatggaaacatttcatcacattcactccaaatagagtgtgccctatatgaaatgaagacttctgatttcaacagggcttccagtcagtactggctaaaagggcttcaaaaatagaacttaaggcctccaaactgtaattcctaatgatatgttgaaaaatattgacatctcacttaatattttacattgagtagcaataatagtccccccaaaaacatttcaaaatagtggttgcctgagaggagagccctgggtcttgtctatttcagaagaattcctaccataggagataaagaaaactatttctttggacagggttcccagaaatggctgttaattaacttgagtgtattgtacacaccatgcttctctacaggtgactaaatgtgagtaactttgttctgagtaagcatcagagctggtcttgattgaactggtttacatttatgaatgaatgcttaattttggccccaaatgttagcttttatttttcttggtatagttgcaacagtctcttagttattcatctatacatgtggtcgccatgtgaaaaagcaaatacactcagagttcttcacttcacaaaatgcgctctttcaaaaatttcggaaattaaacctgctttgattaaatgatatatcaaacacatttgaataacttactctttaaaagaatgtagtggtgatttcatttgtaaagttgagaaaaatgctgtgatttatttgagtactgaagataaaaaggttgaaccctgagctgaaagtcttgggatctggttcatgttctgctactagtgagttttgttgtctcagaaaagaccccaagtatcactgaagagcattttccttgcctacaaaggaaggaaattagaatcaaagctgtataagaatactttgtttttaaaattttctgatcctcatttatttggatttttcttcagttggtttctcagcttaattaagatacaactttgactctcactgagttgtaaattatgattgatgtgctaaacatgaaagtggtaaaatagagaaataggggcgtttcttggccagttccttctgtagtggaaacaagcaggaaacaacatggagaagtggttaagagcaagagcttggcaggttacattttatggccactattacctgacaagttatttaaactctctgagcctttattacatcatctttaaaataggaataataatgcctgtgttacaggattgtgtaactaaaataatgtctgttcagtgcttggtatagatcctggaacatgattacgaacctccttcctctctctccctgccatcctaactcacatcaaaaggaacaggacaaacataaaggcataaattttcatcattgttattattgttatcgttagtgctggtgatataatatcttccaccacaacaggaaggatagaataaaactgccaaataattatgtacctgaaaagtgaataattctcatcctggaaggatgcccttgctgaaacaacaacaattgtgtacctataatagtatcacttagtgttaacattccaggcaattcctggagagtttatagaactcataatgccttccagaagacagttatttatgcccaatatgttatcacggacttcaaaactttcttcttcttatgaaaatagaggcaaagggccttatttcacgttgccttaagaggatatacctgttagacgaagtttctgtaaagattcacaaagggaatctaggtttcaccaaaaccacatttaaacgccaagtaatttctactaagaccaccagataactgaacctaaatctcaggaaagtctttgctatgtgatcaactcacaaactctctaatgcttcaattctattaacggtacaataagatgtggaaaggcaaattgtgcttgatgaatggttgatggactgcaaaatccctgctttcctccaaaggttgtttctaagtgtagcttcgtgctcctgacagctgtgtgctactggggtctttgggagctagaacttggatgacctttcagcaccccaggcctcctaatccttcccttcaaccaccctaggcctctttaaactgactcaagtaactgcgctgtcagcttcatcttcatggcagccaagatgacttaatggactcttgattaggcagatctgagagggctaagagcttgggaggcttaaaaatatgagggtagtgtttctcaactagacaaatgcggtgcttggaatttgttgctcatctgtctctcagttctaggtcactcccagctcttacgagttcttatctttagggttgatgataactaaaagcatccataagaataagcatttaaagattttttttcaccaagaaattaacacttgattatatagtgatatttctttacataggtagctgtgaagattacttttttctgattttcatttatgtatagaaacatgaactcactgaaggttgggaattcatgtttcatttgtcacctaaaaatatattattcattcgcaccttaatattaatggttgttttaccagttttccaaaactgtgaggattaattacccacctaccagtgaaatataattacttaactctatttctgtacttttaggttcgttttaaattttcgattaattttaattctaactgctttcattttcaaaatgtcatgcttacgttttaccttataaacaactttcatggcaaatccatatagaacctgacatctgaattacttcttgaggtagactgaacaattgtaacttgaggtagttagaaaatttggaagaaagaaaatcatattcttgctttatattgtcggttcacacatttatctttgattgagaagctactgttttagttcagctttacctgaaaatatttttccctctgggatgaaattaacacattctttgtttatattttaatgggatgtaacaagtgcagacacctatttcggagcagaatagtgtttcctcttaataatacagcaataaataaaatcttgctcttttactaagcacagacatactttgttttattaacttcctgataggcaccagctctttggatacctaaaatctgaatctacatcagaaatataatttgttaaagtagaataattctttaaaatttatatgaatacctacttaactggataccacaagtttcaatgtgccaagtattttttttttttattactttttttaatatcccacttctttcctgtaaggatttgaaatgataaaggacattctggaaagaactttaaagaaggttttacccaagatctatgaataaagaacaactgaaaagtaacttgcaagcaagtttacaatattaaaatacagcacatgtaaacatatgctgggtgtggttgtataaatgaattttcaggggttttagttcagagaaaccttatgaaatctggagttatttctgtaagaattgaattaggttttcatttttttggagactgcatatagggagcccttcatgtgattaaactctgtgctggagcaaagttagagaaatgatggtcccttaattattaaatagtggtttaatattgttttattcaatgggtgaattcaaagtcactctttaaataactttgaccattttctgccaagaagctcccttttgggaattttaatctcctgattttcagaatatactttattcttactttggttgtacagaacattttgtccttttcctttcccaagaaagagcttgaactggaataattcactaaattccaattcatatttctaacaagtgacattgcgcttctggtctagagtccaacatattcttgcataaggtttaataggacacgttttgtgggcttaagcctctatttgaggactagtcacctgtttgttagtttctctgtctccttggtgtttctgcttgtgacatttatttttctccatataagttgtttttattatgcctaactaaacatgttcccaagtactctgagcattttcttttcatggaatttatataatggttggtcatgaccttaaataataaattctagaagaaacgaacataaattcctgcatgggcaaagtaggtaagagaaagcagtaaagccattcatgttgggcctgaggaactagaaagtgaatgcatgccctttttaaaatggaaaacgccttctcactgctaggagactgttacatcaaatgacttccctgaagaagctgaaaaatccaaattgttagtaaatatttccctctgttgttaaatggaatcatctatttcaaattatttataataccagatagattcaataaaacacatgtgtaggcaggatctggccaaggaattgcaaggtttctttttctccttttgccaatctaaccagtattttcgccagttggggaaaataaaccgcatggagaggaaacctcttgaccatatttagaagcacagctacattggcactcagattccttttctcctagtctaggctcagtctgtttcatttcaaatccttgaatctatgcattaccttcttgatttctagttttcttcccaatattaacatcatcacaatacttagcagcattgattctttttttttcttttttttctattgctattttctgttgctagtgatatcttgtttctgctatgttatttgttgcaatatgtaatattcccacttccactctgttctttaaatactattgaaatttgtttttaaagtttaaaatttagggcaaacacattgccgtcctttacctctgaaagggaaaaatactgttgatatgatatatacatgtccttgagacctgtatggtctcaaaattctaaactgttttattgtcttttgtcatagccaataataactacatttaaaataaatccttccttaatatccgtttttgacaatggccttagtttctactattgatctttttatatttataccaaaaattaatgtaaactattaaattagctttggaagaacaggcaaaaatataattcaccatcatattgtgttctcttacactgacataaagcatgaatagtatgggataagaatataaatcaaatatatatacctggaatgagaacttcttggccagtaaataggaggtaaaaaagaaaaaagcaaaatgagaaaagaaaaaaatagatttataggacctcaccaataaaaatgtcaggagaaaaaaaaaaaacacagctaaagagaaagagatatgcaaacatactgaaagaaaacaaaaaggggtagaacattaacagcttattcacagagtggcccacagctgtggatgcacattagaatcatttggaaaacttaaaaaagagcaatgcttggctccaccttcaaccaattcaatcagattctctgaggcggaatctgggtatcaatatttgcttaaaagctctgcaattgtagttcaaatgtgtagccaggtttgaaaaccaattgactagagaaagacaaagaaaaataacagaagccaatgaaaacttggctagggaagtgaaagatagttgacaaacgcttttcaaaataatttcaaagtgctaaccagcgggcatgtgttaagtaaagatattatgcaaatacttaaggaagcaacaaaaaatacacttgtgtccatttctcccttggttgaacacactggcatttatttatgtgtttaaataattttacatttgaaattgttaatttattatcccaatgatatttgaaagttgattcagctactggttatggtatattttgcaagctaaccatacaaacaatgtacacatttggagctgagcatccataactttaagtttgtacaactatacattcactcactgatttatttcttacttacaaattgctatctggagaactaaatcttgaataatcgaataagagtaggtctactgaaagatattctttgaatctccaaatcaccagttggaagcaaaacactttgatttttaattttttaaaagtgcaatttaggcagatctggaggaaaggcagattctgtaaacgaacatattttttaaagccaaaatgcattttaaaagatattttcagaaaatggcatatctgagaaagaagtgaattaatctaatagtggagcgaaattaataattaattgcatttcttaaaaagaatctcattcctaagatgagtcagcttttaaggagacatttcctgggttaacaccccagttgctgttccggattggtttcccacagctgggtaggagacatagagggcaatcctctacaggtccttcagagaagattatatcctaaagtcttttccctagaggatcatcatttagtattagtatttaactatgctttcttcacccatctctaacattctgccaacgtggtcagtaaaatgattatcataacagaaaatatctgttaaatctcaagatgagaatatccacattttgaggcaggtcgctggtgcttctgtaataaacagaagaaatactggccaaggaattgcaaagttatcatgttcgaggccagggttatgatgaatgtgtgtgacacagtgcttgtgtcctcccattgggattggatcatttatttaaaaaaaaaaatccaacctttatacacaaaggatttgggaagtctgcaatgaaaatataaataagaaaccaatgagatattgataagaatgaaagcctgaaccaggggaggaatgcttttatgaagaagggtcaccttaaataacacaatcagtgcagagggggaataatttatggttgatataaccattcccctctaccaacatgatgacaattgtaagaactagctagattcttttgaggaaacattccaactccttattcaaaagcactttgaacattttgaaaaggaaagggtaaagcatgaaggtaaatgaaaagtggcagagcacatccaaatcaagatgcagattttcatgcaaataaacactagagttaagatacaccatgaaaacaatagtcagctccctcttatgcattggtaaggaatggttttctactcagtatcttaaaattatcctgtcattgtaagacacctttcttttaaatatcccattaaatctatgatagtggtgccagttcagaaaacactgtgagatcaatttaatcagaaaataatacacttcctcctctcccccaacaatacacatccctcaagaaagctaaatttgggaagtttcacacttaacaaaatagtttctatttattctctcaatttatttctcaataaaaattttgaagacagatatttaagacattcaatagggcactcgatgtgggaactcaatactttctgatagacttttctgtaaacctaaaattgttctaaaaaaagtctgttaatttttaaagaggagtgacacttgaagaatgagtgaactcaatgtctgattttgcactggcaattttatcaggatcctgaatcctccatgtccttgaggagacagctcaggtggcacacctggcacacggcagggcatctctccctcctggcatcttccctctcacctcttcttaggtttctcctcaggattactgccctcactagtcagtttcttacttaccaggtcctctatcctctggagggtgaagacagacagaccacgccagtcttcagcagtttggttgctacaatccctgtttaaaacaaaattttttatcatatataattttctcttacctgtggaattctggatctcctttagcctcaaaagaattgagcactgaacagcatccccttcctgtccttatgtgcagagaccttttactctgcattccccgctgcagtaagtggcatcatccacacctaaatcagggcagtgcacacagtcctttgctctattttggtgccaatgatgtgctcggagcctgaaggaaaaacacagattctctgggtcctgaattcagatcccaggaaagacttttttttttcatcttttctttatttcaaagggccctttttgggggagatatggtcaagtgactggtcatatttcactgaaaaccagacttaaagttttctaggtttttcttttaactgcaatttgtatggaatttctcagtaggagattttttatattaccatttcatgaagatgtcatgtgtacaaaattgaatatctagagttagaaaggattcaagggatagttcttttcagcaactgatcttcaagttatattctactcaaggcatttatattatttatcaagaaacagtttaaatttgggctgcagaggacctatgcaagcatctagttcactaaagtcttctaaaaatgaatatatcctctaatagatgtgacacacctacctcaggaacatgatttatataaggtttagtgacccacgttcagggtataagggtattgctataccctcagaagtttctctcagaagggacaaacatttggagtaagcctagtacagagtcccaaagtctggacactgaactagagttttagtgataaaagaggtactacaaattaactggtcaatttcccacctctcccttcttttttactcacataaacacgaaacatctgagatctcatgtgttcaatatatcacacaagtgacagcagagacaagtctagaatagtttgtctgatttgcaacttgtatatctctccttctgttttcctctctcttatcttttcattaaatctcatttctaataaagatagggcaggggcatgtttttctagtatattgcattatcttctgaggcaccatcttggagtgatccactgtgtaacattataactgtgtatctaaggggcctgcttagtggggaaggcctctttatgtgattggttttttgctgatgaagaatcaaatggcagctgaacttcagacacacctaaatcatcctgtgctccagtgtggtttaccatttgcacccatctgaaagcagtgattaaaacctctttgctctgagctagacaaatcccaatcctctgtattttaaatctcaaaggagcgcagataacatgtggagtagtcaacaccgccatcttgaagtaatgtaagtcatacctcaagttcccagttctcaattttcctcaggttgccaagtgaaaaaggcaatcgactctcaacactcagttgtgaaaacagtgggctgtcattttgattacagtcagtaaacagtctgtgtttgcctggaaagaaactgcctaaagcacatggtaccagcaagcagtaggagacatgtggctgagggcaacacatagggctgtctattatggctgatgttggggtaggaaagggatcaaggattgttcagagaatgctgtttgctttatatttgtcatgttgccaatgtacttcaaaatagaaagcttcctgtaatgctgttatattctgatttgcatgtggtttctgctccactgcgcacacagagagagaatgttcacttatggaccaagtagctttttcactatggtgtttcttagaccaaaagacaaaagcagcaacctgactacataaaatagaaaaactattgatccagagacagccccctcccccatgtagaacatctcagaataagggattcgcctcttgcttaattcatgcatttgttcatgggtttgatcccttggaggagagtgatggagtagggaacaggtatatctgaaaaaagcacagtgcgttagaaatataatgagtcccatgtatgtaattttaaatgttctagattttaatatcaaaaaaagaaaacaataagattgattttattaatgatatattttgtttaagatgatatgtcctaaatatcattttgaaatttggcacctacccacatttcaaatgctcagttcctcatgtggtcaatggctaccacgttgaacagaatgtttgcaagatttgtttgggcaattgtatccaccatatatctgataatgccctgcttactgtggtaggtagtcaatacatccttctcctcaaggaatttaataataaatgtagaagcaataaggcacatcttcaataacaacagaagatagaatatatataattactgtaaaaattttagtaggattttaagaggtgacagttggtggtcaatgatatttcagacagcgtgaacatttttgaacgccagatgtcagaggctgaggtcttttaaggaatggaaatatacagagtatgtaagatgtagctggagaggttcattggtaagatcattgtagagaggctttgattaattttcccaaagaaaaaattatagaatttgatggcaacatttactagtcatgtgaccttgggcaagttacttgtcccctctgaacattatagttttcttatctaaaaaatacaaacaacaatcatgtttatcttatatatttgttatgaatattaaatgaagtaatcagtccctgataagtgaccagtgcttaatcactgttctctattatcattcttacttcctaagatattttagagtgggaaatactttaggtaaagtattcagtcttcaatttgctttgttttcaagagagtctagtaaacttggcatagttatataattatttttgaggtaaagaggattgtaatgtatgtattttgatttagattaaataaggctacataattaataaatatagtgcctataaagtttgactttgtttttcctatattgagtccttttatgttttatcatcttaatatctatataatacaaaacaaagttatctgatttacttaatcaataccccattagtggatggtttcattttttctagacattgctattataaaatatgttgccataaatagaatatgtgagtttctaaagattgggctgaatttccaaataataaatctaaaaaaaaaaactactaaatttttcagaaaccaaaattaaataattcattgatttaaaaaagtattcattgagcactactatgtgcgtgtactgttctagacacatgagattcattggtgaaaatagaccccaaaaaggcaaatattccagcccctgtgctgtttctgtgctatccaggagagacataaaatgaataataaacattataagtaagttatatagtacctaacaaaatgataagtgacttggaaacatcagagcagggtaagagattagaggagaagtgtgagcaggtctctttaagacagtaaacttttggccaagacttgaaggagatagaagagttagtcattcagcttcctagaggaagagcatactggaataagggaatagtctgtgtgtgcttccaggtacagaggacagctggaagccagttaggctacagagaactgagggaggaggagaatagaaggaggtgccttccactagataaccaaaaggtcagacagattataaggccttttaggcaattgtaaggatttgggactttttttctgggtagcttctgggggcttctgagcagaggaatgatatgattcgatttctatgttctcaaatcactctgacaggcaaggtaaaaacaggctatatgggagtcaggctggcagcagggagactgaaagcaattgcaggcttctgtgtaatactgctgtaaatcatttcaaggttccaggtgcagcgaaattacaccatagggcatcaaatgaataaataaatgagactgaagaagctatgattgtcatctttaagaaactgcaaaaatgaaagtgatatgcccagtatacatgtttctaacctgaaaaaaaaaaaaaaaaaacaacgtaaaatcctggattcaataagctaggtattgtcaaagtgtggttcctgggctggcaacatcagcattatctgtgcatttgttagaaatgcaaaattgggtcccagccatatatacctggggtggagcccagaaagctgtgttttaacaagaagttagcccggtgattctgatgctaaattttgagaaccactgctttaaactaggttgatgaaactagatggcctgaaagattattttcaatgttaggatacagtgcttccaagttcatttcttaatatttatttttattataaaattaagtatagtccttgagaaaaaaatggtttataagaagtatagaatcatgctaaagaatgaaaaagccttttaaatcacatagaggaacttgatttttatttattatatctcacctcttctaaaaagtgatgcaaagttttatatatatatatataaagttatatatatataaagttttatataaatatagttatatataaagttatatataaatataaaatgttatatatataaagttatatatataaagttatatatatatatctttgtgcaataggaatctcaagacaaggaaaatggagaaaatgtatgtgatacatctgttaaggactgtaggctaatgaatttactctttcaaaatgtacacttagctctcagcctcctgagctcaacatttttaaaggaagaaatgaattttatacaacacaaagaaagaaagaagtctcagactttaagttaacatgaaccaccacgaaggtgatcgaagttactacaaggagaatctctggagctccccaagaactgaatggacaacttggcttcctagacaacatttcaatatttcaccctctaatatcttggtgatttgcccatttgaagttacctctttcatagggacctgaagtcttaaaaccaagtgagcagatggtaattgagactgttacctcatcacagaggttgaaaagccaaccacattcccacctagatggaaagctgtcccttcctcatggcaaagcttgtgagttcctccatgaccacctttggatctgcttctgttcttgtgcaaaatgctgaacagccagaattttacagcctactgcatgacacaaatggttgtaacctgaaaaattcttaagcaggtatatcatgtcatcagtataaaggaagataaaaacaattgaaagaaaataaagttgcttccatggccagagataaagagtaaagatgcaaaatgatgctaaaaaataatggagccatagtaagacaaaaattttacaacactgggaactagaagatcttaaaggataaataaattttcaggataaactaaaataaccacaaaagaggatacaaacttgcctctagaatattcaattgttgatattagcataagcattaataacaatactaagtagaaacgggttaagaaaaataaaattaaagatttaatttgtctaagattcctcagctggtgacatctagcatttttagggtaaaatttctatcatgctgtttgagctatcacttccttatttgaaaaccaaagaatttctcctaaattactaaaatgctgaaattttattaagataatttcaaatgcaggctaaccgtttttgggggatttccagatccaataaatgtattaggtcatctgaaagcaaagtttctggaccatcttatctcatcaccttctaaatgaaattcacttagtttaactaattgcaaccatcagagaaagacttttttgcatcttgtacacatctgtgcaaaataaaatttaagatgtctgttgagcatgttgcctcatgtcctttatactatatcctaaacaaaatttccacccttcagtttagttcttgaaaaatgtttgctttttatatacaacttttaggaaatgtgtttgttttgttttttcctaaaatagaacaaaattcatgtgatccaatatgcttcaattttttcttagttactggggacattacaccaaaattccaggcttgattgccaaaagcactcagatcatattctttactcattcctttagttcatcctttctcaaatagtcatccatgcatcgcttgcacaaaactcacttagggagtgtattaaaaatgcagatccctcgaccctacctcagacctactttttgcagaatctccagaaattgaatccagaaatctgcatcttttacaagtagcacaagtgattctttttttttttttttttttttttgaagtggggcggatggaatcttgctctgtcacacaggctggagtgcagtggcgtgatctcagctcactgcaacctctgcctcccaggttcaagcacttctcctgtgcgtcagcctcctgagtacctgtacctgggattacaggtgcacaccaccacacctggctaatttttgtatttttagtagagacggggtttcaccatgttggtcaggctggtctcaaactcctgaccttgtgatccacccgcctcggcctcccaaagtgctgggattacaggcgtgagccaccgcgccctgctgcacaggtgattcttatgctcactgaagttcagaattgcttagagtccaattttatataatagttaatttgtaagccagggctgcttttaaaaataagtgagatgcaactcttattaagatataacgcagtttgaagtatgtggcctaaagtgaagtattaatccacatgcaggaatcactgcgatttcccatggatacttgggattgaaaaagaaaaaaaaatactctctcctctttgaagccaaggccataaaatatattttctccaatctgtaaatcagtaattttcataagggtaggaaaaagaaagataactcaagcaaatcagaaacttctgggatgctttttcaaactccacccttctgctcctccttattccctcttcgatatccagccctccctacctcatccccctccacatcccagcaaaaagctctcaaatattttaaaaatgtattgaaattgatgttttggttatttaacatacttaacatcatgttcattatagctcaggatgaaggtcaaagtatttaaaacttagttacttgtgtactatgaagacaagggaaataacatttattaagcttgtggctgtgaagtagagggaactaacatttattgaagaattataaatttatgtaacaatctattgctcaatttctgatgcaaggtgtgtcttatgggtattattattagcatttgtgttattgttaccacttggtgagaggtaagagaagagaggcagaggccagatcatgaaggcacttccatactttgctaaagtgattctgagtcactgagagccactgacagatttgaacaagggtaggatatgtgttttgaaaccatcactccggtaacagaatagagaaaaaaaatgatggcttaggagagagttcatctggagacaaagattgtatagaccatgtataaaattgtaaaagtgagatttaatgtttttttgttatggtaagtggccaagggaaatttactggtgagaattcatgactagtttggcttatgagcattgtataaatgaattgcagtaaatattgttttaaatgtcagttactgattttagaattatatatattgccctttgaaattattattattggtttaactctgctaagccattgctgttggttatagcggaaagaagtatgacatctggttattacatttaggttaatatttagcatgctggctttttacctcagcttgtctaaaatatactcttagaagctactaaataggtttatttatcttattttagtaagccaatcaaactgggttttaggtggagaggagaaggaactagaaaatgacctacaacaccaatgtgaaccacatgttccactagtctacctctttggtctttgagatgtttgaggaaaagaagcaaaggggaagatgtaaggagggaagaggagagaaggaagcaagagggaagaacagaaggatgctcaggagtgccagcatgccttcagaaagactaaatggatcaaggctgccaaagaagggggagcacccctgtcccaaccctaggatcctggcagtggttcctggtcccattcttcctaaatcatgctagggcatgcttttaacaagggtcaaatatcttgctttgcatcatccttgctttctcgatccagggccataaaaaaaaaaggaataaaacccagacacagagccagagcacccctatgccaaatgtcaaagattataggctaatttcacctgtattctctttctacagagattatggagcaagaaaactgaagccaagccacatcaaggtttgacagggatgagatacctgtcaaggattcatagtagagtggcttactgggaaaggagcaaagaatctcttctagggatattgtaagaataaatgagataattcacagaagggacctggagcttttccggaaaaaggtgctgtgactatctaaggtaactaaacaacttctgggtataagtttgtttttgtggaaaataaactaaaatctctactatttaacaaggacagctgtatcaggaccaaaagaaggcagaggggtgttttcttccttcctctaccagtttgttcttccaaagaggcaaatacatacagggagacatagcacagatgaccttagggaatggaatgatgccaaaggctgttgatgtaagaaagagagattaactcagttttttttttgtttttgtttttttgttgttgttgttgttgttttgagacagagtctctctctgtcgcccaggctggagtgcagtggcatgaacttcgctcaccgcaagctctgcctcccgggttcacgccattctcctgcctcagcctcctgagtagctgagactacaggcgcctgccacaagcccggctagttttttgtatttttagtagagacgaggtttcatcgtgttagccaggatggtctcgatctcctgacctcgtgatctgcctgcctcggcctcccaaagtgctgggattacaggtgtgagccatcgcgcccagcaactgagttttttatatatttttcttttaagagagacattcatcctgtctatttagtaaattaccctggactgtatttactttaaattttattatatttatttggtaattggatctatggctcacctgactgtatggggtaaagatcatccaaatatgtggtgagtacttggttgtgagctggcttctgaattggtcaagtttttgaactgaccaaagactatttatttatttggtgtatcatctgcaactaactagaaaaactgtctaaaactgtcttagtcaagaaagatgtttattgaacagaacaagcagtgcagaggttgttcgggtccacaagctgagtgatccatcaaaggcccaggggtaaatatgtctctgtgacctgccaccctcagtgtgtcagctttgctctcagattggcatctcttctggttttaatttggctgaagtagtgccatgtattttatcccaatagaaaagggtccagaggacagagaatgctatcttctctttgttctctttcttgggagtgaagaaactttttacagacaatgacttgactgaagtcccctcacctttccttggccagaattagatcatatacctggtccttaaacaaagatgggcaagggacttgaaggaaacatctggaatggaatgaatactggggggtcaaacacacagtttactttgcaagcatttaatagaaacattaaagagataataaatccagtgatgctgatttgtcctttaaaatgttgacttaatttttgttactagttagcagttgtctcttcaagctaataactatctgataaggacgaagtcacagaaaatatcaacccctaaaaattaattagttccaggataattatcttgaagatagagatgaacccatgctttttttactaagctttttttttttttcagagccatgacattgagtccaggtacagaaaaacagaaatagatcatctcgttaaatagttaacacatgttggcaatcatgtgtttagctaatagaaacggaacaataacataaagaaggtctagatttcatctgtgtttggctataacgtagtgatacccttgctgtagagttactttctcaatagatttattcagactaatagtaatgctgatttccttgacaacacactgagagcaagaggtacctgacatagaagaagctagcctaggtttttaatttatcatcaaataactccaaagtgtgtagcatacatgtgaaagtagacgtgggttttatgtttgttattaattcattcctgtttgctttatctcctatgtggaaataaagataaggactatattgctacatttcttagattataccactcattcctgacacagggctttatacatagtaacctcccagtaaggtagctgatttatcctaattttgtttcagcaaacatcaagaatcttctcattttgcaggcttaggtacctaggcttttttttttttttcttttttttttttttttctgaactagacaggtttaaatcttggctccttgtcttatctagtctacctgcacctaagcttcttgatctctaaagtggaaatattaatggtatcaacctcatgaaattgtaacagtgattaaatgggctaacatgcatatatggcatgacagtgtctgagatatagtaatcattcaatagaattttgtttattgttattcaatcttcacagccccctgattaaggtgttatttcaaaactattgaaattatagaaaatagtatttaattctgccttggaatgtgtccagtggttatcattataatgtgctgagtgctctatgtatgcctttgataaatcttatgctgttgggtgcatatgctgcctgagaatatatggtaaataacagacaatcattagctctcagtgaaaatttcactgggaaaaataactaattttcttcaacaggtaattcatcggtcaatcttgtcttttaccttatacccttactataatagtctcttgtagataccaagaaaatacagcatccctcctcagtaatggacccagtccttcacagcaactcacactctccttctcaaagacgtgaaaatacattacagatttttttaatgctatctcaagttgtatgacatacagcaactttccatccataaagatgaaaaatttacagccttctgacacaatcttgtttccatggaaacagaccagaactaatcgattttgactgcaacacaatcataaaaatcccgacagagagagggaaagagagacactactaatactacaggttatggaccaatacaatttgccaaactgtctgctgttctggaaaattaggcaagatgagaacccataggccatgactaatggaaaaaaataaatttttccttagtaacaccacagcatatccgaaatgtttacaatgctatttttctagattctgattcattaacaaatattagtcttgtactcattgtattggctggcttcaagtactttcataagattatgttagcatcatagtacactgataggtgaggctagaaaactgaaatgaactagtcaaatctatttttctgtagttatttatatacagcttagatcttttagagcaaatcatataatagtaagattcaagacaaatatgtcaactataatagaaaaggtcataatttgtgtttgtcagtagacattttagaggagattacttagcttctttgggactgttcttcatttattttacaggcagagagttggactaattgttaaatcccaagtatgtcttttaattagcatcttggaaattcctctttggcatctaggtaattgttctaacttcattgtctatcatcctctctgttccctttacttaaaaattggtagttgtgtgagtcttgcctcttcactcatcatcctttcactttttttccttaggcaatgccgtgaatattcttagcttcagcttcaaccagtgactgctcttttctttctttttttttttttttgacaaggtcttgttttgcagcttaggctggagtgcactggcaagatcatagctcactgcagccttgaattcctgggctcaagcaatcctcctgcctcagcctccaaagtgctgggattacagtcatgagccaccatgcccagactcatccagtaacttcttaatcaactttacccgagcccagacagctttctgagtctcagatccatattttaattctatatccagatgtctcacagctatctcaaactgaacaggttccaaacagaatttattatcatgccttacaaacctccatttctctatttgggttaatgtcgatttgtggcttaagctggaaacctggaagtgagcttaaccctataactttaattcacatctcctatcaagtcagtcacaaaatctcattgtttttctctctcctatacttgtgcattaaatacactcctctggctgtggtttttctccctaacttattgatggcctactattaatgtattccaggcactgtgctcaccctttaggttcattttctcatttaaatgttatattagctctataaagtatgaactatgattatctccattgtacagctagggaaattataaagaataaaaaagcttcaggaacacagcagagtcaggccttgaatccagttctgatttctaagtccatgccttttggtaccagagctatagtcagatcttttacttctcttcttttgactattgagtggtgactaactgctttcttctagggcagttgttctcgaagtatagattttagacaactggggattcctggggccctttgtgtgggagctttgagctctaaactactttcgtaataataccaaaatggcatttgtcttttttcactgttttggcacttgcactgataaagcaataggcatgtgctaaaactgctaatgctttagcaggaatcaatgcagtagcatcaaactataggcatagtctgcattttcttcattgctgcacactctcagtaagaaaaataatgccagttcacataatacatctctgatgaagcagtacatattaatttcattcaagcacaatcctaaaaatacatatttttaacattctgtatgatgaaataggaggaatatataaagtatttgactgcatactgaagtgtcctagttgtctctaggaaaagcacttgtgtgattgagtcaggagctgaataagccacttttctttttttcatggaacaccactttcacttgaaagaataactgacaaactatggttattcagacttgagtattcggcacacattttctcaaaaatgaacaaagggaaagcctgtcacttcaggaaaagcaaatgacagcatttgttgtcaatgtcaaaattcgagctttcaagaggaaattggaatttgggaaaacttttacctgccactgggagcttgacagcctacccatacattacaacttttctcatgacattagtggtgatagtaacaaatgcgatttttggatattatataataaaatttgtcaaaatctggaagaccttcataacaatgtgccattttccaaataattagtgcatgattaggtaaaagacttattcaaaggacaagataaatcaaaagttcattgatatggcttttgatttcacacaactaatttaataaactaccatttgtagagttttgacgtgatattaaagaaggatattcacagttacctggaaaggcaattaaaacactcccttttccagccacacatatgcgtgaaaattctcttcatatatttcaataaaacaacatattctatcagactgaacacagaagcatttatgaaaatctaaatgtattctcttaagtgacatgaagatatttgactaaatgtgaaacaaattcttctcattaaatttttttctgttttgaataatatagttgttttcattaaccatctattgtctgtataaacatacaagtgcttattattagttaataagaatttttacattttttcattttaatttttaatatggtaagtatggatagctaagtcccccgataaacaaaagttctttgggttcatgaatgattttaagagtgtaaagaaatcctgaaaccacaacatttgaaaactactgctctaggatcactccctgcctgtccacgcttcatactgccaccatctttccaatcttcacattgatcataacactccccatccatggcatactttcgtgtgtagtacagggtcctcagtgatctatcctgcctaactttagagttttatgtcataccactcccttctgtgcagggtgatgtccacccataatgaattgcttgtcattgctcccaaactctccatgctctttcttgtctctgcatctgcacacatgccacccccaccccacctgctcaatgtgtctctactgatgtgtcttcctaccaatcctttcccaaccactaccaccataagaccccaatcaaattccaactagcctacaaaacctactccaatatcacttcctcagggaaatttctccaaaccatacctctctctcccttccctgggatgaacatattgatactttttatgaacttcagacaataaccagccatatataactgtgttataattatctgtataaaaatctgcctcccacattggactctcagccccagggaagtgaccatgggttcctggttcaaacagagtactgattcgtagaatccctccataaatattttccaaataaatgatttcgagatcctttccagatttggagttccgcagtttattcctcaaatatgatatactgaaccataatctttttactagttaacaaagggatgtatttgctttacctacacacattcatccacaggctttttggtttttagttaaagagatcatctcctaagatttttttcgtatcttttttgtccttgcaaagatagctctgtagaaaatttgatatattaaattttatgtattttaataaattataatgtgcatataatcattaataatatatatattccacaccaaggcatcagtaagaattaatttttaaagtctgctctaatgtgaatataaaattatgtaagaactctgtataataagctcacagagtacaagaaaggagaggaaaaaagtaaaagagaactgcgaaagaactatgagggatttccaaacagcaaaattgtcattgaagccatgagaaactctactcactaaattctttaatttctcagcctacccaaatattgggcaaaccctaattctcttgcaggggaaaagctgagagtctggaactagcctatcttccgaggacttagagacaacagtatgggaatttcaacgagacgtttttactttcttttgaccaagattcaaattctttattccagcccttgataagtaaataagaaggtaaaggactatttatttgtaaaaagtttttcatgattttgtgatggcaccttgttccatatcatctcagataaatcagaataatttgtgaaaattactcggtgatttccacattagatattttaaacctaatgttatttctaaaacaaaaaccaaccaggagaatccaattaagtaaaatgtatgtattaatataaattagctattcccatctggaaaagggcagccatttctgtgttgaggtgcctcaatgatactgaggctgagacaggttagatgatacaggcataccattagcagcagactcaatactaacccagatctcccatttcaattgcagtgtgtttttcattcattgtcaataaagacatcaaaattagttcaaaaccaaatcctcaaatcaacctttttttttttctcctctaagaaagcgaccgtgtttcatagaatttccttaagacatgtttgtcatgctgtttcattttcattcagcactggagaagagccacagccattcagttcatggcaggtgatatcagacagatggattacacatctttaggtacttacggcttgcagaaaatgctcaaactctttctgcactcaaaagcataaaagctgtgattattccacacagcttagagttggattgatgatgtgatcatcaaaattgacataagatggctaaaaacattagttttattttgtgctgcctcccgtaaatttagaaaacacaaaataaatgatcaactgacttttgagtaaaacagaatttttctcaaacctttcgattcatgtactatacaacctgatggagaaaaaaaaatgtgctgcccaactataaaacagaagttctgttcaaaattagtagagaaaaataacataacttttgacaggcctgctattttattttataacttatatagaatataccttcatagtagcaaaagatataatgacaatgttatatcataaatactaactcaaagaaaagacatatcttacgttaaaaacactttttgggcccagtgcattggctcaccgctgtaatcctagcactttgggaggccgaggcgggcggatggcttgagcccaagcgtttgagatcagcctgggcaaaatggcgactgaaacctcatctctacaaagatacaaaaatgatccaggcatggtggagggcacttgtagtcctagctactcaggaggctgaggtgggaggatcacctgagcccgggagttcaaggctgcagtgagccgtgattgtgccactgcactccagcctgggtgacagagtgagaccctgtctcaaaaaaataataatattataatataataagtaatgttatagaaacacttttttgtcattggaatagatcagggaactagtaattaagatataagcaaaaaaacccccacacacataataagctatattgtttttcttatgttattaatagatccagagcttctgattgtaagctcaaatatatgtagtgagctgccaagaatcagagggccatttagggataaactactacggagcctagaatacatgtgggggcaaaggggaatggtaggaatggggaaaatgtcacagatgactttgatcatgactttggtgccatagtggtaggttcttttataagatgactgatgtacttattttatttggtttgtcattgtttctatattctatctatcttgattttttaaatgtgatttttggcataatgcaaaataaaataactcatatttcgaaatttacatagctgatttcttgtggttttgatagttctattatgtatcctgcaaatagatttttgttcccttccctgagaaattgagcagggccactccatcagtctgccttcccttctttctcatccaggtgatcggcatgtgtgagtgtgcctctatacactgcacttctcagttcattcctttaattccgtagtcacaattgtggttccagcacagcaagaacttgtttaaagagtggtttgaattgtgaggatgcctgaaaccataaaagagggaaaatagctagggaaactgaagataatttaattatgatagtttacaataatatagtgcttactaattccaaaaactattctagacacaacataatcaactcatttattccttatgataacccaggaagtcagtttccctactaccctcattttatagatgaattcaagcaataaggggttactttgtccacaatcacacagctcataagcggcagagccagggtttagaacggacagtgtagcacctgagtccatgcttttaaccactatactaaatggaagattcagggaaaacgtcaaaattgtcttggaataattgaagggcagcatattgaaataaggagtaaacatattctccattgcctcagaaggaaacagagtctggcttaataaaagaaaggaaatactaaagataggtagatttttctggcagcagtggcttccatgtccctgctggttggtgatcagatcttttctggagcagcagttgtcaatgatgctgacaacgagaacagtggttgggtttggcaaaacttcattttctatcctcatttgtatgagtcagggatgtattacaataattgtattgttaccagtacttctttatttggggagttacaaagttatgaaaaggcggggggcaggatgcagaataattaagcaattttattgacaaactttactggcattactcttttgctgaaagtatactatattttggcttacagtgtcaaaacagaatttttttaaatgcttttaaaaaatggacaaaattatagatattcttgaggtaaaatataatgtttatatattatatatactgtacattgtagaatggctaaatcaaactaattaacattaagtacagacttttgatagatttatgaacttggcttattgagaatgaggttgaatgatgatgttttcaagttcaaatgtgtagtgcagtactaaaagcatgacttaatgtttatagctttaaaaagttactaaaaaatgacattttggttgatgttcttatgcccaatcgcttgctttcctaactcttgtgcaatttttcttttattgcaggtaattcgtatgcaagaagctacacgtaattaaatgtgcaggatgaaaagatggcacaggcactgttggtacccccaggacctgaaagcttccgcctttttactagagaatctcttgctgctatcgaaaaacgtgctgcagaagagaaagccaagaagcccaaaaaggaacaagataatgatgatgagaacaaaccaaagccaaatagtgacttggaagctggaaagaaccttccatttatttatggagacattcctccagagatggtgtcagagcccctggaggacctggatccctactatatcaataagaaagtgagtattgattttagacttctaataaatctttaatgaaactcttaactgtaatatacttttctgggccttatatacagcatcacaatttttcttctgttaaagattttataatactcttcactgtcacttatttttatcacaatataataaaacaaacatttataagaaatgaagtcaagagttggttacagtcaggaaatatgaatagatgaatgatttctacaatttcacagtgataattcagatagtcaaaattaaaattaatatcaacaaagtgaaatatctgttatggctgacatattcaagcacagggtagactacagaataatacctgtgcagaaaagaattatgagcatatgttgtacttaattattttttagttcatgactgacttgatgtaccttcacaataatttatattctagaggacaataaataatctgcttagcatcctcctgtagccagacaatacatgaagaagcatgttcacccagagattcctttcccccccagtaacctagaatatgattaggatcttctcttaaccttatatagtttgtggcatgctagattctggatcatgtataccattaaaacatcaccctgaagaaaaaaatgtcaaaattggaagaccaaaaagaaagaactttcaaattttctccatccatacatgatttaaattagtggttatgactgtgctttcctaatgctaaaataaatgcataattgtatcagaattagctggtttctatagttaaactagctgggtgatattttatagaaaatataaaaaataggtggtatactctatgctttctaattggatattaaggcattttataaccacgatttatattttacacttaaaagcgtaaaaatagctcaatgtagaaactaaagataaattagtatcaccatgagttgatgacttatagattatggaagatattaaacacctttattagtcaaagcacatccttttaaaagtttataatttataaaatcaatgatggctaaaggcaatgacaaccattcagacatggaattagtcctgttgttctaaataagtacttctcaaacttgcacatccatacagattacctcaagatgttttaatttgcagattctgaatccataggtctgggctagggccagagatcctgaatttcttacaaatcatcaggctgttacatggccacactttgaatagcaagctttaatgttttatttaaagtcataagactacatgtaaatagctaaacagagtctcctttttccccttttatagctagtttcataaaaggtgacatttaatacattcatgtacttctaaaaataacttatttcaacaatttactatagaattgataaagaaaaatttgaaatgtagttatgatgattacaataagtcaccccccaagaaattggacaaaatattatccggtgaaaactgttgctctgaaggatatgtttgtaaagatatctttaagaaaggaggcatgatttactctgctatgattaaaagtatttgctacttaaagaaaggaagtgtccttaaaaaagagaatcaatcaggctggtaagattaagggggaaacaaaaggagaacaacagaggcaaacgttactattttccaagggagacagaactttagtagtagcactgaaagcattttcttcccaatggccaggccacctcattgtggaggggctacactgaactacctaacacatgctattaaacattccacatcatttgattaggtcagctggcttgggctccatattcagcaagaaaccttctgactacaatttgttttcccctaaacctgcttgaagaaaagaacgtgctcattacatcactacaattatctcagtccatatgaaagtaatgtatctcattgtaaataaatacactggaggccaggcatgatggcccacacctgtaatcctagggcttcgagaggccaaggcaggaggattgcttgaggtcaggagtttgaggctgcagtgagctatgattgtgctactgcactctagcctaggtgacagatcgaggtcctgtctaaataaataaataggttggcattcttattttatatatcaggttttcaagtttggttaatgtgagtctgccactaaaaaacagaattgtcctctgtttttgacaaagtcaatttttattgcctccatggctgagagccagacttagaccctgatttattcatagtggctgtgaaccatcttgcgagacatctagatagtctttacggttggctgcactgctttcgtttatgaagtatccataaagatgaagattgaggtgctattaaacaaggaggtaatttgtcattcttagcatagaaggagtaaagtaagaagctaatggaggaagttttagaatttaaaaatatgttatgaagctgtgttaattatatggaaaaatacaagtaaaaggcatttaaaagctttaaagcattatgtaactctttaccatcattaattagtgatacattttgaatacctaatttaattaaatgagtaatatcacaatgtattttaatggcatttaatttgaccagggtgctattaataatagtgacagtgataatcataactaacttttcttgtgctcatactgtgtcaagcactgctaagttcttgaactcatttactatatagtgaaccagtgaggcaggtcctattgttagctcagtttgtaaatggggaagtgaagcacagagagatgaggtaacttgctcaaggccacactccttaagtggtgaatccaggatctgagtccaggcattcgactccagagccagagctcttaaccactaagtgaaattatatactatgcttattaacataataaaataaaagggaaagttaaaaaattggctgcatcattttttgagttctctgattgatgtggtcctaatcattgagatgtaaatcttattcttgccacaaagtagtaaaacttttagtaaacttataagatgtgcatctaagtaacattctaggaaaaagaagcaagtaacattccagagtacaaaatagctggtttaacatacttccagctgtagcaatgacgatctatctctcccctattcatctgtcattttctcaagtaattttcagtttaggtatatctcttcatatcatcagagccccataatttcaaattcttgcaattctttcactatgcaggacattagtattttattctgcatttctcagaactcagggttctctttgtgtcaggtattgttcctgagacataaactgggattgtagtcttaaggcctgctctgttttagaacctataaattcaacgaagatgctcttagcatgtcagctgtaattccgctagtactacgaaggctaatcttgcaggaggagcaaagggttccatgttcaaagggataatttattgctgttcactctgtttttggagatagttcaaaatgaaactctctcctaatgtcgcaagcagaaattgctttttcagggaaattgtttcaaaagagcatgagtacctgaaccttaaattacggtgagctttttcaagttatgctgttgtgttgctgaatgcctaaatggatcttgactgttcaactgtaatattaaataatctaatcttgtgactccaaggcaaccctttaatgcttctgtgcttcaacaacagtctttccaaggtccactgtcctttacacacagtcctactgctagtaaagaatagtttgcttgcccgcttcataaaactattcacatttatagtgtgcagtttctggaaaattgttagttaagtaatggttggctctatggtcttaaatacaaaaaggcaatgaacagagaaactgtgtagtttctgaaaaatggttagttaaataatggttggcttgatggtcttaaacacaaagggataatgaacagaaaaactgttcagtttctggaaaatggttagttaagtaatggttggcaccatggtcttaaatacaaaagagcaatgaacagagaaattgttttccctgccctttatactgacaatataaatatttttgtctacctactcaaacaaagcatgttgtcagtgaacataaatgtatggcatatagcccctagttaaaggagagaaacatattattaagtaaatggatatacagaatagatgtcttaaaggtaaatagtatctttaaggtaaacccacatttaattaaaacaagtgtttatttgcaaaccaggctattaaatactgtgaaaaaaatggagaaaaagtagattacaagctctttatgctcaatggtttataacaatttctaacctagttctcactggaatgaacactgtgtaaattgctacttgactataattacaagcaacatgtaaaagagtacaaattaatgtactaagacttactggtaaagagaaacaattagggagtgatcaggaggtagtgtgatttatttggaaggacatgattaaggaggtgattgatagctgagaaaattcccagacagaagggattttcaaccttgattgcatattggaatcgcctcaggaaagttttaaaaatacccaaatctgtgcccatccctcagaaattttcattcaattggcaattttaaaatctttacaggacagcctaatattcaggcaggattaagaacctctgacataatagggggtcactgtaggtggaactatattgtaatgtgttgtggagacatttccctgaaatgaagggagtttgcattaaatgacctttcagttgccaccttcttctaggagtctatgacattcatattcagagtcatagggagagtttgactagttgtgagtgaggctgacaactgaattgaattggccatagcaaagatgactctagtgggaaaaaaataaaagatgattctataggaacatggtaaataatcacttgtagcatagctaatactaagtggatgattgtagctttcagatcatagaattttaattgtggaatgccctttgaaatggtgtatttcagactaaatttcaatgcatccatctctcttcagtattagctgagaagttgaacccttctcacacatctatagtcagcaaaaccagattattcaacctgtttgaacattttaaatctacagggacaatcagaagccatcataaactttgaagttaaaagatttgatatgattaaaatacttataaaagattattttagtagcaatgtgtacagagtaatctgaaaagttaccaaagctgaagacagatggtaagctttaaatagagttggaatctgtaacgctacaattccataaaaaaatttgtgtagaattgtcagtttgtatcagcaagttggaaccttagagatagattaggtaatagtaaatagtatctttatttgtaactatatgttaatttaaacatctaacatgtttgtagttatgatatatcaactggtttaaacaaacaagtttgaacaaacaaattctattttttaaaaagttcttcatgtatgtaagctctttaaataagcccatgtctaatttagtaattttactcgtattttctttttcagacttttatagtaatgaataaaggaaaggcaattttccgattcagtgccacctctgccttgtatattttaactccactaaaccctgttaggaaaattgctatcaagattttggtacattcatatccttttaatgtgaattgcctaaatgctatttctaacagttgattttaaagaaaatgtcagttatattttcaagtatctgtaaaatttctttgagattaatggtaacattgttagtttaattcatttatttgcattggttttccactatttataatgagagtattatagaatgactacagcattatagaagaaaatatgtaaccaaccatgatagtgaatgtgcaaaggaaacacatagtaggaaaaagagcaaatctccttacacctttatcagcttcaatgaggtcatatataaccattgctaaagattagattatggttagtattactatttgcattaccaagtgttcaaacttttacgccttaattgtttctgtatcttcagcgcctggatttatccttctttgtgtccttccttccttctttctgtccttcctgtcttcttcccttccttcattcttcccttttcccttccgtcttattcccttctttttttcagtaaatatttatcagactcttactatgtgctcatgtacctggttgagaatatgtatcaaaaagtcgaacttgaaattatttacaatgttagtcaaaaagcatatgtaaaagggcagaatatgtttggatttcaagaaaattctcaagtaatgataaaatagaatggtgattttctgaggcagtgttcaagaatgggaattttgtataggcagattcaaagcaggcttctatataaacttaaagactgattcacctagagacagggcaaatgaaactgataaccttttgaggtatgaattctctcattctatggcttgatgttggaaagtatttatattctaaaataaaatatttatctcaaaataatcataaactttcttacagggaagtctggacttagatcccaagagaacgtactacagctaattctcagaagagcatcagaatagtgctatctgtttaggtataatgtggactagatacaagagtatagccagatggtctgttggggtccgccacaatctaaagtgtaaataaaaagctagaaaataacattaccttatcagcacaaaattggatctccctcttttatgctataaattgtaaaggagtaagttacatcactacaaacctactatttatgatagaattctcaatcaatgtaatctttgattatactgggctctacattctcacactttttacattgcattcgttaacgttttataagtcagtgaggatgaatatatctgaagtacaccttttacacttatggcatactataaacttactaagggatggtgagttcttcttccagggcaatttcacacaactgattggaatgcaaaataacttgcatttgcttcaaatagagatcatttttctattaaattcagttttgtgagtatatggtataaaatgaaaaaaagagtgcaccaaggccatatcacaggctttgaagtttcttattattttatcattgttttaaaacaaataatattaatttcacagtttttgcatcgataaacttttttgtgtgttttggatcatttataaatggccatggtaacctactaacatttattccttaactataatctactttattcagcatgcttatcatgtgcactattttgaccaactgtgtatttatgaccttgagcaaccctcctgactggacaaagaatgtagagtaagtaggaataacttctgggaatgagaaatgcacactcaaattctctagcaatctccttgtgggtatagcctgacttatggtttccacttctgtctaagaaaaagttattttcataatatgaaagaagataagggaagttctttgggggagctattcttctacgaggtaagtatttttccaacaaaatcatgacaatatctgttaaagagaggttataaattagtatatgctttctggtaaactaaaccaatcacctagcctaaaattaggtctcaatcatggttaatcatttgagataaaatacagtgatcagttcagtaatttgatgaattaaattattttattccagtatatagtgattattgttatattcgaatagaatagatttaggtttttagctctaaattaagtagatgtcttaattatacatctaagatgtctaagttatatttagatatgtaagttttttatacacaacatgtgtgctgaaacagcttagatgtgttctgtaaaagaaataaaatgtcttccataaaactgtgttcataaaataacagggcttaggggaaacatgattgggggagagtaaaacttatggaactttgtaactagaatacaacatagaaaccataataatcccaataaaaagacacttgcccagttgattcttttctaatgtttgtacctaaaatcatagccattgagttctttgtggcctcatatcccaggcctcatcctttctcccttgaaatggagactggggatatttgtatgatttcatcaaaataaaatgcttcattctgtattttaatacatggagaaaggtctaagcacattagttgttcaggatgttaaaccaggcccttgttgcactaaaagaaaacacttctgtggatgttgtgtattagtatcaagatctttttattattattattgcaagggattttccatttaagtgtgagaaaaaatgcccttcattgtttcaaaacatcaatatgctggggaaaactgtgcatgaactaacacaatttctttatcgtaacaacattatttcattttcttatttttcagtcacatatgaggttatttgcatcaaagaaacatagtttttagtgaaacaaagtggttatataggctacttatatatagtataatacaataatcaggtatctgactggttaagtaaaaaatgcagtatgctctttttattgttatatttttaaaagtaatgtacaatcggagataagatagtgtaacaaatactgccacttttagttccgtttttatagatttctctgaggatttactgtaccactctaagccattatttgtcagttatttaacatgttatttaaaaaaaaatagtagcttcaaaatgctgcctagaaattattgtaatagagaatccagctcccatattgaggaaagccatttaacttagaactctcatttactatacatgattttggagttaacaaaatggacactcctatgtaagactactctgtatgtggttttcccagcagaaattattgaagcatttaaacatgtatcaatttcatttatttgtataacattattaaaagatagttaaagaaggcagttggagtttgtgaccagcctggccaacatggtgaaaccccatctctactaaaaatacaaacaatgagccaggtgtggtggcaagcacctgtagtcccagctactcaggaggctgagacaagagaatcgcttgaacccaggaggtggaggttgcagtgagccaagatcccaccactgcattccagcctggacgacagagcgaaactctgtttcaaaacaaaaaaaaaaggcaattgaatatacaggcctctctttctaaagaagcagtaataacttagagatgattatacccattatgaaggcagtcttagctttagaaagtttttgatttgcatcattcagctggaaaactttgctcaggttttctgatcaattgtcttcagtagcttgaaagcaagccagcaggaaaaaagcaaagtagtagtggttactaccccaaaccctgggttcagtgaaacagaagataacttagttctgagatgaaaactgaagtcaccgatatttgaaacagtccctgtacaaagatgtggcatacacaaaaccatattatatagtgaggggaatgttatataaggcaaggcacttctatagactgcattttatttaattttatttatactgcattttatttaaaccaatatacttaaaatatgaaaattcaacaattaagattagccaaatttcaaggttttaaaacaccaaagttacaggaacatagacagaattgacagcttgattatgagcctagtgtgggcatagccacgaaagataaaggtcccctgactcccacttacctgcccaacctagttactaataaccatttttgaatacctattctgtgtagagctctgtctcagtaggctctaggactctcttccatggacagccatgaacacttcccatacattccaaatgtacccacatattttcttaatttccccaaatcaagaacaaaagtagggactttaatcttattcctagtaactctatagataagacagaattgcctcagcataaaccacagggcactaaccactaatacaagaaacagaacatacatgtgtggtgtttctaggcctttaaaaggccagctatctctacagacagaaatatcacggtgattatgtgtgtcacacaacgatccaaactacaacacagtaaacataagcttgatattgtaaaatatatctcttcctaatagtcagctacttcatataagtaaagataggaattattgcttatgagatcaattgaattgttgggggagaaaaggaagggaatgtacttaagaaaactagacttgaagatatctgcataaattattcttgatgtctttgttccctcatatgaaagaaacttgtgcagaaaacatttcaaaataatgatcctaacatttttcatatataaatactggtaggctgaaaaatctaatgaatttaatatgagtaaatcaaatctttgtggcttgggtgaagtgctctgaaaaataaacttaaattgtgcttttaaagaacacaatgttgaaaaacaagtactctcaactattttgggaaaaaaacgaaaacagcaataacttatattgtcaagactcaaagaaaagagggctagaaatacatgacattaaacagcaaatagaaaagtcttccaccattttggaggctgaaaattgaatttaagcaaggtttgaatgatttagcccaattgcatagagatagtagctgatgcaaggtttgatttaagaattttgtgtatccgtgtattttggcatttgtgcaaacacacacatataaaatactagtgaactggaacatttcatatgataatatatacacacacacacacatctctatacagcatgctcatgcacacacacacacatacactcagggtgggaggaaggagggcagagagagagaaagaagagagagaaatggggggcagtttataactctacatgattcttaaaaattgaaaaaaaagaaatatattttctatggtagacatgtaaactagccctcaaaatgagtctactcattaagaaatttgaataaaatattttattatttaagtaaatgaatccaagctatgttgcctctaaagttgtactgtctgatgaggaagccactagccacatatggctatggaaccttgaaatttggctaatattaattgttgaattttcatattttagatatattggtttaaataaaatgcagtataaaaaatacgttgacttgcttcttctcatcttttcgcttgctactaggaatttgaaaattacatttgtggcttccattacatttctatcagatactgctgcgctagaaggtcaaactagatgattatccataagatacatgaaactattattctaaaacccaaatagttaaaccagattagattcctaaagaatatattttctcttcagtttaactctttgctcaggcttgtaaaactaactaaatgaatagattatttggtaaatagaagtaaggaacaatattttaatgaattgaaaaaccacaaaaggataggatttgctatgattgaaaacatttattttaacagttcaagcaaaattgttaattttggcttggatgtttttcctaggtacacattcactggaatctatacctttgagtcacttataaaaatcttggcaagagggttttgcttagaagattttacgtttcttcgtgatccatggaactggctggatttcagtgtcattgtgatggcgtgagtaactttgaaaatttgataagcgcaaaggagtgaaaatagtcatagtacaaacaaggtctttgtgtcatatattaaatgtagagctttcttgttagtcaagttaactatatggattgtgtattttaagaatacatattagaatacatattgcaatgtaaatatatccagtaaatgatcaataaatggggttatcttcatgtcatatagtctttctcttcatcaaaatgaagttattcattgactacaatttaatagcaacaactgtacttggattagttttgcaaacaaatgtgttcatattagtgaaaattacattgaaataaagcaacacgattttgtttcttaaaagcaacctttagcatatggcagcctgaggtctatagcaattccatttgttaaactcacagggctctatgtgccaaacccagcattaagtccttatttagtataaactttgccaaaactatcagtaactctgatttaattctgcaggtatgtaacagaatttgtaagcctaggcaatgtttcagcccttcgaactttcagagtcttgagagctctgaaaactatttctgtaattccaggtaagaagaaactggtgtaaggtagtaggccccttatatctccaacttttcttgtgtgttattgtgtttgtgtgtgaactcccctattacagatatgtgacagagtttgtggacctgggcaatgtctcagcgttgagaacattcagagttctccgagcactgaaaacaatttcagtcattccaggtgagagctaggttaaacaccgaggttgactttaattattgagtttgaaatcaatttatatgacttacagcattagccttgttgcttattattacagttcatcccgttaaataatgccaaatgatgtttcaatgtcagtttagctcctaaaattttataaattacatgcgtatttataaagtcagcctttgagtttaacagaaaattgcatgagacatcttcaaaaaatgctaatttgggcctcttgcgctctctctctctctttttcactaccatggctttactaacagatttggattttaccattcgctgcagatgtagttcaaaaatggatctccttttacaaaggagaaaatattattgttgaagagcatgtatatggcatgagacatgagacttacattattttaaaattcttttctcctctaaattactactgcttggaggctagagtaaagaatggattggtggaaaatggctgcatgaaacacaaaatctgaaatgaaaaataactccaagtttttttgtatgtttgttcagcatgtaaaaccacacaaacaaaacttcctgactagatatttaaaccttcatattgaatttccagcaagcacactgttcatgtgtaaaatctgctgttcatctatttcccaaatcatcaggctatccatacagctttggtgtctaaatagtcaagcaatcatttatgggggaaagagaatgtgtgtgactattaagaaatcatgatttctggcactcttcctcaggtaacctatagttctctctctgcaggtttaaagaccattgtgggggccctgatccagtcggtaaagaagctttctgatgtgatgatcctgactgtgttctgtctgagcgtgtttgctctcattgggctgcagctgttcatgggcaatctgaggaataaatgtttgcagtggcccccaagcgattctgcttttgaaaccaacaccacttcctactttaatggcacaatggattcaaatgggacatttgttaatgtaacaatgagcacatttaactggaaggattacattggagatgacagtaagaagtattacattatgttaaccttagtgttgctgaatgaattttcaactataaatagttgagactgtgggtgtacagccacctttgtaaataactgaaatagtccaactctgatttattactaatactaatgtgaataggattaatatgaaataaaatgggtttttttttgtattaacaggtcacttttatgttttggatgggcaaaaagaccctttactctgtggaaatggctcagatgcagggtaagaaacataatatattttttaagatatagaactctttgcgaaaaaaaaaagtaggtaggaaaacaactacatggttatatgtgtagccttaccatgtatgcaataaagagcagtgctgctcccctaggaagtgccttgtctgccttaccggattgccactggtcctaaactcacagcaattaaaaattatccctttgtgaagacctttccccaaaatttcacagttaagatgttcttaaattgatgctccaatgtgtgaaggcccagagtctgtctttgctgtacatctatcagagctgttaggaaacacaggaacacaagatgggcccctttttattggtgtacatatgtatcaatgggatgagttttgtcgtgactggaaaagacccagactataatgtggtcttcagggtggaagcacacttggggaagtgctttgaaatatttaagtattcttgaaggagcatgtatttctgtatacaaagaagccaagggtgcatgtgtgccaaaggcatgtccaagtatcagttgacataatgaatagttcttttaggccacacgttacaacaaaagatgccataatatcttagtcatgctgttattctctaacccttaaatattttcctaagagtattgtaagttaattttaaatcaaaatagggaattttttaagagctgagagatagcaatagtaagtgactcttaggacacggaacttaaatatattttgagtcatcctttaaaaagggaaactggtgtagccataaaaatctaagagagttaatgaaaatgtatactagtcatataaatagagctttggggaattttttttcctgacagttttcctagccttattatgaatgtagggggtaagagcataggttgtagagttcatgtataccagggttcaaatcctaacttcaccacttgtaagctctttgaccttggaaaagtgtcctaagctctctgtaccttagtttactcatcgttaaaatggagagagtaatattctgtccctttaatagttgtgatgattaatgatttaatacacataaagtatttgaactatcacatggacaattgtaagaatttattgtatgtaccagcctaagcaacaaagcaagaccctacctctacaaaacaaaaaaaaaaaaaaaaaaaaaaaaagaaagaaagaaaaaaaagaaaagaaaagaagaagaaaaaaagaaaaacttagccaggcattgtgatgcacacgtgtagtcctaacttctcagggggctaaagtagaaggattgcttgagcctaggaattccaagccacagtgagctatgatcatgccactgcactccagcctaggtgataggctgtctctgaaaaatggctgggagcggtggctcacacctgtaatcccagcactttgggaagcagaggcagggggattacttgaggccaggagatctagaccagcctggccaacatggcgaaaccttgtctctactacaaaatgcaaaaattagctgggtgtggtggggcacacctgtatctcagctactctggaggctgaggcacaataatctcttaaacgtgaaagatggaggtagcagtgagctgagatggcaccactacactccagcctggatgacaaagcgagaccctgtccccccaaaaaatttttttaataaatttaaaaaaaaagcacactctaaaaaaagaaaagaatttattgcctattaactattatttattatgatgatgattaacataaaagcccagataaaattttggataaatttggttaatacatactttattcctattaaaccataataatctattccccttaatgaattcctattatggcttaagtaatttacatcaacagtccccagcctttttggcaccagggactgttttgtggaagacaatttttccaccgaccaagggtggtggtgggaaatgatttcaggatgattcaagcacgttacatttattgtgtacattatttatattattagcatactgtaatatataatgaaataattgtacaagtcaccataatgtagaatcagtgggagcctgatctcaaatgattcacctgcctcggcctcccaaagtgctggggattacaggcatgagccactgcgcctggccattggtgatgagatttttgtttttgtttttgtttttttttgagacggagtttagctctgtcgcccaggctggagtgcagtggcgcgatctcggctcactgcaagttccgcctcccgggttcaagctattctcctgcctcagcctcccgagtagctgggaccacaggcgcccgccaccacgcccggctaattttgtattcttaatagataccaggtttcaccatgttagccaggatggtctcaatctcctgacctcgtgatccgcccgcctcggcctcccaaagtgctgggattacaggagtgagccaggtgatgagttttaaatacaaaaccattttgtatttaagcggcacattccattaaagaaataaatgatttgtattttattaaaattaaaagctgctgttttacaaagatattcttaagagaatgaaaagacaaaccagcaactggaagacaatatttgcaaagcacatatctgatttaaaaaaaaaaaaaaaaagactggggctaggtgaagtagctcattcctgtaatccagcactttgggaagctgagaggggaagatcatttgagcccaagagtttgagactggcctgggcagcatagggagacactgtttctccaaaaaataaaaataaaaaaattagccaggcatggtgtagtgtatctgtggtaccagctactcaggaggctgaggcagaaggattacttgagcctgggaggtcgaggctgcagtgagccatgatcagaccactgcactatagcctgggcaacagaattataccctgtctcaaaagaaaacaaaacaaaacaaaacaacaaaccagtgtccagaatatctaaagaactcttaaaactcaacaataagaaaacaaatgacccaatttaaaactggcaaaagatctgaacagataccccacacgagtatatagtacaggtggttattaaggaggtaaaaaggcactcgacatcatttgtcattagggaattgcaaactaaaacaacaaggagttaccactgcacatctgttagaatgactgaaaaatgtatctggcaataccaacttctgatgaggatgcagaataacaggaactcttgcttattgctggtgggaatgcaaaactagacaaccgccttggaagacagtttggcggtttcttacaaaataaacatagtcttaccatatgatccaacaactgcacttctaggtatttagctgatcaatttgaaaacttatgtcttcacaaaaaacctgcatgtgaatatttatagcagctgtattcataatgaccccaaactggaagtaaccaagatgcccttcaatgaccccaaactggaagcaaccaagatgtccttcaatagttgtatagataaataaattgttatgcccatacaataaaatattactgagtgattaaaaagaaatgagctatcaagatacaaacaaatattaatgaatattaaatgcacatttctaagtgagaaaaagccaacctcaaaaagctacatactgtatgatttcaattacctgacattctagaaaacacaaagcaacagagatgataagaaaatagtgttttccaggggttcatggtgagggattatctaggtaaagcaaaggggatttttttttagggtgagaacctgttctctaagattctataatggtgaatatgaaacttaatgcatttgttaaaactcatagacctttataacacaaagagtgaatcttaatatatacaaattaaaaaaaaaatcttttgtgaggtttggggatcccaggaagaaatggaatatgtgacaaaaatatatacatgtattgcaaaatatgaaatgacctcactgtaggtggtggggtaataacatgctaacctaagtaactttggaaatgagtggagtctgtaagactaaaggtaaaaggaacaataccctagttgataaagttgtttccaatggtagtatagattaacaatcctgaaaccactgtgcatgtgtaccagtactgagcaattacaaacatgtgtatctccttgttctgtcagctgagagggcctagaagcaatgacaccccagtagcaacaaacacagctagcactcagatcttggtttctaataccattttccaataaaaagaactagggctccttggagaaatggttgattctaggactgcggcagaaattataaaagatgagcctggagcatctgatagtacctaaaactaagaaagtgttaaaaaacaaaaaaaaatgcaacccacaaccatggtgtatgtcaaactgttacaggtgtcaactgaaagagcttccagtggccaaagatgaagccatttgaacaaataaatgaaatatcattgaattgtaatccaaaatataaaatgactatccatgactacatgttaattgaaatgattgaataattaaataaaatatgaatggacaaatatcctatgcagaataatttcaaataattttggtatatacttaagatcataactgcgggttccttaaatgtggtctgtacacagtgactttatttcaaagagcacatatggaaaaggaagaaaagggagtaaatttacagtagagaaacctaacactacctcaagacaggtggtgaaagttaacatcaagagtgataagtcatagtgagtgataagtatgtacccttggcatgatgtgatgtgatgacagtgacattttacctctgtagtcttccacccaaaaatccataacctaaatataatcatgagacaaacattagacaaatcccaattgaagggtattctataaaatatctgaccagtaatcctcaaaactgttgtggtcatcaaaaacaagggaagtctgagagattgtcacagccaagaggagcctaaaaagacataactactaaatgcgatgtgtatcctgaatgggatcctggaacaaaaaaaggacattaagaaaaaaactgagggctgggcacggtggctctcgcctgtaatcccagcactttgggaggccgaggcaggcggatcacgaggtcaggagatggagaccatcctggctaacactgtgaaaccctgtctccactaaaaatacaaaaaattagctgggcgtgatggcaggcacctgtagtcccagctatttgggaggctgaggcaggagaatggtgtgaacctgggaggcggagcttgcattgagccgagattgcaccactgcactccagcttgggcgacagaacgagactacatctcaaaacaaaacaaaaaaaaagaaaaaaactgatgaaatctgaataaaatagtaactttaggtaataataatgtattaaggctgggtgcggtggctcgcacctgtaatcccagtacttcaggaggccaaggcaggagattgcttgagcccagaagtttcagaccagcctgggcagcgtagcaagatcccatctcaattaaataataacaatatatcaatattgaaaatggcatggaatgtatgaagcctgtactatcctcatactttttctgtaaataaaaaattgttataaatattaactttattttagaaaattctacaaaaccagctaatgaaatggttgattccccactctttgtctgttttctggcttttaatttttttttttttttttttttttttttttttttttttttttgagtcagagtctcgctctgtcacccaggctggagtgcaatggcacaatatcggctcactgcaagctccacctcccgggttcacgccattctcctgcctcagcctcccgagtagctgggactacaggcacccaccacaacgcccagctaattgttttttttttgtatttttagtagagatggagtttcactgtgttagccaggatagtctcgatctcctgaccttatgatccgcccgccttggcctcccaaagtgctgggattacaggcgtgagccactgcacccggccttaatttttaactattgattcttgccactttgtaaagagtagaaatatggtaatgtcagagccaaaagtgtgtggttgctagctttctgccattctaaatgtccgtaaatatttatttgcatctaaattttctatcggtcttcctagtgaatttcatctgataagtttcacggtgggcaatcacctaaagtgttctggaaattaaagcaagataattcgtcacagatagcagctttgggttttgaaaattcctataagtcaaataaattgaaattgctgtaatttctaaactgaccctacctccatttctctctcttatagccagtgtccagaaggatacatctgtgtgaaggctggtcgaaaccccaactatggctacacaagctttgacacctttagctgggctttcctgtctctatttcgactcatgactcaagactactgggaaaatctttaccagttggtaaggtccaaatgagcatgcataacatttatttttatagacatgtatgaaatgaaaagcataggctgggtgtggtggctcatgcctgtaaccctagcactttgggaggcagaggcggatggatcacttgagtccaggaattcgagaccagcctgaacaacatggcaaaaccccatctctaccaaaatacaaaaattagcccagcatggtggcgcccatctgtagccctagctacaagggagtctgaggtgggaggatcacccaagcccaggaggtggaggttgcagtgagtcgagatcatatcattgcactccagcctagatgacagagtaagaccccatctcaaaaaaagaaagggaaagggaaagggaatgggaaaaggaaagggaaagggaaagggagagaagggaatggaagggaagggaagggaaaggacctgcttataacactctggaacacagaggaaggtccaacataaagcaagtgtgccaggaatcctaattgctcactgagtcagtacctatatatgtacactgaggacttttttatgtgaaaggcattctgctaggaacttggagatgctcatgactcttagaagttgataatccagttgttggtatataaacagcacgttaaaagattttaaaaatcagtgatgttgatgtgaaaatttcaaattaaagctctagctattaactgagactagaaggggaggggagcaaaagtcatctatagatggtatggagaatagctgcagtgcaaatggaatcccactgaaaggatttaaaggttcagtgctcttacttgtcatattattgctctgcatatgaactctaataaaagcattatagtggggctcacatatatatccactatatatgagtttaaaatgtatttatatccaacaagactgcagtcaagcctcaaataatctgattcttaattttgtgtgttgagcatatcaataccaaaaaattcttggtgaaaataaactggatactaaaaagctaattagtctactgactatctaactgtggtaatcagatatttatttggggacattatactaaaatactgatggaattatcccccatttcccctagacattacgtgctgctgggaaaacatacatgatattttttgtcctggtcattttcttgggctcattttatttggtgaatttgatcctggctgtggtggccatggcctatgaggagcagaatcaggccaccttggaagaagcagaacaaaaagaggccgaatttcagcagatgctcgaacagcttaaaaagcaacaggaagaagctcaggtactgagtgataaaagcaaagatttatcattattattattagtttctaagtagaaatagtgttatactatagagggtagattggaactgctttttcattttatatataggcattgtcattagaaaaaaaagtattcaaatatgaacttgtttctgaagttagagtctaacaaactttttagccactgtatataaagaaatcagctagcggatagaaaatacattagagataaggtttactatggaattgtctcatagaacctaagagaggaatttaattttttatttaatttagaaaagaaataaaactgatatttccaattattagtgattcacccctaattatgacatttgagattttgttctgaagttaattgattttaaaggttgacaagagactttatatatacctatgcttaacaattctttgggatttctgtagcaaaaaaaaaaaaaaaaaaaaatgtttgctatagcccacatcaggatatcaggaaggtatctaaagttagatgccaacttgagatttttattaatattaaaggctgtgtgagctaggggtatagtgaatgggacattaatgtgttgaggagaagagacggaaacacagtactgtattaaaagacagaaaaaaaaatccatatactgaaaggtgaagactcacgaatatatagtaaaaatctgattcatgccagttagaattataatttctcaatatttttgccaacatttggtatggccagtctttttaattttagccattctaataagtatctcatttctgttttgattttcattttcctaattactaatgttgagcacctttttctgttcttattttccatctgtatagcttcttttatgaagtggttgttcaaatctttaatcccctcctttttttttagttaggttgtttgatttcatattattgagttttgagcattctttgactctttgggatgtaagtcctatatcacatatatgcttctcaaatatttaaagtgcagtttatccagagtattatttcttagcttttttgtttaaatcattcttttggatctaagaaatttttgccaagtcaacaccatgagtattttcttctaaattttcttcttaagttagttttatgctttatatttaggtaaataacccattttagttaatttttgtataacatatgagtgatatgttgagattcacttttttaaaatgagtatctaattattccaactgcataaaaacaaaatattcattctccactgcattgcctttgaacttttgtcaattattagttgtccataggtgagtttgtctatttctgaactctattctgtttagtttatttgtcatttttataccagtaccacactctcttaattcctgtaccttttatgacgagtcttgaaataacatagtgcaggtccccaactttttgttcttttttttttttttcaaagctgttttggctgttttatgtcccttgtagttctgtatgagttttttttctaagtttcatatatatatattttttattatactttaagttctagggtacatgtgcacaacatgcaggtttgttacatatgcatacatgtgccatgttggtgtgctgcacccattaactcgtcatttacattaggtatacctcctaatgctatccttcccacctcccccacccaccagttagaatggcgatcattaaaaagtcaggaaacaacaggtgctggagaggatgtggagaaataagaacacttttacactgttggtgggactgtaaactagttcaaccattgtggaagacagtgtggcgattcctcaggtatctagaactagaaataccatttaacccagccatcccattactggatatatactcaaaggaatataaatcatgctgctataaagacacatgcacacgtatgtttattgcggcactattcacaatagcaaagactctatatgagttttaaactccatttgtcaattgcaatttgaatgatttctattgctgtcttcaagtcaattatcttttcttttgaacatttaatctgccgctaatttcatccagtgtatttgtcatctgaaacattgtagttttcacctctgcaagcttgatctgtgtcttttttatatttcatatatctctaattaacattgtgaacatacacaatacagttataacaactgtttaagttccctgtctgctaatttgaacatctgtgtcacttcttggtcagttttgattaatttttctctttattatgggtcacatattcctgcagttttatgttcctgacaatcttcaattgaattccagacactgtcaattttactttttttaagtgctggatatttttgtattcccataaaaattattgatctttgtttcgggacatagttatgttgtttacacagtttgatccttttgtatctttaaacatttgaaaatttgttaggcaggaccagcataccatttattctaagactaattattcctcactagtgaatcaagacccttcctaatactctacccaatgcgcatttaaaacgaagtgtttgccagtgtaggaacagacactgttctggcacagtgtgattgccaggtggtgttctctcttatcctcagcctcaggtagttttctaagacacatgcttggtgaataatcttctcagtactcaaggggaacctgagaagatccctagagttctctctctgctcaactctctcctctgtggtaccctgttttgtgaactatacaaccaccctgattttcctaaactcagcttcatctcatccattcatggagtctgcagagatacttcctctctacatcatagtctggaagttccaggccataagctaacaaaagcatagaactgacttgcttgcttttccattttccaatatcttaaaacatcctgatctgatgtccagtgccttcaaaactactgtaacatgtattttgtctgttttattggttgcttcaggagagagcaaatctggtctctgttactcaattttggccagaagcagaaatccaaataatatttttatgcactgacttttttgaggatttttttcagatgaatggctccacatatttgaagtattctttggatgacagtatataacagaaattggtatattcaaaatttaagtttttaacaattctgagttactttgaagatgcacaacaaatagcattaggtcctttctcaaggcattttttggggtaatggagatacagcaatgagttgtttagtgaattattgagctcaactctaggcatagcttttgctgaacatgctagcttgaccactttcatcttaccattggatacagagtagtaatgtggatataccttattgattttatacagaaaactataaacaaatttggtgaaacttgaaaatattttaaaatatacctcatgcttgccagaaagttctacatttgaattatttaagagttttattctatgtcaccataaataaaacacatttataatataataaaataaaaatagctatttacagggcaaatactttatttcaaggttttaaataagtgttataggaaataatgttcataaattgcatatgattgtattttaaagcactgggtttttctattatcattaataaaagaagacaaattaatgtgcttgaaaatcctacacagataatgagtttattctaaaatgcagccattttagggtaaaatatgacatcaattaaaaagagtatagtctttttgaacttagaaataaacatgcactatttctagtagaagtttaaagaacctatgattatgatgagttcggctaaaaaacatcagttctattaccttagtagtcagttactgaatcttagtgaccaaatcatcacaatttgattcagctttagcttcatacatataaaatttaaatttatccaaggtaaagtataatactgattggagtagcacagtgccaaatccattttagttccttattgacaacacaagtaatgatgactagtaaattatcaatgttgaagccaggaggaagtggaggcaaagacagaattagtgcacctataagatcatttatgctgcagtgtagcttaagtctccctaaccacctacgactcttcaaaagttactatctagccaatgacttcatgaaggctagcatcacttccatctttgtttattattggttgaggggccacctagggctagtcacggtgtaggcatgagaaaataatgtggagaaacacaaaccctgcaaagaaatcaatgttttgtcctagatcattctaattgtgtttgacatttaaattgtgatatttaagtgcctaatgttgcccagcttagtatatcccatagcagtctatattgctctgataggaaaaaatttgggagtaagctctagaacaaaattcgaaatagtagctcttaagaaatctaatataattggggtagaacagaaataggtataatgtcttgtagctttgaatgggattttaactggattatatacataaaatgaacaaagtattagttatgtggttatatttttacggacacacagatacagtgagttacagagcctactttgaatcacacaaaaatgttataagaaaatgtaatttcctgagtaaatattaagtgaaatttcttatttgttaaaagaggaattcagcaagttggctgtgaaagtaacacagttattctcatacgcaggacattggtagtgtcacagagttgggtataaacaggtacacagacatgagagatgacaggaaacatctgcctttgagggaactggcaaatcactggaagtggaacaaatgacagatttgagttgatgagtgacacagaaaatgtgtctgaggttacctttgttgccttagaaatctgttttggttttgagttatttgaactgttacccagaataggtttggaaataatgtcttatgcaaaacaaagtttgtggccgggtgcggtggctcgcgcctgtaatcccagcactttgggaggctgaggtgggtgggtcacttgaggccaggagtttgagatcagcctggccaacatagtgaaaccctgtctctactaaaaatacaaaaattagccaggtgtggtggctcacgcctgtaatcctagctactcagggggctgaggcaggagaatcacttgaacccgggggtggaggttgcagtgagccgagatcatgccattgcactccagcctgggcgacagagtgagaccccatctaaaaaaaaaaaaaaagtttggaagtgatttaaatggacataagttgtaggattatggtaagggactattaccaccacttcctttgtttgcagggacaaacaagtcaataaatgattaacactgtgtgttgtgtgtttgtgtctatataaaatagaaaagagaattaaggactttatttggataagaaagggtatatatatattcactgtttcaacaaatggtgtatattatgtacctcatatgtatccagaactctgtaactatatttaacttgctatagataagtgattcatttattcactttattttgcatatatagtcagagttataaaatgtacttaatatttctcattttacatcatgaattatattaaaagtgatactgatgatcaataattccattaaaaacctggctatatgactctataaaattttataaatatctaaattctgaattactgttttatttaaatgctgggtattgtcttatatcaagtcttagatttgagcttccattatgaatatagtgcttaatataaataaatatgttacattttatgtgttgcttggtcaaacacataaatttaaaatcatatttagtactaagtttccctccctgagatcattgtaatcctagagaatttgcagcatagtaattttagatttaaaatcttttttaaatttttaaacatgaagtttaaaaatgaaaactacttaggagagtttgcttcttctcaagaaagatgaaacataaagcacaaagtgttgtcaaagcattataaataggttttatctccatttcttcctaaaatatgttgttatatagactgttatgacagtcttttatgatgtcttgaaaagtcaagtcttttatgatgtcttgaaaagtcaacttgctatctgtagcaagttaaatataagttctataaagttcttcagaagcatcaaagtcaaggttaagtatgtcttgttcttcccccacccccaccccagtgtctgagacaattgatagcaaagtacatttttaaatctttattcaccaattatttactgagccttatttatgtcaggtgacatactagtcactgagcatacaatgatacaatttctatctagcttacagttaatgggaaagataatatattagataagttagatttgtttgtatttagtgatgacatatgtaaaaagtttaactgatattgtcataatttaattattttcacttctgtggttacatttacaaatagtaatatacttaatgagaactcagctttgatgcacaccatattgtttcatatcctctgtatgtcattgttagatcatttccagtctaaaaatactatttgccatgtttcacctcagagctgactgtgtttcatttgtaggtacagaaattcaaagtgcttaagaatacttagtgctgcaatatagaaagaaaatatttgaagcagttctcataatcctttgaatgaatttatgtaatgctatgttaatcatttgttatttataatattaaataatctatgaacgtttaacattttttaagtgatatgtaataaattctctgggagtaacatgatcacagagatgtgaactacagtcctaaatgtaattcaaaggaaggaagaggataagctatctaatacatttccctacttccatctggaggtaaaatagtagacacttgaaatgttttatgttcacaaaaaataaaagaaacagtcttttgtactggatttagaggggaaaaaatacgactcagctgctcagaagtgcacacaggaggaaacgttttacagatggaatcagaatggtagttagataagcaaccaccacgaagaaaacatttgctttttaaagtatagaagacactttgaagagaacagttgtcaccaaccccccccccccaaaaaaaagacaatccagaagataggcaaaaccagatttttcttgctttaatgcatacactagcatattgctttatatgatttaaaacataagggtcattgttaagtaaactcttgtggtgagacaaaataaaaggactagaggatagacttttcacttgtagttaatgagtcttaaatggcaatattttaaccatactcaactgttttcaaagctctgtgttctaaatagtgcctggctttgttttatgacaggcagttgcggcagcatcagctgcttcaagagatttcagtggaataggtgggttaggagagctgttggaaagttcttcagaagcatcaaagttgagttccaaaagtgctaaagaatggaggaaccgaaggaagaaaagaagacagagagagcaccttgaaggaaacaacaaaggagagagagacagctttcccaaatccgaatctgaagacagcgtcaaaagaagcagcttccttttctccatggatggaaacagactgaccagtgacaaaaaattctgctcccctcatcaggtatgattttctactaagtgctctggtttctttgtcattgctattgctttttagtttttgtattttgttttggtacacttttgtactatctgacttcagtgagggacagggaactaacatttaatatagttgtttaaattcttataatagattgtcttcaaagggatttttattaaaccattaataaaatgttcaccattttgagactgattatatatacagatagatatattgatataatatatagatatatataatatatattgatataacctatatatcaacctgtatatatatatgtgtgtatatatgtgtctatacacacacacacacacacacacacacacacacacacatatatatatatataacctacactagcagacttttcaatgagagttttggaatctcttgtttacattttccattttgagaccccagataaacttattttctttgagaatgggtttctgcctttgttatccaaagttgtgatcgtaacatacatataaattttgaaaagaagtgttctttgggttttgtctttatcctttgattaagagaactggactatggtgagtctccattttgcttgcatagggtcatgccgtgatacattagaatgaaattatgacctaaatgttcttgaagagaacagcatcaaaggtagtctatttttgctctgatttaatgccaactacctggttcttcagcatagttttaagtaaaagagtaaaaactagtttcaattatttgatgtttagtaagttttatggattagtaagttaatgtattgtttacatatgtctgatgtaaagaataattagttacaaaatctgtgataagtacaattttggctttgaacactatttggcaccattagaatttcatgtgctatgaattgcaaatgcttctaatcataacaatcttgagtcagaattataccctaaaaataatgctttgagagataatatataagattaatttaatcaaaaactgcaaatcaaccaaggggtatgatatatttttcataaagaaagaaacttctaaaaaaaaccagaagtaataaacacaaaattcaacatagtatttacttttggttgggagaaaaggtaatatgcaagttctcagtgaatgttttataatctatctttaatatgtaaacaaatatttttaaagaaaaaagtagactatattaataacttaaaacttgtattctcatattagaacaaaatggacatgaatacacaaagagttttaagataaagccatttttctgcagataacatcaatatcaagaaattcaactattactatcttgtgtaatacaaatataaaatatattatcaaatcagtataacatatttggaattaacttgaagctctgaagggcaacttggttcctcagatcagatttttttttcttaaacagtcacctttgatattttggaattcttaaaactattaggagttattagaattaagagtatatgaaactatagcataatgatgctacagtgaacacaaacttttgtgttcatatctcaactccaaactagttctgtgacgttggtcaagtcacttgtactttgtaaaatttctgtaaaataaagtaagaatacctacattaaagagatttaggggactaagcaatatatagaaaatctgtgtgacaaagagtaagtctcttattaagttaaaatcggtgaatgaatttcaagtgagggaaagcaaacttctgagtagtttcaattactaacaaatgtatatacataatttgatagcagtattagttcctttattgtttcatcattttgctcaaataaattttgtagatcagttcattcagtccaatcaacaaatatttattgatcgccaactatgtagcaagcatagttcaagatgctgaaaatacctcaaagaataaaagagactcaatccactgacctcatggaaattttttccaaaggagacggacaatgaataaaataaataagttatagactgtgttagaaggtaacaaatgttaagggaaaaaaaagtaagcaggaaaagaggaacaggagccataattggaggtaaaattttaaatagggtggtttacaatgacctcactattaagacattttgggaaagatttggaggaggcaaagaaagaggctctcttaaggaacagcattctaaactgatgaaagaggaagtgcaaaaccctgacatggtagcatgcctggagtgcttaagaagcaactggtagacttggtttgctggagctgagtgaaccacagacaggcaagagcagagagcttagctgatggccagtgttttaatactaaaagcagaatcagtacatacatgtggtagatgtcgctcattttatatttgtaaatagacagaagatagatggataatttcaaaagtgaaggaaataatctattagttttaaatttgcatatcccagtaaagacagactaagagcattaacaaaactaacaagcagaaatgtaccataaacggtttacaatttctgcttctgtaaacaaaaaaggaatctggtagaaagagaatcagtgaaggtggtggggacaggaagcgtaagatagacagtaaatactgctcaaatcaaatgtatcttctgaaaatgtcaaagcagagagggcataaattgtgggtgccctgccttctattcacataaattacaaatgttattttatgtttattacattattttatttttaaacagataatgttagttgtacaaaataaagaaatacttaaaagtataaaatgaaacctcaaaatgctaagtacttctgacaaatattcactttccttgttcccactagaacatcttaaaattcccagcatctttttccatcttgacttttcccaacccactttgaatccaaaccctacatgcatgactgtgtcttatagacctaatttcttctattttcccttttgttactgaaaattaagaaacagtctacatttatcttctgggaacaagatgaaaaagatacctgggaaatatgttttgacatgcctgaggtaaagaaagatggcctttcactccttaaaacattaaagctggttttccctagagaaagtgttgccacagctgtgggtattccctccactctgctgcatcttctagtgtgttatttttggtttattttctctgaatgctatttctgttatcttctttttccgtctctgttgccttgaaagctgcgctcacacccattattatacattccaaagagtgaatagaaatttcaaataaactcagagatctggaacgcctttgaaaatacctgacataaaaatatccaaattaaaggcatgtcccagatacatagtggatgtacacacgtaccacatactcccaaccaatactgtgtagaccgattttcagtttccagagacagtttcagaacataggtgtattgaggtgattatactcagccatcctagggattaatgtaagaccaagttagtatttctctgagtgtaggatgaggtccaccctgtgttagggtcacctggaatgtgtcaggaaaattcagattccagagtcctatctgctacttcctgaatccatattccaaaatctgggacctaaaaatatatatttttaactctcagagtgattcacatacactcaaatgtttcaaaacactagttctgggctgggcatggtggctcatgcctgtaatctcagggctttgggaggccagggcgggcagatcacctgaggttgggagttcgaggccagcttgaccatcatggtgaaaccctgtctctattaaaaatgcaaaacttagccaggtgtggtggcgggcacctctagtcccagccaactcaggagggtaaggcaggagaatagcttgaacttgggaggtggagattgcagtgagccgagattgtaccactgcactccagcctgggcgacagagcgaaactctgcctcaaaacaacaacaacaacaacaacaacaacaacaacaacaacaacacgagttctggatataactgttattatattgatcatttaaatggagtctgaggaaatgaaaaacattagcattctttattaatggggggatgaattgatgtcttcacatgatctaatctcttgatcactttgctgtaaaatcactctattgtctgcccttcggtagacaaacctgctacaggaattgagtgtcacatagacacagcctccgatggacaagctggacagccaatagttcctgtggagaatctaaccaaatccaaaggaacagagcacttcttagtgaataatatccttccagaatatcactgagacagaggacaacaaagattattctggtgctttgcagtctgggaaaagccatgaaaataaagctaaaaattggggcctaagaaaatcagcatgacctaattaggcagaggaaccaagaatacatttgacagagtctgccttttctgttttttccactaaaatcattttatttggttttacactaaagcttagaagaaagagaagatccaggaatgtttgctgctgacatatgtatatgtatatgtatgtatgtatattaccctgggtgtgaagagaagtaggaaagggaatgagagagcaaggaggaatgccattgttcatgatgaggggagaaaacaaatattctgcagactgaatagagatgtttttgaaaactatctgcaagacaagaatacacacagaattatttggggttgctagtttaaaatcctttcaaaatgtgaaagaaggaacttcaagctaaatcctcattttctggtactaggaaatagtttgcttaatttatctgggaatagctgtaatgaaaaaggttttgaattgtctctttctttttaatataattaaaataaaacagaagtatatgttgtttttcacaccacctgctggtgaagtcatgttatatgtcttgcttttacaagccagtgttatattttacacaagaagagtaatttgtgtagcagtttaggaatcctctgtgttgtgtttgctatgacatatagtctctcaaataaggtgaatcattggttgccatttgggaaactgttagcaaatttggaagacaacatcgtaggtaagttttgtgacttctgttcccatgtgggtagagacaaacagtttcagagaaagagtaaactacttttctttcagaattcaaaagaagagaatggaaaaatagtagttttttaaaaaagtaattatcctgaagtgaaatattggctacaatgcaacatttgaaacaaatattttaaatttgagctaacattctcacttgagccaaaacttattctccaggctacattcccttcagattatagcattaagaagtagaagctacttactatttgtttaaccaccattcccatcaaaagaaatcatttatccttttcagcatctggtccctaacctatagcattatgataacccaatccacctaaagtgaagactaaatgaagtggttgtatacttagtaaattgcaaatcagtattgttagtcagaaaaacactctttgtacttaaatttgctttaataaaaatatcaaaatatatgtgtcctctataaatttgattatccatgtttaagagcaagagtatactaactccaaagaaaacagatcctttaatattaatatttattaaataattgcgttcttcccctacccccatcccattcctttcctttttgctttctctgcagtctctcttgagtatccgtggctccctgttttccccaagacgcaatagcaaaacaagcattttcagtttcagaggtcgggcaaaggatgttggatctgaaaatgactttgctgatgatgaacacagcacatttgaagacagcgaaagcaggagagactcactgtttgtgccgcacagacatggagagcgacgcaacagtaacgttagtcaggccagtatgtcatccaggatggtgccagggcttccagcaaatgggaagatgcacagcactgtggattgcaatggtgtggtttccttggtgggtggaccttcagctctaacgtcacctactggacaacttcccccagaggtgataatagatgacctagctgctactgacattattcaccaatttgaaataatcaaagcctggacagtttaggctgtcataccgtcctgcttcctcaaaatgaaagttggtaaaaataatacatgattaatcaaagggaaaacaatagaatattgagaatcaattgaattgtatgggaccattagcttttgttgtatgggaattacttgtaagggaccatggctttaggttaaaagggccccgtttttagagtctgctatgaaatacatatctgcaaatttggtagacctaccgagacaaataatggacattttcaccatcaaatctataagatgtatattcaccaagaattgtataattatctattcatattctggaaaattcatattcttaaaattaaatattataaccaatttgttgataatgggcaatttcatacaactgtcaatatttacagtgctattttaaaatgactctaaaatgtgttgttttttaataggataagatatagaaataattaaagaaatttcaggaaagcacacacatttcatcgtacatctgtgtttgtgcatggaaaaaattggcccacatatgtcaatattgtcaatatagcctcaaagaaaataattcagccttgagactatataatcataatatttattggggggagattgatctgattattaatcattgatagaagataaaaataattttcacctgaatgaaataaaataataaatgactttagcatgtttacaacaaatttccttgaaaattgtgacaggttaattaaaatagttctgtaatataattgtgttataaaactgcatcccactggtgaattcctcttaaagagtactacctgtgataacttttttttaaaaaaaaaactgtttataacttagcaataattcaatattttattccttgaaaattcttacctggaaaaattgcatgtagcatgatttgccaaagaaatgctatgtggtgttgtattacttattgggaagagtggtttgagccatcagtatttggtttgcagggcaccaccacagaaacggaagtcagaaagagaaggttaagctcttaccagatttcaatggagatgctggaggattcctctggaaggcaaagagccgtgagcatagccagcattctgaccaacacaatggaaggtaagaagcaggtcatggaacagccaactttctgtgattatgtgctttgtgaactattccttcttttcatagaattactgaagtctgttacccagatcgaaactatatattagacctaagaatgtgatatatggagtacattatcacattgattacaaaaactaatattggccttatttctttttgacttgggtccttaccttacttgcagagtgatatttcaacacttgatattatatcaatgaggatttattcttatgttatgttactcatatgcaaatagagtaaactcttccccttttctaagtcttggtatatagaagcataaggaaacatttctttcaggctttagtctgttcttcaggcatggaagtgttgatggggttgcgggagcacttaaatgagttgggcaaatcaaaacctgtcctccactgcaagagagatcctacaaaagggtctctcttccatcttctacatacacagcaaccattacattcctccaaaggaccacggaaagaaatgtttgttgattttgacacagaggaataggcagcaactatttatacactaaacttgttcatacatcacacagccctcactccttgaagtctggagagagaatatattagtactgccctttttagatcaattatatgtcaattctaacatatgttctttagaaaacatcaattacattttatatcatgtcttcttggtgtattagatatacagtcacataataattattttgtaacaggcctcatccattaaaatttcaagcaatattttaaatacatgatgctaaaattctaaaagatatgtacaaaccacaaaagtagatttgagtctgaatttatactaaaaagaaaggcatactacgttctcactgtgtgcaagattaatgttgatatggaaactatgagaggagagaatagttcataaatgttatcacacacataagggatcacaactttagacaatgtttttaaaaaggtactttcagaagaaacaataattatttaaaattttaatagttgtgtaatgtttatttaaaattctgttttgacaaagagaatacagcactttaatcaatcataacctagtcattttaaaagcaaaatattaaattcaaagtgcttattttctgtattcaaaagagaaaaaagtcgatctatatgacattttaattaacattttctgaaaatatttaatgggattgtcttctcaagtttcttaagtaatatgaacttctattttcaaatataagcatcaattttgttaaataatgtaaaatctactagcaataataactcatttttgttgttatttactactcttccttgttattgtccctccagaacttgaagaatctagacagaaatgtccgccatgctggtatagatttgccaatgtgttcttgatctgggactgctgtgatgcatggttaaaagtaaaacatcttgtgaatttaattgttatggatccatttgttgatcttgccatcactatttgcattgtcttaaataccctctttatggccatggagcactaccccatgactgagcaattcagtagtgtgttgactgtaggaaacctggtaagtacatttgaagtttacttatttactttggtagatgtgggagagatagaccaaagggaaagatgtatttgtgctgtgttgaacccaaaaattatatcctctttcctcatagaaagaaatatctaaggaatattacagggaatctcagagatacagcctaaaactcaactggtatgaatgctgattgtttaggccaatgtctgtgctgattgatcatggtgtcttaccagttgtaaacgtctcaaaatctttacagttgttcttgctggaaatgtgggtccagataaaccaggagatctaatactggctccacaatcatgtggttttaacccacacagcctctaaaacaatcatgtccattgaagggatgacccaaagattgatgtatatgaaaaaaagaacatcattgtttcaagttaactacctaataaaaagcttcagtgataatcatacaagaaaaaaaatagttgctaaatttgcatttgtgatttagccatacctctggttcaaattactgagcattcatctgtgtctatgtgtgctaatcaaaatgggtgaacaagtaagaaaagggtttacatatattattaatcaagagctttctctgtactaaaacaaacttggggcaaggggtagtggggaaactggaatggagggaaaaggtagactaacaaactaagtaaagggcagtattgcagtctgactttaggaacagttttcatcaagggcttagatatggcccacaagttcactgcatcatttgtctttaggtcagcaaatgttcagcaagagctcactgattttccatcctacaacctctacactgaaaagcatgaatctccttttgagtctcattccaaagactctcctggtagaacttaggcataatttaggtcacatgctcacctctgatttaatcagccttggcagagggtgggatcatgttgaaaacatggcagtcctgaggaatcatgcgtgaaggagcaattgccaacagaagggggaaaggaaatgctggtggacaattggataattgtgtgccctaataagtgacctcaaattatctgcattatttgactcagtagaacacccaccatattcttgagattttcttcatctttggcaaaggccgtgtcccatttttctgttgcctctctcagtgtttacatgctagtcactcaataaataacccactggttgataactacccaaaaaggctgcttcaagtagcatgattttgcaaaagagcacagactttgcagtggagtggaattgagtttgaccttagttgcctagtgcttactagtgatatggcctctggacaattctgataaacaatctgaatctttgttttctattattgaaatgagtgtaataatacccttcgtgcagagttgttgtgaaggtcacatgaggtaatgtgaaagcacctagactgtgcctggcatctagcatgtgctcaataaacagtttccttcctcatatatatgctattaaccttttagacctttctttgaaataatgatggaaaatatttctggtgtagttcttgtatttttcccaggatattggacagttagggaagttgaacaggtgaaggaaatttgccagagtgaagcaggaaatatagaattccaatgctgaagcagttgagtatggaaacacaggataagagaggctggattataagatgattgaatgaaaaagcactagacaaaagcatcaaatctaggtcctagtcaaagtgttcatggtaaatatctgtgtggttttgaaaagtcacttagatccttgagtctattttctcaacacacatataaacaatgagtgtgttggactaaatgactttttatgtatgtcccagttctacaattctatgactttatgggtagtaactgaaataatgaggtgggaaagtggaatgggagactgatgcctggtagattgtttgtgatagaaccatctataagttcaggttagtgttggggaaacaaaacttgccaagatagagagcataaattatagggaacagacttgagttatttatttctatccataaaaataggagaatatgtaaactgactgtctctattggttgatacctccttactataatgattaacatatcaataatgcattgcataatttacaaagcatttgttcatagaatatctacccatagaatttcctacccataacaacctttatcataaatatccatatgaaagtaatacatatgtttaatatatatgcagagaaagagcatgtgagagagaaagaaagaatttctatcattggtgctaagctgacttaggactatattatagatcatagatgattacacagaatgttttgtggagagcttataatttgctcattaaaataaatttagaatatctacagactagtttattactgctcaaattattgcatactgctttatgttctacatgaggacactgaattgtggaattttccatcttaacttagatcaatatgccccattttgcattctgtttctgcagtacataaaaattacatcacttccttgttgatgagattaatcaaatttgagtatcaagagaccttgaatctcaattaagttttgctaaggtgctccgtatttttgtggagtattttgttttgttttgttttttaatcattataaaatgcttgctcccatcatagggattcaatcagcaaaaaatagcctatcaatcatagtaggttagacaacatcataacaaacatttccaacttacctgacaatgctgaaactagattaaaatgtaccaaaaacaatcccattgatttttagggccttaactgaaaacagttacagagatatagctgtcattttggattgctagttgtaataaaaatattatttttaatgaaaagttttatggcgggattacatttttagataagcgtaaatttagggtatatgtttttaaaggtatgagatctagtcattttagaagagctgaaaagatcaccttatgattttctatagaaagagatatttgtagattatttacctggatggttctagctcaccttaaataatatatttctatcatcagagtgcctatttcaaataatagctgcttctaaaagttttatacatgaaataaaatttgtatagttacaacttattttacatttaccaggcaaactcactatttgaaaaaaaaatctttgatgtgttattctataaaatgaaaaatatatttttcaatgggcatttcaccatatacttggattttcatgtactaggcttgcttaaaatacattttatttctatttgagtgaatggatgactaccattaggctgtttttttctgtgatgggtatttcccatctgtgattggaaaaaatgaagtgttagctgcatttatatattcgtaagggtggatcaagatttcttttaagtggaaccaaataattgttatactgttattttgacagaattccttcaagataaaggctgatttatcttcgtaaatgctaaacttgactttacagtcataaactgcaacttgtaactatagcaaattaagagaattgctttaaaagattttctgcaagagtaatttcataattcttcatgtcctgtatctctcagcctatcgttttgagttaaaaaataaatgttgtgtttgtttcattgtttttctttctattgtcaaatacacatttatctagccactcaagtgacttattaatctcaattacatgtatatgcatactgagtattttctcctgctggtttcaattaaatctgcagcttcttgctctattaatccattaaccttaattctgaggcatacatccagagatcattataataaacaatttgtggcaaacttacttttgtttcaggaatgtttataaaattatagaaataagatggtgtcccttaaaaaacacaaaatcaaaaacaaaatatggtttttacgaaatcaatttttaataactttcagtaatatgtggatttgttcctgatgcgatactacccagaaataaatttggttgtgattatgttagaaatgtagtgtaccaacaagggcaataattcagtagctattattcaataccagagttaaaatgtagaccatgaaatgttttaaaattagtgtttttcttggaaatccagaagattcattaaataataccactctacttaataaaatactctcctagaggaaaaaaaaaaaaaagctagacatggctgggtgtgttggctcatgcttgtaatcccagtactttgggaggctgaggcgggcagatcacttgaggtcaggagttcgaaactggcctggccaacgtgatgtgaaaccctgtctctacagaaattagaaaaattagctgggcatggtaggtagcccatgcctgtaatcccagctacctgggaggctgagactggagaatcacttgaagcagtgagccaagatcgcgccactctactccaatctgggcaacagagggagactctgtctcaaaaaaaaataataaaaataaaaaatgaaaataaacatacgtgtgcatgtgtctttatagcagcatgatttatagtcctttgggtatatacccagtaatgggatggctgggtcaaatggtatttctagttctagatccctgaggaatcgccacactgacttccacattggttgaactagtttacagtcccacaaacagtgtaaaagtgttcctatttctccacatcctctccagcacctgttgtttcctaactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtctttcacccacttgttgatggggttgtttgtttttttcttgtaaatttgtttgagttcattgtagattctggatattagccctttgtcagatgagtaggttgcgaaaatttcctcccattttgtaggttgcctgttcactctgacggtagtatcttttgctgtgcagaagctctttagtttaattagatcccatttgtcaattttggcttttgtcgccattgcttttggtgttttagacgtgaagtccttgcccatgcctatgtcctgaatggtaatgcctaggttttcttctagggtttttatggctttaggtctaacttttaagtctttaatccatcttgaattaatttttgtataaggtgtaaggaagggatccagtttcagctttctacatatggctagccagttttcccagcaccatttattaaatagggaatccttttcccattgcttgtttttctcagatttgtcaaagattagacagttgtagatacgtggcattatttctgagggctctgttctgttccattgatctatatctctgttttggtacaagtaccatgctgttttggttactgtagccttgtagtatagtttgaagtcaggtagtgtgatgcctccagctttgttcttttggcttaggattgactgggcgatgcaggctcttttttggttccatatgaactttaaagtagttttttccaattctgtgaagaaagtcattggtagcttgatggggatgccattgaatctataaattaccttgggcagtatggccattttcacgatattgattcttcctacccatgaacatcgaatgttcttccatttgtttgtatcctcttttatttcattgagcagtggtttgtagttctccttgaagaggtccttcacgtcccttgtaagttggactcctaggtattttattctctttgaagcaattacttggaaccaacccaaatgtccaacaatgatagactggattaagaaaatgtggcacatatacaccatggaatactatgcagccataaaaaatgatgagttcatgtcctttggaggaacatggatgaaattggaaatcatcattctcagtaaactatcacaaagacaaaaaaccaaacaccacatgttctcactcataagtgggaattgaataatgagaacacatggacacaggaaggggaacatcacactctggggactgttgtggggtcgggggaggggggagggatagcattaggagatatacctaatgctaaatgacgagttaatgggtgcagcacaccagcatggcacaggtatacatatgtaactaacctgcacattgtacacatgtaccctcaaacttaaagtataataataataaaataaaataaataaaaataaataaaaataaaaaatgaaaataaaaaaactaagacttgaattgatttgtcacattctctcactttaaattttagatatttttattcctgttaatgttcttctttataaattcgtgtagcatcagtgtttttcagtgctcttgaagtagtgctgatctctattttttaggtctttactgggattttcacagcagaaatggttctcaagatcattgccatggatccttattactatttccaagaaggctggaatatctttgatggaattattgtcagcctcagtttaatggagcttggtctgtcaaatgtggagggattgtctgtactgcgatcattcagactggtatctatttatatatatccctgtcgctcattggcacaacatttattttgaaattgaatcaatgtatatttatataattattaattttaattttaaatttacatcaatatgtgacattctaagaaaacatgtaaacatcctctttaaagctaaaccattttctaagaatgatgaaagcattcaaaatactctataatgattaggtatgtagggcacattagaaaacctacaagtactttctaaaactgtgttttaagtttatgaagcttttttggccttacagtctgtaaagatacgcaaataaaaatttagaccccagttaattttagctttttattaaccctacttctaggaatggggactgttttaaagcaacatgtgggaaaatatttgatgttattagtatcttaaataattgtataaaaaactttttgaattatcacaaaattttattgagaaatatgtaaaatttattgaaaattaagcaaaatgtgtattttttcaatttttttcctgtacatttttatcacattatttaggttattttacttttatattggcctataaaaatctatgatttatacttttaatatttctttttactgtctaaaatagaatctgaagataacatttatttgctaatttaaaaagtctctaatcaaaataccatttgtttacatgggcatatctttggatgaatcagaaatgttttatttattatttctgaaatgttttatttttatttttgcacttaaatgatattatgaccagatttacaattctaatattgttaacactattttttctggatttgaaattgaatcagttcagtatattttgagtttttacatctaccacgtgtggttctatgataccacatactaataaaataatgtctaaaattatattatgattactactaacagcatcttttcacttgattacagcttagagttttcaagttggcaaaatcctggcccacactaaatatgctaattaagatcattggcaattctgtgggggctctaggaaacctcaccttggtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggccaaaccatgtgccttattgttttcatgttggtcatggtcattggaaaccttgtggtatgtatgtagtacaaatgctcataaattagaacaagagcagacagtagctaggaacgtggccagatgtagtaaacatatctctggtttatagtaagtggcctagactgaaatccccctattagcactcagagaataagcaagttatttaacttctcctgggctctggtttcccattttttatgacattggaataataaaactgaaatcatatctttaatgcaaagattaaatcagatgtatttatgaatgcctgggggcataaatattagattttcctttcttcttcaaagaaagtaaatttttatcactaagaagaattgtatcctaatattgttttgataagaaaatgacctctactaaatctaaaaagacaactatctattctataatcaaattgctctttgcatgttcatagttcatgtagtttgcttacttagagacataggttgcatagtaccaaattttgaagacacatttcaatgaagtagaccattatattttagctatgcattgtaattatccaagtaacttggaagaggacaaaatgttttcttccctgaatttgcattactataggaaaaccaattattacagtttaaattattcatatgtatggacattgtccagactcaaaggagttacttttaactgtgacttaaaatcactaatgcaaaagcatagtttatatatttatatgtttaatgcttaaatttctcagtcatgcgtgggcaaagcatttctttatgccatcatattgggcctttcctttgagggatacatttcagataaacttgttcaaaagaatgctactgggatacctacgaacatgtaatttttttctccagaatagtaaattagggagctctagattctgaaaaaatctgatacagaagtaaggaagcaaactggggcttttgccttgcatgtcttcctatagtgtaacatattctgaaactcaataactaactacatttcaggctaaaaatattattataaattttcttttacatcagaaataatgaattattcctgcattaaccataacttatcagttggctgagtaactttttcacatatcccatgatattctgaaagttaaaatcgcctcatactttctacacacacacacacacatacacacaaagaaagaaagaaaaagaaaagtaacttatgtgggtctagcctaaaccctggtatacttttagatttctctccatctgttgagctatttgaacatataaatttcaaagtgtatttgatgggaaacgtgttaaatcgtatataatttgcacttagaaatttctgctgttataaaagtttgtggccattgggccaaaggaatttgtatttcaagtatatcatttggaacatatcatcaggctattaaataaataagttcattctttatatacacgaagctagaaattccctaggaaaaaaaatggtaagatgaagtaagataaaatgattaagaagaaagtatctttctctctctctctctctctctctcgttggcagaatccttgagggtaggattttgtctttgcactggcaaacctgagtagacaccatttaaatcttagaagctctgctttcctattgtccctcccaataggaaaaaaagaagaggtgcttgttttatcattttgcccttagagcaggatattaggtcctttaaagagtgtgtgacttagacatggcatctgaaatatagtaagcattcaataaacatttgttgaaataattttagcaaagatctatgagttccctttttaggctgttatttaaatgcatatttcaatattaaaatagacatttttctttttttcttttaggttctgaacctctttctggccttattgttgagttcatttagctcagacaaccttgctgctactgatgatgacaatgaaatgaataatctgcagattgcagtaggaagaatgcaaaagggaattgattatgtgaaaaataagatgcgggagtgtttccaaaaagccttttttagaaagccaaaagttatagaaatccatgaaggcaataagatagacagctgcatgtccaataatactggaattgaaataagcaaagagcttaattatcttagagatgggaatggaaccaccagtggtgtaggtactggaagcagtgttgaaaaatacgtaatcgatgaaaatgattatatgtcattcataaacaaccccagcctcaccgtcacagtgccaattgctgttggagagtctgactttgaaaacttaaatactgaagagttcagcagtgagtcagaactagaagaaagcaaagaggtaagaatgcttttaaattttttgttccatttcctatgataaccatgtactacagttatttactattttcattgtgcttatatgcattatcaaaaagcaatattgaaagtcatatgtctatagtgatgttggaaaatcacaagatactctttattgggaaatggatttctaaaaattccaatttttcacaggaaattaaaccattctgagtctttagtatattcattttcttgatcatttgaaaatgtggttaaaaaatgtggccttttaggctgggcatggtggctcatgcctgtaatcccagcactttgggaggccaaggaggcagatcacttgagcccaggagttcgaggccagcctgggcaagatggcaaaatctcctctctacaaaaaaaaatacgaaaattcactgggcatggtggcacatgcctgtagtcccagctacaaaggaggctgaggtgggaggattgcttaagcccagtaggtagaggctgcagtgagccacgatcacatcattctactcaaccctgagtgacaaagcaagaccctatctcaaaaaaaagtagccttccaaaaaagagatgttatttagtacattacactctcaactacattatgttctttaaaaaataacttattttcgtcatctccttactctctatattaggttttgctatgatttttatgtgaaaactttatgtacttttgttaacctctgaaagtcttattcactatgatagtgtttcatttatgaaagtgttatacacattaggaaagtacaagtagtacttattatattttgcccagtcaaggatgagcagatctatagtcttccagagtaacttgaaaatactaagaactacttttaaaagcttcacttgagggctatagttattttgtaggttaataaacctactcttactgttgtgttactaggaaagagaaaaaagaaggaaggaagggagggagggaggaagggagggaaaggagaagagggaggaaggacggaaggaatgaaggaaggaaggaacgaagggagggagggagggagggaggaaggaaggggaaagaaagggaaagagaaagaaagaaggaaataaagaaaaaagggaaagagaaaaaaagaaggaaagaaagaaagaaaagaaggaagaaataaagaaagagaaagaaaagaaaaagagaaagaaaggaaggaagggaagaaagaaagaagaaagggaaggagggaaggaaagaaggaaggaagcaaggaaggaaggaaattgttcctactgcatgattagtattcttaagtttctatcatagtagtaatgttattaattcttcaatcctgtgttgtggaaaagaggattaaaattctttactattatttatttatagacgtttaatacatatgagtacaaagtaagtctagcacagatggagttatcaaagacaggttttggcttgagggtataatgttgacacagtgggaaccaaaccaacaatgtctgatttcgtgagcatattttggaactcttttttttaaataagtgtatcaacaaaacttgatctgaaatccctataataggtagctgacaatcttacaactcatagcttcctgactattttcaggtattttagagttgctgaaagatagtataataataagttggaaaatattttgaaaaaggtaaaatacatacaaaattaagtagtgatattttttctctgaattccatttaaagtctgctaagtgagttcaactctaatttatgttgctcattctgacaaactaagaattcaactctaattttatttcccatcacctggcatgaatttatgtaagaagaaataccagtcaattaacaagaacttactgagcactttttgtgaattcagcaatctgctggatactaggggtgaaggagagctctataacaaaactctccttcaaggaaatcttgacatatttgagtaagctaacatgaactcatgaaattattaaagacctattaaaaactttaatcctggctgggtgcggtagctcacgtctgtaatcccagcactttgggaggccgaggcgagtggatcacgaggtcaggagatcgagaccatcctagctagtacggtgaaaccctgtctctactaaaaaataaataaataaatacaaaaaaattcgctgggtgcggtggcgggcacctgtagtcccagctactcgggaggctgaggcgggagaatggtgtgaacccggtaggcggagcttgcagtgagcggagattgcgccactgcactccagcctgagcaacagagcaagactccatctcaaaaaaaaaaaaagtttaatcctgtcaggttgcatgtgaggctataggtattgaggagagcaagaataattgctaaatggaagagataaaattgaaatagacctcaaagtttgggtcaaatatacattatcagaaagcaaaatgctgaagcttactaaaggaaaggtggagctgacagtgagcttggtattaaagacagtttagggttatcattgcagattatcatgcagtgataatctacatgaggtaagtgttggttgaatatatagtggaaaatatgtttgaatgtgtgaggtagtttcagattataaagttttaaagtaagccaaagagtttggagttaatagggagctattttctgttctgaagcaggggaaggcaattggaaagtggtattttaagaacatttatttgatatcaaagagtaaaacagtttagagtgaaagataagaaaggttatcttggggaatatggtgataatcattcggtagcaatgaggtgataaaattctcagctagggcaataagtaatgagaattgagactcattggcaacttgacaaacctactaaagaacctgggaaaatggaaaaacagcaatgccactttctgaaatggtctttaaaaagggctacccagtttatgttggaaaaggagttcaattgggatatactgaattagaagtgtcagtgttgggaaacagagtctgagttagaggtcagggtttaaaaataaggtataatgtttgataatgcagattttataattacctgattccctgaaaatggaggagctcatcaaataagtaattataaagtgaaagaaaaaagagaaaactagagacaaagtagcataaaaacttagggtcaaaagaggtagaaaagctaaaagatagaaaaactttttctagattaatacgatagaattttttgacatcagatttatggaaagtaaatatcttaatttcctcctaccgaacagttggtttccaaagtatttttaaaatttcataatgaccaccgatatttcaaatgactgctaattatcatgcctttttaatggcttaaacataataaatttagagtaacaagatataaatctctcctttgttatgtacctggaaaacatttcttacctgaacaaaaatgtcttatggggtgatttaaataactactttatcctcctctttcaagctaaattttgaatacatagatttcaattacaaaatgtaaagaaattatttaaaatatataaatatgttagtgggaaaatcactaaacaaatataaaggtatatatttttataaagctagaataaaatttcaaattatcttgcacagtaatattaaattcaacaataaattttatatgaatgatttggtaaaatgaatactttaaaaacccaccaaaaaagtaatagggaactctcatatatgctcacacacaagataaaatgcagacagtttttaaaataaaaagccaataccagcatgttctaatatcatagagcagattaaatgagttctagcaaagtgcatttttgatttgaaatttccaaaagctgctagcatacttcaggtgcacacttatattggctgggttattcccttttaatagctatcacacacacgaacacatttaaaataacatatccataaagtgacattttggttcatgtttcttaggtttttgacacaagtagcaagagaacattgaactctactttgcagagcacagaatatccttcctctttgctaataaagtgagcactcacataagttaaacccaccagagttatacatttttcactaaaaaacttgcatgaaatgtctgcttgaagaggagacagtaaattaatcattaatttagatggtatttggaaactctagttactgtatttcctctgttcattttcataataaaggatacctgactatcgcagctaaagagaaatgatccctagaagtttttagagataaacatgggaattgctgttatatatgttatatatgtgtgtatatatattacatctgtatatatgaataccactaacataaataggctggtatggaagcaaatataaacttttgcatgaaaaaagttcaggaaattgaaggcatggatttcaaaatagtgatttttttaatcttgcaaaaacttggaattatgcgaatctttttgaggagctctaatgtagaatttgtttgtttttatattttttaagttctcataatcataatttcttgaaatacttatataactatgaatttttgcaatttaattcttaaaagattattggtttgtcttcctaagtgaaggatatagaataaatgcttttaacaatcatatttgaagttgaattccaaacacaatctagcaatatcatactgtgaccttcactgcttaccattcttacttctcacaggagtaaaatcaagctggagccatcaagaatgcagctctggtgttttttaaccagccagaggctcgtgccaccacttttacccaggttatccaagcaagttgtacatgtacaatcacgttctaaatgaattttgactggcctgcatgctactcagctatgttccttcccctgccatggcaaggaagtgctagacttgcccagctgctctctgctgaatcgtgtgacacatcacagcatggtcaggcgagatgggcaatcccaacatcatatttaattctgctaatgagttttctaatttagtctttagccttttaaaaccaattgcatgctctataggatttgtaatatctattttaaaacatgataggaatgtttatggttcaatatagtcagggatgtaggagggcatgcatttttttgtttctctgcttttatttcattaaaataagaccacaactttttattgttgattcagcctttataagtaaattgtattaccaaaataagcctcacagggtttttttctgatagtactgccactttcagatcattatattcagatctatgaatataattttcagcctatccaattcatgtgctccagatgaaaatgtttgctttcatgttttgggggaaaggttctgtaaaaaaaaaaaaaaagaaaaaaaagaaagaaagaaaaaagaaaaaaaaaagaatagggtgatcctgaggtttggagatgaagggccatagtctgtatgcatttgggcaacacatatcttggattttcatgtaggttgggaaaagttatgtctgcaaaaccatagtgatcattgtaacttaaaaaaggaaacatcatgatatatgggatgaaaattcattatatcttgatcattaagtaattggcctagtgtacccatttgttatttgaaatgtcaatgatttatgttaatttctccctaaatgttctatccaaaactgaccaggcaaaaaagagacttggaaaatttactattttcagttattaattattaattttagttttgtgaggagtaaagggaatctcccaagattattgtagatttgtggcgtaatgagcttttattttattctgttcactcaactttctccattgcttactggaatctcagccagagtgcgggttctgggagggaaattttgaaggaaatgtaaagagttcataaatattgggcagttttcaaggcttctggtgacaaggaatatctaattagtttggggttgtctctaggtttaatttatgcatagtcttattttccttagggataactgagaattagttgcagaatgcaaaaaaaatgagaaataaaattatcaatggaaaatagtaacaaagatacagtccatggtgatttatgcaatttttattcagcaccaaatttttagatttagaataaaacaacattattagtcattgaagaaaatctgatttctttttcttttttcttcaccagcagaatagaattaaatggtactgccatattattatttacactgtgtttataacaggattccctccttttcagagtctttatggaaactttgaaagtagatgtttgactaaggtccggagcacatgcccttctggacatgactttgtgctatttttggaatttggaaagcaatggaataatgactctagctttcagtttctctgttacatggccagtgtcttccaaatgctctttgtgaaattgaatgtgagataatttttgagaggagcagatgggtgtgtgaatagccattttaaacccatctcaacctttaaagatggtcttggtgctttagtgtacttctgctgaaaaaaaaaaaaattaaagctggttcagacgaatacttttgtatcctttctgaaaacaaatggcctttttctttttcctttttgatgctcttttaccctactcttcaactacaacgtaattattttcagtttcacataccatgttcttattcaggctattttaaaaataaaagaagctccggggatgttgtacatttaatatatgtccaggcaaaccagatggtggtggttcatatttttaatctttcgataagtgatcgtgaaaaaaaaaaaaaaaagagctactggccttttccttcccgcctaggacaagcaacccaatggcttcactgtgtggctgtcttgtttttcaggtgaaatatcataagtcaagatatggttatgcatatccaaaagatcagactaaggccctgatagtgtgtatgaccaaaactttcctcttctactagcaagacaaaaatccacaactttttagagaaatggctagattttaaaggcaatctgtaatggctgaatcttttattttgcctcttgaatcatacagcagtttgtgagagtcaaatatttgatagctgattgaaaataaatgaaatgtgagcgcatttcagtggaagtaggccagttgctaacattctcttctatctctgaaagttaaatttcattatttaattggataaaaatcaagagcaatatttgtcatatgggggaatttctatataaggtcactctattgggcggcggggaatggtctcgtggccttttttgggtgttaactctattgtttcttatgttgaaataacccattcctgtgagtggtatttgtagttaaccttcttgaaaacttcatattcaggtaccatgtctttgaggacatggttcttggatcagcgtgcggcttccacagcattgcgccgggcttctgctacagccaggcatgttttctgcggctgaattaggcctggagaatgttgcatcttaaaacctgcttttcagcgtgcatttgtagagcataagccatcatccctctgtagacccactcgtttctacaagggatggaaaaatttaacctttaagtgccataaaatattggaggagtagggagaaaatagtacaagaaaacaagtttgaacttgtactatgtggttttatatggaagctttctattattatgcctatattcccaattatatttttctaactacttcaggacaagtatgaatttagttatttagtatagtcatctagtttcttaatatggtaaatttaatttcaggtttctttgcttttttatatcattgtagtatcacagctatggcaatataaagaaagtaagttattctttatatttattggtcacttgcttttaaatcagttatatgcttttaaataaatttgaaggtcattttggttatggctataataagatgtatcacaaaccacccttgactagaatgtgaatgccaaagtgttgaacttatttagaaaatgtttagattatttagattatatcagtgtatagaattatgcatatagtatagatatgtatcatataaatgtatacaatttaaaatgcttatatagtttttcagggtgtacattagtgatttaaaaaatacagcagtaaagttctttatgtatccagtgactaaagcatatcaggtagtagatcataattcgtaagctgatgtaatttaataagaaggtgattcacaatttaatttataaatgtaggtaaatgcataactttagaaatttgatacaatattttcataacttcatacaattaaaacataggtactttcctatgataaatatgtgacctagggcattaaaaaataatgtagtagcatttctgactaagaagattaaattggccagatgcagtggctcatgcctataatcccaacactttgggaggccaaggtggatgaatcacttgagcccaggagtttgagaccagcctgggcaatatggcaaaaccctatctctacaaaaaatttaaaaatcatccaggtgggccaggcacggtggctcacgcctgtaatcccagcactttgggaggccgaggcaggctgatcacgaagtcaggagatcaagaccatcctggctaacatggtgaaaccccgtctctactaaaaatacaaaaaattagccaatcatggtggcgggcgcctgtagtcccagctactagagaggctgaggcaggagaattgtgtgaacccaggaagcggagcttgcagtgagccgagactgcgccactgcactccagcctgggtgacagagcgagactccgtctcaaaaaaataaataaataaatataaaagttagccaggcacggtggcatgcacctacagccccagctacttgggaggctgagatgggagaatcagttgcgtctgggatgttgaggatacagtgagccatgatcatgccacagcactccagtctgggccacagaatgagaccctgtcccaagggggaaaaaaaaaagattaaatcatgactgaggcagattcttcaacttgggaaaactgactttatgtcaaccttcatagataaggaagcctcccataaaacactttttagtgaaatgcaaactaatctaccgtcttctaagctttggttcataagagtcctgggagcttgcaaaagctttgccaagattccctctgagcattccttgaggggctttctagagcctggaagattatctttataatcagaaaatctctgtaataactgtaaagcaattctccatgaaatgggttctactccttggacaatagcagaatggtggcagggttttttccttgtccattgtcaaaagatatgttgtgcctcataatgccaggaggagagaggtgaactgtgatcactgtccctctctatcttaagatgtataaatacataacctccagagctattagagattatttatgtccaaacaagttaatcacattcacaaatatatgtaatctaatgaccttcccaataacaaaaaaatacaaccagaggtccatatgtgtaaacgattgattccgttgtcattcaggttagtggttattaggacttgtgctgtaaaggatttgctttaaatatgtatgtatttgtattaaacataagacacctgcagaatacatggaagaattataatgtgaaaaattaaacatctcacaattatattagcagtggtaacatgggaagtgaagggtgagtatattttctaaagttttcaaatggaaaagtacctgtgtgtgtatacatgtataattacttttttattattaacatattattttttattaaatcattcctatttaataagacaatgcattttctaatataattacatagactctttcaggaccagacttgacttatatatcaaaatggagagatagaattatctaaagactataattctctctataaagtgacattaaaaggtattcaaacattcatcgattcactcttcatgaactcaacttaactattcagtgtctattctatacttggtgatacactggatcttttggtatatatatgtgtctatatgtatgtagttggtatacgtgtgtgtatatatagatgtatgtaaatatgtacatatatttatgagaatatttagtcaaaggaaacaagtataatagattaaatgctctataaaatttagcatgaagaaaatcatgcaagaaagaatggcttcatacaggaagttgaggtttactatgataaggctcagaagttattaagtttggattagccaagaggacaaaaaagcatgaaactttctataactaacctcaaatactttggtttcttattgttattacttataaagtggatattaatagctgtcactcatcaaaagccatagtaattaacccataaactaccagtgaaattggaagaaaaagtggctgagaccaaacaattatccagtattttcttagttacaccagaagctgctacaattctacccagcagtaattttcctaggtctttcttaaatgaataaaaatatcctggctataagaagcagaaaaatcctaggagaggagaagatgtcttggctttcccacctctccataatgtagaggaaattaatggtaaaaaaaaaaaaaaaaaaaaaaattgtgctatcatgaccctaagaactatcagccaaaagtgatggcctagcttctctatttaccatactccaacctaggaggtactctactaaaaaactgtattttgacttaaagtaattttcataatatatatatttggacatggctaatgtcaggttaatatcaactttaaagtaacaccacagaaagtatcatctggatactaccctttaattagttcacattgtaaaatattaaactacatttgcattacgtcttcattaaatcaggaattttgagccaaatttccccaacatgaactgtgtttatggcctttttaaaaataacacagtaactctttcagaaggctttggcagagtgaccctaacactcagctaccaaagttaatgggggctttgaaatcattaacatgtccatgcactattgtttcatcttaaaagctttacattatctaggttgtgctgtgcgtcatgtctttgcaactgttttcataaaactttgcacaatcctgtcttcccaagtgatctcagagtacttattatttattcttgtaatattacagtggctcttctagccatgtggcatgtcacaatgatttagttaaaggaagtattcacagccggatcacacattgaattcagaatgtgctcctaatgaaagtctatagagattctggacaatgccatttatgaggaaatttccatttcatttagaattctttgacaagtattgaattcagttatgcagttcaaaaaaagagagagatccatcatttttcttctagtaaaataagaagaaaattatgtaagccagagaaaaatagagctcaaagttgaaatatgactgtgactaatgttaatgtgctgctctttctttctaaaattatagaaacatggacaatacttagaaacaactggtaatattctttgccctttgaaaatttccatctgaagaggtggaaattaaaaatttgatttgatgtattttaattaacataatcatggctagatgtcagcataccactttatccaactattcttggtttggcctcaatgtattaagttatattcatatggcattcatatacaaatgcagatcattaaacaagttaatcagtataatccatccattccagaccacccacattgaatgttgtctaaactttttttgtctgattcaggtcagtagtcacgttattttgaatagtacaacttgatttatgttaaattattagtacataatgatcagtaatgctaatagagttaaatgctatcactactatttttttttcacacaatgacacagtatttcccagttagttaaataaaagggggaaaatcacatctttgaaatgggattttgtttccagaaattaaatgcaaccagctcatctgaaggaagcacagttgatgttgttctaccccgagaaggtgaacaagctgaaactgaacccgaagaagaccttaaaccggaagcttgttttactgaaggtaaacaagctctgatgtgattaaatacaatctccccttgttctttacggagactgaatatgcctcatttaaaaaaaaaaatttatgaaacgaggtgtggtggcttatgcctgtaaccccaaaattttgggaggctacggtaggaggattgcttgaccccaggagtttgagaccaccctgggaaatgtagtaaggctttgcctctacaaaaaaaaaaataaagaaagaaaaaataaattagctcaacatggtggtacatgcctgtagtcgctgctacctcagccacagctgtatcttagagcttttgcagggagtcgaggctacagtgagccatgattatgccactgcacttcagcctgggcaatagagcaagaccctgtctcaaaataaatacataaattaaattaaataagaaaaatatttaaaataaatagtgaaggcatgtttatctttattttccttttttgtcttttaaaaagttaatctctctagatttctggattatacttatggcagtgactattcctggacagttaaaatgatctgataggtctttttgttttctcattctccataatgtgaggaagctgaccctatgagataaatggcattctagaatgtcatgtcattgatattgtaatcccttcagaactccttggcaatggtgtgatttgatttatagatgctacagtaattacattccctcccttacagttccaatgtggttaatgtgctttggctagagctgttttgagatgtaactgtattgtgaagctttggcagggaaagcaatagctgttctcacagaaagcagcacaatgtcttgaacacaaatcaatgaatatctattattcaatgtgactggacttaatcagatgagtagtagctcagagacttacagcagaagagtggatgggagttagaaataatgcgaaagctaggagggggaggacaaagggaaagagatactgactgacgagctgagtcataggtgtgactaagagaagcactgaggctgaaaaataaattagcttcggaaaattgacagtggctgatgcctgggaagacagcgagattttctgtgcatgtgtgcatgaaaagaattaaaaacccaggatcacatcaaaatatgaataaacaaatcgaacatgtagtttttgcctcaaacctgagagatgcacctggactattttcatcaatggccttgaggcaaaataatcctgactggtggtgaagaatgaaaccattgttacttaagcaaatctagataaaatatttccttgaattctaagtagctggctgagtatataagtctgagaataattcattatacaggagggatgctgacgataactaggaaatgaaggagatggttaccctatgaaatgattacctggaagtggagtggggaaggggcaagaaagtttattttttcctatttaagattaaaatatattttttaattaactatatttgatttttaggatgtattaaaaagtttccattctgtcaagtaagtacagaagaaggcaaagggaagatctggtggaatcttcgaaaaacctgctacagtattgttgagcacaactggtttgagactttcattgtgttcatgatccttctcagtagtggtgcattggtaagtgaaatgcatattggcaagaatcagattctggtgaaatagtttattctccaaaattaccagatgcaaacactgagcttcagaatcaaaagaaaaggcatatctgtgtcttgcagagcttggcacccaaggtttaacgatgcaaaattcagttctgaacaaatcagcaccatgaaacagccagatggaatttctcatctggtgtttatctaacagatgttttcctcactgagacaaccatttgcagagacattctgtaaccacgttactttccctgtcaaatactatccagttctccctaataattgtattaacatttatggactaaaagtgtattttaggtttttttttcatgtataatcaacttattctctcaaaataagccagatcattcaggaaattgtagaaagtaatgtttgaataggccaattctgtccctcattaacagaacttctagttatttctgagttcatattacttcattaaaagcatgtctttgtaacagtaattgagatagagacttaggggtgagaagtaggaaagaaagcacattctaaatcactaaaggcatgacgtttccctgccagcattttcacacttagtttagtctttagattttgtctgatgttcaatgtttatgtaaaatatcaataatcaaattattgttttgtactcactattatactaagcaattttttcaaatatttagaagaagcaagccatttaagtaaaataaaatatttttgattcataggcctttgaagatatatacattgaacagcgaaagactatcaaaaccatgctagaatatgctgacaaagtctttacctatatattcattctggaaatgcttctcaaatgggttgcttatggatttcaaacatatttcactaatgcctggtgctggctagatttcttgatcgttgatgtaagtattttaagtgatttttataaaattgtttttaaaagaggcaagtttgacatttcatatgtttctgttattaaaactttcactaataatgacataattatgcagttatttaaacaaaactgtaacatatgcaacaatgaggaatatctcatgggaaagagtagaggaggtcctaaaaacatgggcagtggtaagagcaaacacagggagaattgttctttaccatagatagacagcttttatttttctgaaagttaagtgcctcaaggtaagtaatagataagtaatatgttaattgacagatgtaagcacttagcttattaacagttcagtttaaaaaaacaaacaaacatctccaagaagcaaaataaaaaatgactgaaggtcagaaagtgtgtaaactgcactttaatcccttcctagagtacgtgtgactaaatactgtgaaattaacccatgtactgacttcattcagccacagccacatacccacagacacaacaaaatgcatttccatttttaaatcagtagttagatcccaatagctaatcaggtatttaccatgcaaagagttaggtgtaggtctgttctgaatctgattaccctggggtgagtagtcataggaacattgccaattatggaatctatctgacgtgcagcctgtttttttattgcaagtgacggagaggcactgggacaacatgacagtcctctgattccttgtagtctgtgatattccgttgcacaaggcttcacagcctcctaacaaaacaaggtgcttcaaatactatctctagccatttcctagcaatcacaaagctccttatttttagctctaacacttgtcaatatgaatcaatgattgccatatgtgtgcctcgttctttttctcatttttgacgagtctgggtctatccagattctactcttcttcctcccacaaacacatattcacaattatataaccaaaatgtgtttaaccctttaagttgataagaaatctgctgtcaagtcacttttaatagaccagaaatgactttcaatttccttggctggcctttcattaataatagagatgaatttcaacataactctgaaaagctatgcacaaatggaaacttagtattttcacattccgcagctagagtggaccttaaggaatatctagggtttattcaagacatgagaaaactaaagcctcagtttaaatattttttggagataacacagcttcttaataataaagttgatacgtgtccaaatttactaattctcaattcagtgctcctttccctcatagattttctgcctaactgatccattataaatatattagttgtaataggtaaatgtgtgtgtgtgtgtgtgtgtgtgtgtgtgtgtgtgtgtgtgtgtgtatcagactggcatcagactggctttgagatttagcatttaaaatctccaccttctctgtcaaagatggaacactaaatacattcaatgatcctttctggttcaaaaagatttttatcatgtatgaagattatgatctttttttatttttgagacggagtttcgctcttcttgcctaggctggagtgcaatggtgcgatcttggctcactgcaacctccgtctctggggttcaagtgattctcctgcctcagcctctcgagtagctgggattacaggtgcccgcaccatgcctggctaattttttgtatttttagtagagacagggttttgccatgttggccaggctggtctcaaactcctgacctcaggtgatccacccaccttggcctcccaaagtgctgggattacaggcatgagccaccgtgcccagcaaggttattttaaaatgtgatagaagttttctagaaaattctgacttacagttactgaactactgcattgtacttcgagtatttctatgtactccccttatatagaaaacatgattatcatgtaaaaatctcttgaggttggaggttttccatcatgtttttatccttgtacacctaacacagacatttagacatctattgagtaatgtttcaatgaatgacaaacgaatggtgccccaaaattactttgcttttagtgagtcaaaattagcagattggaactgggtactgaaagcctcctcctttgggcaagttactgtatcttaaatgggtctattttcttaattttcccaaagcaggggttaaatacatgaattaatgcaacctcagataacagcttgtcctcagagtactggggattcactaagctaaagtaaatataaggttaaaacagtgtttgaaagtacaaataaaatggacttaaagagtttaaagttcatagggtatatcactgtaacaaaattaaagtcacagaaaggtaaagaaaggaagcaatcaatgaagcaagaaaataaacagaacaccaaataaacttcctttcaaatgtatctttcgaaaactacattcacatacttgagaaataggtctgtgtaaaaaatgtaacctcttcaattctctgtctaaaagtaaaattagatttatagtgacatatctttgtaatttcctaaaattcattcatttattcaataaatatttttgagtaccttataaaggatcatatgccattcaagacaaaggagaaatgaacaaaacagacctagccttgttaagcttacactctattggaggagaggaacagacaggaaacgtgtaaacaagtaaaatctaaagataagataaaggcagatcactgctatgaaataaaacagagtactaggctggtaaattactgcgtgtttggggaagcggagggagggcaggagcagtgtgtcagctagtgtccaggagggtgtctaagggagtgcatgggggagggtgccagtcatttgaagacctgggagaagagaggagaagaagcagaagcgcttgaagtgggaatgagccaaggagataaaagagatagaaagaaactggcgtacttgtatgtgatgaaacatgagtgagagtggtagaaaccgaactcaaaaagtacacagtggccatggcaagaagttcgtattttattgtaatttactatacatcatatatgttaacattatgtaatctatcatatattagttataatgaccatgagaagccccagcagcaggataagcagggatctgacctactgttacaaaatgatcatatctggctatggagagggggaggcaaagagtaaaagcagaaagatcaattaggaggttgttttaataatgcaagaaagtggagattttagaccaaggtgatgagacttactgataggcttgatatgtggagtgaagaaaagagaggattcaacaaatggattttctttcaccgtgaacaaatgggtagaggatagaaccattaactgggatggggaatatcagaaaaagatttggcagggtaggtagatgatgggtgggagagagatgtattcatttgatatatattcatttgagatgtttattagacattcaaaacaaggtactgaactttatatagatctagagctcaggagagaatccagaatcttatgtatataaatttaaggttcatcgagatgtatatggcatttgaagctacaaacctgttttagctcacctaggcagagactgcaaataaacaaggcaacccagaaccaaactctggggacactataacatttagaagttgggcaaaggagaaccagccagtaaattagactgagaagtagtaattaaaaggaaaacaaaatatgcatggtgtcatagaaacccagagaagatagttgggtttttccaaaggagaggtgatcaattttatcaaaggctacagtgaaaaaaagtcaaaaatcaagcaatattggtatataaaattgacatttggatttggcaaaatgaaggtcattggtgttgtggatgacagaaaataatgaagatgaagaaatggagacagcaagtatgatacttcaggatggaatcaagggcaacttaactcatgcctctgccttccagaatactgcactagaaggagcactttttcagattctgtacaattcttttcttctcaggtgaaggtcaaaaagatactatgttcattttaaaaaacaaaatataccttactataccatcctataactacacaaactatactatagatgctgctattgaccacacaatgaagtaaatacataatttaattaatatttatttaaaacgtattgaaaacatcagatttcttgaggtccttatcaatttttgcagtcatctctgagaaaatgcatctgagcatctctcataaaaacttcgtttgattctaaaacatcctaacatgctaatgtgtgaaaaacaaactctagtaaaagattcaaccatcatgaagtatttattgctcacaggtaattttcactaacagcacaggttaaaaggagatgcttgatattatggctttggaatgcttttcctgcttaatcacatgctccttagaatcccataagctgctctgttgaggtgaacaaaaccaccatagggacactttctgatcctaatatgtatttccatttgccagcaacccctaggatctagtatttcctgccttagttcttgacatttattattgacatattggcaacctcaataatggagctagattgttattagtagtaatagtagtagaaagatattatgcctagtactttgtaagcacttattgtgggaatggcactaattaagagccttacataataatagtgaaaattactaccctgatttaatgcacactgtgtacaggtgccaccaaaagcacttcacatgtgttaactcatctaatcttcaaaattctatgagttagaaacaactattctcaatttgcaggtagggaagctaagacaaagagaggttaagttactttcccatgttaacggaactaataagtggccaagctggatttggtacccaagttgtctggctctaatgactgtgtttctaacccctacattacaaacctcattataaatgtctcttttacttacaaagtatttattaatctttttaacaagcttttgattttttgtattattatttctattttgctacagatgttatctctatttcacaggtttagaaatgtcatacagctagtaggtggtagagctacctttacccaacactgggttctttgatccatattttacaatagggcacagatctatttggcatattgtgctgaactagtcaaagagttcccacatgacaccgaaggtgattgcgtataagtggtggtgaatgaaagcaatgagatggtgccttgctaatatgcagacacctgccttgaattttatctagcacccttgtgcagagaattagaataaattaaaagagctttggggtaaaggaactaaataattataaattattgtcatttcatattaatttctgatctctctctctagatatatttccgtgtaaacagtctagtatgtgatttgactttttctataaatgtcttctgatagaaatgattcattttgtccatttcttggaagaatttaattctcctttagcattattaattaattaataagaaaaatttctcacaggcaaggtttaaaaagataatcctactaatgtagctataaatttctatagcccattctttgaaagagtatggcttttaatagagacttttaatctctaattctggtcttttgttaaactccaacccatacttctaactgcttcctagataatacatgttaatacacctgttatctgcacatgttcatcatgtttcccctctaagtcatgcatttcttccaaattccctacttagtctgatggtaatgtttgtataaatccaggccagatgtcatcttcagcctttctgcctttcacccctcacaaccaatcaatcagcaagttcttctccattttattgactaataaatgagtggacagtctcgcccctcctcttcagcacatcaacaccactgcaatcaactggaccaagcaatagcttactaaatgttcctgcctccagtcacaacctctgcaaataaatgttttcggaagacctacatcactctttttcttcttaaaggcctccccgtgggatgcaattcatcagccagcattctaaatggtgacagtaaaggcaaacaagcgttatcatttgtaatactaataacaaccaaccttaactgagctataaattgtcctttgtcttcaatgcttaatttgtttaatcttcacaacaacttatgcagcatctactgttactttcctagtgtgtagatgggaaaattgaggcacagagtagttatctagttaagtaacatataacatacattcattatgtaaaatgtcaaaaacaattcatatctttccaaaaagaaataattacacctgaagatacagtcataattacacacttcataaacagaagtaattatgctcacaatgaatcaaaattgcactttaaaattttttctaggagtgtgcttgaagatgatgcatctattaacaaagatactttgatttgttctttttcaacataaagaacatatagtgttattttgatttaatcatctttaaattgccaaattaagaattccagacaaagaaataaacttagagagatcacctgattcaaagtcttcattttaaagacccctcccccactgcacatagtgtttggaatgtttaagtgaaattcctgtgaaactcatggcttctctgtaccatattgtagtcaccagtgatgagtgcaccagattttactcatccttttcccagggatgaacgcttagatcgtctgcttcctgctattataaacaataccacaatgaccacggtatttgcttttatatagcatgtgagcattgtgaattttctaatcatgtataaagttaaagaccaataaataaaccataaagataaaagtagaagagaaagcaaagaggcggcccttgagttacaaacttacaaactccccttacataaaaataaattatcctttttttttctttaggagacaaagtctctctctgtcacccaggatggagtgcagtggtgcaatcatagctcgctgtaacctcaaactcctaggctcaagcaaccctcctgcttcagtctcccaaagtgctgggattacatgcatgagccaccactcccagtctggacttccatttctgactgagattgcatagagactgcacttcccacagcctctggaagcctgcgctctattcctgctgtacaccttacccaccccagctggccaaatccctctgtcacaaatatccccaacctcccatcttcactagagctctctgctaccattcccatggcagctttgtacctgcccctcaccactacctgagcccttttctaggaactactcagcagataggaaatagggctcctctgtggtggaagcaggaaggtgtgcagctagcaatctgaaattccgggtgcccttgtcctaagaaatactgagcttaaataccatgtgctatttaagcccctcagtactattaatgggaaaaactcaacttcaggatatactggaagagacatctgtggtgttgcagggaaacccaacaacaatgtagataactgtttagatgttctgatgtctgtagcaagtacagattttactccagaagttgtgaagttgtattttattctgctctctgaagggttggagagcgttgggtgaagggactcaagagtgtctagctttcctgtatacaaaattttaatcagttctgttttcagctccatcaattgcccctctgtttttgagcaaccaaatgcctccagttccagagccttctgatcattttttgaaacaatttgagttgcttttgcaggcacctgggtttctgctgctctttctctgatgagaaagtaattattcctgtgctttccacagtccagaatgttttaaaactcttcttgttgtatcttctcctattatctttgtctgtattcctttgcttttcttctagttgaacttcagtagggggtataaataaatatgttgttcaaacagatatagtaaaagtttagaaagaatctgtgtgttttactatttggttaatgagcttttactggatgagttgtaggagctctttttatattaaggaaatttagtattttgtcacatgtggtatgaatatttttctaatttgagcttttgtctcttgaattcttttgtcatgtataaatttttcatattgatttagtcaaatttatcagaattttttttcttcttggttttctcatgtttatgaagacccatttcaagactattaaaaatattccgggcttttttttttcagttttttagttggagaattttgtttgtttctttgtccattagtttatattttatgtttcaatttttgaccaacctgaaatttaatttggtgtaaggtgtgaggtaaggctctagtattatttttttctatctggcttctcatttaatgaataatcagttgttctatttctcctctcatttaaaattatctccttatccatgtgctaaatctcagtatccacatgctaatttgagctttattttatttcattcattctttgtctgctaatataacagctttaattactgtatatttataatcaatatctggtgaaatttgtcctctctgcttttcttcttcacaaaattttaaattattattatacttttactttttctgaattatatttttaaagtttttgtaattcaaaaagactcctacacaaacttttttaaaagttaagatgaaaaatgtatttatcaaccgcctaaaataattagattattgtttataatagtttttcacttgattctcttatgggattttttaagataacaacaatatatctgcaaacaatgatttctcccacttctctaattcttataactcttctttttccagaaagtgttaaataataatgttgttgatgggcatactcttttattctgattttaatgagaatgcttatggatctcatcatcaaaaattatacaagcttttagattgaaatatatcatcagaatgtatggaggtgatatagagtttttatcttttatttgttcatgttgaactttaaacattgtctttagccattttcaaggaaaaaaaattcctgttgtttggttccttaaccaatcacaggatttccagaatcttctttggaaccatcaactccatcctgcattattcttttctttctcagtctcagctgccataagaatgtggaaaggtgtggatgacaactgaaccaacccctgacacctctatcacagacatttccatttatttactgtgtagtgtgatatggtacctagggtcatataaattcatattaaaaatttagtttttggaaatgggtatctcatactttgcacacattggcaagagtgccttttgtgtttagcacaaaagagataatattaaaacactatgtattgaaaggttggggacaaatttgctaaggtgaaaaacacattagacataaaaacagatgacctaaattctagttatatgtttacctgtggccatctttccttggagtggtcatttcactattctgagacacaaagataatgagtgaaagaggtcactgtgaattgtaaagcaccctaccaatgtagtcattatcttcaaactttatgtatgttgcaaatctttaaaattcttgcaaggagctatctccacttataatagagatttgaaagatctcatttcaaaatagcttttaaaccatattttttcacatcagttaaaccactaaaataaggttttgccttatacaaaatgacattgtagcttaagtcatgcaaaccagaaaaaaatatttatgtatgtgattgatcagattgtgataatcttatcgtaatttgcgtggaaaaatcattttaagttatttgattaaaccaatctgcagtgagtattctcaaagtcctaaaaatattttaaattccctttattttcctatataagtcaaatacgcaacagatcccagcacagatttgtcagaaaatccagtgtcaggtagttttttatgatctctccttgggaacttctagaaattctaggacatatgtagcctagaaatgtggtgctaatttcctctgatcctcacatattgtggctgcaactctggcactatgtcctctgggccatgaggtccattaaaataagtgtagcttcattaagcccagcttctctaacaacacacaattccatgccatgtagggtggttagatgcaggtggtgcctttcaacctttaaactcatgacttcctatctttcctgaacccactgttctggatattaccttactattttctttttttttttaaagagaaaagaggctctcactctatagcccaggctggagtgcaatggtgtgatcatagccactgtaacctggaactcctgggcttaagcaatcatcctgcctaagcctcccaaatagctaaggctacaagtgcgagccaccatccctggctaatcattttttaaatttttttgttgagataaggtctcactctattgcgcaggctggtcttgaactcatggccttaagtgatcctcccacctcagcctcccaaagcactggtattacaggcataggccatcacacccagttttacttttcttttcaaagcataagcttccttacttcaaggtcttgagaaatttgcagccacgtccctttaaaatcccatgtctcaaataaaggattttgttgggaggttgagaaaaatcttcagatagtaactctagaaacataaagaagctgttaattcctcctgaggaaaaggagcatagaacatagaagcctgtgtgttctctaataacctttccaatctttccagtcttctataacagcaaacctaagacagaaatgaatagctcaatcaattatcctgccactaatcaagtttagcagtcaagtcatgtattattctgttcaattcttaaaatgtatgctaaattaaacaatgagaggacagtggcttcatatgttgttaaagcctaggttctggttttggtatcactctttatatcctgtgttcttgggcacattattgatttcatcatatttcacaagattgttgggaggattcacttaaatccattttcaacagccttttttcataggaaattaagccctaatgctcttaagccattgtggatataatgaattaatttctctcttatgaattaaggaaagcactagttatgtaccatctttgaaagaactgagaagatggtcattcaaatcattttcagtgccctatgattcagatgaagaagaaacatttttaatggatgcaaaaggttaagatatgcttttgacgtcagattatttgggttcaaatcgccaattctactcttattagctgtgcatccttttgttgttgtgggtgggggtggcgctctaacttcctcacacataaagaggtgatggtaatggtagctatatctttggatttatacatgaagacatgttattatattgaaagaaaattaaagcaaataaacttcctcccccaaaaaaggacatgtcttctttgatctttcatatatttaagtaaaatttagtataaatacaagttaagtcttatcaaaaaccagaagtgttttggattttggaatattcgttctatgtcagttgagcatctctaatcgaaaaatccaaaatccaaaatgctccaatgggcatttcttttgagtgtcatgttagcattcaaagcgttttagatttcagatttttagattagggatgctcagcctgtatcaggaagctgtaccatctctctgaatgacgaggactatattctaaatcttaagtccagcagtttggataaaaattttccctggaataattatttatccaacatattttggctaaagtatatctgaccagacagcgttagacatgttaagagaacaatgtttcatcccagctgataaaaaaacgtatacgatctggaaagggagataagatatctaatcagtgaacgctattacatggtgaatgcttccagaatgcataactaagatattacataaactcaagagagaaacattatttctaatcaataattttaagcacacatccatgaaggatctggcattgaactcaatcctgaattatcagtggtatatgcacaagttgaaaaggggtccatggtataaaatatctaactggagatattgacacgtgttgataaatatgggcaagtattctggtttcattggttaaaaaaaagcaatagtatgagatgagactggcaatataagatgaccccactatgtggaagatgaaagttgccaaggtatgtccaaattagtatttagtctgcattaaatagataccacaccctataccttcagtcaacagtttatttcttggtgaactaattaatttttttttccttttgtaggtttctttggttagcctggtagccaatgctcttggctactcagaactcggtgccatcaaatcattacggacattaagagctttaagacctctaagagccttatcccggtttgaaggcatgagggtaagaagaatagacactctaattattcatgtcaaaattacatgtaggtaatgatttagatagaaaagggtgccatactcttctgatatttatttcatagaattacagaattagagcaaaaatcttagatatcacaaagcctagccttctgaaactggagtttatttaaacaggctctcagaattttgggaggacagaactgagactagcatccaggtcttcttgtcacagttcaaatatgtttctacaacactcaaaaaccttggactgccagttgtttcttttcattgcttacaccccttgaaatgactactgactactgacattcatccgtggtggggagtttctttctctcaatagtttgattccttcaaaattactggcaatgaatgaaaggtaaaatgggttttgtgtgctttgcttcttgaattaatatcagtaataaaaattattgcataaggaaacaacattgaattttagcctctaacaaattgctaaataacatccaaagtgaagggttaaggtaattaagcatttcaggcaacctccagagttttttggtttttttgtttgtttgtttgtttttagacggagtctcgctctgtcgcccaggctggagtgcagtggtgcgatctcagctcactgcaacttccgcctcccgggttcacgccattctcctgcctcagcctcctgagtagctgggactacaggtgcccgccaccacgcccgctaattttttgtatttttagtagagacggggtttcactgtgttagccaggatggtctcgatcccctgacctcatgatccgcccgcctcggcctcccaaagtgctgggattacgggcatgaaccactgcgcccagcccagagtttgttttatagatctttttttctaattgagcattctgaataaggttcactttttctatagcagttgtattttcctccccagctctcttccttaatatgtatattatgcatctaaacataaaatcacactttattatagataccacccatttgccatgcccctcggtagaattcagcacaaaggccagttttgtttaatctggcttgtgagtgcatgtggatatttaatttagtctaggtgatagggctttcatgttaggatgttaggagatggttggtttggggcaataaaaatatttcaaccttgactttaaagttcacccatcagggagaattaagccactctccagactctccagaatcattgtaatcaaagaaatatttggtttttacattgtaatttcatttccttgctaatgctaaagaaagttagacaagataaaattcataaaaattactatacaatttcaagttcttttcaaaccaaacttttaccattactcataatacttaagctctcatttggttccatgtttcctattaacagttcatttatgaggggagatagcaactgagcaaaatttaaaacttataaattttctctaatctgaaaaatattcaaagtttagaatttttaattcagtcatatagcacaattaatattccagatgcaaattatgataatgtattatgcatttacttgaaaacaggagaacctgtggtggtgtgtaccaaacttgtccaacccgccttattttgttattgttgttgttctatattgttttaggctactaacagcctgaagccatggtttttagtttctatctctagtgataagtggaaaagagggatgaggaagggactttacgggcccagccagaaacagaaactaagaacccagtgaatgcattctctccctggcaagtataatgcatatggcttaacttccaaaagaaacaaaattcaagtagcataggaaatgtttacaattttggatttctggttttgatgtcaatttaagattccttggtattgatttctaaaataatgtttgcagtattttaaaataaaacaatacttttatttaacataaatgattaacagaatggtccaatatgaactagattagacaagaaaaattactgttgactttcataaagatttcaaaatacatcttaatatcttctgaatttaatgagaagtgaatgaattttcctctcatgaaataggtcagcctgggttgatgaagtagcatgtgctccaaagtgaacatttaagagattgtgaagtaataataatgggaacttatccagtactgttacgaccagatataaattccactttttcccctaacttaataaacctttttattgagatttactaacagggggaaaaagggacccagtaaattcctaatcctgttcttcgtagtcataaaaagttaacttgatctgagaatatagatttaaggcatttttaatactttgtttatttgcaaagggtttgtttactggctttttcaaattatcattcattcattaacactcttgaaaattaaaatgtattactgaaagatgattattttttctgttggcatttaatgcatctttctattcttttttccccagcatacaaacattttctgactccatcttactataccaggtttttaatgatttcttttcatactgtagcatattttgctttccttaaaaccttagctctttagttgtgtcattgtttgttttccttcaaatatgtgctagaaaaattagaagaaacaacttgtccacctagatttttatttaactcttttcaagcacatattaatactaaacaaatacattgaaggaatggtttccattcaaaaggtttgtaagctatgttcccctcgctgtctcttctaggtggttgtgaatgctcttgttggagcaattccctctatcatgaatgtgctgttggtctgtctcatcttctggttgatctttagcatcatgggtgtgaatttgtttgctggcaagttctaccactgtgttaacatgacaacgggtaacatgtttgacattagtgatgttaacaatttgagtgactgtcaggctcttggcaagcaagctcggtggaaaaacgtgaaagtaaactttgataatgttggcgctggctatcttgcactgcttcaagtggtaagtggctactgtacgagttttgaaaaagttttcaagatgtttcaaggaagattatttccctgatgttcttcgtttgaatgactaacatttgacagcatgaaaaaaagttaatgataacacctataatatcagcttgaattgatcataaaaaagatgttacaattattttataatgtattttccttagtgttaagcttttagtatgttttaatgtgattttatatttctgctttcttttttgttatatttttgggtactggtatcatttttagttttctgtatcaattattgccaaaggagcaactttaggtactaaaataacaatgcatatttgtagtgatgaattaaatgtataaattattagccagataatttattataacaatgtctaagaaatatgattctactatgtgtcaaaatgcaaatcatagagcttacactttaacatataagggaattgggactgagatggcagtttcatgaataaagtctttcactaaattttagtgtaggaagaaaatagaatactttcaagaaaaaaaaggaaacaagttccagactttaaatacaaatgtttttctatttcaattttatttcaatctcttgatatgaaatttcacaatattgtacaaaaagttatttgttataatactgtcagattttcatctggttaaatgtcattgttaggtgaaatttttatgaacaattcaaatatatgttatttacaggccacatttaaaggctggatggatattatgtatgcagctgttgattcacgagatgtaagtatcactcaaatattatttataggttctagatttcttatggtgaatattggtggtaatttaaacactgatacatccaaaattctatattagaacatttaatattgcatataaaaaatgaacagtctgcttcaatatagatgatgcttgattaatgtgtgcctaatatacaatatgtagctaatatgaaacgatatctagctgcatggatcctaagacattagattggtccagtaaatgagactattctgagtggaaaagttgttcagtggggaagtaacttgtctctccctatccctggagagtatgataaaccagactctgtgaagcagcttccaagaatatcatgatacagaaaagcaagcaagtttcagggacactcaatttagaaaataaaaataaaaataactccacagaatatatctgtgctgaattttcctcttagaagttgatgttctgctcttaaagccgtatttccaaaattcagcatttccaaaaccaaacagaaaatactgcaaaaaattatgactaataataggctcaaaatgttttccctgcttatatcaccgtatttatgttaaagaatatgttaaatgtaaggcacaatgggaaaagagaatcaagaacaatcataaaacttgcaaaccttcattttactagatcatactagttttaaaaaattgtttttgtagaacaatatctcagggtaaggcaaaagtagcactgtattaagtaacagcactcaataaattactgatttagtgtaagtatttatagtatttttcatattatttaatattttcaatatcatttaggttaaacttcagcctgtatatgaagaaaatctgtacatgtatttatactttgtcatctttatcatctttgggtcattcttcactctgaatctattcattggtgtcatcatagataacttcaaccagcagaaaaagaagataagtattctttagcttttacctttcttcattctggggttctgtctgttaatacagccaaataaccagaatacctgtggtcatgacagacttaaatcatgtttatattattttcagttgcccatgtggttatttaagctgcagggattccagcctctagtcagtggctcctctcaaagtttatctattggatagctttctgacccaaaaatgtgtccactccttcggacccatccaacgggtctccagtgctttagcttggcttacagagcctttcaggaattacctccacccagttttccatcttcattttttcctacacttcactctatacatgtgtatttccctactacatagtcaccacccatacatctatatgagctttctgcccttttctgaacaagcattctcttgtacctccatggctttttgtgatttttttttatcctggaatgttcctagaaaacccataatcatcttttaaggcctagcttaagggtaagctatgtaacagcttgtctctgagtctctgaattcattgttgcctctgcagtacatttaatttttttgtcatatcaacatacactgtccacctacgttttcagtttcctgctccatttagaagcagaatactgtatcttatatatttatgtaattctgacacccagcacattgtctagcacacagaaagtgttaaaaactgttgaatgaagaagtaaaattatcggcagtgaaatggactaagaaaatgttttctgttttgcaaaaatatatttgagacccttgtgcctacttttaaacatagtataatcaaattaggatcctgtagcgatcagagttttatgtacgtaaggattttgcataatattaagatattcagaatttcacataaatgggaaaagcaggataaatgtatatgtaggaggataatatccacttaaaaattagaaaagattaaaggaaagacaaatattttttgtgaaagtactattggaacacagaattgtaaccagttttatactatgtctttactttggaggtcaagacatctttatgacagaggaacagaaaaaatattacaatgcaatgaagaaacttggatccaagaaacctcagaaacccatacctcgcccagcagtaagaattacttgtctcctttaatgttccaaagccatgcgtccatatggtcaaattgagcaatgctctggagcagaacatattaggtgatatcaccaatattgagccctaattataaagttcatattttgcatcataattcacaacttctgcactcattaggagttaccacattccaaaaaaaggaggtaatgttctttataatttgtgagttgaaaacttctagctcagggttcctaataaatacttccaaagcaaggttcactttcctgctaccaacagcacacctggttcctcctcctctagccttcccatcccactctccaaggcctccctctatactctctgctccctccattcttaagactagaaaatattccaaacctgtttagaaagggaaaaggtgtcatcaaaattgtttgtttcaccaaatacaccaaaacagaataaggcatattcagaatgcatactctgtagagcctcatgatgatggaatgatgtaataatgacagattatgttcacagagctggactctaactcagctattttctgagattggtaaggagtaaggaaactgaggcccaaagaacatacgaatcatgccccaagtcacaaatcttgtaattgccagaactgggacttgacaaggccccataaattctctaagtgacttgactttaccatatttataagagtagttggagctggaatgtgagggagcagggtaagaggggaaaggattgaactgactttactagagttctttaaaaattaaaacatggtcacttcatgacctttgatttttggtaagccatgaagttttaagtttttactctaaatgattaataatatatttctttaataaaactgtatttactagccatattaatataagaatctttgaaagcatgttgttcctgagatgattgttaataagacaaagaaaaaaagtgtttaaagtcatgcatttttgttaaagcacagggcataggtaaagaaggacagatggaaagaaatacagataaattaacaagcccatacatagattcacagagctagagaggtagaattcaatagaaatatgactgatgtatttcaggggagggaaataaggtataaaccaaaatttctaaaatattgataaatgaattggtgtattctctatctaaatatctgttgatattaacctgctttgtaaatctttgttattagtagtcactattttttataaaaattatcatacttattcaaatcaagcaaagactacatatattatcagccaattgtcacaaatttatgtgtttgtttttgttttgttttttaagagacagggtctcactctgtctctcaggctggagtacagtggcaagaccatagctcactgcaagttcaaacacctggggtcaagtgattcacctcagcctccctcgtagctgggactgcaagcctgtgccaccataccaggctaatttttttttaatagaaatgaggtctcactatgttgcccaggctggtctggaactcttggcctcaagagagcctccagtctcagcctcctaaagtgctggaattacaggcatgagttgccacgcccagccttaatttatgtctcatccagctttgtctttccataggacctatataaaccaaatatgctttgtttagctatataaattttttttccattttttttaacatgaagagaaaaaaagcacacaaaattgtttggggtaatatgaggagggtgcacatccatcccgtatgtggaagggctttatctacaattttactgcattattctttatgaaatatatatagtaaccttatttctcttctctcactttctagaacaaattccaaggaatggtctttgattttgtaaccagacaagtctttgatatcagcatcatgatcctcatctgcctcaacatggtcaccatgatggtggaaacggatgaccagggcaaatacatgaccctagttttgtcccggatcaacctagtgttcattgttctgttcactggagaatttgtgctgaagctcgtctccctcagacactactacttcactataggctggaacatctttgactttgtggtggtgattctctccattgtaggtaagaacagcttaattaccaagaggtatagttacagagaaacagttgccccaggaccttctagctgattaacatggaaattaggtctgagaataataatgcatatagatgtaaagttcaacactagcatatttgaataaaaactctgaaacctgggtttattcacaaagctaactagttagaaaccatgttaggaataccagatttgggaaagaggtgaagaagacaggaaataaacattatcaggtactctcctaatcttaaaccaaggtcacaggctaaaagaggcagatggcttaaaaaacaaatcattgtaatgcaataaagttggtattgtaagaagcactgaagaggaagtagccatctctgctggaatgagttaacacaggcttccagagataaaggtgatgcatcctaggtgggtcttcaaagaagagttgagatttagtaggagaaaaagagagatggggaattatagaaccccaaatttagaaacttcaactttaacctcatgtcaaatatggcccatttctctctaactgaagagtatcattaaaaaatagaaaacaatatattcagagatttcagaaatatttttgtttgtaattgccacaattcatgtgtagggataacaattcatataaattgggtctatataatcttaaattgccatgctaccattggagattatttggattttgcaaaaattcatattggtttatgacattacagaatcactgaataaaactctgtaatctgtaattgctaatgtcagggagtggatccaaatatttaataaaggctcatattcataacaagtttgttgtgttcatagaccttaaaaaagataaagccatcatgtaagtgaaagatattatctgtttagctgtgttctatgttttccataggtatgtttctggctgagatgatagaaaagtattttgtgtcccctaccttgttccgagtgatccgtcttgccaggattggccgaatcctacgtctgatcaaaggagcaaaggggatccgcacgctgctctttgctttgatgatgtcccttcctgcgttgtttaacatcggcctcctgctcttcctggtcatgtttatctatgccatctttgggatgtccaactttgcctatgttaaaaaggaagctggaattgatgacatgttcaactttgagacctttggcaacagcatgatctgcttgttccaaattacaacctctgctggctgggatggattgctagcacctattcttaatagtgcaccacccgactgtgaccctgacacaattcaccctggcagctcagttaagggagactgtgggaacccatctgttgggattttcttttttgtcagttacatcatcatatccttcctggttgtggtgaacatgtacatcgcggtcatcctggagaacttcagtgttgctactgaagaaagtgcagagcccctgagtgaggatgactttgagatgttctatgaggtttgggaaaagtttgatcccgatgcgacccagtttatagagttctctaaactctctgattttgcagctgccctggatcctcctcttctcatagcaaaacccaacaaagtccagcttattgccatggatctgcccatggtcagtggtgaccggatccactgtcttgatattttatttgcctttacaaagcgtgttttgggtgagagtggagagatggatgcccttcgaatacagatggaagacaggtttatggcatcaaacccctccaaagtctcttatgagcctattacaaccactttgaaacgtaaacaagaggaggtgtctgccgctatcattcagcgtaatttcagatgttatcttttaaagcaaaggttaaaaaatatatcaagtaactataacaaagaggcaattaaagggaggattgacttacctataaaacaagacatgattattgacaaactaaatgggaactccactccagaaaaaacagatgggagttcctctaccacctctcctccttcctatgatagtgtaacaaaaccagacaaggaaaagtttgagaaagacaaaccagaaaaagaaagcaaaggaaaagaggtcagagaaaatcaaaagtaaaaagaaacaaagaattatctttgtgatcaattgtttacagcctatgaaggtaaagtatatgtgtcaactggacttcaagaggaggtccatgccaaactgactgttttaacaaatactcatagtcagtgcctatacaagacagtgaagtgacctctctgtcactgcaactctgtgaagcagggtatcaacattgacaagaggttgctgtttttattaccagctgacactgctgaggagaaacccaatggctacctagactatagggatagttgtgcaaagtgaacattgtaactacaccaaacacctttagtacagtccttgcatccattctatttttaacttccatatctgccatatttttacaaaatttgttctagtgcatttccatggtccccaattcatagtttattcataatgctatgtcactatttttgtaaatgaggtttacgttgaagaaacagtatacaagaaccctgtctctcaaatgatcagacaaaggtgttttgccagagagataaaatttttgctcaaaaccagaaaaagaattgtaatggctacagtttcagttacttccattttctagatggctttaattttgaaagtattttagtctgttatgtttgtttctatctgaacagttatgtgcctgtaaagtctcctctaatatttaaaggattatttttatgcaaagtattctgtttcagcaagtgcaaattttattctaagtttcagagctctatatttaatttaggtcaaatgctttccaaaaagtaatctaataaatccattctagaaaaatatatctaaagtattgctttagaatagttgttccactttctgctgcagtattgctttgccatcttctgctctcagcaaagctgatagtctatgtcaattaaataccctatgttatgtaaatagttattttatcctgtggtgcatgtttgggcaaatatatatatagcctgataaacaacttctattaaatcaaatatgtaccacagtgtatgtgtcttttgcaagcttccaacagggatgtatcctgtatcattcattaaacatagtttaaaggctatcactaatgcatgttaatattgcctatgctgctctattttactcaatccattcttcacaagtcttggttaaagaatgtcacatattggtgatagaatgaattcaacctgctctgtccattatgtcaagcagaataatttgaagctatttacaaacacctttacttttgcacttttaattcaacatgagtatcatatggtatctctctagatttcaaggaaacacactggatactgcctactgacaaaacctattcttcatattttgctaaaaatatgtctaaaacttgtttaaatataaataatgtaaaaatataatcaactttatttgtcagcattttgtacataagaaaattattttcaggttgatgacatcacaatttattttactttatgcttttgcttttgatttttaatcacaattccaaacttttgaatccataagatttttcaatggataatttcctaaaataaaagttagataatgggttttatggatttctttgttataatatattttctaccattccaataggagatacattggtcaaacactcaaacctagatcattttctaccaactatggttgcctcaatataaccttttattcatagatgtttttttttattcaacttttgtagtatttacgtatgcagactagtcttatttttttaattcctgctgcactaaagctattacaaatataacatggactttgttctttttagccatgaacaaagtggcaaagttgtgcaattacctaacatgatataaatttttgttttttgcacaaaccaaaagtttaatgttaattctttttacaaaactatttactgtagtgtattgaagaactgcatgcagggaattgctattgctaaaaagaatggtgagctacgtcattattgagccaaaagaataaatttcattttttattgcatttcacttattggcctctggggttttttgtttttgttttttgctgttggcagtttaaaatatatataattaataaaacctgtgcttgatctgacatttgtatacataaaagtttacatgaattttacaacaaactagtgcatgattcaccaagcagtactacagaacaaaggcaaattaaaagcagctttgtgaacttttatgtgtgcaaaggatcaagttcacatgttccaactttcaggtttgataataatagtagtaaccacctacaatagctttcaatttcaattaactcccttggctataagcatctaaactcatcttctttcaatataattgatgctatctcctaattacttggtggctaataaatgttacattctttgttacttaaatgcattatataaactcctatgtatacataaggtattaatgatatagttattgagaatttatattaacttttttttcaagaacccttggatttatgtgaggtcaaaaccaaactcttattctcagtggaaaactccagttgtaatgcatatttttaaagacaatttggatctaaatatgtatttcataattctcccataataaattatataaggtggctaattgg

SEQ ID NO: 40 - DNA, 222599 bp, Homo sapiens
  source 1..222599: mol_type = genomic DNA
acagacgagaacactgaggtttggagaggttgttacaccctttttccctcttgtgattggtggtaggaaaatattaagtagaggagagacacagtaaagtgccaagagctctggcactcattacctagatcctcgcgagggtggagtgagcggtcgaaatgctcatgcctactttacagatggacagactgaggatcggaaagactgaggtggcctgggggctgtcagggaggcagcgcctccccgctcctggcagcaggtccctgtgggctgaaacacgagcctccacctgccgctgattgacttctcgttttttcagtgggcccaagatcctgtaaattgagttccctgcgcttttggatgtcagaaacttcactgagcgcggcactgttggggggcaggagaaaggtaagacttggcactgacgcgggccacagagcacgcgggtcaccacgacagctttcgggtctcgccgcccggcgctggcgagcagccagccagcgtctcgcggcgggtcccggtcctcagcccgcggcccctcccggcggctcggcgggggcgtagtggaggcgggcccggggacgctcgctggcgctcccgcgcggcgccccctgccggcgccctgttccctcttgcccctgatccgctcccggcggcgcggagacgcgagtctgagagcctgcgggcgggcggcgcgctgcaggcgagcgggcgagcgggcgcgccctgcaggggtaggtgggccgcgggggcgcgggcgggcgggcgcgaagcgcagggagggggcgggggcggtggcagcggcgcttgcgggccggggccggcccgggcagggggcgcgcgcggaggggtaggcgcgggggcggggcgggcggggggcccggcagtaggggcgcgcgcgcggtggcgcgcggcgggcgcgagtcatcaattatgcaaggactcgggcggtgcggggggcgggcgcggggagcgctccaagatggcgcccaccgcagtcccgcccgccgcatcctcggcgcctttgcagtccggccgcgcctcccgggccccgcgttagggccgccgctgcctccctcgccgccgccgctgccgtaagtcgccccagagcccccgccctagcgctgcttcctgccctccgggtttcccttctcgcctcgggacccttgagcggggctcgcccatctccagtcaggggctttgccgcagagtgcgcggcggggctccaggggccgtggagctggggctctgctctccttgttttggacaggtgtttggaactcttgcttccttctactgtgtgtaccgggggtctcttaagagaactgaggaccaccagtccccaccccggacaccctgctttctccgtctcggctacagtgagggacacggcccgtccttggtgccccttccgcggtgcagccctccatccctccctcagtgccgggcagagttggggcccctagccggcttgcactgggaagggcagcgctgtcgggatcttcctacagcagcccctcagccctccccctcccccatgtcttactgcatccttctccctcagccggcttcacactgctaaaaactgcagaagccaagggctcctgggttcttcccgcagccagcactcccgactccctctgtcctttactcggatgcgttcgtccccctcccaacagggtgctctggagttgtgatgggggctcccgggaccttcctcggcaggcgaggattcctgcatttggaagcacatcactttgagaatatccccttcccccatcccacccccacccccaccccccacccccacgccacccgatgcagagcttgttcctctcctctccctcccccaccttaccatcagcagcagcacccttggcttcttgttagcgttggggtacaggactgtttgcccagctccgtgggcttggaccctcctctctagttctcacttggtaccttggggcaccgcaaagcctctgcagtttctcctgagagctcagctccatcccctccattgccagcaacaaccaccggtggagacttggctaactttccaggggttagccaggactgtcagaccctttcaggggccccagcttcgagttgggatggaatgggaaccatttttcagcccgataaataggattcttcaaaccatgcattccatccgactactccaccctatgccctcttcctcacttacactgcagtttttgaagcatgagggaatacattttatgtccggagattccaaggttctgcatcagcgttcataataaatggatgtcatctgtttggggggagggtagaagaaactttggattgcatctggctaaagtcagggggagggagaaataattagcatggagcaagctctgccacacaaggaaaactgctttttatgcacagtgggcaccagagagtcagggatggaagcaggaagtgtgggtgggggccatgggggtaaagggggagagtgctttttataactgttttcccaagtttgaacctggagagcctttagagagaggtagcagtgtgttagggctgggggatgttttagctttccaatggagatttcgggtgtggtaggtttttcactgtctcaaaatccctctgcacttctcttttctccacgtgcattagaagatgtggagggggggatgttgtgcttttattcttttctcaaaaaaaattttttttttgatttgtgatgcaaatggctggataacattaccacacggtaccatcctggtaggaatcttgggggaatcagacttaaaatgctgaaagctttatagcacattacatgtaacctggttcttgaaatactgcagcatttttctttggagctcatgacccataaggccttcatttctccctgaaagaggatttggttgctggttggtgaggtggtggttgtgggtagtgatcctttggtgttcagcacgcattccctgtcctagaaattgaggtcctccctggagagggctgcaagcatgttccgtgttctctgaacatctgattcagggtatatgtaaatgtgttgtgtttctgagtagagctggtggtgggtattgcaaagcagttcataatggtgcagatcagttattggtttcttggcttcagtttgagcagctttggttttcatttggggttttgtcaacttttatcaaaatctttggaggattttgttttaaattaataaaggataatcaagtggaatactgcatccttaaaaacaaccatacggttgctgttgctttccttgtaggacccttaagaattttttctcctggtccagctttgggttgcctgtgtttaggcttgtattcaggtttcttgctgtggtgctgaaaggacagttccccgaccagttctgcggcgaagtgcacacacactggacatgattgagtttttttttgctttttattatcagcaggctttctcgtggatgtgtatgtacatgcgcagctgggtttgtacttgaggttgaggcctagttatcatattttattactcccacataactcttcattttggctgtccctcatggagacaatgttttacaggctgcaacagatccatatgtaagccataagtgacattttgctgactgcattatttcagcacacttcagtcatttcaaatagcaagcaactgttaatattcttggtctccacaggaagtaatccgatagctggctaaattaaactggatcaggagagcgtcttctgtgggttgatttgaatagtgaactgggaaaggcacttgacacagcagaggtcagtattactaaagtcgatttatccaaaaaactattttaaaatcataaaataggaaggaggccataaaattcacatggtaccacctcccacccaatacaggaatctcctttatgggagatctttgctttgaatacatccgttggtagggaacttactgccacataacgtagctcattccatttggattccactgtgatcaaagtattttaatctcattgaaaaggtaatatacataaagttgaaagacatataaattggagctatatcggggtaaatgccattcttgtgcttgtttccaagaaaagattgagaaccatttttctgtagagaacatacaagaaacttgcacttacttgaaaagaatgcaaaaatagagacatgtccacctaaagcaagaaaaacattctgtgaatggaaagaaaaataattatctttaatgtgctggtattatgtaacaaattgttctagaaggcacatgcttgaattaatgaatatttaattcctatggattatgtctaaggacactaaagctatactatatagaaagcgttaaaaatccaaagtatatccagagtgagatcagttaccataattataaaaatacatacttattgcagaaaaattttaatatatgtaaaaacagggaaaaagtcatccttagttttaccatccttaccatctttgcttctaccataagcaaaacaattatctgtgttttattatgtttttccagtctttttttttcccatagagagggaaagaagcgcttgtaaagttatccagaatgatagtattttaaaactgagccctttaagctcttaattttatagttcacttgctagtcatttagggacttaaacagattgttgtatctcaatttacctttttcttaatcctttagaaatgttccaaaaaaaactgtaatgtgaaagaattcactcatagaattggacttcactcgtaaagtctgtttgtttatatttagcacattaactgaggaatcaataaaccttttcttaatcaatgaatcaacaaatagtctcactctgcacctactatatataaggcactgaactgaacactagtacaatgcctctctaagctggcgagcacccgcttaaaaaataatactgtgctcaaaaactgtggctattaaggtgtcgaaggaaacagaactcttaccctgtaagtttattaattgcggaaatgtatggcagtctgttagggccagcccagtgatttaacctaaaaaagaatagtttgtgcaagaatgggaagtaaatgcagtcaaaagacaaaggagaaggtttctggaaaaattatccctttgtgaagttatggagacacagccaggacacatatttaagtactatgttagagattaaggtgaaatgaaaacccaagaaggttgctatagttacactattgagaagaaaatgtcagaagcagtatgggctttggaatcagacaaaactagattcaaatcccgactctgctatgtattggctttgtgaccttgggcaagttatttaatctattggagcttcagtgttcctatctataaaagtgggaataataatacctacgttgcagggtatttgtggggattaaatgaaatctctgtttccttatggtttctgacacatagtgcttaatatatattagcccccttgcctctagggatttagcagcttaatgtgtatttatgtatgtatttgacgtagtatatatgtactgtattgaatttcagtagtctgaaaagcagacggatgctttatcttcagtctggcatagaggatggaacccgtaggtaccctaacttggatggacattgctaagaaaagttttactgtacaattgctctgctggcttccaccaacacagtgcaaatgtggttaccaaagtacctcttgccttgtccattcccaaactacactagaataggactctttacccaaaaggaatgctttggcactctccagctgggctgtttttagctgtagcctgggatctgaaggtgaaatggactcaaaggctgaggcctgcctttatgctgacttgagctggatttttacattgtggtaagtgattatacatgtttggagttggttttgtcttcagcaccattttaggtttccccactgtatagtctttgaactgctttatttgaatgggtctcataggtgacctgccacctttggtaaatgttactctgtgtttgtctatttataaaaactttcaaaatccttctatcagtcgattgagaaggaggtaaagcaaatatcctacccactttatagctgaagaaactgagtatcgaagagcttaatgaaggaagttgtccaagctaaggactatctaactggtgtagtggagactggtacctaggttggtcgactcatgtttagtgacttctttctgttaaatggtgttatattctgatgttcatataaccaagtaatgtgaacaattttggttttattttaagatattattagcttaggtagctaaacatatcttagtgagtgggtataatgaaagattctgggatagacagagggagggcaaaagtgcctttgaaggaaagcattttggaagcaggaaggatgaggggaaattaacagaggatgtatcaataagtagaatatggatgaaaacaggaggcaccaaagtaacacacttgtgttccttctgtggctatcctagctacttttaaaaaggtcatatcttggtgtctgcttatctttcatccgtgtctcttgcatgtaaacacatatacttggctattcatgaaatctctcccattgccaacctaggttgtaaccaggactgtagggaattatgaccattgttacctggacttctttgcttatgcaaggctgaaactggtgtgagactcagagaacagaatatgctggggattggtgatgggtacgggcagcaagttggggccaaagaagttctgggaggactttgggctagaagtagtacaaaggttggagaggctaatagttaagattttccttgggtgtatggagatgtgtcatactgaggagaatagaatgaaataaaagccagaagcctgagggtctaagaggtacttttagtttggtgctgaagctctcttgatcctggaaggagttgattggggtgggttgactaaaataggcgatggagagatttggatcactttatattcactattgatggtaggcatcctgtattcactgggcatgtcccaggatctggaagtggaaagcactgaactccctcaaaaggcacattcacaggctcctttcatattcagctgattagtgtagttttttgtgctataaatttttgggggttcctggggagtaagaatgctagagaaatagtggatgcttacttatccagggatggatcatcaagcttgtgaattatacagttatttatttttctcctttttcctccattatgagcacttaactgatcattagcatttctaccagcgtgaacttgggaagggagaaaaagtcaaaattaaaatgttacttttactttttagataatgattgataaaggaagagatggcaactactttgtcaatgaaaaaacacctcatatttaatctgttcttctctccttattttaatagtatagacagttgaaggctgagcctctacaagtttaatgtccactgcaagctggtgtaaatagcatttttctttcattttagtgagcaacaaccctgtaaacaagtagggcttaatttattatatatttagctccttgtttcaggattaattcctcaattaaggataatgcaacaggcttttgtgttacattcactactgtttttttgtcttagcaggaagctgaatgcttttaagtgaaaaaaattaatgcattattaaattgcaggaaaaaaatcaagcaggttgcaaatgagactgatagggcattctcagaggtcagaatacccagaaatcacatttgctacagatttctcaattggatttcctgtgatttggtgaatactctaaagaggcataatgccttgtttgtaggaaagatgtcttgaagataattagtcattttttaagatgagtattgtgatagggagggaagaaagtgtttggagtgtgacgaatcatcatagggagaaagcaaaagaaggtgaatgacagagtgaaaatgggcaaggggatttggatgtgaacgtggggaactgctcatattttaagagtaggtattcactcccctccaacaattcctttgggtacacctccgtattactgaaccagatcctcatctgctggacagggcacagaaccttgggaaggtggtttttgttgttgttgtttagttttattttattcttagctctgctagaactttgctgcaaattgctttctttatctgatctctgcattgagaaaactggagaatattttcttgctttatggaaaaaaatgtaatattcttaaacgtttctttcatttcctcttgatttttagtcatttaatacaaaaacattttctcagaaggctctgttgacagtttctcttccattgtcttgaaatgtttgtttgaatatttaacagaggcacaaaattcaaaaatcaaaaagttcgaagttaagtcttcttttactgtctcccagtcatgcagtatgcactccataatagcaattactgttactaatttctcttgtaatgcttcctgcatacatacatgcacatatacatattgtctccccctgctcctcacagttagttccattgtcttttaaggaagacttaaaataatttgaggatttggattctcattctagatcatcttagatcagttagttaccccttttccttaagaaatacataatgcctctgttttatttttcttagtaaaatttatattctaatttcttggcttatttaatgtgcaagttagtttgggctgaagcagcctttcctactaacctacattgcttttagggttttccttatagaattacctgttaaaaataaaagtgcagggggagacataaccttgagaactattggttcattgctgtctatgagtgaattctaaatcgcctgcttgaccacatcagtcaacaaatatttagcgagtagcaactatgggatatataaaagatagaccttatgttctaggagcttatttattttgtgaaataagtcataaacacaaaatgttaaataagaaaagattttcataatggttgatgattaaaaagttggaaaggatttattgctaaataaatggtatagttaataaattgattttttaggaaagagagagcatttcaagttggtatgattagagacaggttgatggaagaagcatgatttgagctgggctttacagaatggttgggtagaacagtgtgagccaaagtgagaaggcaagaatgtacaaagtgttttgggggagcagtgagaatctccttgtggcagataagcctgcaaagataggatagagttagccaaatattaaggactttttgaagtttcattcataacatggagaatgtagaatttagagagtatagaatgacagatgatcaaagctatactgtagtgttttaggaatattgggcagcagtgtctaattggatggaatagagcaaggaatggacatccacttagttggctctttgatttgtcccagctgtgtagtgatgaagggttggagtagtgtagtggttataaggatgggaaggaaggaaagtaaatataactttgtatatgtgtgttacatgaatgtgtgtgtttaacgtttttctaatgttagaaatagtttataggaagactcagtagaactcagtgaatgactttacatgggagaaaagggagagggaataaagattattttactgttttaaagattagagatagagagtctcctattttgaaaatctggggaagtatgttctgtaatccatggtagtctggtccatagcattttggttaacaagctgtctttatttctaattttctaattgtttctctgcagagggttttcttgagcttttaatgttatttcttgtaggaaaacttgaatcttctgaactttattatctaagctctcactgataaagattatttaatcttcgtttgtgggtctctacccttgttttggagttttacattctgtccattcatagacacttaacttgtcattttcgttggcattctcaactcaccttcagtttggaggataaaggaacaagaattctatacctttttatagacttggtaaatgactcttttgtccttaccgaaactcagtatatttgattttttgattgtttgtttatatcccatgtgcttcatgacagccatactatttgaaattgcaggctgagttaaaggtagtaactgaaaggattttagtaggtgaaagcagagggaaagaaaaggccttatcagccagtgatgttgctttctgtttcaggtactgaatcttaggccgtgtatgaaaaatgtcagacttgacttgcatgatcttcttggtatagctggggtacaagacggtggccagagggccctaacgtacaacttgagtatacagtggtaacttagagcaaaggcagaactcagggagcttgggttctgctactgccctttctcgtcagaaatgatcattgaatgagaaaaaataaagggttactagattatcagaacatggacatcaaaataatagaatacaccaagagaaaaaaaattagaaatttaatgcaatttttaaatctcatttaatttgttaaaattatatttcttctcaccacgaaagttactgagttcttgcaaattccattacatttaccacagtttgcactcagacatttggcagaagtccccatggtttgctgtggaaccagtagagcaggcacagttcatgtacaagatgttaataaatttagcactctatttagggtattacccaaattacccttacagtaattctattaggagattctctgtgcaatcccattataagtgcatacctttctcctagtttgaatgctcaaagtaacagtaattaagaactgttatacaatagtctcttggaaaggcattcttaaggtagcctgggatgaggaaagtccataaacaccacttaactgaatgatggcaatctgttttattcatctggatgttctcatgcaagtaatattttagtagatctatagatttttcttatttcttaaccatctttttgtttgtagtatttcttcttccttgtctctagaaatgcaggagagggttgtgtaaaacccaagaagggttttactaagtgcacagactgaatgattaagaagtgtagtagggaaacaaagtacagtgatcatatgaatgtttcacttacctaacaaggccttttttttttttttcctgactcatgcaggaaacttcacccataagtgcccaaggggtaagacttattttgggatcttaaggtagacttctggcattagaaattgctcaaaagctttataggtcaaagaaaataaattcatctttgtgttatgagtggatatcaaagatttgctattaattagatatgttttccattttaattttaattagattaaaattaaagtctgacccttgggggctgatgtgctttgttcctagccagttgccttgtctttcacctcgcacttctccacaggctgccttgctggttccagtggtgaggctcagcagtcaaatggggatgtcacttacatgccccacttgggctctaccctggagccctacctttgccaagggtggtgctcagagaaagggtttttttttttttttttttttttttaagagcaatgcatttaatactcaatgcaatctgttgcaaaatctcaagaaaaaaactcattcccagagaggaaggagtgtgtatgttttttttctagccaggattctagaaccattagctccttataggcattgcttctgtttatatggatgttgagtggtcaggcctttccagtttttttgttttttccttccacagtttaatcctagaacctagaaagaactgttatttgtgggaattgaatgctgactttggtagtattaagaaaaatccagtgtggatctgtagagttcagagtattggtgctcaacacaggaatgataaatgtttgagattatggatatgcgaattaccctgatctgatcactatatatgaattgaaacatcactatgtaccccataaatatgtatagttattatgtgtcaattaaaaataaagcaaaggtaaaaatttgagtaagtttgtaacacagaaggccaaacattgtataattccacttatgtgagttacctagaatagtcaaattcacagacagaaagtagaatagtggctatcaagggttgtgagaaacgggtagtggagagctactggttaaggagtacagagtttcagcttgagaaaatgagattgttctggagatttgtagtgataatggttgtaccacaatgcatgtacttaatgttacatacttgtatacttaaaaaacggttaagatggtaaattttatgtatattttaccacaatcaatcaatcaatcaatcaatataaaacaaaaaatagagtatggatgctagtccagattttggacaagagggtatgtggtgtttttatggccaaaatatagggaccagaaaccctgctttctagtgtggctttgggccaatacacagttcccctgggatgagcagggtactctttcctagtgggagacctattcctattagagtattacagccaaataaaccactactttcttcacaagaataagctcaataaaactaatatttgaaaagattttgaagttctagctcatgaatggcaaatattattttcctttttttcttcttaatctacccaagatagtatttcatttttcccttttaacattttaaacagcttttgttttattttttcttatttttaaaattttacaaacagtaaaattgaaacaaatcttggtgtacagctctgaatttttacacatgtataggttcatgtaaccgtgccacaatcaggatacagaacagttccattaccccaaaatactccctcctgctgttcctttgcagtcaaactttccctaatccccagcccctggaaacctgattggttctccattcctgtggtgttaccttttccagaatgtcataaaagtagaatcatactacactatataaccctttgagactgacttcttttgctgagcataatactttggagatttaaccatgttgttgtatttttcaattgttcttttttattgctgagtagtattgtatgtaactgttccaatgcatatacattgtatataacagtttgtcaacctgttcgtctgttgaagaacatttggaatatgtccagtttctggtgattatgaatagtacttctgcaaacattcatgtacaggtttttgtgtgaccctaccttcatatttctcaaagctgatccctaagagtaggattgctgggtaatatagtaagtgtatgtttacctttataagcaactaacaactgtttttcagaatggttgtaccatttcgcattcccaacagcagtgtatgagagttcagcagcatatgcgagttcaggtgctctgtatcctcattggcacttggaattgtcaggtttaaatttttttttttttatcttagccattctaataggtgtgtagtggtatctcattgtgatttcagtttgcatttctgtaatggctaatgatgtctaatatcttttcatgtgctctctgtgtatctttgtgaagtgtctgttgaaatgttttgcccattaaaaaaaattggattgtttgtattcttactatgagttttgagatttttgtttttaaaaatgttgtttttgagatatcaaaacagatatctttatcagataacttacatgggcatattttctcccactctttagcttagcttttcttaatagtgtttttatagagctaaagttttaaattttgatttagtccaatttgtcaatttttttcatttatgggtcacgtttttgatgtcatatataagaactctttgtcaaattcaagatgttcttggttttctgttaaaaattttgtgtagttttacattttacctttagatctgtgatccattcaagttaatctgtgtattagatatgagatttaggcctaggtttatttttatttttttgctaatagatgtgcagttaactgtttgagcaccattgttgttcaaaagactgtctttctcctgaattgattttggacttttgtcaaaagtcaattgcctgtatttatgtgggtttatttctgggctctctcttctgttccatcagtctgtatgtgtgtctgcgccttcctcaataccacacggtctcttttttccccaggtttttttgtttgtttgtttgtttgttttttgtttttttaacgggtttttgtttcgttttgtttggttttctttagagatggagtttcgctcttgttgcccaggctggagtgcatgtcacgatctcagctcaccgcaacctccgcctccccttcaagcaattctcctgcctcagcctcagaagtagctgggattacaggcatgcgccaccacacctggctaattttgtatttttcttttttagtagagatggggtttctccatgttggtcaggctggtctcaaactcctgatctcaggtgatccgctgccttggcctcccaaagtgctgggattacaggcatgagccactgtaccaggctccagtgtttttttttttagcttttattttaggtttgggggtacatgtgcaggtttgttgtatagatagattacatatcactggggtttagcatacagattattttgtcacccaggttataagcatagtacctgatgggtgtttttttgtttctcaccctcctcctaacgtccaccctaaagtaggcccaggtgtctgttgttcccctcttcctttccatatgtactcagagttttaaatacgagtttttcatgttcctaatttagctattctattgtcatagctttcttttctttccccataagttattggggtacaggtggtatttggttacatcagtaagttctttagtggtgatatgtgagattttggtgtacccatcacctgagcagtacacactgcaccatatttgtagtcttttatcccctgccttcttccccaaagtccactgtatcattcttaggccttttcatcctcatagcttagctcccacctatcagtgagaacacatgatgtttggttttccattcctgagttacttcacttagaataatagtctccaatctcatctaggtcattgcaaatgccgttaattcattcctttttatggctgagtagtattccatcatatatacaccacagtttctttatccacttgttgattaatgggcatttgggttagttccacaatgttgcagttgtgaattgtgctgctataaacatgtgtgtgcaagtatctttttcatataatgacttcttttcctctgggtggatacccagtagtgggattgctggaccaaatggtagttctacttttagttttttaaggaatctccacactgttttccatagcagctgtactagtttacgttcccaccagcaatgtagaagtgttccctgttcactgcatccacaccaacatctactgttttttgattatttgattatggccattctttcaggagtaaggtggtattgcattgtggttttggttcccatttccctgatcattagtgatgttgagcattttttcatatatttgttggccatttgtatatcttcttttgagaattgtctgttcatgtccttagcccactttttgatgggattgtttgttttttttcttactgatttgtttgagttcattgtagattctggttattagtcctttttcagatatatagattgtcaagattttctcctctgtgggttgtctgtttactctgctgacttccttgtgccgtgcaaaagcttttagtttaattaagccccaactattatctttgtttttattgcatttgcttttgggttcttggccatgaaatccttgcctaagccaatgtctagaagggtttttcattgttatcttctagaatttttatagtttcaggttttagatttaagtccttaatccatcttgagttgatttttgtataaggtgagagatgaggatccaatttcattctcctacatgtggctagccaattatcccagcaccatttgttgaaaagggtgtctattccccgcttacgtttttgtttcctttgttgaagatcagttggctgtaagtatttgagtttacttctgggttctctattctgttccgttggtctatgtgcctatttttataccagtaccacactgttttggtgactatggccttatagtatagtttgaaatcaggtagtatgatgcctccagatttgttctttttgcttagtcttgctttggctatgtgggctcttttttggttccatatgaattttagaattgtttttctaattccgagaagagtgatggtggcatttttgtggggattgcattgcatttgtagattggttttggctgtgtggtcattttcacaatattgattgtacccatccatgagcatgggatgtgtttccatttatttgtgtcgtctatgatttctttcagcagttttgtagttttctttgtagaggtcttttgactccttggttaggtatattcctaagtattttattttattttattttattttattttgtggctattgtaagaggggttgagtttttatatatatttatttatttatttttttttttgagacagagtcttgctctgtcggccaggctggagttcagtggcacgatctcagctcactgcaacctctgcctcccgggctcaagcaattctcctgcctcagcctcccaagtagctgggattacaggggtatgccaccacacctggctatttttgtatttgcagtagagatggggtttcaccatgttggccaggctggtcttgaactcctgacctcagataatccacccaccttggcctcccaaagttctgggattacaggcgtgagccaccttgcctggccggggtttagttcttgatttgattctctgcttggttgctgttggtgtatagaagagttactgatttgcatacattaatcttgtatctggaaactttgttgaattcttttatcagttcttggagctttctggaggagtctttagggttttcaaggtaaatgatcatatcgtcagcaaatagtgacagtttcacttcctctttactgatttggatgtcctttatttctttctcttctctgattgctctggctaggacttccagtactatgttgaagacaagtggtgagagtaggcatccttgtcttcttgttccagttctcagagggaatgcgttcaacttttccccattcagtattgtgttggctgtcagtttgtcatagatggcttttattacattgaggtctgtcccttgtatgccgattttgctgagagggatcataaagcgatgctgcattttgtcgaatgctttttctgcatctgttgagatgatcatgtgatttttgtttttaattctgtttatgtgctgtatcacatttattgacttccatatgttaagccatccctgcatccttgatatgaaacccacttgatcatggtggattatctttttggtatgttgttggatttggttagctaatattttgtgaaggattttagcatctgtattcatcaaggatatctgtctatagttttcttttttggttatgtccttttctggttttggtattagggtgatgctggcttcatagaatgaattagggagggttccttctttctctgtcttgaggaatagtgtcaaaaggattggtaccaatttttctttttcctttttttttttttttttgagatggagtcttgctctgtcgcccaggctggagtgcagtggcgtgatctcggctcactgcaagctccgcctcccgggttcacaccattctcctgcctcagcctcctgagtagctggggctacaggcgcccaccaccgtgcccggctaattttttttgtatttttagtagagacggggtttcaccatggtctccatctcctgaccttgtgatccacccgcctcggcctccgaaagtgctgggattacaggcgtgagccaccgcgcctggcctggtaccaatttttctttcaatgtctggtagaattctgctgtgaatccttctggtcctggactttttttttattggtaatttttaaattactgtttcagtcttgctgcttgttattggtctgttcagggtatcctaattcttcctgatttaagctaggagggttgtatttttccagcaattgatccatctcttttaggttttctagtttatgtgcgtaaaagtgttcatagtagccttgaatgatcttttgtatttcagtgatatcagttgtaatacctccagttttgtttcttattgaggttatttggattttctctcctctcttctaggctaatcttgctaaaaggtctatcaattttatttatcctttgaaagaaccagctttttgtttcatttttgtattttttttgtttcaatttcatttagttctgctctgattttggttatttcctttcatctgctgtatttgggtttgatttgttcttgtttctctagttccttgaggtgtgaccttagatgtcagtttatgctcttacagtctttttgatgtaggcgtttagggccgtgaactttcctcttagcaccacctttgctgtatcccagaggttttgatagtttgtgtcattactgtcgttcagtttgaagaatttttaaatttccatcttgattttgtttttgactcaatgctgattcagaagcaggttacttaacttctatgtatttgcatggttttgaaggtttcttttggagttgatttctagttttattccactgtggtctgagagagtgcttgatacaatttcagttttcttaaatttattgagacttgttttatggcccatcatatggtctctcttggaggaagttctatacattgttgaatagaatgtgtattctgtggttgttggatgaaatgttctgaatgtatctgttaagtccatttattccaaggtattgtttaaatccgttgttaaatggattcatagtttaaatcccttgttaaatggatttgtagttaaatctgttgtttctttgttgactttctgtcttgatgacctgtgtagtgccgttagtattgaagtcccccactattattgtgttgctgtctcatttattaggtctattagtaattgttttataaatttgggagctccagtgttagatgcatatatgtttaggattgtgatagtttcctgttggacaaggccttttaccattttataatgtccctctttgtctcttttaactgctgttgctttaaagtttgttttgtctgatataagaatagctacccctaggctgggggcagtggctcacgcctgtaatcccagcactttgggaggcagaggcagacagatcacctgaggtcaggagttcgagatgagcctggccaacatggcaaaaccccgcctctactaaaaatacaaaaatactcataggtgggaattgaacaatgagaacacatggacacaggaaggggaacatcatacaccggggcctgttgtggggtgtggggaggggggaggggggagggatagcattaggagatatacctaatgttaaatgaagagttagtgggtgcagcacaccaacatggcacatgtatacatatgtaacaaacctgcacgttgtgcacatgtaccctaaaacttaaagtataataaaaaaaatacaataaaataaaataaataaaaaataaaaatacaaaaataagccgggcatggtggcgcatgcctgtaatcccagctactccggaggctgaggcaggagaactgcttgaacccaggaggcggaggttgcagtgagccgagatcacaccatggcactccagcctgggtgacagagcaaaactctgtctcaaaaaaaaaaaaaaaaaaaaaaaggaatagctctccctgctcactcttggtgtccggttgtatgaaatgcctttttccacctgtttacctgaagtttatgtgagtccttatgtgttaggtgagtctcctgaaggcagcagatggttggtgagttctgcagttttgtatcctttaagtggagcatttaggccatttatattcaatgttagtattgagatgtgaggtaccgttgcattcatcgtgcatttgttgcctgtgtactttggtttttttgttttttgtttttgctttttaacttgtatttttgttttataggtcctgtgtgatttatgctttaaagtggttctcttttaatgtgtttccaggatttgtttcaagatttagagctcgttttagcagttcttgtactggtggcttggtagtggcaaattctctcagcatttgtttgtctgaaaaagactgtatctttccttcatatatgatgcttagtttcactagatacaaaattcctggctgataattgttttgtttgaggaggcctgaagatagggtcccaatcccttctagctagtagggtttctgatgagaaatctgctgttaatctgataggttttcctttataggttacctgatgcttctgtctcacagctgttaagattctttcctttgtcttccacactgttgattactgtagcttcatagcaagacttaaaattggatattgtgacttttccatctttgttcttttttcaaagttgttttggccatttcagtccttttgcctttgcatataaatttcacagtcagcttttatatctgcaaaaactgctggcattttgattggaactgcattaaatctataaatcagtttgagaatttatatcttaactatatcaaatattccagttaatcaacatgatacatctcttcatttatttgggtaatattttattcctttcatcagcatcttatagttttcagcctatagattctacatgttttgttaggtttatacctaagtattttttttttttttttgagacagagtctctctgtcgcccaggctggagcaagctccgcctcccaggttcacgccattctcctgcctcagcctctagagtagctgggactacaggtgcccgccaccacgcctggctaatttctttgtatttttagtagagatggggtttcaccgggttagccaaggatggtctcgatctcctgaccttgtgatcgccttcctcagcctcccaaagtgctgggattacaggcgtgagccaccgcgcccagctatacctaagtatttcttaagctaatataatttgtttgtttgtttgtttgtttttagatggagtttcactcttgttgcccagtctggagtgcagtggtgtgatctcggctcactgcaacctctgcctcctgggttcaggtgattctcctgcctcagcctcccaagtagctgggattacatgcatccctatgcctggctaatttttgtatttttagtagagacagggtttcaccacattggtcaggctggtctcgaactccctgacctcaggtgatccacccaccctggcctcccaaagtgttgggattactgacgtgagccactgcacccggcctaatgtaaatttttctattttagatttcagtttctaatttatttcttgtatatagagatatgatgatttttttgtatgtgaacttgtatcttacaaccttgttaaagtcacttgttctagaagctttattataggtttcttgggatttgctatatagataatcatagtccatgaaaagtgatagttttatttcttcctgtctaatctatatgccttttctttgtttcttttttcccccatttttacagacttccagtaagatatcaaatgtgggtagcgagactggacatccatgcattcttcctgattttagggaaaaaacattcagtttttcactattaagtatgatattccctgcttgttttttttgttttgttttgtttttgagacaaggtgttactctgacagccaagctggagtgtagtggcgcgaacgcagctcactgcaacctctacctcccaggcttgagcaatcctcccacctcagccttcgaagtagctgggatcacaggcacatgccaccacacttggctaatttttaaaatttttttgtagagacagggttttgccatgttgcccaggctggtcttgaattcctgagctcaagtgatccactcaccttggcctaccaaagtactggattacaggcatgagccaccatgccctagctgctagttttagtacattcattttatcaggtcgggtaagttcccttctattcctagtttactgagaattttatcaggaatgaatgttgaattttgtcaaatgctttttctatatgaattgatatgatcatatgatttttttcttgtttagtctgttaatataatgaattacattggttttcagataatgaacctactttgcatttctggggtaaatgccacttggtggtgatgtattctcctatattgttggatatgatttgctaatattttttttgagatggagtttcactcttgttgaccaggctggagtgcaatggtacgatctcagctcactgcaacctccgccttctgggttcaagtgattctcctgcctcagcctcccgagtagctgggattacaggcacccaccaccatgctcagctaattttttgtatttttagtagagatggggtttcaccatattggccagactggtcttgaactcctgacatcccgtgatccaaccgccctgcctcccaaagtgctgaaattataggtgtgagccaccatacccagccaatttgctaatctttttgttgagaagttttgcattatctgtgttcactaggatattggtctgtagttttgtttttttcttgtcctgtctttgtttagttttggtatcaggataatactgaccttataagataagttgggatatgttccctttaacattaaaaaaatattttcggaaaaagattttgtagaattctccagggaaaccatctgagcctagggttttctttgtgtgaaggttttaaactataggttagatttctctaatagatatagaacaattcaggttgtcatttcttttggggtgagttttaatactttgtggctttcaaggaattggtccatttaatttttgttgtcaaatttatgtgtatagatttgtctgtagtatttccttattcttttaacatctatggaggtctatggtgatatactttcttttattcctgatattgatagtttgtatattcattcttttttttccctttggctagaggcttattaatgttattcatcttttcaaagaaccagcttttcctatattaattttcctctatttttctgttttcaatgtagttgatttctgttctttattttctttcttctgctttctttaatttactcttccttttctgtttttctaaggtggaaacttggattgttgatttgagacctttcttcttttctaatataatctcttaatgctacaaatttccctctaggtactgttgtccctgcattttacaaattttgatatgttgatttttgtttcccctgagactttctctttgacctgtggattatttagaagtatgttgtttggagtgttgggagatttgtcagtgtctttgttttattgatttctagtttattccattatgattagagagcatactttgtattatttcaatattttacaatttgttagggtttgttttatgaccaagatatgatctagcttggcgactgtacatgtgtacttgaagataatgtatattctgttgttaggtggaatgttctatgaatattgatatctattcaagttggttgatggtggtgtttagtttctctgtatccctgattattttctgtctacttgttttattgattactaagaaaggaaaattgactatacttgtggatttgtccattttatccttagttttgtccatcgactatacttgtggatttgtccattttatccttagttttgttagtttttattttgtatatttgaaggttcttttgttagttacatacacattttggattgttatgtcttttagtgaattgactttttaaaatcattatttagtgtctctatccctggtaattttccttgctttgaagtctactttatctgatattaatataatcatcctacctttctgtcggttcatattttcatggcatttattttccactttttacttaaaagacatttttcccttgaaataatttcagatttatagaagtgttgcaaaaatagtaaagagagttcttgtattttcttcacccagcttcccctaatgttagcatcttatataacagtgatacatttgttaaaactaagacatttacattggtataatactttattaggtaagctacagacttcatttggatttcaccaaattttctactaatgtccttttttctgatccaggatccggtccaggataccatattgcatttaacattctatttttaacttacatttatcgtatttaatgtgggtttctggtagatagcatactgtatgttctttttttttttttttaaatccattctgacaacctctcttcttcttattcctttttgaaaaaattgtattgtggtaagaacattttacatgagatgtaccctcttaacaaattttaagtgtacaatacagtattgttaattatatgttcaatgttgtacaggagatctccagaatttattcatcttacttaactgaaagtttatgcccattgattagtaactgcccatgacaatctcttttagttggtatgtttagaccaccttcatttaatgtagttattaatatgtttgggtggtctgtcattttatttgttttctatttccttttccttcttttggattatttttaatattctattttttttttactgttttcattatatagttattttagtgtagcactaggaattacaatgtacatacttaagtgttcagtctacttagaattaatatattaccactttaagtggaatatagaaatgttagtaccaccaggtgcagtggtgcacacctataatccaaacactttgggaggccaaggtgggcagatcgcttgagcccaggaatttgagactagcctgagcaacatggtaaaaccctatccctacaaaaaatacaaaaattagtgggcgtggtggctcatgcctgtggtcccagcttctctggaggctggggtgaaggattacttgagcctgggagtttgaggctgcagtgagctgtgatcacaccattgtcttccagctacggcagcagggtaaaaccctgtctgaaacaaaaacaaaagaaaaaaaaatgttagtaccgtgtagatctctttactgtctcccttttatgttgtaattttcatacatattgcatctacatgcatgaaaacccaatcaataatgttataatttgtgcttttcaaccatcatttatattttattattatttttaaaaattattttttgtggagacaaggtcttactctgtcacccaggctggagtgcagtggtacaatcgtagctcactgcagcctcaaacttctgggcttaagtgatcctctcacctcagcctcctgggtagataggactataggtgcatgtcatccttcatgcctggctaatttaaagaaaaaattttttttttgcagagatgagggtctgactgtgttgcccaggctggtcttaaactcttggcctccagcagtcctgtcatcttggcctcccaaaatggtgagactacaggcgtgagccaccacagttggcctcatcatttatattttaaagaccctaaaaggagtaaaatgggtattacatttaccttggtatttaccacttctattgctcttccttgtttcctgaagttctaaatttccctgtaatattattttccctccatctaaagaatttcctttagcatttcttttagagcagtctgctagtgatgaattattttggttttctttatatgagaatttctgtatttcatcatcatcttttaaaaatattttcactagatatacaattctgggttgacatttgtttcttttcattttcccccagcacttaaaagtgtttcactgggctaggccaggtgcagtggctcacacctggctcacggatcacttgaggtcaggagttcgagaccagcctggctaacatggtgaaacctgtctctactaaaaatacaaaaaaaaattagccagacatggtggtgggcacctgtagtcccagctactcaggaggttgaggcaggagaatcatttgaacccgggaggcggaggtacagtgagcaaagaatgcaccactgcaccccagcctgggcaacagagtgaaactgtctccaaacaaacaaacaaaaagtgtttcactgggttgggcatggtggttcctgcttgtcatctccgcactttgggaggctgacatgggaggactgcctgagcccaggagtttgagacaggctgggcaacatagggagacccccatctctacaaataataaaaaattagccaggcatggtggtgcatacctgtagtcccagctactcaggaggctgaggtgggaggatcacttgagcctgggaagttgaggctgcagtgagccatgatcatgccactgcactccagcctgagtgacagagtgagaccctgtctcaaaaaaaaaaaaaaagttttactgtcttttgttatgatttctgttgggaaatttcagtcattcaaattattgtttccctatgtgtaatgtatcctttttctcttactgctttcaagattttttattttagttttcattggtttgatcatgatgtttttgcacaaggatttctttgagtttatcctgtttggtgatcactgagtttcttaaatctgtaagtttatgtcttcttaaatttgggaagttttagccattgtttcttcaaatactttttgtgcactatactttctccttacctgttgggcctttgatacaaatgttaagtcttttggtgttgtcccatgggtcattgagattctgtgctttttttccttcgtttctaatttttttctctctctcttgttcagcttggataatttgtgtattttcaagttcatcaactattctgtcatctctattatactattgagcccatccaatgaattttaaaatttctgttattgtgttttctaatttaaaattttccatttggttcttttttaaaaaagtgttctatttcttcattaagactttttatttttccatttatttcaagactgtttgcctttccttctttgagcatacttagaatagctgcattaaagcctttgccaattctaacatcttgcattgatatctgttgattgtctttttccttgtgagatgttgagattttcaagtttttttgtatgttagtttgaatttgtatcctgaacactttcaaattgttagaagactttgggtcttgtttaaatcatatagagaatgtttcttgcttatttgttttagcaggcaatccagttagattcaggttgcaaattccttcctgccttctgtgggctggggtccaaaatcagttcagttttcaaagtatttgccattctatttctgtttattccaggtatgtcccagctagtggccagtttcagatctgggcagcagtatactccagagattagttgtcaaaacctttggtgtgctgtttagggccagatacatgcatgcacagcttggagatgagccccggaattcatatacagccttattgagctcctttctcttgttgtttcccagactttccagatctgaagggtttcccatcctgctaccctgcctagaagtcttggacttttagtttctctattctgccttttacttcctatgaccacatctcccttgagaaccaaatggcaagatacggagagtcaacgaagcaagggaggctttcctgtgctcttgggatcccagcttccctggtcagggaagaacttttgctattgactgccactgctgcttaactactgtgaggtagggcaggagagagcaggaaacacacacacaattcagattttctcccttccctttcgtgtctaggggctcccttttctgtttcttggaccagaaatggaggtcttctcctgtagctttttctgtctgtgcttggggcacagttctggatttggctgccttttttgagtccaggccaagagataccagagcaacacacacacacacacacacacacacacacacacacacacacacacacacagaaagaaaaaaaggcaaaactctgctggttttgtgatactttgaattgtgggtttcttttcctaaactatctgctatcaattatttttcagagtcattaagtaatggatggagcagctctgtccaaggattttagttgaatacagtgggagatacagggtagagtgggcttacttcatcttatctggagtgagaaactttggttatttgagagaggaacaaggctggcaggtgtgagaaaggtggtggctttgaggcaggttctcaaccttgagagatcaagtgactagattgacaggcctcgaggtcctgggaggagacaccctgaggaatgacttcagtatttttgatgcaggatgccctctcctcctcctttttaatttttaaatttaagtaaaatgttttttaaaatatataatatctgcacttagcaccagattggaaagctgtaaagggaacaaagtaagagaggtaagtcttcctcagttacctacctcctagccacacagttcctttccctggaggcaaccacttcccagtttctcatgtgtctttacagagactttgtacttattaccaaactggaatatggataagtgtgcatatattaacaaaaatggcagtgtactgtacacactattatataccttactttttctcttaatatgtcctggaggcctttccatatcagtgtccagagaaggcctcgttctttttagcagctgtgcagaatgccattaaatggatatactatcatttatttaataagtcctttattgatgggcatttatttcattaatgaatattcagtaaataaatatttattccattaatttcaaactctccttattatgggaaagttgcattcaatatccttgtatacatattttgcatatgtgaggctatatagaataaatacctgggattagaattgctgggctaatgatgtgtgtccatttaaaactgttaatagcatattgttaacttatttcatatcactacaaataatccatcaacttttaagccttgatatggtaaggaatattagaataggtaatagaagccttcatataatcttaaatctttattcaaactcaggttaacatttaactcaggttttaccaagtcttttaccaaaattatgtggaaaaaaataaaaaggattaactgacattttccttctttccttacccttctaattctagtaagagatgtgtcaacaagctgtgaaaagaatatcataaaatgactaaatagtaaacaaccaaaagggaaggatataacagtcaagaggatttagatgaccaattgattggacagtcagttcccaatcctcaaatgttggttggattaaagcttttcttctaagaacattttgtctatcatgtgttctcacctacacaagcatgtctgtattagtagagagggcaggtggaagttgttatttactgtactgatgtactgatggtggaatagaagccctgcaaaagtgataatcatttttttcctggtccctagatcaagacattcagtgtgaaaaaattttgtgcaagaaacagtcttagagaagtatttaatattatggagaccaaagagttgtcatttagggttgttttgatggattgtggtgataattttaagtcaaagctttcttggaaaatctgagatgcagatttttcaatacaatggagcattttcttaataacaatcattttaatgttatactagtgaccaaaaatcagatcagtggatgcttgcttaaagtttttcatgtttacttgggtatgattgtattggtttttacttcaattaatttcaataaatcatgaataaaattagctttaaaattaatctgaaaaagactatttttaagtgaataatgtgttctttatatgggaggactctacttggataaattgttaagtaataaaacaggttttggtagctcttcaaatagtcatctttaattttttctttatataactctatatttgagaaattgggatgagcacgtattagtttgtaaagaaatgcaatgcagtagaaactgtaaaagaaagaaaaacagctaacttggaaggctgtgcacttaatagaatgaagcaatcattgcataaaacattcttggaatttctattttgaattttgccttctgaacctgttccacatcagctagacttaaaaaaaaaaagaaaaaaactatgtgtggtgattcacgcctgtaatcccagcactttggagggccgaagcaagaggatcgcttgagctcaggagtttgagaccagtctgggcaacatagtgagacaccatctctatttaaaaaaaaaaaaaaattaggtgtggtagcacacgcctgtggtcccagctactcgggaggctgaggcgggaggatggattgagcccaggaggttgaggctgtagtgagccatggttacaccactgcattccagcctgggtgacagagtgagaccctgtctcaaaaaaacgtggggcctcataggatcagaaaccacggtggagcagactatgaaggagaaatatgatggttcttataatggcttcagtggggctggctttctggaagatgttcaggtatttatccttggtctctcctcagctgctttatagagtaatgcagtagaggaaagactgtcaagaaattttttattacttaggtgctatatcgtttgctttttaacttcataaaattttttggccatctctgcttagtatataaagcaagttgagcaagtgtggctcttgccaactataaacttaggtcacttgggtctggaaattccctcttgaatgctatttcctgaatttgatttagagatcagagtttacgtggtcaatgtacgtctttcccacaggatagccaatgaattcttagagttttaaaccatcactctaaagcatgctaatttgcatttagaaatacaaagtgcatcatattggtgaccccttttagatagtgggatgggtatcagatgttacccattagttctgatgtcttaggcagagcctatgcagttatttggccacagactaggacattgctagtatattatctattcatgtatatgatgatgattcttggaataatttcctctggatgtggagagactagggcagtacagatttctttaattctgtgtcagagcagtagtgagtaagaaggaaggggcagagtgtcagccacagctacaggcctcttacaggcagtctagggtccagaccagacacgatgagcatcccaacagaggcctgagttctgcgatgtaggcagaatgaccagagagacccagtttatctcatccggagatttggaagggaagaaaggagtccacatcaaagaaagaatgtgtacgcctgtgttttcaggattctgtctgcctctggtaaggaagcatctgaccgtgaatgtgccatggaagctttctcttcattaatagaagtatcattacaggagactcagttcacaagacagtatctcaagtgcactttgttctctgtagaaagaggtacccaataacatgatcatatacttctgtcacatagaaatgttgcaaataaatttttaataagttaaacagttaatttttctcgctaacttgaccttaaaccagcattagattttttaaaatcaactttttattttggaataattttaggtttacagcaaagttgcaaggggaatacggagaattcctgtatatgcctcacctggtttcccataatgttaatatatcaccatggtgtatttgtcagaactaagaaaccaatgttggtacattactattaactaaattccacactttatttggattttaccacttttcacactgatgtcctttttctgttccaggattcagtcaagagtattacattgcattgtcattatgtctccttagtctcttctggtgtgtgacagtttctcagacttcccttgttttttaataaccttggtaggtttgaggatactgatgaggtattttgtagaacacccctcaatttaggtttgtatgatgtttttctcatgattagactggggttatggatttttgggaagactactacagaggtgaagtgccttcctcatatcatattggaagaatatactaacatgacttattacagataatgttaattttgatcatttggttgtgttagtgtttgctaggtttctcactataaagttactattttttttctctttctatactgcattctttggcaatgggtcaccaagtccagcccacgcttgggggaggaggagtgaggattaagctttacctcctacagagggtattatctacttatattatctggaattcttctgcaaaggaagattttccccttctacctatttgtttatttattgagttgttaatttgtatctctatggacttgtatttattttataccttgggttataatacaataccatgctatttattttcttcctgaaattgttctagctttggcttctggggcctcttccaggttaacttctgtgtcactttgacatgtcctcatccttttgctacttgagcacctccctacttttttagaattagaagatgttccaggttcatcttgtattttccttgccccggctctagaatcagctttttctaaagagccctagttctttttattggagaaaccaagttctgagcattgggttgcatgctgctagtaggccctctcagtgaatagagttaggaaataaaagtatgtatgctaacccatgtatatatacatatttctaattatttctgtatctatcagtctgtatatatgctaagctaaacgtggatttgcactggtatctttgactccaactcagtactgcagagttcattctagcctttcccccttgcagatctgcatttcactctctggcaatgagaaacctgcctctcatcatccaccgtggtagatggggagtttacttatttgttcaaacccttacacatgtaaagcaggttcagatttgttaacttatactcctatgagctacgatttaccaattagagttccatgtttatgtacagattattttgtcattagcctatagttgtcagtcaaaacactattttctttttttttattattatactttaagttttagggtacatgtgcacaacgtgcaggttagttacatatgtaaacatgtgccatgttggtgtgctgcacccattaactcgtcatttaacattaggtatatcttctaatgctatcccttcctcctccccccaccccacaacaggccccggtgtgtgatgttccccttcctgtgtccatgtgttctcattgttcaattcccacctatgagtgagaacatgcggtgtttggttttttgtccttgtgatagtttgctgagaatgatggtttccagcttcatccatgtccctacaaaggacatgaactcatcgtttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcctttgggtatatacccagtaatgggattgctgggtctaatggtatttctagttcaagatccctgaggaatcgccacactgacttccacaagggttgaactagtttacagtcccaccaacagtgtaaaagtgttcctatttctccacatcctctctagcacctgttgtttcctgactttttaatgatcgccattctaactggtgtgagatggtatctcactgtggttttgatttgcatttttctgatggccagtgatgatgagcattttttcatgtgttttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccgttgcttttggtgttttagacatgaagtccttgcccatgcctatgtcctgaatggtattgcctaggttttgttttagggtttttatggttttaggtctaacgtttaagtctttaatccatcttgaattaatttttgtataaggtgtaaggaagggatccagtttcagctttctacatatggctagccagtttttccagcaccgtttattaaatagggaatcctttccccatttcttgttcaaaacactattttctaaggttatataggccagcttttttttttcctctacccccttcagtgagtttatgtcatacatttataatatgttaggttcatttgtcacagtctacatcctatcctgggattccctgacatactggttctcttgaaaaaacgtacataccttaaagttcactctttgtaaggtacagttctacggattttaacaaatgcatagagtaacgtatgttccaccctagtaacacatagaataattccgttatcctaaaagtttccctgtgcatctccctgtagtcaaacaccttccactgcaaaccctgataactagtaatctgtttttcatccctgtagttttgccttttccaaaatgtcacgtgagtggaatcatataatttgtagtctttcacctagcaaaatgtatttaagattcactcatattgttgcaagaatcaatggcttgttgctttttgttgttgactaatcgtccattctatggtataccacagtttctttattcagtcacctgtcaaaagacgttgttgcttccagttttggatgcttatacacaaagctgctataaatatttgtgtacaggtttttatgtgaacctggttttcagttaacttggatcaataactaggttgtgattgctgggtcatattttaagtttatatttaactttataggaagttgtcaaactgtgcggtattagagtttaatcacccctccccctcttttgtttttttggacagagggaataattaaacaatcgctaagattcaggccaaaaatgtcaactaattatctacttgtctgtgtaaaattcagcttatcaagtaactgctgtatacatagcattgaatttgttgagtggtagaagtttttaaaggagtttgctatctaatacggaaggtgagagtttgtaagcagtgatgtaagccaccatttaggattaagttgggttgggttctagttctttgtgtctggtggcaatagtagtggtagtatccagttgatttgtggccattgatgtaatttataaaggtgactcagtgactacacagagtggtcaatgtcattgaaaggaaagtttattacttacatttcccaagacaagagggcattctgcaccacacagggccgcagagggaagcaccagtttcagtcaggaggcagaaggagcgaggggaaagcatggtccagagctcttactatgttttccttgggaaaggcaaggcagggcaggagaaacaggttagaattggccaatttgaataattccagtgggctttagggctgtccttagttgtctggtacctggtcctgggttgatttagggcaggtgaaatgttggcttgatgtgtgagagttagataaaggaggtggttcagagaatggactttggctctcgggaggtttaaacaactttggccattagtttggccttgtgatctatggatgccagatagacaaatacagaatcagcaaaaacacagaatacccaacacgaccttcctgcatagagctctccgtacctaccagttgaattatttaattcaatgcattattgactgccaactttgaaatgggtacagaaatttatagatgaagactttgtcctcaaggagctcgtgatatatcatgaaaaaccattcattcattaattaagcaaacatttattgaatatctaccatgcaccaggaacttgctagtctttgaagattacagggctttaatcaaacagatggaaaatttataacaaaatagagtatgtttctcttccttataaacattagtatttaggacaaaaatacattctctcattttgctgtgttttctttctcttacctctcccacctccactctccaattgttttctggatttttaaaaagatttatttatttatattaaattattaattgatatttaattatatattctattatatgtaaattagtatttatttatttatttagatttttttagcttggattatggatttgagttttcacattcatgaacatgtaagcaaaagcatgtgattgacagattttcttttaaggatctggggcagatatttaaaaaaactcaaaagttttcatttagttgtctttttactattgcctctaacaggcagtaatgggggaagtagcatagttatatgtatgtgtggctgaaggagtgggaagatgaggtgctgtgggggaatattagcttgtgaggagagttagagactagggactaggagtaggagacttattctagtgttggttttgttgttaacatatacactttgggtagatgtcttcctctttctaaagcctcagtttccttgtttagagaacagggttcatgattacaacttgttctatcttatattattgttaaacatgaaatgagataataaatatcagccttaaagtgcaatacaattgtaaagtatgttataaggccttaaccataaaagcctcagaaaatattgagggaatgaatgagtgtatctctttgagacgcagtcttgctctgttgccagggaggagtacagtggcacgatctcggctcactgcaatctctgcctcccaggttcaagggattctcctgcctcagcctcccaagtagctgggattacaggcatgcaccaccacacctagctagtttttgtatttttcgtagagacaggatttcaccgtgttggccagggtggtctcgatctcctgacctcgtgattcccccagcctcggcttcccaaattgctgggattacaggcatgagccattgtgcccagccctcttttttcttctgtttctgacatttactacaagaaataagcactgagagcccttgatcttcttttctgaattgtctagtattaataatttatagctataatttagtaatcatgtgctttcttgtatttagttatatttttgaatgagttagtctcagcacttcaaggacagtaactagggagcattcatattttctgtctcctagagtgcaaagtacattatagttgcttatcaactatttgttgattcattgatacttgttgaatgtgtagaacatccaaataaaacctttggagactaatgctaaagcaggatatatgcaagtgaatgagaaattggtatacagactgggagagatcatcatggaatggagttgataaaaaggacttgatagaaggttcaagggagatcctgacacagacctttaagacattgtaggtttagtttagggaacagaagggcatgccaggtggaggattagaggcaggaatgagaatggcattagaagatgaatgactggtggaatgacagtaaaggtcaaattggtaaaggtcaaattggtgaatttttaagactagtttacatttagcatagacaagtgacctccaaattttgtttagaagtgactcattgtgattatgtggactggcccttcaaggttgagacttaatgcttacaaagtcccttgcttctgcagaagaaatctctgaggctactgatgtcactaataatataatccatgtagagtgtcagaggttttttagctgttttgtagcctggttaagcagatagggcaagaattagcaatctttatggagatgtgccaaagtttgggttactctccttctggagggtgaagaggattcttattctgtagggattcgcacaatctgggagtggtggggggaaaggggtggtggtgactgcatgctggccccagctgtaggtgacttatagagactgtttcaagtggaaagaagagttgagtattggtgtcaacaggctggtgtttgtgtgggccagcaatttggtacttccaccctgaaataaagatatctttcttattcaagaattatagcaagttggcagatacccacctgtttcatgttcgctttcaatctagttgtatattagtaagtactggttatatattattaagtgctagtctggataatatttttacggatgagctgggcaacatgatgtagacatgattacctggtcttgagaatttcagtccagggctcttaaacctagataaacatagaagtgtgtatagacaagtttctgaaagtctgtctggtgtgtttataatggaagatgcagtagctatcttctgactttgaagaactgccatgcagaacagggatttgactactgtttggcctcaaaaactagcagtagagtaattgatgggtgaaagctcgtagaggcaaattctaacagtacttgagaaatagatttctttattagcagatgaaatgggctgcttaggaggtcactgttctctgtctgtcatagctattgatatggcagaggctattttttcctggtaatttgtgaaggaagtaccagcatcagtcagtggtagagctatcagagtgtctcaatcttggcctttggcattattgacattttgaactagtaattcttccttgtggggctgttctgtgcattgtaagatgtttagtagcatccctggcctctaccactacttgcctgtggttccctcagcccccaagttgtgacactcaaaaatgtctccagacattgccagatgttccctgaaggacaaagtcacacaggtatagaacctctgggctaggtgaaattcaggtaccttgcaactctggtaatttatacttttttgttttgcaagtgaattctgcatcagttttgcaaaaaaaaaaaaaaaaaaaaaaagtgaaaatggtttagaggacgtacataattgatgtggtggtgttctgtttccttccaattcagggagactttatggggatggaagtttttcagaatctttgagtgatattgtgataagcttggaattagcaggatattctctgtggcatactcttgggagagggctaagaggtgggaaggagaagctgagatgaggtttgagtggtgacacctgggatgactactgtgagggagaagaggagagaggagaggtgtgaattagttgtggcagccagatcaggttatggccatgcagagcactgaggttctcttcctgatggctgtcttcatccttcttctctcccaaagcctgtgcaattctatggtggaggagggagtgccggggaaattataaggtttaatcttgtcttgaattttatctcctccatttcctagttttgacctggccaagtttcttaacttcactgtgccatgattttttcattttgaaaaattgtggtaaaatatacataatataaaatttaccatttttaccattttttaagtgtatggcttagtggcattaaatacattcacattgttatgtaaccatcagcaccatccatttccagaaggtttttatcttccctaacttaaactctagctattaaacatgaactccccattccctgctcccaagcctctgacaaccgccattctacttgctatctctatggatcgaccactctagggatctcatataagaagaattacacagtatttgtctttcttcaactggcgtattttacttagcataatgtcttcaagggtgatcgatgttgtagcatgtgtcatgatttccttcctttttgaggctgaataatattccgttgtgtgcatataccacattttgtttccattcatctgtcagtggacactttaggttacttccatctttggctattgtgaatgatgttgctgtggcattttgtttcattttcattgtaaaatgattttaaaaatgatgcttcttccacagcattctggcgtctgtccggaaaggctccttgtagagtgctgggcactggctcatgacaagtgacacttcctctcctcacctttttgatgccagttcattgcacttttgcttcttttatatctccctcctagtataagtaatcaaacccaagcagagactaatgaattttttttcctgccaattcaagtccattctaggactgacaatttccaatcaatgttctctgaactgtttgtttcaagacttgtcaatctttggaaatttgagtttgttctaatactgccttatatgttcagattctctttaatggctctgagagtccttcactacatctcattgtcacacttttctctaaaataatttgttacaaagccttgctaatggcagcttgctgtgcccagggtcctgaggtcccatcatcaagcgttttgattcatctgccattcaaaagactattgatatcccgagggcaagttttagatacacttggtgaatttcattgctttgttcctttgacttcttcctttaaacacccaggctccctccctctgtgggaaggcgtatttttggctggcccttttctatctgtgccatctgtcacaggggtcattgctcagaggctggcttcctccctgctgggagcaggtggtcaaaaccaatggctattgacagggtcaggttggggcagcttaccaatatgccccccaagcagtatgcatagttgttctccttcagaggaacaagagaaaaccttacttgggggtctttttctgcattaaagaggaaaagatgcagatgtgattctaagttgtttatttattcttgtggtccagccacttgtcaactgtcctgtctgtgctcttgtctctgcgtacttcaactggcactgtactttaagaccactacctgaagcagcctccagtgtagcaagaaagcaacatctgtgaaaattatggatgatagaattactcaagctggttcatgtctaagatgctagaggtgatgatcctgacccttgatcaaacaaaataaaatatccctgaagtcttttgatgatctctggtggtaaagacccttgtttcaaagtcttatttaaagagatcatacttccaagcacttaggattctgggcctgactcacaggagagccagcccagtgctgagtcacttagccaacttcattcattgatcatgtgcttgtgcacagcttggtggcaaggtgggagagaattactattttcaaatgttccttcctgaggtagcatagtccagaagtaagccgagagacaggatgctagagttctattcttggcccagctatgcaccttcagcaagatacatccccccactcccctgtctaatataggaggatccagggaaataagtaaaacaagtaaaacagataagaacagaagagtttttaaaaatgcttttcccagagagattgtggctcccaaacccatgtctacctggctggccaggttttgttgccaccacttgttcaaggaacttaccatagcctccactgataaggaagaatttcttctcaaaaaagaaattctggaattcctagtctttgttctttttcaaacctttaatgcttctttcctgcagtactcattacattatgcttgggtatattaatctttttaaaagcacaaatgatttttctgctaagtgggggaaataattcagaacagtttatagaataagtagtcttagatatgtagtctcaggttactgaaatcagcttgactcagtgtaaggcattgctggtttctttggggcctccctagttctcctttgagttctagtgttggtgacactcccctcccttgtggctgtactcttatgtctaacctcagtcttagacataattatgctttcacctcttctcatccctggagaggtaaaatcttttctacctagtcctcaagcattgtccacaacctagggtcgtatcataacagttcttttggctgacacctgaaccacactgtagtggtatctctaaatttgctcatagaatttatttttaatatgaaatataagaagcatacagcaaactacagagaataatataatatttactttggatctttcttttatgaacaagagaattcatgatgagtacacttgaagcctgaggcatcatgtcaacccctcttcccagcgcttttgaacaagccttttttgttcaaggcactttgcagcatgcttagcttccctgtaggaagtctgccttccatgacctatattcattattctgtttcctccgtgcttttacagcccccttcccacccctcactgtgaccttgggcaaattgctttacctctctgagctttatatttctgatctatacaataagaataataacaacatctgcctgctctgggttattttgagattcaaatgtggtaatatatgtgaagtactttgttaagctctgtgttacacatggcatcgatcatctgtatagagaaactacaacactgttttccaagctgtggaagagggtgctgaggggaggagggtagccaagagatgtggtggatcagaatccccacaggctttttcaaactgctatgtatctaccagcactggtatgtgtgtgcatactcatatatacacatatacatttacacataacaattagaaatattttgaaggtagggaccaagagaaataatctcttatctagattcccttctagcatcttcatggttctgtgttttctctcccacatggttttaaactgggatggccaataaaaaatgtcagtttcttagtttctgtatgctcaaagttcacattttaagtaagaatcttcatcaactgtttggccgaggaggtttgctttcaccagttatgctttgtgaaattcctcccaccaattcttaatctagaatatgtctttctctccttggtgctctgtctttcctgctgcatgtggtctgaaaaaggttctcctgctgtgtaagcattatggatgcctcagcacttcctctgttgcacattaaacttgaaggcagttggggtgtactcactgttggatcgtttctgtaccactgtgtgtctgttctctatagacgtcctggttgctggtcattgtctcttagtgttccatgttgacgtaatcatatgcattttatttgattatgatactctggcgcagactagggaagagatactttggtgaaaatatctctgtataattgtatttaagaactattcagtcttatttttaaaaatatttgagattcaagaagaaatcttttaaggtcaagtgttgaaatcaaacacatcctagaacccattcattatactcctaggtatctacccaagagaaacttatgtgggcacatggcaatctggacaagaatgatgatggtaacattgttgatgatagcacatagttgttggaaacaaagttcacaacaggagagtggataaattatcttagagtcaaacaatgaactactgctatgggaaaatgcatgaattagaggaaaatgtatcaaaagaaataaatgtcaaacataatgtggaatagaaaaatgcaaatttcaggatatgatcaatatgttgcatttatataaagtttcggaacatgtaaaacaatctttattatatatggatacactgtttatatggcaataatacataaccctgcaagagagtgagagacacctaattcaggatagtagttgcttttgaggaggttagagaggaattgtatggaaaagaattatacaggggcgtccattgtgtctgcaaagttccattgctatctgtgtttttgtaatgcctgaaatatttcatgaaacaaatcaactgtaataaaaaggattcaaaatgcatatggaatatgatctacaacttttgaatgttattggcaaaggaaagaacatggatggatttcatagtggttctcttaagtattaggctcatagacggtttttaatttttatagttttctatatttttcaagttttctacaatgaaatacgtattattattattattattattattttttttttttgagactgagtcttgctgtcacccaggctggagtgcagtggcgcaatcgtagctcactgcaacctcctcctcctgggttcaagcgattctctggcctcagtctcccaagtagctgggattacaggtgcctgccaccacacccggctaatttttgtattttttagtagagacagggtttcaccatgttggccaggctgatcttgaactcctgacctcagataatctgcctgctttggcctcccaaagttctgggattacaggcgtgagccaccacacctagcaactgttagaatttttaaagccaaagaatgttatttaatattatgtaaaatcatgtgatgacaaatagtgatttttcaaagactgacagaatagtctacaagttaaccacttcctagtcagaagaaattctcatggggctagagacagactggatcaaactgcagagaaataaacaattttgatttgttgttattttccgtttatcttattcctaggacttcatacatcttactgttcgtagaacagatttctgtttcttctcagcttaggtatcacttttatagaaaactaccccttccctctctacaacacacttgcccctaatgctgggttatgtgaacctctagtaccttatccttaatgctgttgtgtcactgtattgtaattggctggtaatccatctatctctgctggagtttaagctccacaaggatgagatgtaggtattttgttcatcattgaatcagtgccaggacctagcacaatgtctgacacatagaaggcactggtaaataattcttgaatgaatgaatgaatgaatgaacgaaaggtcacaactgaaggggacattctggaaatggagccatttgatgggaaactttaaactaggtttttttcactcatagatacaagaatggtaattaggctgagtaataagatgtgagtaattctctctggaactcttaagtggaaaagtgaaaagccagagctttagatgctggtgccttactagaaataatgaatgagaaaatggggaaataaagaaagtacacccaagatagagataaataatatttaaaaagtttaaggtggttcctccttcattttatatgattttaagtgttgtttttaaatctggccttaaatgatatgatttcttaatattaggtatgttttatcagtattcattttttaacatacgtatagaaaaatgcaatgactgtatagcttcataaattttcagtgcacagcaacccagaagcccacccaacttctcctaatcactgcctttccccaaagataactactacacccagagtttttgtttttgtttgtttgttttgagacgcaatctcgctctgtcgcccaggctggagtgcaatggcgccatctgggctcattgcaagctctgcctcctaggttcacgccattctcctgcctcagcctcccaagtaggtaggactacaggaacccgccaccacgcctggctaattttttttctatttttagtagagacggggtttcaccatgttagttggggtggtcttgatctcctgacctcgtgatccgcctgcctcggcctcccaaagtgctgggattacatgcgtgaaccacagcgcctggccgagtatttgttttttaataatacaatctttatagaatgcctcaactcattatgtcgctgtttgtatctggagtaagtcagcctgttggcccatcaccatcttccacctagtaatctgaatgaaggcatggtaactttagcccaagaaggtgctccattttattgacaacaaatgtcatactcccaaatcatcatttaacttttattgcagagatcctaaactatgggtgtgtagaaaggtggagaacagaaatttacttatatagtttatttggcatgagctctggtttccttggatattgaagacctcaaaaccgctgggtctgttatttaagagatattaaaatcaatttgcttcccagtttcaacattgtctttcttaagacaatagctggataccattctttcatttatgccacaaacaactatccagtggcctactgtgttcctctttcagggcaaagcatgatgcaatgcaaggcattgtggagtatgtgatgattaataagcatactttttgccttaaggcacttataaccaagtaagcaaaatgaaatacataaatataaaacgatacaggcatacctcattttattgggctttgctttattgtaatttgcagatactgcatttttttacaaattgtaagtttgtgccaaacctgcattgattgagcaagtctgtcgggaccattttttccagaagcatatgctcactttgtgtctctgtgtcacattttggtaatttttgcaatatttcaatttttttcattattacatctgttatggcgatcagtgatctttgttgttactattgtaattgttctggggtgccatgaaccacactcatatgacagggaacttaataaatgttatgtgtgttctgactgctccactgaccagctgttcccccatctctctccctctcctcaggcctctcttttccctgagacacaacaatattgaaattaggccaactaatagccttacatggcctcttagtgttcaagtaaaaggaagagttgcacatctgtcaccttaaaggctagaaatgattaaacttagtgaggaaggcatatcaaaagccaacttaggccaaaagctaggccacttgtgccagttaaccaagttgttaatgcaaaggagcagttcttgaaggaaattaaaagtgctactctagtgaacacacaaataataagaaaatggaacagccttaatgctgatatggagaaagttcgaatggtctggatagaagatcgtactagccacaacatttccttaagccaacgcccaatccagagcaaggccctaattctctccaattctatgaaagctgagggaggtgaggaagctgcaggagaaaaattggaagctagcacaggttggttcaagagatttaagcaaagaagtcatctccagaacatgacagtataagatgaaggagcaagcgctgatggagaagctacagtaagttatccagaagatctagctaagatcattaattgatgacggtgaccatactaaacaatggattttgaatgtagagaaacaaccttctattggaagaagatgccatctaggactttcatagctagagaggagaagtcaattcctggcttcagagtttcaaaggacaggctgactctcctgttaggagctaatgcagctggtgactttaagtggaagccagcgcttatttaccattctgaaaatggtaattaatggcctcttaagaattatactagatctactctacctgtgccctataaatggaacaacaaggcctagataacaggatggtttactagatattttaagcccactgttgagacctactgctcagaaaaaaaagatccctttcaacatattaatactcattgacagtatacttggtcacccaagagctctgatggagatatacaaggagattaatgttgtattcatgccagctaacacaacatccattttgtagtccatggagcaaggactaatttcaactttcaagtcattagtttaaaaatacattttgtaaagctatagctgccataaatagtgatttatctgatggatctgggaaaagtaaactgaacaccttctggaaaagattcatcattctacaagccgtaagaatatctgtcatctgtgagaggaggtcaaaatgtcaacgtcaacaggagtttgaaaggagttattcctttttttttttttttttgagacggagtctcgctctgtcaccaggctggagtatagtggcgtgatcttggctcactgcaacctccgcctcccgggttctagcaattctgctgcctcagcctcctgagtagctgggactacaggcgcgtgccaccacacccaactaatttttgtatttttagtagagacggggtttcaccatgtcggccaggatggtctcgatctcttgacttcatgatccaccctcctcagcctcccaaagtgctgggattataggcatgagccaccacacccggccggaaggagttattctaaccctcatgaatgactttgaggagttcaggatgttcatgggggaggggactgcagatgtggtgaaaatagcaagagaactagaattagaagtggagcctagagatgtgactgaatggctgcaatctcatgataaaacttggacagatgagaggttgctttttatggatgagcaaagaaaaaatttttttttcttttttgagacagggtctcgctttatcgctcaggcttgagtgcagtggtgcaattatggctcactgcagccttgacctccgggctcaagtgatcctcccacccagcctacagcatagctgggactacaggcttcagccaccacacctggctaatttttgtatttttttgtagagacaaggttcaccttgttgcccaggctggtcttgaactcctgggctcaagcaatcttcctgccttggtctcccaaagtgctgggattacagcgtgctgggctgaaagtcgtttcctgagatggaatctcctcctggtgaagatgctgtgaggattgttgaaatgacaacaatatatttagaatattccctaaacttagttgataaagtagcagcaaggtttgagaggactgactccaattttgttttttcatttttgatttttttaagagacagggtcttgctctgtcacccaggctggagtgcagtggtgtgatcatagctcactgtagcctcgaactccctgactcaagtgatcctctcacctcagcctgccaagtaggtgggactatggctgcgcgccacagcgtgactcaaattgtgaaagatgctctgctgtggataaaatgctgtcaaataccattgtatgctacagagaaatcttttatgaaaggaagaattgatcaatacaggaaacttcattgttgtcttattttaagaaattgccacagccatcccattcttcggcaaccaccaccctgatcagtcagtcagtagcgatcaacattaaggctagaccctccactagcaaaaagatgacaactagctaaaggctcaggtgatcattagtttttttttttttagcaataaagtattttttgaattaaggtatatgcttttttttttttttttttttttttttttttttttttttgagatggggtctcagcttgttgcccaggctagcaggctagaatgcagtggcccaatcatggcccactgcagcctggacctcctgggctcaagtgattctcccacctcagctgggtagctgggactatgggtgtgcaccaccacactctgctaattttttttaagtttttttttttttaaaacacaggatctcactgttgcccaggcttgtcttaaactattggcctcaggtgagcctcctgccttgacctcacaaagtgctgggattacggatatgagcacatgtgcctggcctgtttttttttttttttttttttttttttttttttttttttttaagacagtgctttcctacacttaatagactacagcatagcataaacataacttttttatgcactgagaaaccaaaaaaattttgttactgactttattgtgatacttgctttattgtgatggtctgcaactgaacccacaataagcctgaggtatgcctgtactttaaagtagtcttttagaagtgatctaaaataccaggagggagggagagatttttttgatcgggggaataagaacaactgtcccaagcagcaataggtaagatagcattctaatcaataggaatggcacagccaaagtataggagtggaaaagtacagtaggagtgaggaatgtttttgtgaagcattagacacagcagagaacgtctattaataggttgaaaagagccctgagtgctcatttaaggatttgggactttattcaacaagcagtggagagtctgatgtttctgaggagaaaggagccatggctatcaaacccaaatttcctatcagttcctgattcatccaccagccaaggttactgtaccatccttgaggttgaatgggttgggccaactttgaggattagtgaaatcatttgttattaatgaagtggttaacaatagttaaggtaccatagcaattatgaacaatcttctgctttaatttttcctataggatcttttgctagtcaggtcttctctgagtagatgagagagataactttgaatgtctcagggaaaagtgtaagagtaagttttgttaatacaatacaagtgagattggaaatgcagttggctctccatatatgtagtttctccatccatagattcaaccagctgcagatcaaaaatatttgagagaaaaaacagtaaacataacagtaacaatttaaaaatacagtgtaacaactacttacatagcatttacatcatattaggtattataaggaatctagagattatttaaagtatataggaggctgtgcataggttatatgcaaatactacaccattttacataagagacttgagcatctggggattttgctatctaaaggggtagtgggagtgtgtgtatcttggaaccaatccccaatggataccaaggaaggactgtatattcttatcttactaccactgtgcttgtcccattttaacatttttttcctgaatgagaaataccatactgtacagaaaaagcacacagaatggagagtcaactcctgagtctaagtcctagctctgctacttattatctttgtgaccctgagcaagttacttaacctttgtgatcttgtcatatggtggtcaggagattccagttggaaagtagttgtgaaagcgttattaacaaaattgggatgtatgttgccttgcttgtatttggagatagtgtctcctgtaggcattgttgacattgtttatagatgcttctgaaaagaccaatgcgtgtcccacatcttatccactgtgcggaaaggcagtgtgttatagaaaatcactggggcggagagcagaaacactgaattccagcccacaccctcgccctggcagtgtaactcaaatgtaactacgacctcataagctaccctgcttttgtcttaaggtactgtaaaaacaaaccacaacagtcacaaaaacaacagaaaccacacacacacactcaaatccaattccaagagacttaaagaacaatgcagatctttactgcagaactgttgaaaagaagatgcattggacattctactactagacttcttaaaaagtactttttgcccgcattgtatactagttgtcctatctcctttttttctttctcctgcaccatgctctgcagcgtcagccacattcctagattgctccttcctggtctttttatcatcgccatcattatcattatttggagagttttccactttctcttcctacctattgttcttttcagcatgaggaaaatagctaattgaaacaagaaaggaatgatctcttcttagaaaatggacagggggccacttaatattttgtgcctgtgtcactggctgtttgatacaaggcaacctctttaaccccaaacaccttttctatgaagctggatctagcaatatttgctcctttaaactccaagtaaggatgagttgaggtaaaggataaggaaatgctctgtaaatgtgaaagtgctacacaaatatgaggttgcattaatttgtagcctcagcaactgtttgcaatttgtcactctgtcagctcaatctcctaagatcctaacaagtctgaaatcttgttcaggaaagttccactctgtttttaaacatggctggccacaatggattgttgctgccattcatagctaggctactgtgtatttttatatttatagttgtataccactttgtaagcttttgacaaacattctctcatctgatcctcacagtaccctgtgagatgattttatcacccccatggttgaagctgtacctcaggccttcccatcgtttttgcctcttctgcttgcagtcaccttatttgagcaccactacagctacttgggtaacccatcttctcttcccctgtaaaacttcatggaagtgtgagtgatgcttctgaatttggtcagtaggatatcctccagtaaccatttagtgggtctgctcttcggcctgttagcgattgattcagcaaatgaagagcaaaaagcacacaagcctgacatggcctttgtgatgcctgtatccagacctcttagccacactgaaggctgggtggcctcacagcttttgatttggagtttgatactgctttaatgccctattgtttaacccagtttcacagtaatcttttttggtcattgaagcaacctgagtgttccctgagtagcaaaacttcatgcgagctgtcagttctcttgttgtcattagaagtcttcatcttgttttcagagcttctttggagtaggaaagaacttgatcttagtcattgtcaaagatgtcatggtacggggaaaccatgtggactttggagagaggctgctcccaatgtgatcctaggaattcctgtattttcttcgagttcgagtctcgctttctttcctcacttgtaaaatgaagctgtcaatgcctgcctaattaggttgttatgaagattaaatgtaatgtttatagagtgcctgtatatattattataacgttcataggtattacacctgctttgcagacaggcccataaccactttgatgtatcttctttacttctgtgtatttgggcatgtctatttcaagagaactttattaataattaactccagatctatattgttgaaagaattgccattgaattctggagttgaaagagagccaattgttattttgtataatagtttagagccatccttatactctgcaggagaggaatgaggtggacttgaggctcattcctgcttcaaccagagcagaaatacttttgtctatattatatattgacatttcgtgtaagatatgatttgaaaaagacttccactgattgaaaacaaaaaaactttaaaattttaatgcaactttcttcctgtccaacacagaaatctattttccaacatgacagacagataatgacttaggagagtgtatcctgataccaggtttaaattctaagctttccaatgcctggaatgtagtagacactcaagacgttctcattgaatggataaattcttggtcattgttgtgttaagggtcaactgaatagtgctggacctttgttctagcctgtgtgtgtgcattttcattactttattcaacacataattatttgatgatagattttgagtcaggatattattccttctgatttaagcctctatgttttttgaatcttggtaatcctgtcagagaaaccaactttgcttagtctgtcagattccaggagagctcattagttaagtgttatgatctcatagggctggaagggatcttagaagggatgcagggaagggaaagagtgctgatcacaagaagtagtgtggtgaagttgttaagaacacagaccttggggccaaacagcttgggtttgaatcccactgtgggacgtagagcaaagttacttaacctctttatgcctcagttttctcatcagtggtatgggataagaacaataactacctcagagggttgttggaagcatcaaaagaattatatataaagctattagaactgtgtctagcaggtagttagtggtccatattaaaaacaattattggaagtattattaagacctacttcagacggagtctcgttcactcagtgctcaatggtgcccaggctggagtgcagtggcgtgatctcggctcgctacaacctccacctcccagcagcctgccttggcctcccaaagtgccgagattgcagcctctgcccggccgccaccccgtctgggaagtgaggagcgtctccgcctggccgcccatcgtctgggatgtgaggggcccctctgcctggctgcccagtctggaaagtgaggagcgtctctgcccggccgccatcccatctaggaagtgaggagcacctcttcccggccgccatcacatctgggaagtgaggagcatctctgcccggccaccccgtctgagaagtgaggagaccctctgcctggcaaccgccccgtctgagaagtgaggagaccctccgcccggcagccgccctgtctgagaagtgaggagcccctccgcccagcagccaccccgtctgggaagtgaggagcatctccgcccggcagccacctcgtctgggagggaggtgggggggtcagccccccacccggccagccgccccgtccgggagggaggtggggggatcagccccccgcccggccagccgccccgtctggcaggtgaggggcgcctctgcccggccgcccctactgggaagtgaggagcccctctgcccggccagccgccctgtccgggagggaggtgggggggtcagccccccgcccggccagccgccccatccgggaagtgaggggcgcctctgcccagccgcccctactgggaagtgaggagcccctctgcccggccagccgccccgtccaggagggaggtgggggggttcagccccccgtctggccagctgccccgtccgggaggtgaggggcgcctctgcccggccgcgcctactgggaagtgaggagcccctctgcccggccaccaccctgtctgggaggtgtacccaacagctcattgagaacgggccatgatgacaatggcggttttgtagaatagaaaggggggaaaggtggggaaaagattgagaaatcggatggttgccgtgtctgtgtagaaagaggtagacatgggagacttttcattttgttctgtactaagaaaaattctgccttgggatcctgttgatcggtgaccttacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcggaaggcctcagggtcctctgcctaggaaaaccagagacctttgttcacttgtttatctgctgaccttccctccactattgtcctgtgaccctgccaaatccccctctgcgagaaacacccaagaatgatcaattaaaaaaaaaaaaaaataataataaaataaaattaaataaaaataaaataagataaaagtaaaaaaaaaaaaaaaagacctacttcatatgtatcagctcatttaaccctcaaatgaggaaatggtggcccccaggaacacattcaggaacacattagtctacaggatgccactaatggattttaaccaaggaagttaatttatcagaattatatcttaaaagtcactcttgggacaggtagactgaaaaggaatgaaactggaggcagtgagaccagttagacggttgctatggtaactatacaagaagtagagaggctttttctggaaagagttagatggtaaatatttcaggcgttgtgggccacacagccttttgcaactactcagctctgctgttgtaacacagaagcagccacagacaatacttacataaatatggctgcattctagtaaaacttgacttacagtgtttcagtattggatgacaagatttgaagatggatggtgccaatgacagtacaacaatgtgaatgtattccatgccatggaactgtatacttaaaaatggctaaaatggtaaattgtatattatgtatattttaccacaaaaaaactttgcgagaagaaatgaaacacttttcagttttagaacaatgggcaggaaaaattgtttgcatcataacttgaatcaaggaaactggtgaagaaaatgagaataggtgtggaggcaacagttagagactacaaagggttttctgtttgcgatataaagggaaaggctcttgtgccttgtggaagaaataaaagaaacatggaaagcaagttaaatttgaagaaaaaataggtgatgggggaatggggaggtaaagtagaggacagctttgagttgtagtgtctgcagggccagggagatggaagcggatactagtagcttggtagctatatggatgtatgtacaaggtggaaacctgtcttcattttggactgatggaacttgctcagagaagctttgggatacatttataataattgtaatcattggattgacttcattaaataggatccattcttaagaatctttcttagtgtttttagattaaaatatctaagtactaacttggtggcatgcaccagtagtcccggccacttgggaggctgaggcaggaggattgcttgagcccaggagtttaagtccagcctgggcaacacagtgggaccccatctctgaattaaaggaaaaaaaaatatccaagtactcaaagtgtaagtgcttcacaagtatctcctgatagttacttatggataatcatacatttatatccacactaggcctctgtcaaagtattctatgaacagatccttcaaagggtttctggggggaagacatacatgtaagtcaaccaagagtgactatctcaaaaggattaggaagagaccagttcttgagaatcagaggcaaatagctcagctttgggtaaattgggtggagtgagacgtaggaaggaaagacttcagaagtggcctcactaggtggaaatccagggagacagatgaatgcacgggcagttccccattaacatggttgcagacattcaccaggctgacgaggtccctgagacctggtaggagggagagcagatcttgatgttatcaagagaggctgaagactgcagtttttaatgtttaaaatgattaaaactaagctttgacaaaattgtttttatttcaatttctagaactgttatagattttccaaagtgaaatctgtaagtaacaaagtagaaaattggcagcgtagcatctcgttgtcattggagaagggaggagcccagggagtggggacagtgtaaaccatccatctggctgcatttttctcttctcctatgataagagccacccaccttcctcccagtgcagagctgctcctctggctaattccaaatgagctatatatcaacatgcaaagagctgtctcgcagtcctcagagtctagctatagttctgtaccaagcttcttatcttcttttgcttcttgctattaaatctttcccttgaggagcaaagatggtggcgtgaggtgtgctgctgcaaactggcctctggggaggagaagggtgggggccactgactcatgggaggccaaatacatctacaggattgggggaggttctttatcacaggaagaatttttttcataacctttagatgcttttacattcatctcaaaaacaaaattctgaactcagaacttggaaaagatagagtctcactatgttgcccaaaggctgaagagcagtggttattcacaggtgtgaccatggcacactgaggtctcaaactcctggcctcaagaaaccctcctgcctcagcctcctcagtagctgggactataggcatgccaccacccttggtgtgtaaatgtgtctctatgtagtctcctagagtgggtagtcctgtttcttttattaagccactttctctattcttgaaatgtggatgtattagtccgtttttacactgctgataaagacatacctgagactgggaagaaaaagaggtttaattggactcacagttccatatggctggggaggcctcagaatcatggcaggaggcgaaaggcaattcttacatggcagcagcaagagaaaatgaaaagatgcaaaagcggaaacccttgataaaaccactagatctcgtgagacttattctctaccacaagaacagtatgggggaaaccacctccatgattcaaattatctcccaccaggtccctcccacaacacgtgggaatcatgggagtacaattcaagatgagatttgggtggagacacagctaaaccttatcattccacccctggcccctccaaatctcatgtcctcacatttcaaaaccaatcatgccttcccaacagtcccccaaagtcttaactcatttcagcattaacccagaagtccacagtccaaagtctcatctgagatgaggccagtcccttttgcctatgagcctgtaaaatcaaaagcaagctagttacttcctagatacaattgggggtacaggtattgggtaaatacagctgttccaaatgggagaaattggccaaaacaaaggggttatatagggcccatgcaagtccgaaatccagcggggcagtcaaattttaaagctcccaagtgatctcctttgactcaaggcctcatgtccatgtcacactgatgcaataggtgggttcccatggttttgggctgctccacccttgtggttttgcagggtacagccttcttcccagctgctttcacaggctggcatcgtgtgtctgtcttttccaagcgaacaatgcaattggtcggtagatctaccattctggggtctggaggacggtggccctcttctcacagctccactaggcattgccccagtagggattctgtctgagggctccaaccccacatttcccctctacactgccctagcagaggttctccataagcgtcctgccccacagcaaacttctgcctgggcatcccggcatttccttacatcttcttaaatctaggcagaggttcccaaaccccagttcttgacttctgtgccctcgcaggctcaacaccacatggaagctgccaagtcttggagcttgcaccctctgaagccttggcccgagctctacattggcccctctcagccacagatggagcagctgggacgcagggcaccaagtccctagactgcacacagcatggggaccctgggcccagctcacaaaattattttctcctaggcctctgggcctgtgatgggaggggctgctatgaagaactctgacatgccctggagacattttccccattgtcttggagattaacattcgctcctgattccttatgcaaatttctgcagccagcttgtatttctcctcagaaaatgggtttttcttttctatcacatggacaggctgcaaattttccaaatttttactctcagcttcccttataaaactgaatgcctttaacagcatccaagtcacctcttgaatgctttgctgcttagaaatttcttctgccagataccctaaatcatctctctcaagttcaaagttccacagatctctagggcaagggtaaaatgccaccagtctctttgctaaaacgtagcaagagtcacctttgctgcagttcccaacaagttcctcatctctgtctgagaccacctcagcctggaccttattgtccatatcaccatcaggcctctggtcaaagccattcaacaagtctctaggaagctccaaactttcccacattttcctgtcttcttctgagccctccaaactgctcccatctctgcctgttatcaaattccaaagttgcttccatgttttcaggtatcttttcagcaatgccccactctactggtgccaatttactgtattagtccgttttcatgctgctgataaagacatacccaagactgggaagaaaaagaggtttaatttgacttacagttccacatggctgaggaggcctcacgatcatggcgggaggcaaaaggcactctttttttttttttttttttttgagacagaatcttgcactgtcgcccaagctgcagtgcagtggtgtgatcttgttgggagcaggccccccaaaatctggccataaactggccccaaaactggccataaacaaaatctctgcagcactgtgacatgttcatgatggcaataaagcccatgctggatggttgtgggtttaccggaatgagggcaaggaacacctggcccaccccacattgggcaccacttgccgagaccagctcggtcggggagaccctaacccagcggtgctagaggaattaaagacatacacacagaaatatagaagtgtgaagtgggaaatcaggggtctcatagccttcagagctgagagccccaaacagagatttacccatgtatttattaacagcaagccagtcattagcgttgtttctatagatattaaattaactaaaagtatcccttatgggaaatgaagggataggccgaattaaaggaataggttgggctagttaactgcagcagcagcatgtccttaaggcacagattgctcatgctattgtttgtggtttaagaatgcctttaagcggttttccaccctgggcgggccaggtgttccttgctctcattcccgtaaacccacaaccttccagcttgggctttatggccatcataaacatctcacagtgctgcagagattttgtttatggccagttttggggccagtttatggccagattttggggggcctgctcccaacagatctcggcctgctgcaacctccacctgctgggatcaagtgattctcctgcctcagcttcctgagtagctggggttacaggcacccgctaccacgcctggctaatttttcatatttttagtagagatggggtttctctatgttggccaggctggtcttgaactcctaacctcgtgatccatccacctcggcctcccaaagtgctgggattacaggcatgagccactgggcctggctggcacttcttacatggcagcagcaagagaaaatgaaaagatgcaaaagcagaaacccctgataaaaccatcagatctcaggagacttattcactactatgagaacagtatgggggaaaccgcccccatgattcaaattatcttccacctggtcattcccacaacgtgggaattatgagagtacaattcaagatgagatttgggtggggacacagccaaaccatatcagtggatatctcttctctacatattacctctatgatttggaagaggccacttttctttttgttccacctcccagattcaacactgagagctcctaggattgcagttatcctgccaatttctccagggaagaaagaagcagctgacatgggtcttctgctactacttaattaattataaagaaactattttttaagctgaagctgatgtttcacttgaaacaggtgcttagctggtggtatttgtgaattcttgactttttgttccaaacaagaagactaaataaatagcaagtatggatgagaaaaaaaatcattcccttgagcttcagaagcacatatccttgcctatatgatgcctccatttggaggtaccaaagcacctcagactcagcatgttcaaaagtagtcgtcatcttaatctgaacactctgcatcacatcttattccttgtctcggtgaatttcactacctttcatccctttgctcatgatttgggtgtcttccttgatttttcttatatcttaccttcctcttttagtcagtcaacaaaactgtccagtacatcatccctgctgctgctgcctggcttaggctgtcatctctcagtggaattgctacaatagtcttcttcctggtcttcctcactctgatcttattcctccctcgtctcattctatacactatagctagaataaccttcctaaaatgtaactttgatcaaatcattttctactttgaagctttcattatctccttattgccttcagaataaaagcaaaactccttcccatgagagcagggctttgcgttcctgatgtggtacttgattacctgttagctgattttctgaaatccacttacactgaactgcttgcagtacccaagtggcttgatctctcttgtctgtagtctcttaaatatgctatttcttcttcctgcaaagctctacccattttcttcccataacccaccctaccagcccatctgtgggctttagctaagatgttactttctccaggaagctttccttgatctctccaaacttggttagatgtcttgcttgtatattctgtaaaagcctgttttactttattggaagatttaccatactgtactttgcctgtttacctgtctactacctcagaagactataaggtcctttgaaggcaggagtgagctattattcatcagagtatcatttatggcatatgttggggggcatagtaaatttttttctctcttttaaaaaagattgtagtaaaatatccataacatttaccatcataaccatttttaaatatataaactgggccaagcgaggtggctcacgcctgtaatcccagcactttgggaggccgaggtgagtggatcatctgaggtcaggagtttgagaccagcctgaccaacaaggtgaaacccagtctctactaaaaatacaaaaattagctgggtgtggtggcaggcacctgtagtcccagctacttgggaggctgagacaggagaattgcttgaacctgggaggcggaggttgcagtgagccgagatcatttataaactttttcatcatcccaaactgaaactctgtaccaactaaatagtaacttctcattcccacacagcccctgattacccctattctgctttctgtctttatgcatttgactatttttggtacctcatataagtggaatcatacaatatttgtccttttgtatcttgtttatttcacctagcattttttcaagattcctccatgttgtagcatgtgtcaggatttcttgcctttttaagctacataaatatttcattatgtgtatatttcacattttgtttattcattcatccatttgtttatctcatagacatttgggttgtttccaccttttggcagttgtgactaatgctgctaagaacatgtgtgtacaaatatctttttgagttcctgctttcagttcttttggaattgctggatcttatggtaatcctatgcttaatttttttgaggaactgcagtaatgttttctatagcagctgcaccattttcctttaccaccagcagagcactagagtctgaatttctcaacatcctcacccatacttgttattttctgtgtgtatgtgtttttaggtaagaaattttgtttgtgttttaatattagacatcctaatgggtatgaagtggtatctaattgtgattttgattcatattacctaatgattaatgatgctgaacatcttttcatgtgcttattggtcatttttatatctgtttttggagaaaagtctattcaagtcttttgtctatttttaactgggttttgttgttgttgagttttaggagttctttatatattctgggtattaattctatcacagatacaatttgcaaatattttctctcattctctgagttgccctttcactctcttgatagtatcctttgagcaacaaaagcttttcattttaataaagttccatttatctattttttcttttattgcctatgcttttggtgtcatgtctaagaaatcattgacagatccaatgttatgaagcttttcctctatattttcttctaagagttttatagttttagctctgacatttaggtctttgatccattttgagttaatttttgtgtatggtataaggtaaggatccaacttcgttcttttgcaagtgaatatccagttttgccagcaacatttgttaaaaagattgttttccccattgaatggtcttggttcccttgtcaaaaatcatttgaccatatatgtgagggtttatttctgggctctttaatctattccattagtctatatgtctgtctttatgccagtaccacattgttttgattactatagatttgcagtaagttttgatatcaggaaatgtgagtcctccaactttgttttttttcaagtatgagacaagatctttttaattttccccttaaatcttttgtagatatggggtctcactatagttgaccaggctggccttgaacacctggcctcaagcagtcttcctgctttggcctcccaaaatgctgagattgcaagtgtgagccactgcacccagcctgagacaagaccttagtgctacttgctaccttttatttgatcttccttccaacatatttttttgtgtgttctagcataaagtgtttgctttatttatgtatttattgagacagagactcactctgtcacccaggctggagtgcagtagcatgatctcagctcactgcaacctccacctcccaggttcaagcgattctggtgctttagctacccaagtagtttggattacaggcatgtacaccacgcccagctaatttttgtatttttagtacagatgggtttttgctgtgtcggccaggctggtttcgaactcctggcctcaaatgatctgcctggctcagccccccatagtgctgggattacagcactttgtaaggcatgagctactgcacctggccctggagtgtttgctttaacagcccctcctagatgacttctcttcctttcattcctgttataaccgcatttcaatactggttttcttttcctctttcatgccgtatcccttaatttggattctactttgtttgttttcaggccacagttggcattttaaggtcttttttttttttcttttttagagacaggtttagacacaagagttgtgtcacccaggctgtagtgcagtggcaccatcatggttcactgtagcttctaactcctgggctcaagtgatcctcccatctcagcctccccagcagctgggaccaccagggggacccagataaatttttttactttttgtagagatggtatcttcctatgttgcccaggctggtatcaaacttctggcctcaagcgatcttcccatctaagcctcccaaagcactaggattacaggcatgagtcactgtggctggttgcattttaaggtcttaatcctcctggacaaccaaaagaagagagctctacccatttgtttgtccgtatctttgagtctagttcaatctcttttagaactgccagagccaaaagttgcttttgttgttgctttatcatctgggctgcctgtgtcatctttagcactgcaggaagatgcacaatgatatagtagtggtatgatggacaaggtcattgacttagagattgggtgttttagtgaaaagaacattatattggaagccaagaaatgtgggtcatagctttgcatctgtcactaattggcagttagacaattcagcctctcttatataacttatggatgaagcaaattgaactaggtggtctctaagttccttctaaatctaacaagtttgttactgtgcaagatgacttcctcagaaacagaagacatttaagcttgttttaatggatgaatagaacttaggtaagaaagaaagatgtcaggaggtttaaaataaggaaatgaaaatatttttaggagtcagtgaaagtaacagtgaccagacattttattaagtgatgctgggtcaattatataaccacaggaaaaaaatgaaccttgtcctccacttcacaccatatgtaaaaatcagttcatatggttttcaaaactaaatgagaaaggtaaaataataaagattgtaaaacaaaggagaatacctacatggccttggaataggcacagatttcctagaataaaaaagtactaacatgaaggaaaagactgatagattggatttcaattaaattaagaactacagtttatcaaatgacaccattaagacaggtgaaagagaggaaatatttgaaatattatatctgacaaatgacttcaatggagaatacacaaagaactcctacaaactagtaagaaaaatgcagtttaacccaataggaaaaagtgagcaaagacttaaatcagcacttcacaaaggaggatgtctaaatggccaatcaacctttgagaaagtgctcagtatcatcagacaaatacaaatttagacaagagtgagccaacaaacatgagaaaatgcatcagtatcattagggaagtgcaaatcaaaaccacagtgaggtaccactttacacccattaggatggcagcaattaaaaaaaaaaggtaagaaaaaggaaagtaacaagtgttggcaaggatatggagaaattgtaaccttcttatattgctgttgggaatacaaaatggttcagccacaaaatgcaaaatagttcaggaaaacagtttggcagttcctcaaaaaagttaaatgtagaattaccaattccactcctaggtatagactcaaaggaattgaaaataggtactaaaataagtacatgtgtgtgcactgttcatagtagtcgaaaggtagaaagaattcaatgtccatcaacagatgaatgtgtaaacaaattgtggtatatacatttctgggatatatattttggggtttttttggttttattgttatttttaattggcacataatatgtggtacagtgtgatattttgatacatgtatacaatgtgtgtaatgatcaaattagggtaattggcatatccatctcaaatatttatcatttctttgtattaggaacattcaaaatccacttttctagcaatttaatccacttttcaaaatccacttttctagcgtttccctgatgataagtgatgagcatttttacatatacgttttggccatttatatgtcttgttttgagagatgcctattcagttcatttgcctatgttttaattgaattatttagtcttttgctgttgtttgagttccttatatattctggatattaatcccttgtcagaggaatagttcacaaatattttctcccattctactggttgtctcttcactctgctgattgtttcctttgctgtgcagaagctttttagtttgatataatcccatttgtctatttttgcctgtgtttcctgtgcttttgaggtcttctccataaaatctttgcccagaccaatgtcctgaagtgtttctcctatgttttcttctagtagtttcatacttacatgtaagtccttaattcattttgagttgatttttgtatgtggtgagagatagggttccagtttcattcttctgcatatggttatccagttttcccggcaccatttattgaagaaattatccctccccaatgaatgttcttggtgcctttgtcaaaattcagttggctattaatatgtggatttaattctgtgttttctattcttttccattggtctgtgtgtctttttatgctaataccatgttgttctggatactgtatctttgtagtatattttgaaatccaatagtgtgataactccagctttgttccttttgctcaggattactttggcttttcaaggtcttttgtggttccatagaaattttaggattgttttttctatttctgtgaataatttcattggtattttgataaggattgtattgaacctgtagatggcttttggtagtatggttattttcacaatattaattcttgcagttcatgaacatgggatgtctttccactttttttcgtgatctttgatttttcatcagtgttttagttttcctggggagatctttcaccttcctggttaaatttattcctaggtcttactatttttttggtggctattataattgggattgctttcttgatatctttttctgctagtttgttgtggatgtatagaaatgctactgatttttgtacgttgattctgtaccctgcatgaaataccatagaaaggaatgaagtactgatacatgctacattatggatgagccttgagaacactatgctaagtgaaagaagtcagacacaaaggctcacatattgtgtgagtccatttatatgaaacatctagaatagataaatcagtagagagagaatgaagactgatagttactaggagctgatggcaaagggtggaggctgaaggttgggaatggagagaaactgcttatgttttagaactagataactggtagtgtgaatgtactaattgccactgaattgttcaccttaaagtggttaattttatgttatgtaaatttcatcccaataaattacttttttaaaaaatacgagatgctgctatacccaccagagtgggtaaaattcagaagactgtcattccaagtgttgatgaggatttggaacaactggaaccctcttatattgctggtaggaatattactaaagctaaatatctgccattctctgacccagcattccactcctagctatatgccaaaaagaaataaaggtatggctaccaaaagacacctacaagaaggctcttagcagcttttattcataatagcttaaaactataaacaacttagatgcccatcaaggtagaatggataaattgtactacattcatacatggaatactatgcagaatgaactactgctacacatataagaagatgaatttcacagaaatagtgttgggtgaaagaagccagaacccaaagagtatgtttatagtctacttatatgaggttcaggtagaagcaaaactaatatatggtgataactgtcagaatagcttttgctaggggtggttattgatggctcatgagagctgtctgggatgctgaaagtaaattttctacatcttgatttcagtggtggttacacaggcacatacatatgtacaaaataagctgtgcacttaaggtttgcatactttattgctttattgtattataccttcaaaaaatttaaaactcagaatacagttaccagcgcaggtgttcttgcagagaagccatagaagagaatgtttatgatgcatacggttgtagaatgccttgagtggcagtgaaatggcagaaatttggaatctgtcctataactggtaagtttgagggagggaaatgacttaatgaaagcagatttttagggaaatggatccttggaaatatgcctggtggactgagggctggtccactagtggggagactactgcagtaggacctgaattagggcaatactattgaaaatggaagctcttaaggaagagcaattggaaaggctgatgactggttgggtatggatagcaaaaggggacttggcagagataactgagattccatgctggatggctggtccagaaataagaaagccaggaagaagaatcagttttggagtaagatgaatagtttttaaatgctttagtttgaaagtcatagcaggccactagagacagctgtgggactcaggagaacaatcagggccagtgagagaaatctgaaaattaccaatgtacaaattattttgaataaatgagatccctaaaagactgtaacagagaaatttcagaaggccagcccttagagaaggaagagttgatgaggaagaggagactgcagctgtagttcaaccaggataacatagtgtcacttaagccaaacaaagagagtgggggtggagatgtaaagggagaagatacaggaaaaggtacaattgaagatgggatgaagagcaggggtaatcgagaggacacagtcttggagaagacaggaagaaacaggatctgaaagcaaagacagagaacttagccctgggctgctgtgaagaacccaggtgcctgcaattagatcacaagaatttgtcagcatcttcagtgacttactcttgcagtgttctttgtcctctgcgtaggaacagagagtgacctaggattgagaatgagtgtgaatgtaggagccaaggagtcttcatgcatttggtctcattatgggtttcaggcataatcttattcactgtgaaagggatacaaaagaagtttaagacctctgggaatttattctctaaaaggtacaattcagcaatgattaagtgccaaaacaagtttatttagtgtgtttcaaatcttcttctggctctataactttgggcaagctacattagttttctctgactctgtttctttatctgttaagtggtgataataatatctgcctcatatgctgctctggagattgaacgagttaataccagcaaggtgcttggaataatgcttgaaacatagtatgtgataaatgttagctaaggtcatggtggagtgctgtaggagtgtagaaagggaaataattagtcaaggctgagttggtgggaagactgtggaggagtagggatttattggggggcaatgcaaggatgggtaggagaagaatgaaggaaaaggaattttaggttggggaaagcattgtaactagtcttagatcagtaaagccataacatctatgtgatttacttactaaacaaaactattcctgttagggagtagtgggacatagcaaaggaggataaataactgatatttattataatgaaagaagttctgagatggggcaccagagcattttggttgtgatttttatcctggccctgtgactcagggcaagttgtctgatgtcttaggaccccacctttcctcatctaaaatcaaatggactaaatttgtaaaatccttacagctctgaattccttagataattcctacatggaaatgatttctctgaccccactgtctgtaggatggtggtggtttttgcgcagcgtgaagccaactggtctatgtggggcaaacttgtggttatggcctctttagccccctgctgtgagtgagcaagctgaccggccctcatacagacactacacactgtcttgcaacacttagcaatcaccactgctccagagatctggaatctcagcaggtggatttgtggaaggagctcttgggtatctcattcccaacttatttagagttaactctactactgttctcttgaggagcctcaaggtttagttgccttgaagtggaccttgagggctaagcaaaaggggaaagaacaatctttagtcttaaaaaaaaaattcctggattgttcttatggtgttcacaaaactaaagagaaaaaagcagtaccatgagcacccaatgaactgccagcaaagccctaagcctttcacagtaaacttacctgctcaggtcattttgtgcttgaaactgaatactgctgcttttgaaaccagggattgattcctccattttactgcatgtgtttaaataatccaggactcttataaacataaatggaaaatgagcttttcaaataccatgcttagaaatcattggctctcataagacattacttcagttttctttttagaagggaatttttgtttgcaactgttctcacgtctccgtccttcctggtttgagcccctctcaggagtcgcacgcaggcccttctgctgctgctctgcctgcagtgctgcagtgctgttgcatcagaggaagttctctaggattccactcccatttgctttttctagttgctaagcaggtggcacttagaacagtatctgccctctgagcttgatggttgaagaagatacttttggacttttatgctggatggattttacacaacttgatgattgaaaaataacttgaaatggaagaactaaagcagatggaagcgattttatctatattttgtgtctccaaagtttgaagggtttattttgttttcagaaactgaaatttgagaagaatgacaatttatcctcatcttgcccttgaaaggaagagtttttctttggggagtggagctttaggaaaggaaggtgacttgaactgtaaggacttcacagctaatatatgcccctgggtaatgttacatagtccttatttgtttagaatagaagttccttgagggagtagaatatatcctttttgtcatatgtggttcctaatagtgagttgcatctgagtgaatataataaataactagcaattcaggagactcctgatctttgatctcccttggcagatcagtccatgccacagatttcctgaaaagaaaaataagcatgtcatggaagaaactatgtgttttttttgcaaaggttgtgaattaaggttgagagtgagatggtttagtctggcctctttttagagcagtgattgattaatgctgtctgtgttgctgtttcttccagagctgacctgtcctggacgcagcataactaacgaagctgctgcaggatgagaagatggcagcgcggctgcttgcaccaccaggccctgatagtttcaagcctttcacccctgagtcactggcaaacattgagaggcgcattgctgagagcaagctcaagaaaccaccaaaggccgatggcagtcatcgggaggacgatgaggacagcaagcccaagccaaacagcgacctggaagcagggaagagtttgcctttcatctacggggacatcccccaaggcctggttgcagttcccctggaggactttgacccatactatttgacgcagaaagtgagttggaggaggaggagcagctgcagatacctgtttcctaacaggcttagggagatgggggagaaagaactgtgtctctttgccaaagtttggataagtagttaaccttttgtttcagttctggcttgtggggattatttttcattttaattgctactaagggtcatttgtggtcttggcactcatcaactctattaataagacttctgattttggctccaggccagatcagaaaaaggggatgtaaatgaaatgggactatttaaaagagtctttaaaagatgggatagtaaaagatagtacagcctccctctctcaaacacacattcaaaattctatctttaatataaagatgttgttactattgtgacatcagtagagtagtgtggtggagatggtgtatttgctctcttgtctagctccctttgtgacattagagcatagctgctggggacaggaataaaactgagtaaagcaaacagccaatgaggacagacccaggtcattggccctgttacacagttgtctggattgattcttccagcactgattcttgcagtagagtcaattctgttattcatgcaagtagggagctcaagtgaaagaactactaatcttcatttggccaagagtttcaaacttcctgaacaaatatttgactaaatcttcagctactttctcatgattatcttctgaaacaaggcaccaagtagagaaacaaagcctcctgggtgatccaccagctaaataattgaatcttgaggactggcatcagacaccgttttagggaacccctcatttgacagattttttttttttttttttttttttgagatggagtcttgctctgtcgcccaggctggagtgcagtggcgtgatctcagctcactgcaacctccgcctcctggtttcaagcaattctcctgcctcactctcctgcgtagctgggactacaggctcagagcagctacgtaatagaaaaaagtggaaccattagtctgttctttcactgggaaatctagaaagtttaatgaacaaaatgatatgatgtaaagaacggtagattggaagtaagaaatcctgattctaccataatttaccatgtttattatttactttttttttttttgagacagagtctcgcactgttgcccagacaggagtgcagtggtgcggtctcagctcactgcgacctctgcttcctgggttcaagcgattctgctgcctcagcctcctgagtagctgggactacaggcgcccaccaccacactcagctaatttttgtatttttagtagagatgggatttcaccatgttggccaagctggtctcaaactcctgacctcaagtgattcacccgcctcagccttccaaaatgctgggattacaggtgtgagccatcgcacctggccttattatttacatttttattttttagtaaatgtattgtccaagctaccacagataatttatggggaaataaatgaagaaaaaaaccttctcaaaactagtttgtaattttcggcaagacacttcatctctctggacctaaactattttttccaactcaaatgcaaattaatttctcattttctttttgttttatagtttttattttttatttttcctttaacttgtattttaagttcaggggtacatgtgcaggatgtgcaggtttgttacataggtaaatgtgggccatggtgatttgctgcacagatcatcccatcacctaggtattaagcccggcatctattaactattcttcctgatgctctccctccccccattccctacctctgacaggccccgatgtgtgttgatccctcccatgtgtccatgtgttctcatgattcagctcccacttataagtaagaatgtgtggtgtttggttttctgttcctgtgttagtttgctgaggataatggcttccagcaccatccatgtccctgcaaaggacatgatctcatttctaatttctcattttcttaaacctgacaggagatatgaaaaaatatatagagctaatagttgttagagcccaattttcctttgcatactctttttccctggttcctgctctatagacagcctctttccattcccaatgcctcagatttcagtggcctggcttgagagtggggacttaccaaagagagtgggtctctggacctgatgggtgtcattcattggataggccaaattgttcttgatggtgctccattagaagactgattcttcatggtagaaattctgacttcagccttcggcttcatcacaagggtaaattgttcctggaaaggataactttaataattttttttggtaatcttgaaaaaatatataccaccatacagaaaagctcataaagtataaatacatagcataatgattacaaactaacagcatgtcaagaaagaacattgctagcactttagatatgttcattgtacttttaaatgaaggatattttacttgattaaaaataatattcttgctcaagttaacttgcaaatctttaccagcagtgctgatacttctataggggtggaaaaagtccacctccattctcctagggtgccagctgggtcttagaattaaattgacataacatagattaacaggagaaaagcataatacatgctttatgtagcacaggaaccctcatgaagaaatgaagaccgtaggctgggcgcaatggttcacgcctgtaatcccagcactttgggaggctgaggtgggtggatcacaaggtcaggagtttgagaccagcctgaccaacatggtgaaaccccatctctattaaaaatacaaaaattagctgggtatggtggcacgggcctgtaatcccagctactcaggaggctgagtcaggagaatcacttgaacccgggaggtggaggttgcagtcagccaagattgtgctactgcactccagcctgggtgacagagtgagagtctgtctcaaaaaagaaaaaaagaaagaaatgaagacctaaagaagcagagtcagttatttatatactggattggacaaaaaagtagtaaattgtgaagaagcaactaaattatgtgggcaggcttaaaagataagacttatttaacaaggtcagtacagtattctcttggtctcaccttctcgcccttgaagataagcatgttgcctttccttcaggttcagggagtgtcttccacacaggaatttcatcttccactcttaagaaacaacaagaagatcagagtgatttttttgcacccgctgttatacaaatgtctttaacttagtcaatatgccagaatagcgtatcttaaccccttcacttcttgctaactaggccttgtactaaattagcaagatctcttctacaaggaagcacactgggaattaacccacaaatcaaaaagtcataagggtagaaatgactttaagaggacattcctttctgtttgttcttcaagggctgccttaaataattcttcgcaaaatagaatctcttttctttgctaaatgataccagtggaatcctttatcttttcctcataggtctcattttctaactgatgaattgtctttgtgactctcacaaaaacttgtttcttatttccttccctctttctcctagtgggtaagagagaactcgttttctattagtgaagttctggttttagctcggatttcacactcccaagggacacagggccctaaaagttgtgcaccacgttttcgagatactgttatttattccagctggtactggtttggctatcataagtatctgaggtccttgttgggtttcacactgactttttcagctggtccctgcaaacaatctgaatcatcctctctttgaattgcctcagacttctcagggctactttacattttctttgtctcttggtacttcgttctaatacctcctttctttggctttcttgtttttcagctgtttgctacaaataattgtttaaggaacatttaaatttttaaattcagtttttaaaataggtaatatatttaagtggttaaaaattcaaaggtacttggtaaataagtttcctttttacacctgtctctcatctgtctatttcctatctccctgcacaggcaaccactgatagtagtatcttccagagtttctttatgtgtatgcaagcaaaaacaaatatgtgttttatggaacttgaactccattaaaagcctttgttcttgtttttttcctgttgttttcttaaacctattgaagtcttaattttgttttttgtttttacttactattatttttttttttggagacagagtctaactccaagttggagtgcagtgatgcaatcataggtcactgcagcctcaacctcctgggcaacctccatctctgtctcccaagtagctaggatcatacgcatgcgccaccacatctggctaatttttgtatttctcccacttttaaaagtttttcttgtttagtgaaaaattaaggactttttctctgttgcacaaagtgcctgtcttcactaaaaaaatgctctccaatgcttaataatttgttgaatacaaaatggccatatatactcctaatgactatcttaagtaggcagccaggaaatctgtaggttaagctgaaacaaggccttcagaattgactcctatccctttttaatttcttagaactgacagttgatatatgtgtcttttttgtttaatgggtataccgtgttacaatcatataaacaaaaatttaaattacaagattgatcaatgtgtttttaaatagggcacactcctattgcattaaaaaaattatatatggccgggcgtggtggttcacgcctgtaatcccagcactttgggaggctgagtcaggcagatcacttgaggtcgggagtttgagaccagcctgaccaacatggagaaaccctgtctctactaaaaatacaaaattagccaggtgtggtggtgcatgcctatagtcccagctactcaggaggctgaggcaggagaatcgcttgaacccgggaggtggaggttgtggtgagccgagatcacgccatcgcactccagcctgggcaacaagagtgaaactccatctcaaaaaaaaaaaaaaaaattatatatagcttcctaaagttcagtttaccttcaacttttcaggtgtacctttttctgcaaagagatatctgcttattagaataatagaaaattataatttgatagccttagacatcatctagttcatcctcctcattttataaattttatgaggtgaagtactttgtcaaaagcccacaccactgttggtggtataaccaggactagagctcatgcctcctgaccctccatttattacaacatatttctagttccccacttttctaattttttattaattgattctcagcctcaattggctcagttctgctgaagctgggcagggaaatagaagaaaaataagctccattttcatttattccttaaaaatccctgtggtttttaggacaggtcctaaaaagtgcagtggtaagagcagtgcttctgggggaaaggattcatgttagccccctgtattgtatcttctcaagtcaaggagctctgaggtgtgctattccagggacttgggcttattatcaataccgccagttattcaactggacatgtgatcttgaggcaatttgtttaacctttctaccacttgttactttttaaaggaagagtatttcctatctgccatagtccatccctaacctatggtaggatagtatacaatcatgtgtcacttaacgatgggggtacgttctgagaaatgagttattaggccatttcatccttgtttgaatgtcacagagtgtacttacacaaatctagacgatgtagcctactgcacccctaggctatatggtatagcctattgctcccaggctacacacctgtacagcatgttaccatattgaatgctgtagacatttgtaacaccatggtatttctgtatctaaacatagctaaacatagaaaaggtaatgcattgtgctatagctacaactttatgacagatacaaggtcactgggcaataagaatttttcagcctcataatcatcttatggaactaccatcccaaatattgttgaccaaaacattgttatgtggtgtctgactatagtggaaagagtgcctaactgggaatataaaaccttgttttagttccggctttgcttcatgtttgtacttggccaaatcactttaatttccttacctacaatatttgcaaaatagagttagacccatatctgtatctttctaattgtatttcacacttttgcctgtcacatattgtattttagctgtggcgaactacttcctgtttccttagtgtggaagatccctccacccacccaccttcttctggtctccctctcttcctgttggaatgtactctgtcttttagttttaccttttgatattctacccacacaggcccagcccagaggcctctttttccttgtagcctaacttaattatcttacacttggagaactgattactccttttaaatttttaaaacacattaggatcttcagtcctacattggataagaagttggtttcaggtttaactcaggttagatgtggagggtacctgtgttcccaataatgtttgcaattttctccttatttcactaatattagtgccatcagcttaagtgatacatacacacgcagccctatatgagctcctggcagaaaatccttgccaaaactgtgctgacacactttcaacaggtgtgcagcacagagaccattacggaaggatttatgttcattaggtgtgatttgaagtattgctaataagttgtatttcctgcttttgcacaataagcctaaatgctgctttctgttttaaataaaaactacatattttaaaactttggtttattttgttgttaaaaattttttcccaacaatataaggaaacaaaatgatgtttcagttattttatttaccaaatcaaattgagataaatgctttgagacactgggaggtgggcccttctcaaggggatgggtcattgatgggcacgtatggtcttgtcccctctctaagtatggctacctagaggagaaggaatttaattaagcattcctaaatcagatttctcttttgtagccttggcaatagaccaaaagttgggaaatcttatttctgatcccatccctgtgtaattccaggtgatcttgggcatgctatttaaccatttaaggtctcaattcctccaatctagaaaattaagattatgctaacagctaacatgtcacttattacaggttgcagtatagaccatttctgtaagaaaaatccaggtcatctaatttgattggaatgtggggaagtgactgaggaacagtggaagatgaggctggggagggtgagctggagcaaatcctggagggcttagaatgttagactcagaggtgtggtgtttgtttgagaagcagtagagaactactgaaggttctggaatgggagtaaggatacgtgatgatagctgtgcttagagaggtgaatgggacgacaatatgtaagctgggccagaaggaaagagaactgaaacaggcagatcagctatgaaataatgaaggtctgagttacagtggtgggagtggaaattaaggggattggatgaattcaatatgatttatgatagattatggagggttaaggaaggaatcgagcatgcaattattcatttgacaatttgataaattgttactgagtgttttctatatgccggggctctgttccgtgcccttgggaacaaaacagacaagccatatacattgttggaacttagtttttttgttagggaaacacataacaaacaaatacggaaataaaattattactgataatgatacgtgcattaatgaagataacatgttccagctactttagaggcttatggtgctctaatttggtacagagactaaacttggagaatccagaagaatcaaagattatatggtctctcaaatattcagtatcttaaataggacttcagcaagtactaaattataatctttaaaagagccaattttgagagcatttgcccctcttggatttttacacagacagaaataaaatatacttgagcatcagtgtgagctattggggtgcttacaaagaaacccagcattttctccaggtttaactcgggttagatatggagggtacctgtgttcccaataatgtttgcaattttctccagtcctaagttctcatgcaggtactaagctgtgattccatagttctgagccacatagggtatagacatagacagcttttacctgaattctaggatgtgtgttattagccagtcacctcagccataaaattccactgattggtaattttaggaattagtttctgttggtttctccagggtgtgatttgtgcaatcttatcataacaaaaatttacctgtggaatgggactatttaataatggccatttaaatgttaaagaatgtttcaagattatgataatatcgatcatctctgacaataattaaacatattttaagtgctttcttagttaaggagagaaaactgtgttattattttacagagggatgcttctcttttgaattgtttccaaattgacaaatgagttgtaaatgtttctttacatataacactatttgacacaacttaagatcaggattgtcccatcatatgacaatttctgctaactctgattttaccagaagaatttttgatacaagctctgaagatgcatttctattccagacactgttgagcctgcaaagtttggcctatggaaccaagttggaataaaagattctgctgatttcagagaatagggtgccccatctactgttcaagaccaatccctcacccctgtctttgaccctgtgcctttctacctcctctggaatttcactcctttggttaccctttctcttttctgtattttccgtctttcctctcatataggttcctttcccatagtctgtaaacacactcaaagcctctcccatcctaatgaatcctcacttgacctcctgtccccaggtagtctaattgcttcccatgccactgaaaattgtaaagaggagggtttactcaccacatacacatatctacccactcctccatccttgaagcctgactgcatcctcacccctttcatgatattataagatcttcccaataacatctcaaatggccaagtctaagattttttttaagttcttaactcactaaacctctctgcagtgtttgacaccatttattattccctgactcttatatctctttacttccttggcctaattttctttttatctcaaatgtttccttctctttcatgttctcaacctttccctaaaatgtttatattcccccagattcagttcttggcccatgttcctctcagttggcacattctccctggatgatctcatccagcctcagttcgaggactcctgactctagcctagcctagaatgttccttaaatattcaacaccttgccagtcatctgtttctggattttcccacaggttactcagtatattcagaattgaactcattttcttcccctcaaacctgcttatcttcttttatctactttcctagttgatggcaccagcaaaattctagatatcatttttgactccccaattttcttcagtccctgaggattgccagtactagggatatctcagtataatgatgcacgctttcacaagtatgaaacagttgtggctccagaaacattaacttgcttcctcaagttccctcaactaatatgtggtagagtcaggtttctgttccagggatctgtgaatttcaccttcatggtctttcttccatgccctgctgtctatatagagcatattgcaggatgatttttttggttttgtttcctatcatttttagagaattttctatcattttgcattgcctcaatatgaagttagtatagtcagccctccatacccatgggttccacatttaagaatttggggaaattatttggggaaaaaagcacatctgtactgaacatgtacagacatttttttcttgtaattattcccaaacaatatagtataactatttataaagcatttacattgtattaagtattataagtaatctagagatgatttaaaatttactgatgtgcataggttatgtgcaaatacaatatcatcttatgtcagggattgagcatctgtggattttggtatccctgggagtcctggagccaattccccgtggatactgaggaacaactgtatgttgttgtgtttagttcatttgttttataccataccttcagcatggtatctgagacatagaaaaggagagaagacttttcaaactaaaattagtgaatttttatgggtagatgagctaaggggtagaaaagtgaccgtatagcttcaactgggcacccagaagaaagttggatatagttaaaggttaggtgattttagctatagtatttctttatgaaagaagagattcatacattcaacaaacatgtatgaactgtctaccttgtgccagataggcatcacattatgtactgtgcttgctaagctgagaaaatcatagtagatggaagataaacccctccccttcacggatctcagggtccagtgagagatactggtatgtaaacctcaataacaatattctgtgttaactgctctaatagaagtaagtacaagtgttatagggacacacaggagggaaggacaattctattgaagagagttgaatggggctgtcttcatagaggatgtgatctttgacctggacctttaaatattaaagtatggttaaaaaaaaattcacctgtcagagaagagatgagagagtagttcaggtgtgaggaacagtgcatataaaggccgagagacatgacacaggtttaattgtttaaaatagtgagtgtagctgtaactgaagcatagagtgtggtttggtaagacaggagataaagcctagaggcaggttggagccaatgagtgcatcctaaggggttttgttttctctcacttccagagttcccaggttggaaataacctttgggacccattttgagctagtgcagccttgctctggattcttgctctaacttgtgcacaagtgtccttcctgcaggcttgtgccaagtatgtggatccaaattaacagaaatattagccccttcttgtcatcttcttttttttttgagagagagagtcttgttctgtcacccaggctggagtgcagtggcacagtctcggctcactgcaacctccgcctcccgggttcaaatgattctcctgcctcagcctccctagtagctgggattacaggtgcacgccaccacgcctggctaatttttttgtatttttagtagagacggggttttgccatgttgaccaggctggtcttgagctcctgacctcaggtaatccacccgcctcggcctcccaaaatgatgggaatacaggcgtgagccactgcacctggccagccccttcttgtcttctaatggccactccgtgtttggagccaaagagctgaaggaatggcagtactgtgtgatagcagtggcagcatcataaccacatttaacgagtgcctgttctgtaccagccactgtgttaaggactccttgtgacccttcatttaatctttataacaacctgataaaattggaatagtgattgatggcacccactttatcaataagaaaactgagccttagcaaccttaacataagttgcctaagatcatgacagctaatgagtgacagagctgggtattgaatccaggtctttctggcctcaaagcctgtaaaccactctgctttgctgctttctaagagagaggagagtgagaatagattctagaatatgaattcagtaaatagaggggttaatatgctttacataataagcctgcattttgctcttgcttagagcaactgtagtctgtgcactttaagaggttaaagtagaaggtgatcaaagtcaaatttatatcgaaggacaacaaggaagaatggccatggaggagggtcagacctgccctgccctgggaagcagcattgtgctggctcagcattgaagcaggtgcacagtgctgctgctctgcccggtatggcttcctgtgaccagaacgtgagcaggaagggtggcagctactccaaatgtaggttggagagcatggggttacaaggtcaaagcaaatgaagaagtgtatgcagaagcacctggaaaactgtaaagccacaggcagatgtggtgctagcattatcttcatcaaactgaacttggagaaaagaccataaacagcacatgtagggggttccgttttgcaacagttaaagttattaagtagaggagattcgttcattgatctgagggttggaccagatgacctggtgcagtaaaaagagtttagaactagaagccgggagatctagtccctggcaactcccccgccccgctcctgctcactagtgctgtgaccttagtttgggcagagcattctgtgcttggtttcttgtttgtgaaacgaatagttagatttgagtaatagttttgaagctttttaaaattgtagtatgccttgataattaagagtataggctttgtagttagattgcctcagttcaatgctaaatttcaccacataatagctgtgttgtcttgggcaagttacttaacctcctgcctcaattttatcatctgtaaaatagtacctacctcatagagtagttgtgagacaattattatattaagtatcttagtagggtgcctgcctgccacatagtaaatgcttaataaatattgaattttattatttcttcaaatagactcataggtaaaattatcggttactaagaaggaatttttaaaatacgggatttagtggtctcttttgctccattctcagtatcgtgtaatagaggcgtggaaaatgatggttctaaataatcacacagctcaaatagaagtacacgcctagggaagaattttgctggtgtctttatgtcctgctttggtttagtatttctaaggggagctggatagtaccaggacacgggtactctggaaatgcattccagttatgcctttgctggagactttcctgggacacactggggctatataatataacctatattgtaattttacttgaggaattcactaggcagattagcataaatcaggattcttttcaacatggcatagtcatttttacataacaggtcatttgtttctgaacagcttcctagcctgatatagaatctgtttagattctgcattatattttccgttattaaaccagggaaattttgaaaagacacttatttgttgcttgctatattggctgtatgcatactcagaaatgaatgccaaattgctgttgattaatgaacaactggccagttgcctagttcagaaagaggtgcataggcctgggggaataaagtacatatattttgtttaggcaggcaagaatttaaggccagagaagttggctaaaaatgagaggaccagttagttctagaaatcaaaacagttaagatctagggacagtcataagtcattgccagtaatagttatagtcagatagactcaaaggttcccagctgccctcttgttgattagctaaacctctgagcccctaggtgttcattatagccagaagctcatcagatgcctgcagattacctttgccctagttgagatgttgacctctcaggatggggagaattggttgagtgaagagctgctctcctgggccatgtgtttcacagcaaaccagggaatggataataaatatttctcgaagaagctttctcttctatgatattctccacccctgcattgagtactcttctatataaagtcttttcatatatatgcatcctttattgttttgttttattttattttattttattttattttattttattttattttattttattttaccaagacagggtcctgctctgtttcccaggctggagagcagagctcactgcagtttcaacctcctaggctcaaacgatcttcccacctcagcttcctaagtaagctgggtctacaggcacatgccaccattcccagcaaattttttttattttttttgtagagatggagttttgccatgttgcccaggctgatctcgaactcctgggctcaagcgatcttcccttcttggcctccaagagtgctgggattacaggattacagatgtgagcccatcctgtttttttttaatttacactttttgtgtggctaaaaaaattatttcagtcttgggatggggtggagacatgctaataaactagctgtactgcagtcctgtgatgactgtgtgtgttcattgttttgcatttgcagtatgctaggatttgtttggtatgcatatggacgtgctctacctggccttgcacggtgttccttcccctaatagtgggccccaaagagaagatatcttaccctgagttaacaatggcaatgcttctacattgtgtgctccaagccccacattgctaattagaaatgaaaagcctgtgcttttcagaaggctcattttatgccacatgacacatttattaatactccatgccataactcgttaagaactgttctgccgctcttaatggaccttgtgctgaaacacattcagtggctgttgttgtaaactgatatttccccttgggcagtaaccgcaatccaatttcaatttcccttttaactcatttacttcacaaagatctaatttgagacagattaggtaaaatattattggacttcatgggcaccaagtgattgttgtttaagaagtattgtaaaaacccaaagcttgctgtcctttccactatatctaggctttgaaggatctggcgttagagcgtagtgttgaacgagagaggacaaatgtccttttctggattcccaccagaagtttaacgatgattacaaacgtttaatcagccatatgaaacatatatacatatatctctctcaaagtcaacccatcaccagtcattcctttccattctcccatattcactgttctcctgagaacaggggataaaagtaggggagatagtgcagggaaaagcattgtgtgacgcagttctgccttggggctgctctatgctcccccctgctgacataagtatggtactatcaagcactgttgaccctggacttgacagacttcaacataaggaagcagaataactaactcaagagagttctacaaggataaaatgtgagagaataaataataataggctttctcctcaaatttatggtttgctgctttgttgcacttaatcctggatgctctgtgaattttctaaatcgtagaattacagatatcagtgctggaaaggacctgagtatgcccatcaggcagccctctctcttattttatagacgaagaaaatgagatctagagacatgcagtggcccagccaggccatacagttaggcagaggcagggaagaaggagaacacaaatgttttagcacatgacctgagagatgatctagtggttccccaaatctggtgagcacagattcctggattctgcacacttatttaatagaacacctggagaagggatttatgactgtgttttttaaaaagctactcagcctaggctgggcatggtggctcacgcctgtaatcccagcactttgggaggctgaggcaggtggatcacgaggtcaggagatcgagaccatcctggctaacacggtgaaaccccgtctctactaaaaatacaaaaattagctgggcatggtggcgggcgcctgtagtcccagctactcgggaggctgaggcaggagaatggcatgaacccaggaggtggaggttgcagtgagccgagatcacaccgctgcactccagcctaggcagcagagcgaggctccgtctccaaaaaaaataaaaaaataaaaaaaaataaagctactcaccccaggtgcagtggctcacagctataatcataatcccagcactttgggaggtcaaggcaggaggattgcatgaggccaggagttcgagaccagcctggacaacatagcaagaccctgtctctacaaaaaataaaaataaaagataagacaaaatagaaagctagtcagatgattcttatgcagtcagtctggacttagtcaggaactaatattagtgtatcccctggggcagatcagttttgccatctgtttttgtatggcccacaagctaagagtagtttacattcttaaatggttggatgtgtgaaaatgatacgaaatttaaatttctgtgtccataaagttttactgaaacacagccactcttcttgggttgcatgttgtctatggctacttttacaccacagttacaggggtaagttgttttaacagacactgtatggcctacaaagcctgcagtattgactgcctgcgccctttcagaaaaagcttgctggtgccgggtatattacttatctctttctcgtgtaactactgcaagccccagtattaaaagggaaattcctaagctttgagtacttgtgtttgtccaaagactatcttgccttttttttttttttttttttttgagacggagtctcgctctgttgcccaggctggagtgcagtggtgcaatcttggctcactgcaagctttgcctcctgggttcaagcgattctcctgcctcagcctccagagtagctgggactacaggcacatgccaccatgtcgggctaatttttgtatttttagtagagatggggttttaccatattggtcaggctggtcttgaaccgctgacctcgtgatccactcacctcgacctcccaaagtgctggacttataggtggactatcttgcttttcaaaaaagatccattgtgaaaaactgcatgcaaattatctgtaaatctaattatttcaataataaaacatgttttattgtaatacaatttcctactaaagtatgggagatttaccttcatttcaggagtttagtgtgctagatgtttatttttgttaacagaaaaactgtttttatacttgatgaagatataagatgtaaatatttagaaaggggtgatggtaaatgagttttattttaagtgcaacactcagtacccaaattaattaggaaatttctatttcacacatcaaatgtccttagtaaagccttctgcttacaaaatcatagtttttgaattcactaaagatgcttagtttcccccagaatcatcagtctcccacttgacagctcatgactgatcctaattcagaatcctacctcctagtttttcttcaaccaaggtgtaacagtttccatttcctaatggcttccttttgtttttcttcttctccttttccctcacctaaaacaacataagcatttgttcatgaaccaatcaacagacatttatgaagcacctgctgtatgccaagcactgcaggcactgattcagtgataggaaataccctccatgctacctctagacctatatttccatcacgaccaaaccaagagacaagaaaaatggaaagtatagagtacattactttaaaaaatcctgccaggcgcggtgactcacgcctttaatcccagccctttgggaggctgaggcaggcggatcatccgaagtcaggagttcaagaccagcctggccaacatggtgaaaccctgtctctactaaaaatacaaaaaaattagccgggcgtggtggcaggtgcctgtaatctcaagtactggggaggctgaagcaggaaaattgcttgaacccgggaggcggaggttgcagtgagccgagattgcgccattgcactccaacctgggcaacaaaagcaaaactctgtctcaaaataataataataataataaataaaaaataaaaatcctgttgtctgtctcctaaggagaggttttgtaggtgatattgtaaaggcctggcccggtggtttttaggtcttggggcatgggccagtgcttctttcattgttgcttagctgccctatctaccccggggactcaaatttctcattcaccagagaatttgtctcccacaccaacttcattctttgccacgttgccactgaactgcctcccaatctggcacagtggaagctgttgagaggctcgaagctcggcataacatgctgctctttgctgcgtgacctttgataggtggtgttcctctcctgagcttttgttaagtgtatagaggataataattcctccttcacccatacttcatgggaacctcatgaggttgaatgaggaggttatttaaaaggctattttcatagagggagttgctgtagaaacacagagaggtacaagtacttcagagaaggggtttgggggaagccctgggctgtttgtttctttgagaagccaagatatggaagagctatagctcagccctcgatatgtttcagatgaaccctaggtctcctacttctctttgcttttaggattaggctttttctgcagcatatcccaccagaaccagtatgctccattacaggaagaatttcactgcagtacaatgtcaaacactagggatggtgtagtgggcgtttgtagaatgaatctagctcaatacttttccattgggaagagaatgacgtgactctggtagattaggaaaggaaagaatagaagataagaaaagaactttaaaaaacatcactaatactgtgcattgggagtacataggctgatcattattttggaactgtggagggaagcataagattggttcctgccctcaaagaaccaaaagcctaattgtaggggatggaggttaaaaaaaaaaaggtgggggcttttcataaatgacctgtatcaggttaagaaggacctctattactagtttgttgagtacttttattatgaaaggtgttgaattttgtcaaatgcttttttctgcatctattaagatgatcatgtggtttttctcctttattaatatgttgcattacattggttgattttcaaatgctaaactatctttgcattcctgggataaatcccacttggtcatggtgtgcaaccctttttatatgctactggatttggtttgctggcatttttgttgaggctgtctgtgtctatattcataagggatgttagtatagagttttcttatgatgtctttggttttgtatcaaggtaatactggcctttagaatgagtttagaaatgttctcttctattttgtgggagagtttgtttaattctttaaacatttggtagaattcatcagcaaaaccgtctggtcctgggctcttctttgtggaggttcattttttaatgcaaggtacagaagagtatttatggaacaatcccatgtgagagagagactttttaaggacatagatgtatgcttttatttacatagaaaatttctagaaggatatacaaaaaaactggcatcgaaggttatcattaggtaatgagatggaacttggtcttatgttccttttttcttttaaaaaaattatgatcatgcattgctccaaaatttaaaaataaaaaactacttaaaatgactagcatttatttggccatttgctctttcactcacacagtgagatgttaggactgtgtatctgccactggcctgtctccttaggaacttgcagtctagtaggcccttgcatctctcagcttcacagtctgctctccctcttccctattttattctccatcaacactgaattactggtcaattccctaaaaaaaacctgcagctacatgctactatgctttcatacatgtgatttttgttcccttacctttccatcccttctcactaaatctgcccaattaatttttcttaattcttgtttgtcctttaaagccccttccaaatattagttaccttcctttgtgaacttcccagctcactctcttttttatttcccagccaaggggaaaaaaatctctccctcctgctgcctctcatacattatgcatatttttgttattgaactttgtacttaccctgcatcataattactagctcacatatgtgtcttccctaaaagtacagttttattcagtgttgtgtcctggtaattagcacaatgcttggcacagaatagatgctcaaaaatattttaattcaattgaattcagaacacagggcattctgggtagaatgagccacataaacaaaggccaacgttatgaattatgagaacctgttccgaggacatgagctagtttggctagatgggaacattcatactgggaaatatgatttaattattttggcaaggctgatattgggggctcttgaaagccatataaagcagattgaatattggtaagtaaatattgattgaatgaagaacatttctcacttccttccagtctttgctgaaatctctcttctcaataggcttatcctgaccacctctttaaaactgttgcctctttattcacccatcccctgactccagcattcttgatcttcctctccctgttcttcctccttttcccatagcacttgtcatcttctgtgtagcacagcctatatgatttactcattcattacagtttttatttattgtctgtctttcccactagaatttaaactcttcgggccaagactatcttgttcactgaccattcccaagcacctagaacactgtctgacacatagtaggtgtccagtcaatatttgttgagtgaatgaatcctaaattaatgaacttcagtatcgtgtacagagctggcatagaagcttaggtatgattcaaatggcctgtttctgaaagaaacaagtttattctgtaaaactgccaagattgcatcagctatttgtattataatctgggcagggcagagggagggaggtggggcaaacattgtgttaagtttgcttgtttaaaaaccaagttgggaagtaaaaagtattaaagacttttgagtttatgtattccttacctagaaatcattgtttcatgtggtgactcatacccatgctttaataatttctctctctttctttctccacagacctttgtagtattaaacagagggaaaactctcttcagatttagtgccacgcctgccttgtacattttaagtccttttaacctgataagaagaatagctattaaaattttgatacattcatatccttttcggcaaatgtggagtgagtgcggcaattgcatggttgcttgtttacctttccaatatttgacaactggattatatgttaagttttttactgatagtgtagttaactagcccatcagtcagaggtttaagagtgaactcctgccacatcccaagctaagcttcagcaaattattattttttttcttaggatgatattgtgggaatctgaaattttgtttggtatcattgtatggacaaattaaaataacctttgttgaagtcttaactttatttagtactcagacttcagtgatttctttctgtggccaactattcagcttaatatattaaaagccattattagaggtttttgaaagtccttcttgagttacaaatagttggatgaatgctttagaaatcagctttgaatttttaaaaaattttttgagcagtgagcttagaaagtgagatagttctcagatgaaataacctccttgttacagaggtttagatgcagattgtaggataaataggaattttttctggtatttttactcaccttaaatagaaaaatgccaatttattcaagtggcctgagttacaccttattaacatatgagagtgcatgtggcaaatgaaaaattatttgatggatttagtgatgttgcatggtggcttgaaacttccatggctggtcgatatttaacagcatgtagtcccatgcttcgaagattactgtatcctccaagtaggatgaggaagccagcagtggcaacttggtgaattggtttagaagcttttgccacattttattaactcttgagaatttagcaacatggttgtgaaatctgtagtttagaagcaacacacttctgaaacctgaaagtttataaggaaataaataattcacagtggacttcttcctttctgttggatcagaagatggagtgttttttctcttctggttccaaaaagcatgaagacaaatccagctgtaatgaagaaaaaaaaatccagctgtaagaaatattttctctttttaaaactccactggtagaataaagatagtgaatgccattaacaagagagagtgaattagtggcaagtgggatatggctcccaggctctaattggctctaattgtctaatatgacaattagagtttgagtaacttgtgctgacctaaaatagtttaatttttctcagagataagaacagaaaggcctgagaaaaattctggatggaaatgaaatggcagtatggtttgctatccataaacattcctggacactttcagaatggattttgctctattacctagtcttcagaagtgtggtggtgcagatgtccttgaaatctttacctaacacgccgcagctggtttcccacattggacatattcaacacatatgggctgtattggctgatgccttgcccccaaagacaattcagccctttagaaggactagggaaggctgggtatgatggctcaggcctgtaatcctagcactttagaaggctgaggatgtaggatcacttgagcccagggcttcaagaccagcctggatgacatagagagaccttgtctcttaaaaaagaacaacaactatggaaaaaaagtgaaccattgcatgtagattttcaaataactagctatataagataattaacttaccaataaatgaatacctagtcatatagatttaattgattttcttatctgacaactttggttgagaaagtgcaaaggtattatactaagtgcaaaaaacatttagaggcttagtctgtagttgagctgaaaagtggttaggggaacatgtttcatccaaagggagtagaacagtgacggcccttttgaaagaaggagaatagctgtccttccccatccatccacagttcacagtggcatgctgtgtttatggtggtgaccacagttttcattgtcaccttgcatttttctcttctgtgcttcatctcctttcaggttattgatttagatctgatacccaatggaaatgtgtttgttttttgagaaaacaaaaggcaggccagattttaatattgccccttgactcttctctacagtatttagcatgatcattatgtgcactattttgaccaactgtgtattcatgacttttagtaaccctcctgactggtcgaagaatgtggagtaagtaactcatttatgtgtgtgcttgtttgttttaaatatttttagtcactaaatcttgctttgccacagtttacccatcaaggagaaaaaaaattagttattgcctctctttatttcacagagaaggctgaaagtacatgtggaatttaggaaatagccctccctaaaagtcaactctagaaattactgcccttcactccaccctttcctgtgccaggcagtgccgttgccctgcagccccatcaccatcttgtatcctcagttcctggtgatactgttttctccaattttaggtttccctgttttttgacttctctaaggttaaaaacagctctggggggcctccttaccttcttcaaaatgatcatgtactagatagctgcaaagttaacttccttggaatacagttcaggacccagtacaacattccaaaggtcttagtttgtgcatttcagtaagtttcattcaaagcatttctttctcctcctcacttccttcctgctgcattggctgtgccctttctgttttgtctctcttagttgaagcaacacttcaggcaagtgctaacttaaaaggttcatttaaagtttctgtccagaaattacctcaagctattcatttctttgacaggtacacgttcacagggatttatacatttgaatcactagtgaaaatcattgcaagaggtttctgcatagatggctttacctttttacgggacccatggaactggttagatttcagtgtcatcatgatggcgtaagttctccccttactttattggtgttctgggtgtgattctgtgtgtggagttgtactcctgggtctgtttgtaggtgtgcatttgtggacacagctgtatgaggaattaatggataaccatgtaaggccctgtgggcttatgtctatgattcttgcttgtgagggcctcttgtggttcaggcgatgataatgtgattatgtgggagaaggcaagcagaggctttacagctgggagagaaaggaggaggtgatttcccattggcactctctcgtattttattcctccttgtaacgatcacggtttgcacacctatcattacaaggcctctgtgaagacttgaaattttttagttgtaaactttcagctgaaaattagtttcctgggtatgtcttaccgtatgtaatttaataaggctggccaggagttgcagacttcagagcacattttagagtcaaaacatgagccaaggtacccacactggcacttcctgaagagttactaaccagaatttcgaactattgctcaagatcagtgtaactccacattggtatgttactgctcttgctcatttgtgttgttttagcaataaaaatgtatctttgggaaacttagctgatgatagaagagttatagcaggctttaatatttttatttccaggttgggaaagcgttttgtggtttgagagtgtagtgggggtggtgtataggttttgcatgtatgcatgatgtgtaagaaagagtgcatttaaatatgtattgatctgagcatctggtggaaagatgtatttcaactgtaaaatgtgaataaatgatatgcatcgaatacttgaaactgaaactgactttctgttatataaaggcaatgtcttactttctagcattatgaatacacattagtgttcatttaaaatttttaagtgtccttgctaggcacagagcttgtaattaaaatgagcacttaacacaatatttgctctgatcccatgatttggattttcctgagccctgcttttgtatgtcacaggccaaaacttcgtttatagacatgactacaatcatatgattacaactcctgattaagtcatatatacagacatttagtcaattttgccattgtcaactagggagttactttaatgtagatttgtttttgtggggctcctgctgcagaaatttgtctccctctcttaagaaattgttcgcaaaacctgggaacataagtctttgatacctcctggccttcctttttactaaaaaatgtgaatgggctgacagtaaagccattctgattgggatcagcacattactatgctgattaaaggagtaaatcccaaaaacctcctttctaatatacttttgaattcttcttgtccaattaaaaacaaatgttccttaaatgtttgtattttgaagcttttctttttcaaggaaaaaaaatgaaaccatagcttgtatataagaccctttcttccccccattctcaaaccctcgcccagtggtaccattacaagttaactttggtttgattctgcaggtatataacagagtttgtaaacctaggcaatgtttcagctctacgcactttcagggtactgagggctttgaaaactatttcggtaatcccaggtaagatggtccggggttggtgttaggtgttgggatagggccctgacgtgacgtattgtactttttgttttgttgtggttttgttttttcctttggtgtttgtgtttgtgtctgtgtttgtcacttgtgtctgtgtgtgacctcccttactacagatatgtgacagagtttgtggacctgggcaatgtctcagcgctgagaacattcagggttctccgagctttgaaaactatctctgtaattccaggtgagaaaatttgtacataagactgactttgccacatctcctctttctcctccattcgttttgtccaccattctaaagcagcatcagtacagttgataatggccttgcattctgcatgtttttcctgggagacattctctggaatggccgttgggtcctcaggcagttttctctgagtgcttgccaggcatgcagcccccattccatccatgctattgaaaaagcacgtgcttaagaatcacttggatctcaccatatttgaaaaaattgtcacagagctagctgtctctttgtatataaatcatttgcttcctggctccatggaattacagtaattttgacatttgccatcatttcattgcttgtgatttctaggcttcctatcgcatggtttgctgatgggacgttattcaaagaattatacatttactattactatattaatgaaattttttaatcacagaagagatctacccagttaactaatccagtatcagagacaaatttaagagacttggagttagtgaactgcacttaaataatcactgtctatcatgttctactgctgtctgtctcactagaataagaaccagtagacatctactgtacatattcagggttcattctcagacataaatcccaatgaaagcttatgcaggcactgttaaaaaaaaatcaaaggtaagataagatacaactaaaggtatgggcaacaaaaagtatagaagtttgagggggaaaaacagaatcagtaggtgagttgagagttagttgattgacaacctctttaaaatttgtgcctttttctttttggttctggttgagctagcccagtggttcttaaccttttgaaggttttggatccctttgagaatcagatgaaagttcacagaccccccccgaagcccatccatggaccccaggttaagattccttaatttaatttaaatcattgctactgggtaatacttatctttctaaagaccagtcttgaaatcttaaaggaaagatattttagttagtattgtgagcctaagatatactggcagtaacttggcagaggtgaagactgtgttgttgctctttggactttagttgtggtcatgggttttcaaggaagactccgtagagaccaggctttccacagcagtttcgtagaaataggaatgtggagaaagaacagaggcatcctattcttatcctattcctattacgtggctcttccccttgtggctgactcagaaatatctctctttttaaaatttatttttattttctagagacagggtctcactctgttgcccaggctggagtggtacgatgatggctcactgcagccttgacttccagggcccaagtgatccttccttctcagccttccaagtagctgagaccacaggtgcatgccatcacacccagctcatttttaaaaaaaaatttttttgtagagacagggtctccctatgtgttgcccaggctggctgccaactcctgggctcaagcaatcttcctgcatcagcctcccaaagtgctgggattacaggcgtgaaccactgcatctggcccagaaatatttctttttcccctttttaacattatctcaatagcagatagagagggaagcacaaagatagaatcctggagagggcagactggaatgtggtttactgagaacctcaaagaaggtaaattcatcttcaccacttacaaatttgggccatggagttggccagtaaatcagtgccctaccaaagatgaattcctatatttttagcgatggtagctgactccctatcaaccaaaggctgggtgtcagttggagtatatacttcttggcaaaaaactacaaccttaacttaccaagatttagttcctagccattttaaatctgcttaacagaaagctcagctcattctccagacagcctcagatagctcattgatggtggcctaatctttaggcaagccctgtcttattttttgaggcatctggaatgccacatctttactttcctttttcctatggtgtctctcctcctctggccccttttaaatatgatcttgtgttttctgctcacttccctcagcgtactctgcaaggcatctgtctctttatgttcctgtgatctcaaaacttctctcccagaattaaattggaaagctgtattctattcactaactagggcagcagatgctgtctctagtctagctcatagcttctgtctctgtctctgctatatggttaacttttgaccatggcatttctgcaagataactcttgattggtgtcacgttatttattctttgtatatatccttaatatgtcatgttatttatcctttatatatatatatatatctggaatatatgcagtatctaacacagtggtgcctggcccatagtagtgctccataaatgattgtagtagcagcacttatgattataaagaaacctaagccaatagaaagggtttgtatcaagatttagacatcagcttcacagtttgaaatagagtcccagattcctatttctagaagcacccccaattgagctggctttgggaggctaactggggtggaaaataacattaagggatagtaaagcgaataatagatcactgtcagtaaatggtatatttggttcttgaattaaaagtgtggctctcagtctcaatctttttgctcccgattctatgttttagagttagcaagagaaatccagtaatgaagtttccctcatgggaagttttctctcatcccatgggaaattctgaaattgctgattatgctttctcccatagagggctgttgtgctattcctacctgcctgctatgcagtctccttccaaggcgggagcaccagtgtatgagtcagtggatctgggccatctcttgcttggaagtatgtcattttgattcttgtgtggtagagctggcccatgattcccccttagtaaaaaccattgttctgtataccaagttttctcgtggatcacttcagtggaattgttgttctctttgtcttctcctcttcccagtttggttatagactactgccaagggtgccaaaaatagaatgtaagtgagagcaaccactgacctggagcctgcaaggtctcacaaagctccctgtgtatcaacttcctttatgagagcttttcctttcctagagcactcacccacccccaacctgggctgatactgtccttcctctttgtgtctttggtagatattctgagtatgtcagggccgccaggactcctgaagattggacagtaaggtgcatcagttagctctgcccttttctgtaagaaatgctttgctttacagctttcttgtagctcagaaaagaccaaacccaccttctgaccctttttactttacttgacttggatacatactatttatgctttccgttttgctccagaggcagcaacttggagaacagtgtacacaaggtctgtgctaaaagggtcggttatagaggagaccctttctaaattttctttagtctggaatttgtcaggttcaccttgacattgaaatattctgcctaaaagtttatatgtcttaaaactttgttttcactttgtatttgtctgagtcccgcataaagtgaacttctaagtgactctgtcagaagttttgtcctctgcatgctttgatcatgtgccacagggctgacatgcccaaagaaagggtgggaatctcgaaagagtttctcaggttcttcttagcagcatttaatagtataagtactaatagaactggttgagagaaactcacttgtcagtttcttttcatttctgtcatttaaatggctcccccaaagcactgcttatctgctgctcattagcacttatttaatttcattccaccttctttagaattgtactttcttgattatttttctcttggcaattttatttctcagctttcatttctgttactttcactcctaaccagtgggatcagacaggaagcagggaaaatgataggcctttctttttcccatcccagtattcacaaagaaagcattttctttaaacgtatactttgtgaatgtggcaatttctgctgcataatgatgggagatataaacggttttaagactatatcctgactcattgtctcttttaaactattctggttattctcttgcctttgtatttctccttttcccacattgcttcttaggaaagataaagtttaacagtggtcctaagtgaaaaaacactaaatgctcacaggatcccactgacccatctttgagagctagtttagttttggtcacactttgtgatgtgaatcaggtctcgagtaaataaatctagagtcccccaatctctttcaaattactgttgctctaaagaatcttcaagagctatcactgtaggctgggtgcagtggtacacacctatagtcccagctaatcaggaggctgaggcagaggatcacttgagcccaggagttcgaggctgcgttgagctgtgaccacacctgtgagtagccactgcattccaacctgggcagcatagtgcgatcttgtctcttaatgaataaataaataaatattatcatgaggattgcagttgcagcaggaaaagtcaacacagcacactactttacccctatgctttgtctgaacccaagcctaactctgggaacagggcagttgttctttccctgggttgagaactgcttgttattgctactgaggcctgtttcaatattaactttgtaggggaattagctcacattgcttcaaaccacttagatttctcaacctgagctacaaactagggaatatgaattagctttatttgtttattttatttatacatatatattttttgagacggagtttcgctgttgtcacgcaggctggagtgcaacggcctgatctcagctcactgcaaccgccacctcctgggttcaagcgattctcctgcctcagcctcctgagtagctaggattacaagcatgcgccacaacgcccagctaatttttgtatttttagtagagatggggtttcaccatgttggccaggctggtcttgaactcctgacctcaggtgatccacccaccttggcctcccaaagtgctgagattacaagtgtgagccaccgtgcctggcaaattaactttatttataatctggccatccagtggtggaagactttgaccccaatatgcttgactgatttttctggacatagcacataggcaggcattgttcatttgttcacaggattcctgggcattgtgaaacgtgacaggagattcagaagtacctttggacatagagtagaattcttcacctgcttcttaaaattccttaaatatccagctttccctcttgtcactgaccgttctctacattgaatccagctgtcttttcttggcctgtggtaaatgtattaactgtttctactcagacacgtaccaaagcgagctaatgttagccttttccaagagttctcactgtccaatttgcccccacgtggcttctgttgcacactctgttgtgtaggagtcttttgaagaagcattctgctgttttggataattggttttcagtcagtatcttgcttgttctggaatgtgatgttgtgagccaatagaataaaaagacagtgtctctgtatagccagaatgatggcattctacattctggcttgtgtcaggtcaggaattctactaacaactttttgcctttattgacaggtgttgatggtacgagggagcgctttcaggcagtcacagctggcaagactgtagagcttgagcttaggaaatgaattgatggcatcatctccataaattggcattgatgtctgcaaatatggccatttgcaatttatcctaatgcaaggaagaagagtcttggctgagaccaatgtatagttcagtgactgtttattatttaatattgctgtgtgatcatgtgccttcctttacctgaaaacatgaagccgcatcacctttcttcttctttttcctttgccttctcattttctcttggtgatctggatgggaatcttggagagtaaaccttttagattgctgtagttagtgttatttagtgattatccttgcttaattaagatttatctgaccctctgtgaagtataagcagctgaataccatttccaattaagtttctactttaaacatcttaaaagctaactcaccaatgagatgatctaagccccagacttcaaagctgaggcttgaaaaagtgtctttttagcttccttgactcatgtttacacatttctttagcaataacatctggtttatggagaagagatgttaaaccagctgattgtgagcatttgggtccatctccaggaaagtgaattccatgcaggcttgacatatcagattagtgggggtcatctctggttgcaagtagcaggacacaggaataattcagggaacccaagggctggaatgcacttgtgcttctgggaagccagtagaaaccagaatgcagagccagaaagccacaggtacaaggaagtactttgtctccatctctcttctctccacgtgtccatttctctctctcagcatactaactgcctttactgctcagtcacatcttaatataatgacagaatatggctaccacttagcttccaaatttatttattaccattctcaccacatgaaaatattactcaactgtctcttatcctgttccaaattcctgtaggaaaggatctggatttaggtcagatgtccacccagacatctgcaactactgagagaaggtgaccttgtacagacatggctgctgagagctcattcttaaggaacaggggatagttggagctcatggcctagaatttccacttatgtggacctggaactgtcaaagagctcccagcccaggaaaatcagattctactcatgctaaaattgtatgcttttcaaattatttacttacaaactcagtggtttggctattttgtagtattatactcttgttactaatacaaaagacagcttacagctcatttctcaattcagtaaaatagcaatggtaaagtcctttaacagtcatctggtgtttggaaaggtgattgtctgaatcgtctggagagatggctgtataggcttcataaaaaagtccaggaaaaagaaactgtacaaccatttttagtgacccattcaagtattattttttaaatcagtctatgactttgaaaacagtaaacttgcgtaattttagaagcctaggattgaattattgattcaatataggcccactccaacccagtcaaaatataatgaggacttctctgttccttagcaactaaatgaaaataaattccattacactggaacaatttttatttcttgatggctgccttctactttattccaccagtaccttcttacctagctgtgtgattatgatacgatttcccagggccttaggtttaaaagatagcttgaaatttcaattacttaatctcaatcaaagaaacatctctgccttattttgaaagacttttggagaagattcttcagcttctccactactgcccactgctgtgtagtggtgtgtttatccatgttctgtagatgagaaaatgagactatgagaagtaaccttaaatttgatttgaaacacaataggtcaggccgggtgcagtggctcacacctgtaatcccagcactttgggaggccaaggtgggcggacgacctgaggtcaggggttcgagaccagcctggccaatatagtgaaaccccatctctgctaaaaaaaaaaaatacaaaatttagccagggcatggtggcgggcacctgtaatcccagttactctagaggctgaggcaggagaatcgcttgaacccagaagacggaggttgcagtgagccaagatcgtgccattgcactccagcctggacgacagagcgagaatccgactcaaaaaaaaaaaaaaatgaaaaagaaacacaataggtcataagtagtgattgagccagggccagaataccagctttctgattccctgtctgatgctctttctgcacagccctgtgaggagaaaaataatcagattataaatgctttgtttcctggagcccaagcaagcgcttcataatccctttgtggccacagtctccatggaaggctcactctaagaaagcacaggactctgcatcctttatctctacagtctacctcttggttcttttttctttaattcctcttagatcccttttaagatatttgtgtaagaggagagaactttctcattcatttactctcccaataaaaatgtattaagtggctgcctttgtgccaggtcttgtgctaggcagagcatccatttctattattggactcagaaaattctattgggctcgactttgaaaagtctaggtgattacttgcaaaatacagcaaaagaagaatcatgtccataccacccattagatcaccattatatgaggttagccctgagcagtgccattttcccaatcatgtccctttgaggagggtaccatatgtaaaatagtgataacaagtgttgagtgccagctatgtgccaggaactttactaggtattttatataaattatctatttaaacctaacaacaacccaatgaggttggtattgtaaatccatttttatagatgagtagactgaggttcagacaataatggtcaacatttgactcatttgctatgtactaaatgctttgtgaagttttttttgtttttgtttttttgttgttgttgttttgtttttgagacggagtctcgctctgttgaccaggctggagtgcagtggcgcaatcttggctcactggaacctccacccccgcaccgggttcaagtggttctcccaccttagcctcccacagtagctgggattacaggcgtatgccaccacacctggctaatttttgtatttttagtagagatggggtttcaccgtgttggccaggctggtcttgaactcccgacctcaggtgatccacctttcttggcctcccaaagtgctgggattacaggggtgacctactgctcccagctgctttgtcaggtgttttatatgaaccacacttaatcctcacagcagccctatgctactcaactataattttccctactttaaagatgaaaaaacagattctaagaggttagaaggcgtattgcgtaagtcagacaagtaagtggcataacttagttaagattagtgattatctacccaggcacacccttcaaagccaggattaggattcccttgaatttcagttcagtggtcttgccttcagaagtgagcagggatgagattcttcctgaggcctgtgtgtcaaggcttagcgcctgcctcttgctcatcctggtgcattggctaccaagagtgctcagtgctttgttggccgtatcctatggatagcctgatatctgggcacgtaaagactcatttggacccaaaaagcatgaacctacaaccatatttttctgtctcttctgtcactgatctctccatgtgcaattaagaaatacaccttcagtctacatttgagccagtgtcttacatttaaactttaaattaaaatgtttttaatgtttttgtttttaatttaggacagaaaaaagatcattgtagaaagcagggaatgtatgtgatacagaagaagtatatttttaaatggaaaaagacaaagtataaatactggattaataataaccttttcaataccttggcatttccagaatccttgggaaaatattattgtaccttctcatttattattggcttttaaacttcccagtggttttctttctaacctggaggcctcctcaattcctgatttttccatttgtttctttgacaaatatttactaaatacctactgtgggctaggcactatagatacagctgtgaacaaggtagatataaaaaatcaattataaccatgacaaatgctacagaagaaagtataagatgctactgaaacactagtaacaatggagaggaagaagagttgcaaagtcagagaaggctttctggaagaattgacgtttaaactgggccttgaaggatgagtaggatttaggcacagaggacaagataatatagcagggagcattccaggcagagggaacagcaggtatgaaggccctatggcaagtaagagctgggctcatatggggaaccaaaaagtagtcagagatgggaaagtgttcccaggaagaaaggagccacatgttggcagaagaatctttcttttgctttttaagatgtattcacttaaaaatggatacttctggaatattgataattttgctgacctattattattctcatggcataaatataaagtggccatatttcaagagtggtgctgtggggaggagtagcagccagtggctaagagggaggcttggggaggtggggagggctttgaggtgcctctgattccggggattctgtctcctcaggcctgaagacaattgtgggtgccctgattcagtctgtgaagaaactgtcagatgtgatgatcctgacagtgttctgcctgagtgtttttgccttgatcggactgcagctgttcatggggaaccttcgaaacaagtgtgttgtgtggcccataaacttcaacgagagctatcttgaaaatggcaccaaaggctttgattgggaagagtatatcaacaataaaagtaggtggcctcttctctgcaagaggaataggaaaagtctattcctagttcacatggtcagaagctaccacagggcttaaaaaagtagttggaggccgggcgcggtggctcactcctataatcctagcactttgggaggctgaggcaggtggatcacctgagattgggagtttgagaccagcctgaccaacatggagaaaccctctctctactaaaaatacaaaattagccaggcgtggtggcacatgcctgtaatcccagctactcgggaggctgaggcaggagaattgcttgaacccgggaggcggaggttgcggtgagccaagatcacgccattgtactccagcctgggtgggcaacaagaacaaaactccatctcaaaaaaaaaaacaaaaaaaaaaagaggtagttggagctggaaaggaatggcagtgctactagaactagccttgtaaaattattcctttcctcgacgtaggattgtgttcagaagctctcaaacatcagccctctctctccctttttcgcatgtacccctaaacttttgctttgaaattcaggcttagaagcttgataaaaattatttttttccctagctgagttacttgggatatttacacatttagtccagaatgtatctatggaactcaaattttcttaatactactaagactattgcagtcgatctagtctagggaatcaggtgatctttaaggcactattcaatcctattacagttgagtagttttaatcattttatttgaggaaccaaaggaaaatttgatgtagtgatacttctttagactcatgaaaaaagttagagatgtcactattagtcattcctgagaaaataaagtcagtttagtaaccataagaaagtgttgcaaaggagatttcggggacatatgctggaaaggaaaacatgccttgtaatttaaaataggacctagtatctagtgaccaatgagctctaaaatatctttgataaagacacgttgtaaggatagaagaatagagtggtataaaggggtgtacaactcagaaaacttacttttaggtccctttgattcaagtaccagaatctggcatatagatttgaagtatgaatggaagttgggtgtctgtgaaaactatattgcatcaagaactttgggatagcacttttaatttgtaaatatatataagaaaatcattaataggaaagaattcttatcagctgtcacagctgttggaaaagatttatgagctaaagtcaataactttctgctggggctagttaggaacagtgtaaccttattctctcattcacttaaatctgcctgttcatttcctgcctcttcaaacttttctagcaaatttctacacagttcctggcatgctggaacctttactctgtgggaacagttctgatgctgggtaagtagctcacctagttttattctctttccttaaaataatgtacctgttattagtagggtcaaaataggcaatatgtttacttttctttgtgctcaagtagtagaccttacaattgcatctgacctatcggttggcatagattttctttgtttcacatttgtctatctaaagttgacatttcactagtaagtgcctgtgcttgtagtctcaagccaaaatgaaagaatccaaggatgaaatcaataacaccagatagcttacctgcctcttggggactcctctcatcctatagtacaatagagagcaaagataccatcttagtgatggttatggatccaaggatgacccaaaatatgcttgacctgacagcatagaggaggaaaaagagtagcaacgtagtatttgagtcctgatcctgatacttcctgctctaagacctttggcaagccatttaacttacctgagccttggtttttttcatccataaaatggatttatttaataagccatgctctctcttgctcacagggttactgtaaggatccacttacattacatgaaaatgctttgtaaacagagggctttataaatgtagggtggtagtgtcattttgcagagtatattggtcctctaagaactggtgttttaacatgaccacaatgtctagaaatccatttaatttctgtattagactactagagattacattgaaagaaatatgagatgaatctaaaagcaggagaaatggtgtaactgaggtaactgaaatccccccttgacttaggttgtcacagtgagtgtaaagaaaacaaatgattaagaggaacttctggccaggcgcggtggctcacgcttgtaatcccagcactttgggaggctggggcaggcagatcccgaggtcaggagttcgagaccagccaggccaacacagtgaaaccccgtctctactaaaaatacaaaaattagccagacgtggtggcaggtgcctgtaatcccagctactcgggaggctgaggcaggagaatcgcttgaacccagaaggcagaggttgcagtgacccgagatcatgccatggcactctagcctgggcaacagagctagactctgtatcaaaaaaaaaaaaaaaaaaaaagaggaacttctagccgtttgtcatttgggataatagctgagttaaatttgattgaattgcacattgatatgaatctagaacagtacttctcacactttggcatgcataagaatcacctggcatacctcttaaaaatgcagattcatagatcccatatccagaacttttaattcctagtttgggtaaggatgcaggaatctgcatttttaaagaccatgccaggtgattctgaccctaggctgtccccagaagttggttagctgcttatttccttcttctttttcttctaatttgttggcctggctctatcaatggttatttattatctccaaggtcatggagtaaatagaattatgttatttattatctccaaggtcatggctgggtggaattatgttgaaaagtcctgaacttccctttctttctttaggcaatgcccagagggataccagtgtatgaaagcaggaaggaaccccaactatggttacacaagttttgacacttttagctgggccttcttggcattatttcgccttatgacccaggactattgggaaaacttgtatcaattggtgagtaatacctcttttcctttggccatagagtttgcatgagcttatatggggttggggaccttctgtgtgagagacatttagtgaagacattatacaagatctaactgttgtgtttcccacagtcagctggtttttgatattaagtgaattctctcagttctcatccctgtttctcgaatgctcagtcatgtatagctgtagactcttacagccttgacggcctcttgtctggcctgagaatctgctatctctatctacttcctattgttcatcctctgcagcatatctccttttggatatttggggttagggtttgttttttttgttttgttttgttttgttttgtttttgaggtaggtactacaggcatgtaccaccacacctggctataatatttctactttttggaaagttgggatttcactctgttgcccaggctggtcttgcaacttctggcctcaagtgatcctcccactgtggcctcccaaagtgctggaattacaggcgtgagccaccattagggcttctgtttaagaaaaattaaacacctctttgtgcaaggcactatatagatggaatttccataaggaccttggagtatatcaacatttttgagatttgtaacacatttggatttgttcaagcaggttgtacagataaaaataaggtcagtaacattctgttgggctacactggtgactctggacaagtcatttaactttgctggttgtaatgaagttagtgtaagtgattgctaagtgtcttacagcttagaaattttatgacagtccattgttttctctttgtgtcatttggtgataccagttactttgaaaatgaaaaacacgtcccctcaggcatgaaggaccctctttaagggaagtttctagttcaaatatctgagttaattcttacctttctgttgcacagcctagagttccctcaggttgaatgtttctcatgaaatatttgtgattgatgctgtttctttttttttttcttttttgagacagagtctcgctctgtcgcccaggctggagtgcagaggcgcaatctctgttcactgcagcctccaaacaattctcctgcctcagcctcccgagtagctgggattacaggcatgacgcacgcacctggctaatttttgtatttttaatagagacggggtttcaccatgttggttggccaggctcgtcttgaactcttgacctcaggtgatccacctgtcttggcctcccaaagtgctgggattacaggcatgagccaccgtgcctggcccattttgtggttaacagaataaagatgaaaactgtgtaatagtgggttgcatgcacataacctaaaacctagtttccttctgcctttttttaacctcccccactatcctttatgtcatattgtcatatccttttaaaactcatcctattgcaaaagaataaggaagggtgtcactcaagatggggatttcctggccggacacagtggctcatgcctgtaatcccagcgctttgggaggccgaggcaggtggatcacttgaggccaggagttcaagaccaacctggcaaacctggtgaaaccacatctctactaaaaatacaaaaattagctgggcatggtggcacatgcctgtaatcccagctactcgggaggctgaggtgggagaattgctttaacctgggaggtggaggttgcagtgagctgagatgatggcactgcactccagcctgggtgacagagcaagactccacctacaaaaaaaaaaaaaaaaaaatgggtccgggcgtggtggctcacgcctgtaatcccagcactttgggaggccgaggcgggtggatcatgaggtcaggagctcaagaccagcctggccaacatagtgaaaccccgtctctactaaaaatacaaaaaaattagctgggcatggtggtgggcacctgtaatcccagctactcgggaggctgaggcaggagaatcgcttgaacctgggaggcagaggttgcagtgagccaagatcgtgccatcacactccagcctaggtgatagtgtgacacttcatctcaaaaaaaaaataaataaaataaaaagatgggatttccttcaacttggacctgatttcagagacataatttgtctgttaatgctgtttgaggatctgtagataaataaactgcagtcttgtattcttttctttatacttgtcttagcccaaaatcaaactttttttatgaaagaagtgtatggggaatatttagaaatgagaggggatttttttgtcacaatggttgggagataactactgccatttaatatgagttgaggataagtgaaaccattcaaccattgggagtaccaagtgcccacaataggaaggagtactgcacaaggaaacagtcctgtacaaaatgcaaatagtgcccttacagaggaacttggcccattagctgttttcagcccggttcatttggtacaagtgactcagaaaatggcctttgtctttgcagactttacgagcagccgggaaaacatacatgatcttcttcgtcttggtcatctttgtgggttctttctatctggtgaacttgatcttggctgtggtggccatggcttatgaagaacagaatcaggcaacactggaggaggcagaacaaaaagaggctgaatttaaagcaatgttggagcaacttaagaagcaacaggaagaggcacaggttggtgatgaattctttgcaatagaccttcctgccagatcatggtgactaagaccccatctgattttcactgcagttgatcttttctaggcatattttcaaatagaggccattggtctgatgaaaataacccaagtaacaactgcagatggttgctccaattattccatttgtcttaacagccaaattgtttgttcatatcatcttttgttgaattgctcaactgttcagtgtgcaaccgccatgatgactgggaagaaaaaagtgaccagggcagtttatatagtgtttcacataagcatattctttttcttgggagaaatgttaagattcctgtggtcataaaaagtattatttctaattaaaaagaagatacaggcaaaatattaaagtaaaacttgaaagacatttgtgatctcatcaccttaacacttaactttctcatccttatctaaatgtacatgtatttatacatttttaggacccataatatataatgttacttagcattcatttccagacttgctcagaagggatcctctggtaccaaggcagcagtcaagttcttgtctgaaatgctcaagagaataactcccaaagttctcaccactgggttctgctctgttcacttagggctgtgtgccagaatacacagaaaccctctaacagtctaggtttcctgcctccttttttcctcctttcccttcagtagggaaatgttctgtactaactggttggctttgggtggctccagttaattgccctggtctggcttccctgctgtggcttctttcctaggctgctgcgatggccacttcagcaggaactgtctcagaagatgccatagaggaagaaggtgaagaaggagggggctcccctcggagctcttctgaaatctctaaactcagctcaaagagtgcaaaggaaagacgtaacaggagaaagaagaggaagcaaaaggaactctctgaaggagaggagaaaggggatcccgagaaggtgtttaagtcagagtcagaagatggcatgagaaggaaggcctttcggctgccagacaacagaatagggaggaaattttccatcatgaatcaggtaaactcttcttttttctatacctttttcaaaaatgtattttttattaaggtaaaatgtgtatatgtatattataccatctttaccattttaagtgtaccgttcagtgttaagcacaattatattcttctttttcctctttcatcccctctatcccctcttcttcctggcctctagtaaccaccagtctactctctaccttcaagagatccacttttttagctcccacgtatgagtgagaacatgctacatttgtctttctgtgcttggcttatttcagtgaacataataacctctggttccatctatgttgctgcaaatgataggatttcattctttttatggctgaatagtattccataatgtaaatatactgcattttctttatccatttatttgttgatgggcacttaggttgatttcatattttgtctattgtaaatagtactacaataaacatgggagtgcaaatatctatttaatatattgactgactttcttttagttatataccccataatgaaattgctggtgtattattcagggttctctaaaggtatagaactaataggatatatttatatatctattagtatataaatatataaaggggagtttattaagtattaacttacacaatcacaaggtcccacagtaggctgtttgcaaacttcaggagcaaggagagtgagtctgagtcccaaaactgaagaacttggagttggatgttcgagggcaggaagcatccagcatgggggaaagatgtaggctgggaggctaggccagtctcgcctttttacgtttttctgcccgctttattttcactgacagccgattaaatggtgcccaccacattaagggtgggtctgcctttcccatcccactgacttgactgttaatctcctttggcaacacacctcacaaacacacccaggatcaatattttgcatccttcagtccaaccaagttgacatgcagtattaactatcacattggattatatggtaattctatttttagttttttgaggagcctccatactcttctccaaactcattgtactaacgtgcattcccacaacaggtaaactctttgcattggctcaataagcctaaaaacatctggtttttctaatcccacttgatttttgttttcccctttggccctatgttttccaggcccatccctgcatcctcatttctacctcactatgctccatattgttctcctctgggaggaagtgttaccagcacatttggaacattctccattctaatcctgccctcccttctctgatgtaaaagccaaccctagactatgtgatcacctttggcagacttgcttggcagtaaagtatatgtcacaccagcaatcttcatgttctaaaacatcagggagagcttttctcctctaagcatcagaatttagctcaaacatctctgtttaagaattgcatttaattataggggataataataataggagtcatgaaacaggacatcttatttgagcatggcaagttctactgattaattattctggatatgtagtatcacactgataagttagcctatggtagattgaaagcctccagtttttcccaactttgataaataaggaaactaagcaaaaaagagaagagaagacttagggtaattgttgagcattctgttactatagatgtcatcacataaataggtatttttgaatttcagagaacaccaccaaaatctaattcttaggccatttaatttcccattttaaagaaatgctggaaagttggtaggtatagaatagattatagttactgtttatggcagtatatccagtgtcttttcttttttcccagagatgattcattttcccacttgcatctctcactttccggttcagtcttttgccagtcttattcatttcaggggatgagcaaaatccctcatgtccatccctttctttccattccttaaccttatcttagttttggctttacaattgtattattttgttctactgcgtttgtccactgcagttttgttttctgtagtctttctccttctcctttgtattttatatactgtcaacagattacgtcctaaaatgtagttctcatcattcatgtagtaggcatttatggagtacctactacatatcaaggattgtactaggtcctagggcttaaaaggtgattaaaacatcatccctaccctagagagcttacagtacagtgagacagctgaatacactaaaaaattatgtagtagcatgtgttattccataattgagatatgctgggggtgttagaaaagcacagatctatcccaacatggagattcagtaaagattttctgggaaaggtaaatttctgaactgaagcttaaaggatagacaggaattaggtagtgtatgtgtgtgttggtgagggaacaataagaaaaaagggatggtctaggtttagaagggaagcatattccagtttagacatccaaagtttgaattatttgttggataaccaagtacagatttttttagacaaggataggcaaatgatagctcagggaagaggtcctgagctgagaggtggtgattgaaaccatgagacttgtggagattactcaaagagaatgtgtcagttggaagaatagtgagccaaaggcatgaccattgctgttcactggcatagagatggagttcaggaaagaaaacggataaacagtgttagagaagctgagagggccaagagttcagtgaagtcaggagagtagcgatgttggagaaggcagggccatgatcaatggattgaaatttaacagagatgcttagtgagctcagaattgaaagtgtccatcggatttggcaatataaagtcattgaggactttaaagacatgttttagtccagagtaaggaaggatgccatgttgagtggggagtggagacaatgagtatagacttctcatcccagcttctttaaagagtgtgggtggaaataagcatgtttatactttgtggaagaaaaaaaaacagaaaagggagacgtgttagaaaatgaaatagaatagatagaagtagagcacaatcttggaagataccgaaatagatgtggtttttaacagaaaagggacccttgttccctgaaaccttaagaaaacagggaaggatgaggtggataaatttgtagaaaaggagtaggaagttgaggaagataacccctgacagtttagtgttttgataatgttgggaattaaaaatcaaggagtttgagatcagcctgggcaacatagtgagacctctgtctctacaaaaaatgaattaattttttgataatgtagggaattaaacatcttattgaagggaatgagaggttgtgtttggaggtttaaagaaaatattgacagtttagaatagtttttaagaagaatgggagagggaattcccctaatcagattcattctatttactaattaagtcccaactccttaccctggaattcatagcattccccatccccttagtacggttacaacctatgtgttcattctccagtctctgtgccccatcaagcaccctatacctgaaccagaatgagctactagatatttctcatatatgatgtttgttttctaccctctgtggtttgctcaagaaacaccctctctaaaatgtcctgttggccagcacagtggctcacacctgtaatcccagcactttgggaggccaaggtgaaagaatcatttgaggccaggagttcaagaccaccctgggcaacatagagagacccctgtctctaccaaaaaattggccaggcgtggtggcccatgcctgtagtcccagctactccggagtctgaggcgggaagatggcttgagcatgggaggttgaagctgcagtgagctgtgatcttaccactacactcctgcttgggcaacagaacaagaccctgtctccaaaaaaacaagaacaaaaacaaaccaaaaaattaaaattaaataaaatgccctatttttctgtctttgaatttctgcatcatagttattctcaatatcttcctttcaagaaaccttccctgactctcctgttttctagttggaaatcttcattttatctttctgttatgttttatatgtacctctttatttgttgctttttactctacatatagaaagtactctacatatactctgtgtgcatatttatttatgctcatatcctcttctctctaaataaagtgttaaagtcaaggtctgcttcttagcacatggctagatattgttagacaaatgaatgcaagacttttagaaatttgatttaaccctttctgagagacttctttatagcctgaagccatctctatctcaccttcacctctcctttcttctagttcagcctcttttggggaaagtatgatagtagctttgttgtaattttacccttgtcttgagagactcactgagctatgaataccttagcgctgttaacgctttgctattgaatggtctctgattattctataggctttagtacaaaggtacactgattgctccttaactcaaaaaataaaaccaggtttttgagatgccctgctgtgcatgaaaatattcacttagtctaatctctccattcaaaaaaaatagtaaattcctagaggccaaggctgactgccaagagtagcttaagatgctacaagggatagtagtattctttgtcccaggactttcctgcagtttctctggaagagtgactgaggaaatcgaggcctagaaagaatcacttataactataactagttatagaaggttatataactagtaagtgttcaagccaagatttgaacccaggttcatccaactccagagcctgtgctcctaaccaccccttctttattcctgcacacgtacatgatcatctcttctgttagtttaacaatgaatgtggcttcagttttctcacaacatagttcagttatgtgtcagtttcttttatttccatagcttctgagttcttttttttttttttagaaattttgagatttttttcatttgaaggtaatcgtaatgctattaaattcacaaatgctaatttaaatattcaatcctatttatctaaaacacacattgcaaacacacaaattatctattctctccacgtcagtacccattcatatagtggtttggaaatggggagaatagattccccttaaactgcaagtcagcaggtgtttctttacagttaactttagcaaaattcatacaaaatagtaattaacaatgatctttacttgttaactcacaaggaaacaccttcaaaactgcattttgttaaagtttctgtactaaaatgtagaaaaactgaactacataaatattgaaaagttaaaaattccttaatttttaattcctggtaccactaccacaatttacagggcaatatacctgatgtaatgaaaagaaaaagaaaaagacaaggctacaacagataaaaaacctcaggaatgtacatctaattgacactacattgcattaatcaatagctgcacttcctgcaaactgtggctatggtagtcctgaacaagaagggtttcctgtttaagctgcagtaacttttctgactatggatcatccttccttctgtggcagatttttacagttcctctaatgcatttgggacgactgtctcaaagtaacctgcagctttcctgacagctcctcgcgctctctcctgctgagaactgtagcccttttctgctgtttttagaaccttctgctactatatccaccacttccaccactagatgcataaccaccaccatagggactgcccgagcttcttccaccaaaacttccccctttcatgggtccataatttgattgctgttgtccactataatttctaaaatcattatagttcccaccaccaccatagttaccaccgccaaaatttcctccttcattgtaaccatcatatcctccaccaccgctaccatatccaccacaccaccttggtttccatatcctggtccaccaccaccatagccccctctactactataaccaggaccaccagcatagttgccaccgtcacttccaaatccattatatccaccatcacctcctccataactacctctgctgccaccacctccaccaccatagcctcctcttccaccaaagtttccaccacggccaaaattacctccaccacctccaaagcttcctccgcaacccataaaattgccagatccacctccacgacctgtccgtgatccagcggactgcatctcttgtttagaaagggcctttttcacttcacaattatgcccattaatagtgtggtatttctgaacaacaattttatcaactgtatcatgatcatcaaaagttacaaaagcagatcctctcttttttccactctgcctctcttgcataacttctatggtttcaatcttgccatacttttcaaagtagtctctcaaattatattcctttgtatcttctgtaataccaccaacaaaaattttcttcactgttagatgggcaccaggcttcacagaatcctctctagaaacagctctctttggttccactacatgcccatcaaccttgtgtggtcaagcacacattgctgcatccacctcttcaacacaagaataagtcacaaaaccaaagcccctggaccattttgtttgggggtctctcattaccacacaatctgtgagtgtgccccatttctcaaaatgtcctcttaaactatcatctgtagtttcaaagttcagactaccaataaacagttttctcaactgctctggttcctttgggtcatggccctcttcctgccggtggcaatgtcgacggctggagtcggactgggggcgaccaggcggtggttttacctccattttgagcctgagttcttcttgagacatctcctgctcactcatctccgacctatttctctatatttttaaggctcagggcagtttataaatattaagttgagcctattttttcaaagtattttaattgctctattgcagcagttttcaaactttctggtcttaggacccctttatcttcttaaaaaattttgaggacctaaaaacctttctaaaatgtgcttttaatttctcatattagaaattataattaagaaaattaaaaaatatttactaattttaaaaatatagtaatgataaacccattacatgattaacacaaattatatatttttaagaaaaatgaactgttttccaaaaccaaaaaaaagggtttttttttttgtattacatttctgcaaatctctttaatctgtaatgtaatagaaaacagttgaaatatcatactggcttatgcatgcattcagtttgttgcagtatgattttctttggttaaggtatttgaagaaaatcaagtttcatacagatatgtagtggaaaagggaggaatattttaataaccttttcagataactgtgaatgttcctccttgatgctgttccaaaacttaacagtgacaattatttaaacagttagttgtgacgtggaaactataacagtaactttgtactctgttatagtaaaatcccttgctccattttgtgccatagatctttaacctgtgaatgatttctagcatcatgcattgatcatttgagaaatttcctgagtttatgcaaatcttccaaatacacacaagattttaaaactatatttattattaccaccaatctcatcataaaactatttaaatattatgaaactgtcaggctcacagtgtcactgtgtgcttatgagaagatgagtgataaaagcacatatcatctcagtattattaggaaagaattttgacctcatgagccttccttaaaaggtctcagggacctccgggggtctccagaccacactttaagaaccagtgttatactagaaagaaaaagtgaaatatggcatggaaatagaacatgtaaaatcactccttcatcacattccaaacatcccagtcatgtaagcctcatcttgacagacaatttacgtgtatcccctgagatccctagagataatttttctgtggaatgcaaaagttacactctcaaatccagaacatcccagagccattctcccgagcaaacatctaaacctaagttggaattcatagtttaactgtgactgcctgaaaaggactaaaagctcctggttggttgacaggaagattttgaaaagagggagtaaggcctactcatctcataaactacacaggatcccaggatttaatagagccatggatcctgagtcatcactgaaaacctctagtctaggaaaattgagattgaggaagggttggggtttcagccctcaggatgtagctccttagggaatgccctaaatcaggattggatcctgggtacaaggagaaatggagcaagtcacctttacccctttcacatttgtccattgcagactactcttttgcaaagagtgaaacaaggaattagaaaataatagaacagtttttcctcatattatgtattatcttaggatcctgatttttaagtgttcataggttcactgaattggtcataaccttcatcactgtcttatcatccttatcactatccttaaggttaagaatagtctgatgtattagatctcatgtagtatatgatatttcctcctggcctccaagtttcaagagggcagggaccatgtcatatgtctcgttcaccactgtatccacaccacttagcacacaataggtatttggttaaataaaattaaattttggccaggcacagtggctcacgcctgtaatcctggcactttgggaggctgaggtgggcagatcacttgaggctgaggcaggagaatagcttgaacctgggaggcggaagtttcagcaagccaagattgcaccactgcacttcagcctgggtgacagagcaagtctctgtctcaaaaaaaaaaaaaaaaaaaaaaaaattatataaaattaaattttattgtaaaatgcataaaacctctttcctaatgtgaaggcctaatgtaccaggtagtatcagcacccagcattgacctaaggcaaaattatgaattcagtgtagtttagcttgctgtgagaagtgaagcagtgaccccgtgcaggtgtggaacaaccctaaaatgggtggctaagctgcagtacctaatctaagtgcatgttaattaagttaaacattgtagttactatgtgcaaagcactctgggagatataaggatgaatcagtcaatgtgcccttaaggagtttgtagttggttaaaaatgagaggtagaacatgtatataaagaactgttgtaaaaagtagagcgtaggctggatacagtgactcacgcctataatctcagcactttgggaggccaaggcgggaggattgctttagcccaggaatttgagaccagcctgggcaacatggcgaaaccctgtatctacaaaaaatataaaaattagccaggcgtggtatggcacatactgtgtggtgtggcacacacctgtagttccagctacttgggaggctgaggtgagaggatcacttgagcccaggaggttgaggctgcagtgagtgattgcactattgcactccagcccaggcaacagagtgagaccctgtcttgaagaaaacaataaaaaataaagtagagcataaatattctgaaagggggtttggtgctatggaaagattaaggaagttagtagaggaagaagcagaagggctggatcatggagaactgagaggatttccccagctgaaaatggagcgtgcactggaaacagaggaaataaagacctgcggtagggtggctgcatggtagggtgtatgagaaaacagtgaaagatgaagtagaataagtaaattagagtcaaagctgggagggtcttgaatgccatttttatgacggtgtgatagtgttaaaggtgattgtggcatttagcaaaggggccatgagtacctgagtcctgtgttttcctggccatatttctccgcagtgacgccctcaagagagatatatgtgcccaaggcaccggttattaacacctgggcttgtacgctgaacctcagtgttctatgttacgcttgccttcaaacttgtttttcatgtacagatcaaccagtccaaagcccacattcccaactacctcctttatctaactcactcactaagccaatatttcccttccctaaatcaccccatagccagataccagacaagtagttaccacctctgtaggccagagccttccaaaattattcaaactccccaatcctaaacttgctcagacttacctatcctgcctcatcccttccttcctgaggaaaccacaggctcaggctaaactttccccctcactccttctgcttcctgaccaacacttatatttccccgtatggccctccatggcatggcaagcccactcctcttgggaacggaagtaacgaactcttctttcaaaggcagttgcctctgtgtctgtcaccttaccgtgatctgattaaaacaaaatcccaagtacatcttaagacaccatcttctggccagccacattgtttagagcagtgtttctcaagttacctgtggtaaaggactcatttctatttttcccaattcttcatgaactgatactattgtaaaatacagtaacaatcaatttctagaaaaatcatcacattcttagatgttatgactgtgtctaattgttacaaaagtttctaaatgcccctctcagtttccttacttgtctcattgcagaccaataacaagtcatgtactagctgcctgtgaatcacaccgagcagagctggttcaggggaattaatcagtgattcaaagggggtgcccaaacatacatgtaagaagaatagtaagcttaccaatccagcaacatggaagaaggacgtgcaagggcttcctctgttatgtgctcctttaccacacagcgtatgtgtccttttaacacacagtgacaacatctactcataaatgaggctcagtcaacattctggaatctaaccaatgtagctccttctctctggtacaaggatgaggcagaagaacaaaataagtcagggtcatcctgttttctagagacctatatatagcatatggcatgtatctaacaatgacatttatatataattatctatgattagtgcttttcttgatgtggtccccagtgatcaaattcatttattgtcttagaagttcgtgggttgcttaaagccaaagcaggaaaagcctacataacacgtgaaagatacaggtgagagcatggaataatatgcaactagaattatccaaagaaaatataccaatctggggacaggggctttgtacattacaagaagagacaggatctaaagtatagaaccagaaacggaattgtagccaacaaaaagataagggcagaaatgttaaagaggagccccatagcccttccagtgttaacatcaaaagtattaacaggctgagcgcagtgcctcactcctgtaatcccaggactttgggagaccaaggcaggaggatcacttgaacccaggagttcaagatcagcctgggcaacatacagaccccatctctattaaaaaaaatttttttttaattagccaggcatggtggcacatgcctgtagtcctagctacttggaaggctgaggcaggaggatgccttgagcccaggggtttgaggcatatttctgttttacatatttctgttatgagtgaaacagaattataactggggatgttgagatgttttaatttcaggagattgttgcccttgcaatacatactaatacatttattaacagtgaaaaatgggatcatgctttttcaaatgaaaataaatctaatttagccaattgctctgacattgaggactgactgctcattagatcatgtgattgaacattttcagaaatgagctaaatctgtgactttaaggtagattttgatgaaaatatatttaaatcatgtgataagataaaatcatattaaaaataaatgttggcaatgatggaaagacattaataatattttgatcatttcaaccatctattgggttaaacgagcttcctttaagtacaagagtaactcatgtgagaataacccacataattattagtaaataatacagctttttgatgtcctcagaaatcaagaaagggaatgtgtgtaggtaacaaatcttttggcaaattgagttttcagttctttgctttcaataaaattggaaaaagacttaattgccagccgatagattattacaataaattttgctgatagtttgctatatatttttggtatataacttggaaggagtccaaagaattgagtgacattactataacaaagttcttccattccaagataatatttatgtgaataaggttttagcacataaaattgattattagaaaggtggggaggattgatgttgagccatgtctcattctaataataagtaatactaccaacaaatatttaaacaccaattgaaaagaaaatctcatccatcttattaagaaatgcattttaatacaattttctttcttaagtctattacctataaaatgtgtaatatatttctatagcttgatcaattgtattcataagaatattaataaaaactcaatccaggagaattatttaaatgtcttaaagactcatgctcatagaaaatttttaatagtaagtacagtttatttataattttttgtataatttgttggaatcatagccaacaaaaagataagggcagaaatgttaaagaggagccccatggcccttccagtgttaacatcaaaagtgttaacaggctgggcgtggtgcctccctcctgtaatcccagcactttgggaggccaaggcaggaggatcacttgaacccaggagttcgagatcagcctgggcaacatagagaagtaaattcaggggtgagcagtaaaatacattaaaacataaaagtgtacattcaaataaaattccctagggaatatggaaaggaagcatgaaattgaaggagaagaataaataagaaaaaatttatgctaaagaattcttggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacctggcaggcggagcttgcagtgagccgagatcgcgccactgcactccagcctgggcgacagagcgagactccgtctcaaaaaaaaaaaaaaaaaaaagaattctttaagtaaatttctttaccacaaactttacggtaaacaagagttttatttaaaaacatcaatgccggatattatataacttacagctgtttgagaattatatactttacaactatgtaaacttttgatgaaaaaaatatgtttaaaatggggtggatggaatactatgcagccataaaaaggatgagttcacgtcctttgtagggacatggatgaggctggaaaccatcattctgagcaaactatcacaaggacagaaaaccaaatactgcatattctcactgataggtggaaattgaacaatgagaacacttggacacaggttggggaacaacacatactggggcctgacatagggttgggggaggggggagggagagcattaggagaaataactaatgtaaatgatgagttaatgggtgcagcacaccaacatggcacatgtatacatatgtaacaaacctgcacattatgcacatgtaccctagaacttaaagtataataataataaaagaaaaggaaaagtaaataaatacataaataaaatggggtgggagggggcatatataattttcaactgaactaaaaggcttgaaggccactgttggagtagtagttgaccaggacatgtacttggagagaatggcaaatgatacaggcacgttttaaattctgtctttttggccaggagcggtggcttatgcctgtaatcccagcactttgggaggccgaggcgggtggatcacctgaggtcaggagtttgagaccagcctggccaacatggcgaaaccctgtctgtactaaaaatacaaaaattagccagggcgtggtggtggatgcctgtaatcccagctactcaggaggctgaggcaggagaagctcttgaacccaggagctggaggttgcagtgagccaagatagcgccaccacactccagcctgggccacaagagcgaaactccatctcaaaaaaaaaaaaattatatatatatatatatatatatataatatttatttattgttatatatataatatttatttattgttatatatatgataataaataaattctttttgcccagtgtggcgtagtctaactgaagttaaagacacctcctctgagcccatggtaaaaagaaatacacagccatgtgctttaccctggataagttgtgtataatgtgagataaaagcatcttagggatgcgtgcaagaacagtgggtagacgttttgaatccgtaactggtcaagcacaggtgagtaacaatgggtgatgaactgtagcagtcaacatgcagaagtgctttctggaaacacttgtgttctgatcacaggagtgcgagggtggggccggctgggaacctaaccactttgctcagtataaaggtccacactcccgtctcatttccccgtccctctctctttccctgtctgcccctgcagtcactgctcagcatcccaggctcgcccttcctctcccgccacaacagcaagagcagcatcttcagtttcaggggacctgggcggttccgagacccgggctccgagaatgagttcgcggatgacgagcacagcacggtggaggagagcgagggccgccgggactccctcttcatccccatccgggcccgcgagcgccggagcagctacagcggctacagcggctacagccagggcagccgctcctcgcgcatcttccccagcctgcggcgcagcgtgaagcgcaacagcacggtggactgcaacggcgtggtgtccctcatcggcggccccggctcccacatcggcgggcgtctcctgccagaggtgaaaattgataaggcagctaccgatgacagtgtaaggaagaacacaaatagatcgaggctaggcatggcagtctcccccgctccttcccctcctctttccctgctctgcccatcccacttggtctgtctggaccccactcctgttaacaccccagccatttctgtgttcttcctggcctatttctatttctctcttcagttttccccctattactcaccctgtcttctcctttcctttattctttgctccattttccccatcttccctccttgtttctgacattccttctcccctatcaactccttcctttattttaccgttttctttctctccatctttatctttgctagtctgtgtgcttgtgtttccctcctcccacctgctttgactgaatgcctctggccccggagcctgcccggatggaatgagaatgccatggagccaccaccaatgaccaagtctgaaccggtttggaactaccattgcttctcttcccccacgtcttctaccctcctagggaaacagcttggaatttagagatcttatcctttaaatttcaaaaaagtaattgagttttgaataatgttctaagtctcctctgcaagaatgagatgtgctttttctaaagaggaatgctcatgtgatgtcagggtgggaggtgtgtgccagcagagccaggcaaggagaagttaaagaggccaataggaaactggacccagacttttaaaagggattgaaattgaaataaatcaaaggaggaaaaagtgggaggttggggcaagaacacattttatatgggggaggaaggaaaggggaagcaaaagatgaattttaaatgtaatcaaatgtcaggctctggaggagttgcatataatagcttcacaaaatcagttatctagaggtttggataatggtgcccctctttgggaagagccatctcctaacatttctttaaattctaagctgtttgtatcttttttattttaaaattcttataaccttagtgatcctaatccttcatacctctaatttctaactttcctcagtccctcttcagctggtataaactccttgagatagcatgttagtctatttctttctaacacttcagtttcttctaacacagcatgaagatagccaatcctttaattagcatgatgcatgtatggaggaaaactggacaatcatggataaagtttattgaatgtatagataaaatatcaaaaggcaatttgtatgtgtttgggattgtctagtctcgcccttcccttttatttaaaagcaaaatacagccgggcacagtggctcgcacctgtaatcccagcactttgggaggccaaggaaagaggatcacatgaaaccaggagttggagaccagcttggcaacacagtgagaccctgtttgtacaaaaaataaaaataagaaacattagccaggcatggtggcatgtgcctctatagtcccagctacttgggatgctgaggcagggggatcacatgagcccaagagtttaaggctacaatgagctatgatcactacatttcagcctgagtgacagagtgagactctatcaaaaataaaataaagcaaaaatactctcccccttatgtttgtatagctttttataagctacaaattactcttacatgcattatttaatttgtcctaaataaaaattctgggctgggagtggtggctcacgcctgtaatcccagcaccttgggaggccaaggcaggtggattgcttgaggccaggagttcgagacaagcctggccaacatggtttgaaacccatctctactacaaatacaaaagattagccggatgtgggaggctgaggcaggagaatcgcttgaacctgggacagggaggttgcagtgagccaagattgcgccactgcactccagcctgggcaacagagcgagactccatcttaaaaaaaaaaaaatctgtaagggtgactaagtgaagattaatatttctgtttttgagatggggagaaggttcagagaatttgtgttcctttgggtcttacagctcatcactgatagagccagaatctcagacccctcagagaccctaatcttccgtgtgccagttaattttaatttgttctctgcctagacacttggccgttgctcttctcaagacctacttatttaagatcagcaacagtaagaacaataataatcctctggtttctctttagattgtataaatctttcactttttacaacaataataaacagtgggccgggcacggtggctcatgcctataatcccagcactttaggaggctgaggtgggcagatcacctgaggtctggagtttgagaccaggctggccaacatggcaaaacctccatctctactaaaaatacaaaaattagccaggcatggtggtatgcgcctataatctcggctacttgggaagccaaggcacgagaatcacttgaacctgggaggcggaggctgtaatgagccaagattgcgccattgcactccagcctaggcaagaagagcaacactcttgtctcaaaaaagaaaaaacaaaacaaaacaaaacaaaaacagtggctccagatagttggccaaaataaatgttatagatacttatctttacatttaatttttatttgactttcactaattctgcgaatagggataaattttgggctccacagttagataattatgttctccgaaaaaacaagagataatatcaatggcaaatgaaggatggatcaacatgggcagtagagttggggcaattcaaatgtttagaaccaaattgaattttgatatactggcagtttttaaaaatatttaagccaaataatgcagcttgccttttctctgaataaaaaggtattagagaaggtattcagaaagaaggagcttaaacttcagctgaagagagatgatcaggtttaggggttttgtttttgtttttttagcaccttctgttacactgtgtgggagaaaaaaattgagagtcagttaagcagatggctgtggaatgtaaggctttctgtactgctttacactgtggtctataaaggtctgcatttgggttttgggggatctacatacccagcaccctataaacacttaggaggttctctgtagtgacctcaagtgaggatggtgacagacttgagaattcccaaagtcaggaggtcacagtggcaggaagatgaggtaggcaagaccatatcattcccaagggcctcataactaggaaaaactatttttatttatgtatttatttatgttattagaagccataaagaaactgttatggctagttgttaacggtgtgggaaaatgtctaagttacattaataggcccaaaggaagaaaacagcaaaacaagatgcatatagtttgtgtggtatgataccaaattatataaagacaaactacatagagaaagaagatgaccagccaatagttaacaatagttgcctttgagagaagaaattatggacttttttcttccttatacttttctgttctttctggttttctgtagtgagcataatgattatagccatcatatattgagttcttattatactatgctgagcattttatatacattatctcattttattcttataatcactctattcagtaggtggttttatcctattagcagatgagactcagagcgctgtagtgacttgggaattggaccttaaaccatggtctttctgataccaaaaggaacttcctgacagcttaaatattagctcctttagaaagtgggaaaaacagtcacttatcttagaaggacacagtatattaagacttttatattattcaggattataaatttaattatgaatattaagagattctaattgcttaatatctcttaaattaactagaagcccaagacagatgaaaattaatacctcttggggctaggatttagtgattgttactagcaaacattttggatgcatccacagccaaggattaacctgagcaattagaatgcatccagttgtgtatactcacgcttcacagagtggcataggagccactgatagtgcacgcactggtctcacacaatattcctgcttaggctatgccaaatctatattttttccttcaggcttaaattaagaaataggctgtaagaaaaaaagacattcagacatcacttcattagtctcatcaaaaattattttatatcttcattagttattcagttgtgattgagtgttgagattttttgatcattttggaatttcacctttgctttttgctgaagcagaagataaagggactttttcctgcgtctccatctctgagctgggaaagtaggtgagaatcatttctcttcactcattgccactagcaatccagaaatcacatgcaattgagaaatcatgttgaggcagcttgcaaatgtataagcattatctcatttaatgcttacagcctggaccttatgaaacagatactgctattggctgcatctgactgaagaggaagccaaggcttagaggaataaagtaacttgtccaagatggcacagtaagcagtagagttaggactgaatccaagcaatctaactcctaagcttttaccattaaccattacaatatactaactctgaagcccaagttctgtatttgtgcatatgatcctgggaaattctctaagccattttcttctctgtaaaaagagataaaaggacctctgttatagggctattgtgaagataaactataacatatatatgttattcatatataatatgcttcatatataaagtgtgaagcatattatgtggcccattcttgctgttcagaaagccaattttcattccttttcttacacatttttggccctgatagctctgagaagtaaacagtaccgaattgcttgacttggagaaggtggggctccttctaaaaatcctttgtttgagaaagagaaattattgtacaattattttaaagcaaaacactatgcaaatttgagaaaggcttgggaaggggattatggctaggctctaaggatacttataaaatgccataagttttaattccaagaaaggtgactggctaataaacgtccagttatgtatttccatgtgaaaacaatttagagtcaataagaagtcaaacttccttgggcagatctctagaaatgtgggcagaatctgccatctgcagctattgtaggatatctctttgaaaaggactgctgtaatttaggaggttggaagtcagtggctaaatgcccaaataaacagcatttgggttaagagaaatggaacaaacttgtacggggtttaacttccaaagaacttacttaaggttttcagttgcttcctcagttactgagggtttttcctccaaggcttcttacaggttgaattaaaaaaaaaatacaaggctcctaactttaaaatgttaattctcctccccactcaccaacaacacaacacaaaacaaaaaaactatacacctccatttgcaaaaaaaaaccaaaaaacactgaaaagatagagaaggggagggaaagggtatgtgatctttcctctggcccttggatctcaacatagttggaagaagccctcttcccactgccaggtgatgagaattgtgcagctgagcctgtaacaaaggtacatctcacggaagcccaagcagaattctaggtggaagctgactatgagaagctgacagtgaagctgctttacctgggagagaggctcctccagattttcttcccttcagttgtctgatttaacataaatagtagctcatgcctgtaatcccagcactttgggaggctgaggcgggcagatcgtttgaggtcaggagtttgagaccaacctgaccaacatggtaaaaccctgtctctactaaaatacaaaaattaaccaggcatggttaatctcagctactcgagaggctgaggcaggagaatcacttgaacctaggaggcagaggttgtagtgagtgaagattgcaccactgtactccagtgtgggtgacagggcgagactctttctcaaaaaaaagaagaaaaagaatagccaagaacctagccttgaaatcccagctttcaaaacctcacttagggaagagggcctgctcacccgtgttggtgtaccctaagtttaacagattagattttcctggtagtacagatatattgttctctagacaccatcttagccccctctcagcacttttagtgatgtccttcatagacaattttagtttgtgtcatgttagttaacactggtgaatatatgtttgccctctctctcttcatgaatcagcctattttgatgaatactatgagacatctacaaatggacaatgactagaccatgtaaaaaaatagaacgttgacccatgacctgcccaagaaaccatcccccttatctacaataaacagtccaagaagccagcctgttataagtcaaacttgcaggaagccaggttgctgtctctgatgacaatccaggaagctaagtaataatttctgtaacaatagtcccctaatgagagccaggcatggtggcccttacctgtaatcccaacgctttgggaggctgaggcaggaaaattgcttgaacccaggagtttgagactagcctgggcaacatagtgagacctcatctcttcaaaaaaattaaaaaattagctgggtgtggtgtcacgcacctttagtcccagctacttgggaggctaagatgggaggatcacttgagcctgggaggtcaaggctgcagtgagcagtgatcactgtactccagcctgggcaacagaggaagaccctgtttcccaaaaaaaaaaaaaaaaaaaaaattcccaaatggccaggacttgattcataactgacagctttccttaatttttgttcccattttcaacttagattcaaccagagacagccaaacatgcaccccccaacccatcacacgagatgtcccactttttattaccttgactacagcttccccatgccaacagcctccattcaagccacatttcaagccttcccttttctcacctgtaaatctttgccactcctctgcctgcctttgagtttctgccaaaacacaaatggcagttatggtggcggacttcctcagtatagcaaggtctaaatagcgtttgcttttctcatttggttgatctttatttccacaatacagataatattttatacatattttatactccatatttttgcattccatatttcttctcaaaggaattctgcataatcaaattctggtaggacattgggtaagccgcacccaagagttaaccaaagttgtgggtaaaaaggaggtggagaaggagttatctgagcaattgaggatcattccctaaacccatcattaccataagactctcctaaaaagtactctcctacccgtttctaatcagttccttccacttcaggcaaccacttctgactcgtatcactatagatagatttgttttcttttgtatgtgtagactcatacaatatgtatttgtatttgactgctttcaatcaacaagatatttttgagacatattcatgttttatataccagtagttcattccttgttattgctgagtggtatttcattgtataaacatatcccaatttgtttattcattctcctgtcgatagatgttccggttgcttccagtttgcaactagtgtgaataagcttgctatgagcattcttataaaactcttttagaacataaacgttttcatttatattgggtagatacatcaaagtgaaattcctgggtcatatggtaaatgtatgtctaatttataagaagttgccaaacagttcctcagaatagttacaccatttttttatcccaccaacaatgtattagggttacacttgctccacatcctagccaaacttgctgttgttagtctttgattttagcattttaatgcatataaaatgttgttttattgtgccattaatttgcatttcctgatgactaattatcttttcctatgttttttggtttctcatacatcttctttaatgaattgtttattcatatcttttgccccttttttgactttttattattgatttgttttttatgttccagatacaagtcaaatataaaaatgtttaatgttaatgaagttcagtatatcaatttttttcttttatgatatggctttttgcatcctgttcaaggatgcctacccccaagaacatgaagatattttacttctataagttttatggttctgagttttacattcaggtctccaatttatctcaaattaatttttgtgtgtgaaatgagatacaagtcaacctggatagatatccagtctgttagcaccatttgttcaagagactttcctttctccattgaagtgacttggcaccttggacaaaaatcaattgatgtatatgtgtgggtctatttctggactctgttctgttcccttgatctgtttgtctatgcttatgccaatatacatttgtcttgagtattgtaactttaattcttgaaatgtggtagtataagccctaagaacaaaaaataatatttttaagattattaaatagcatctctagagattattttcctattctagagcctttgcatgtccttagaaaattttatttaatttcagatttttgtgggtacatagtaagtatatatatttatgaggtacatgagatactttgatacaggcatgcaatgcttaatgatcacatcatgaaaaatgggatatccatcccctcaagcatttcttctttgtattacaaacaatccagttatattcttttagttattttcaaatgtagaattaaattattttcactacagtcaccctgttgtactatcaaatactagctcttattcttactttctaacaattttttttgtacccattaactacctccatctccccgctacccttccccactacccttcccagcctttggtaaccatccttctactttctatcctcaggagttcaattgcattgatttttcgatcccacagataagtgagaacatgtgatgtttgtcttcctgtgcctggcttatttcacttaatataatgactttcagttctatccatgttgttgtaaatgacaggatctcagtctttttttatgtctgaatagtactctgttgtgtctaagtaccacattttctttctccattcatctattgatggacacttaggttgcttccaaatcttggctgttatgaacagtgctgcaacaaacttgggagtgcacatagtgcagatagtgcagttatctctttgatatactgatttcttttttctttttcttcttctttttttttttgagacaatctcactctgtcgcccaggctggagtgcaatggcacaatctcggctcactgcactgttaacctctgccacctgggtcctatgttcaagcgattctcctgccttggcctcccaaggagctggaattacaggcatgtgccaccacgcccggctaatttttgtatttttagtagagacggggttttaccatattggccaggctggtttcaaacccctgacctcatgtgatccacctgcctcagcctcccaaagtgctgggattacaggcatgagccaccacgcccgactggatatattgatttcttttcttttgggcatatacccagtagtgggattccggatcgtaaggtagctctatttttagttttttgaggaacttccaaactgttctccatagtggttgtactaatttacattcccaccaagagtgtacaagaattcccttttctccacatcctctccagcatttattattgcctatcttttggttaaaagccattttaactggcatgagattatatctcattgtagttttgatttgcatttctctgatgatcgtaatgttaggcaccttttcatatacttgtttgccatttatatgtcttctttggagaaatgtctattcaaatcttttgccagtttttaaattggattattctgttttttcctatagagttcttggagctccttatatattctggttactaatctcttgtcagatggatagttttcagatattttctcctattctttgggttgtctgttcactttgttgattgtttccttgctgtgcagaagctttttaacttgatgtgatcccatctgtccatttttgctttggttggctgtgcttgtagggtattattcaagaaatttttacccagaccagtgtcctggagagtttcctcaatgttgtcttatagtagtttcatggtttgaggtcttagacttacctctttaatccattttgatttcatttttgtacatggtgaaagacaggggactagtttcattcttctgcatatggatatccagttttcccagaaccatttattgatgagactgtcttttccccagtgtttattcttggcgcttttgctgacaatgagttcactgtaggtgtgtggatttatttctgggttctctattctgttccattggtctgtgtgtctgtttttatgccagtaccatgctgttctggttactatagctccgttgtataatttaaaatcaagtaatgtgattcctccagttttgttcttgttgctcaggattgctttggctgttctgggtcttttgtgattttatataaattttaggattttttttctgtttctgtgaagaacaccattggtattttgatagggattacattgaatctgtagcttgctttgactaatatgaacattttaacaatattgaacaatccacgaacatggaatatctttccagttttttgcatcctcttcaatttctttcgtcagtgttttatagttttcttgtagagatgttttatttcttttattaattactaggtatttaattttatttgtggctcttataaatgggattactttttttatttctttttcagattgtccacctttggcatatagaaatgcttctggtttttgtatgttgattttatgtcctgcaactttactgaatttatcagttctaagagttttctggtggagtctttggatttttctcagtataaaatcatatcacctgtaaacaaggataatttgacttcttcctttccgatttgtgtgccctttatttctttttcttgtccaattgctctaagtaggacctccagtactatgttgagtaacagtggtgaaagtgagtatccttgttgtgttccagatcttagagaaaagctttcagtttttccctatccagtataatattagctgagagtctgtcatatatggcttttattatattgaagtatggtccttcaatacctagttttttgagggtttttaaccacgaagggtgttgaattttataaaatgctttttcaacgtcaattgaaatgatcatatggtttttgttgtttattctgttgatatgatgtatcacactgattgatttgcatatgttgaacctttcatgcatcccagagataaatccaacttggtaatgatgaatgatctttttaatgtgttgttgaacttggtttgctagtattttgttggggtttttttggaaatgtatttttgcatcaatattcatcagagatattagcctgttgttttctttttttgatatttccatgtctggttttagtatcagagtaatactggcctcatagaatgagtttggaagtttctctcctcctttatttttcagaataatttaaataggattgacattggttcttctttaaatgttggttaaaactcagcagtgaagccatcaggtcctgagtttttctttactaaatggctttttattacagctttgatcttgttacttgttaattggtctgttcaggttttggatttcttcatggttcagttttggtaggttgaatgtgtctaggaatttattcactttctctagattttccaatttattggcatgtagttgctcatagtaaccactaatgctactttgaatttctgtggtatcagttgtaatgtttcccttttcatttctgattttatttatttgggtcttctccctttttttcttcattagtctggctaaaggtttgtcaattttgtttatctttccaaaagataaacaacctcttgtttcattgatcttttgtattttcttcattccacattcatttatttctgctctgatctttattatttcttttcttctactaatttggggttttgtttgcccttttctagtcaagatgcaccattaggttattaatttgaagtttttcttcttttttgatgtcagtgctgctgagaccagctcggttggggagaccctaacccagtggcgctagaggaattaaagacacacacacacagaaatatagaggtgtgaagtgggaaatcaggggtctcacagccttcagagctgagagccccaaacagagatttacccacatatttattagtagcaaaccagtcattagcattacttctatagatattgaattaactaaaagtatcccttatgggaaaagaagggaagggccaaattaaaggaataggttgggctagttaactgcagcaggaacatgcccttaagacacagatcgctcatgctattgtttgtggcttaagaatgcctttaagcggttttccaccctgggcgggccaggtgttccttgccgtcattcctgtaaacccacaaccttccagcttgggtgtgagggccatcatgaacatgttacagtgctgcagagattttgtttatggccagttttggggccagtttatggccagattttggggggcttgctcccaacgtgtctcccttctttgatttgcaaagagataaaagcaagggcggctttgtcacagtgagctacttcttgcaggagtcagaatctgcatctgcagactatacaaagaaaaacaacgtagattaaaagcacagtcatcattgaaatcacagagcttccaagtgtttttatccattttaatggattactagctgctaatttgtctgcagcgcctttaagcactccagttcctggcattaaggtcaggtgtgcctgggatgctttaaatatttgttctttaattttgcaatatccaaaggcaagtttgtagagtgtctttgtagatggtttttattttttcctaaattttgatcttattaagagctattaatagtttccacaaatccttatgtttagctcccacaacgagccctatcatttgaggttgaggtgccactataccaccatggttccagataataggaacttttgccgtactttttggtatttctaccatgtgatcagtttgttcagatcatctgaacatagtctggccatggcacgcagactgagaggtgcaattcaagcttaacattcccttaggggaccaattaataatgattccataggaatcgttgtgcagcacctctgcctgttttgcaaagcaatcttcctaaacaagtacgttcattttttctaactgggtccaatcctgtttacaaataggtttttgagggtggtatgcctcaattataggagcagatttattatggtaaataccgagatcagaaagcatgtgtaactgtgtcatagagtgattgcatccaggcattattaccggcccttattgaaggaatactcacgacagtggtgataaccactatcatagctaccattaaattattcattgtgactggttgtcccgctttcctcaggttttcttcctccatctctgacagcttcttgatctgtccccaggtgggtggctgtggttgacgggtgttgctcgtaactgttggggtcctcctcagcatcggtctcgacatggctgcaaccggggggtcctcgggatcctcctggagtctcttcctcggcatctggctcctgataaggtttcaggtgtcttgatggtatccaaatcggctgttgattttggcctggagaaatacaagcataacctctaccccaagttattattttacctatttcgcacctttttgttattggctctgtccaccaaatcagttgttctgtttctgtctttgcagctggtttctgtagatgctgttcagctgctgatagcatctggcctttgggcaggctcaaaaaatttaaagttaataatgctaggttcagttgcatttgtgggggttcagtattctctgtctctccctttctgcttttgcaactgctgttttagggagagagattcattctttccactatggcttgtccttgagaattgtatgggataccagtaatgtgtttaatattccacatagagaaaaatgtagctagagcttggctagtatagcctggggcattctctgttttaatagaagcccatcaccacaaaacactgcaaaaggtgacatttaacacgggcagaagactcttctgattggcatgcagcccagacaaagtgagaaaaggtgtccacacatacatgtacataagctagtctcccaaacgagggaacatgtgtggcatccatttgccaaatagagttaggttacagtcctcgagggttaactcctcctgtaaaagatgaggaatgtaccatttggcaagttgggcatcactggataatagctttagcttcattccaggtaatgctatatctgcatttgagaccagaggcattgacatgggttgaattgtcaaagtgtccagcattagatattgcaatagcaactaggccatcagccatttaattcccttcagtcaaaggtcctggaagaggtgtatgagctctaatgtcagtgatgtaaaaagggtgcattctactcctaactgctatttgcagttgggtaaataaagtcatcggttgttcatctgtatgaaatcgtaactgagaattttcaattaaccgtgtggagtgaaccacatatgaagaatcagaaatcacattaataggcatttcaaaagcagtcaatacctcaattacagctacaagctccgcttttagagctgaagtatagggcgtctgaaaaactttaccttttgattcaaaataagaagctttaccattacgagacccatctgtaaaaacattctcaacaccttcaattggtttaaatttagttattttagggagaatccaattagttaatttcaaaaaactgaaacagcttcgttttaggaaaatgattatcgagaatactcacaaagtcagctaaacgggtttgccaagtaagactatttataaaagcttgctgtatttgtgccttcgtgagagggacaataatttttccaggatcatatccatgtaatttaacaatccgagttttcccaatccctatcattgtagcaatttgatctaaataaggagttagagtccgtgaattagtatgtggaagaaaaagccactctactaagtcctgttcttggacaataacaccagtaggtgaatgctgagttgaaaaaattagcaaatctagggtcttctctggatctgttctatttatttgagctttatggacttgcttctcaattagttgtaactctgcctctgcctcctttgttaattgccaagggctagtgagactaggatttcctctaaggatagaaaacagattactcatggcataggtaggaatgcctagagcaggtcgtatccaattaatatcccctagtaatttttgaaagtcatttaatgtttttagttgatccctacgtatggttactttttgtggcacaatggtagtgtcatttactcaggtccccaagtaggagtagggagtagtagtctgaattttgttaggagctataattaaaccagcacgagaaattgaattttgtaagtgatcatataacacttagcaggctgcaggttgtttactgcaggaattgtaaatgcaaaccattcacagtgttgctcagctaaagggatagtaaagaaacagtcttttaaatctatgactgttaaaggaattgatggcttttaagtcagttaacattctccatttacctgattttttcttaattacgaaaactggagaattccaaggggaaaatgttggcgctatgtgcccattttctgattgttcagcaagcaatttctctaaagcctccaatttttctttacttagcggccattgttctatccaaattggcttgtctgttaaccattttaaaggtataggttctggaggcttaacaatggccgccatcaaaaatgatttcctaatctttggtgggaactttgtttttccactttaagcggttctttcaaaccatgcaaatttttttctagtcccataccagggacataccccatttcatgaatcatatgttgactttgagggctatataattgttctggaattagaacttgtgctccccattgttgtaataaatctcttccccataaatttataggtacagaagttataattggttgaatagtcccaggtcatccatcgggcccctcacaatgcaaaatataactactttgatatacttcagtggctttaccaactccaactatgttcagttgagcggattgaattggccacgtggacagccagtgctatagagaaatgattgaaatgtccgttcctgtatctcccaaacctttacatttccttccctgaataattatttcacaggtaggacgtttatcagtaatttgatttacccaataagctgctttgccttgtttatttgtgcttccaaatcctcctgttcgtttaatttcactttttcccattcccacatatggcacaatcaggagctgtgctatgcgctctcctggctctgctttccagggaacagaagtagatataacaatttgaatttccccattgtaatctaaatcaatgactcctgtatgtatttgtacgccttttaaacttaaactaggccttcctagaagtaatcctattgtccctgctggcaagggtccacagactcctgttgggaccttttgcgggggttccccaggcagaaggctcacagcttttgtgcagcataaatctactgcagctctaccggctgtggtgggggacagacattgtacaggggtgagggaatggcctgagctggaaatgccctggtttagaatggggcccgggacaggcccctcatggtgtttcccaaaatcaggttcccatctttatcaaacttagagtgacactgactagtccagtgttttcctttttttatatgttggacctatttcagactcaacagttttcctttttcctctatctggcggcctgacttgctgattttttctacattcttttttagtatgaatagcttttttaaattctttgagtaatttaaaaggaaaaggctcaaatgtagctgtaatatttccctgttgatctggggggtttgttctaacagggaaccgccaaacctctaaatcaccctctcgtatagcttgctgaattcctgcctgaatagaactaagagccgtcactcgaggtgccgctcgaagagtcactggggcaactactttttgcccaatgtcctccggaaaagaaagatccggggggtcattttcttcaaaataataaggagggggtgcagaagggtagggatgaacctctccttcctttgccactttagctttagctggcaaataaacctgctctgtaacctcttctgttacttcactattctcttgttcctcctcattatcagtgtgaaaaagttctaaggtgaaacgaaccagaccccatccctgtcccattgttaccctgaggcatccgagctccccttcttactcaccatggggactgctttaagagtactcgggtgtcctccagctagttttctgttccaagcatcgcttcagcaaccctttgacctggatttgagcccccacgaatggacgccacttgcgcgagaccagctcggtcagggagaccctaacccagtggcgctagaggaattaaagacacacacacacagaaatatagaagtgtgaagtgggaaatcaggggtctcacagccttcggagctgggagccccaaacagagatttacccgcgtatttattaacagcaaaccagtcattagcattgtttctatagatattaaattaactaaaagtatcccttttgggaaactaagggaagggccgaattaaaggagtaggttgggctggttaactgcagcaggagcatgttcttaaggcacagatcgctcatgctattgtttgtggcttaagaatgcctttaagtggttttccaccctgggcgggccaggtgttccttgccctcattcccgtaaacccacaaccttccagcttgggcgttagggccattatgaacatgttacagtgctgcagagattttgtttatggccagttttggggccagtttatggccagattttggggggcttgctcccaacaaggtgctgatagctttaaacttccctcttactagtgcttgcactgtatcccataggttttgttatgttgtgtttctgctatttgtttcaagaaacttttcagtttccttcttaatttcttcattgactttgacccactggtcattcaggagcgtatttaatctccatgtgtttgtatcatttccaaaattcctcttattgatttctggttttattcaaagatgcttgatattgtggtaaaaaatgctggatatttcaaattttttgagtattttaagacttatttgtgacctaacatatggtctgtccttgagaataatccatgtgctaagggcaataatgtgtattctgtagcctttggatgaaatgttctgtaaatatctcttaggtccatttgttctattaggtcatccttagtgtaggttaagtccagtgtttctttgttgattttctgtctgggagatctgtccagtgctgaaagtggggtgttgaagtctctaactgttattgtattgaggtctctttctctttgagacaaggtcttgctctgttatccaggttggagtggagtggtgcgatctcagcccgctgcagcctcaaccttacaggctcaagtgatcctcctgcctcagccctctgattagctgggactacaggcatgcaccaccatgcctggctaatttttgtatttttttgtagagacagagttttgccatgtttcccaggctggtctcaaactcctgggctccagaaacccacccacctggacctcccaaagtgctgggattatgggcatgagctattgtgcctagcctgaggtctatctctttagctataataatatttgctttacatatttgggtgttccagtgttgggtacatgtatatttataattgctatatccttttgctagactgacccctttatcattatgtactagcgatctctgtctcttcttataatttttgtcttaaaatctattttttctaatgtaagtatagctactacttctgctcttttttggtttccattggcatggaatatctttttccatccatttattctcagtctgtgtatctttataggtgaagtgtgtttcttgtaggcagcagatcattgggtcttattttttcatgcatttagccactctatgtctttttattggagagtttagtttatttacattcagtgttattactgataagttgggacttactcctgccattttgtcatttgttttctggttgttttgcggtcttcttttacttcttcccttccttccttgtcttccccttagtgaaggttattttctctggtggtatgacttaatttcttgctttttattttttgtgtatccgttgtgtgtttttcaattcgaggctaccatgaggcttgcaaatattattaatgtctcataatccattattttattttatttttatttatttattttttgagacagagtttcactcttgttgcccaggctggaacacaatggtgtgatctcggctcactgcaacctccacctcctaagtgattctccagcctcagccccccaagtagctgggattacaagcatgtgccaccacgcccggctaattttgtatttttagtagagacgggctttctccatgttggtcagactggtctcaaacttctgacctcaggtgatccgcccacctcgacctcctagagtgctgggattacaggcgtgagccactgcacctggcataacccattattttaaactgatgacaacttaacactgattgcataaacaaacatgcaaaaagaaaactaataaaaactgtacactttaacttcatccctctgctttttaactttttgttgtttctctttatgtcttattgtactatgtcttgaaaagttgttgtagttattatttatattggcttatcataacactgtaattatggtatgtgggagtttacatgccacaattacagtgttacaatattctgtgtttttctgtatgcctactattaccagtgagttttgtatcttcagatgatttcttcttgccgttaacatcctctcttctttcagatggaagaactccttttagcagttcctgtaggacaggtctggtgttgatgaaatctctcagcttttgcttgtctgggaaggtctttatttctccttcatgcttgaaggatatttttgccggatatagtgttctagggtaaaagtttctttccctcagcactttaaatatatcattaccactttctcctagcctgtaaggtttttcactgaaaggccagctgctagatttattggagctccattgtatgtttttttttttcttttctcttgctgcttttaggatcctttctttatccttgacctttgggagttttgttattagatgccttgaggtagtcttcttttggttaaatctgcttggtgttctataatcttcttgtacttgaatgttgatatctttctctaggtttggcaagttttctgttattattcctttgaataaactttctatccgtatctctttctctacgtcctttttaaggccaataactctaagattttcccttttgaggctatttgctagatcttgcaggtgtgcttcgttttgttgttgttgttgttcttttttcttttgtctcctctgagtattttcaaatagcctgtcttcaagctcattaattctttcttctgtctgatcaattctcttattaagagactctaatgcattgtttagtattcagttgcattttccaactgtagagtttctgcttgattgtttataattatttcagtctctttgttaaatttatctgatagaatgctgaattccttctctgtgttatcttgaatttccttgagtttcatcaatatagttcttttgaattccctgtctgaaaggtcacatatctctgtttctccaggattggtccctggtaccttatttagttcttttggtgaggccatgttttcctgcatgatcttgatgcttgtagatgtttgttggtgtttgggcattgacaagctaggtattttttatagtcttcgcaatctgggcttgtttgtgcctgtccttcttcagaaggctttctaggtattcgaaggaatttgagccccgagtccaataatgctgtggtttttgcagattcatagaaataccaccttggtggtcttggataataaagatctggaagaattctctggattacgagacaaagatttgttctttttcctcactttctcccaaacaaatggagtctctttttctgtgctgagccaccttgaactggagtgtgttgatgtaagcacccctctggccattactgctgagactgctgggtcagacttgaagccagcacagcacagggtctcgcccaaggcccgctgtaaccactacatggctgccacctgtgttcactcagggccctagggctctatagtcagcaggtggtgaagccagccaggtttgtatcctccccttcagggcagcaagttcccccaggtcccaggtgggtacagacatgttgtccggaagccagggattggagcaaaaagccttagagatttcttagcactttgggagtccaaggtgggtggatcacctgaggccaggagtttgataccagcctggccaacatggtgaaacccatcaagaggacagggaccatgttgtatgtgttgttcgccactgtatccacaccacttagcaaacaataagtatttgtttaaataaaattaaattttagctgggcatggtggctcacatctgtaatcccagcgttttggaaggctgaggtgggaggatcacttgaggccaggagttccagaccagcctggataacatggcgaaaccttgtctttactaaaaaatacaaaaattagccgggtgtgcttgtgtatgcctgtaatcccagctattcaggaggctgaggtgggaaaattgcttgaacctcagaggcagaggttgcggtaagccgagatcatgccactgcattccagcccgagcgacagagcagactctcaaaaagcaaaaacaaaaaaccttagagatttgcctgatgttctattctgcagctatgctggcactcaaaccacaatacaaagtccttcctgctcttctctcctttttccacaggcaggaagcctcttcctgtggccaccaccacaagtcattcttacatacacagatgttagtgtagtaatgcagcaaggaattcccagggaaatcggttttttttttcctgtatttcttctgtagctttgccaaacaaacaaaacaaacaagaccccaaggtcactgatccaaatctgaatcagtgaaacggtctgatgaaacactttttttttttttttttgagatgaggtctctatgttgcccaggatggtctctaactcctgggctcatgtaatcctgccgcctccaccacctgagtagctgggactacaggctaatgaaacactttgataagataaatcgtaatctgctaggaactttcttctgttcagtccttaaaatctgaagatgtttagaacagatgggctttttgatgtagctctccagaggtaattattttctttttaaaacagctaggatcattctcttactgatcagacatatgcttctccagcctcatacaatctcccctgtcctctgagggctgctgattgtctctgtcctcttaccttcaccatcttagaaggtagagccaagtctacatgggtgatatggtacagtgaacaacatggttactaaagagctggattagttttaagccaccccattaagcctgaactgatgtggaatagtcacaagaacgtaagtcagggacatgaagaaaccctttgctgtaatctaccataccagttattgtccagggtggagcatgtaatcatattttttataacaatctgattatactttctgccattttttattgggaatttgaacattgcaggttaactcataaaactgtgaaagggcaagataaacataggatacaatatatttaattaagatagcaaaacctttctgtactttcttacaatggcttgtaggagatctggagcagatcttcaacttgctaatattcagttaggcccagatttggtatttggaagaggcagtttattagaataatggtgctcctactcaaggaagaaacagcatctataatacttagtgtgatcagggacttgactttaatgaaatttcaaatagaagtaaatttgacttacttcgtcatgtggaccaattctagccaaatattgtggatttgagattaggaccagaaaactcagggtctacttcggatgacagtaccccaggaggatctggtctttctactctatgcttggaatgaaccaggtgagatgtttgggtcccagccagattcttggggtcattgtagattcacacagacttaaatgacttcatcttatcacccacagaaataaggatgaaccatagccaattcatttcattctacttcttgaagtgaataggactgtaggatcaaagttaaagactgtaatgaagatcacacactggactgtgtatcaagtaaggcccagatttacctttatagacttaactcactctatttgcttttctttttttttttttaaaggctacaactgaggtggaaattaagaagaaaggccctggatctcttttagtttccatggaccaattagcctcctacgggcggaaggacagaatcaacagtataatgagtgttgttacaaatacactagtagaaggtatgtgccctataatgtcagtccaaccgctgagatataaatatgtaatgtgcatggtaaatataatccctgtcccttggtctgagttttgcaaagactgtctctgagctttaggaatggaacgtattcctatatagaaactagaatcacaaattctcttcctaaatttacatgcagagaatcaaatatatgggcttcagatatgctgccagcattgtacacaggtacgtaagagataggaaaggacctgcatgagtgacctagaggagctcaagacccctgtcattgtcatcatgaggagtcagtggggtgctgtaaggcataaaggaatgtagactgaagaactgcaaagatacaaaatcatagaatttccctcatggtctctaccccaaaacataccttcctttttcctttttaactacttacagcccttttggttttcccttaaggaagaatgtactgtgcgttttgattgcacctagttctgtctctcttcaaacacccccacatatccataaataaatttgatgtgtgactaggtaagttgaaacccttcttactttgagtgctccatgccacagggaaagagcaaccgctgttgaatcatagcacgtctgcagtaatgttgctgtcagtgcctgagttctctgtgttaggtgggttctctgtgacacaacctggcgtgctgaggaatacctgaagattttccattaggccacagtccccctagcaagaatcagctcctctccagttatggtctgtagtccaggatctgcatgctttctttagaggtaaattcagtgacagatttcctctcccaagattctgatggattctgcacctatcttcttcattggatttatgttgatttagctgagttgtctcattgtagatctagactattcttgaggcctcaaattgctattcttcagaatgcagatgcctggaataaccaaagtccctgagacaggaaaactcaaaatggtcccagtatccttgagacaagttatttttttagtcatttaaacccagtgccacttctactctgtgtgtatgtgtgtgtgtgtgtgtgtgtgtgtgtgtgtgtgtgtgtgtgttggggagggggttgcagtggagggagagtccctagaaaagaattctctaagggtgcttacttccccacatatgtgcaaagaatgagactataactagactgaccttgagaatatctcaagtaaaaaaatgaattaactgctttcatctgccttaacaacctctgtttattcctgttttctttaattaccatcggggttattgtctgatagaacatcttcaagctttgtagcttatactttgagattgtgggcaaataactgcaggtcctaagaattccaagctaagaaatcctagcctaagaactttggctaattttattattcacatagagaccaagacaggatttctctgggtatctgtggcagttgagaaagaaaaactaacaacctccaacaggtgcattttattattggtagagacatcagaacagcagaactatcaatacagtgcaacagttatttatttattactgcattggcttagcacaggtcccagcaaaagtagatgctcaaacaatctttgtcaagcaggcattggctgtgcttagaatggtaggagtgctggtgctgcagggctcctttcggaggccttagagctttcatccctttactgagttggatacaaaccattgggacgttttaaaattctcttttctgcctcttctccctgttctttctctttctgtcctgctgtgcttattctccaccctttacccaccatcacacacattaaaaaaaaaaatagatgtaagggtagctcaggagacagagacagatgtagttgtgttcctgaataggaaaatattattccagttttttgtcctctttcctaagccctgattttcacatagttatacctgtcctgccatttcctgctcaggcattccgcctaacctctccccttgtatttgacccttttgttgaagctgatgggacagaactgctataagcaaagagcaatgaatggctgaccggaatcacgtaagagggaatgaaacatccatgtctgtttaaccattggtccctctgtatttaatgcttgctacagcattaaaagccagcattgaacgaattgtagttcttgctctcagactttcagttaggaaactttgacattattttaatccaaagattaaaataattattatttaaaacccaagaggcaggctacgacttacctaatagtttagaaaccacagtggagaattctagaatcctgtcaataattagaaaaccctgcctgctctgccccaccccattcctattgcaaacatgcttaccaggatccagcacatttagtagagttcaccactagcagagctataagctttggggatatttcagaggactgggcgtggggtgtaggtagagtagtatagtctcactcttcaaagcagtaaagctgtgggagaaggggagatcgtggtgaagtaagaaagaggaagtagtgatgtacttgacattattgatttttaatatcaaggaagtacttgacattattgattctcaggtaaaacaattccaaaaactcccctagaggtaactggccatagctattgctgccactatttatgtattcttttatttaactgaccagcatcaagtgtcagtatagttacttggctgatatcagcctttcctgtgtggcagtaaccttagtgagggtgggggctcttcatcagtgtatccttggtgcctagcacattgcagatgcttaaaagttgttgaactgagttgagggaagctcctgccttcagaaacctcatggtctaccaaagccactatcttggtgaaattgtgaggtcctttctgaaaacaattcccagtacccctgaggttaagacccaaagtaacctctctgaaaatgtccaaaagcaaagtaagagaaaccccacaaacctttggacatctcacccctagatgttaacccattcccccaagccaaatactgggccattccaggcatgtggaaccagtaacagtttgcaaagtcataagtcacttgataagccttcttattccccaaatgatcttttctagctcctgaagctccacattgtcttactttttgtaggcgtgaaagtttatcctgaggatcttcccttctcagtaaatgtggctaagagatgtctggtatccctagaggaattttcttggtgccctgtagggcaggaaaacccctttttgctgtgtggcaagactcaagacctagttcattttaaaacattacaattgtgtcaactgtcataaatgtgagcagtcgcagcttcaacctccacgtgccaatgagcaacagtcgtttggagaagggaggagataaaaaagggaacggaactaaatttccaaatatgtactgtaagaatttatggaaataagagaaccttgtcattttcttttttgggggagaaaactatatttaccttaggaagggagggagttctctgaggaagaagccacagcagattttcctcacagacttcctttcccacgcagcctcccacgtggcgcttacaggggtccttaaatctgaaaaaccaaggcaaccattttcttagcaaccagggaaccaatcagaaactcagccaaaaccaccttgtctaaaataaagcatcgccatccagctggttggaaaagggaacgtaggctaatttaaggcagccatcttggttttggtgaaatgttagggaattttttttttccttaaatgatttgatagtgtcagcagaattgaacagagagagagtagctgttacagccaaccctgtagaatcaatacctcacattctgacaggttttcaaagttcacctcttaaaaagcatcctcttagctcagggtccttggaattttgtaatcctggcagttgtatttcatgcttaatttgaggagagctttgttatgtagggcttcatacctagattgttgtaactgccagttgagtgtctgtctttgatatctgataattcttttgaatctttgctttggaaatgacctttgagatcgtctagtccagtgatttttcagtctgtgtgtatcagagtcctgggattctaggggagtgcctcaggagaggaagaaatctatccaagtgggctcctgcttcatctagggaaattcctggtgtatttcatgtattgggggtcatgtgagatcttgtttgacaataacactttctgtttctaaaagagacggagaagataagacaaaggagagaaagaaaaaggaaagaagatgatgacccagggagggaaggaggaagaagctgtagaaagaaagagaaaagcaaaggatgagagcaggaaagggcaaaggggcaagaaagaaggagacaggaggagacagaacaaggaaggaaaggtgaaaaggggagaggagtgtgacttgtatttctaactcaaccatgagctgtaaacttgttaagggtggagacagtaacttgtacttctttgagaacatagcagatgtgttttacatggtggcttggtcgatgatgctggtcctgctaatgaagataataataatagcaaacacttccatggcactttctatctgccagggtattctggggcactttgtatatattttagctctttaattctcacagcaaatcaaagtaacttgttcacggtcccacagttagcaagtgtctgagctagtatttgaactcaaatatgtctggcttgagtccatacttttgatggcttctctgacaataattgaataatatagtgtataatagaatacctaccatttattgaggatttaccctgtgccagatactatagtgactgctttacaccagcatctaatttagtcaaactcattcagtcctgtaacctgtaaagtaaatgccttgttttacagctgaggcagctgagcagagaaatcagctaccttgcctgggatcacacaacttgtaagcattcaagccagttgaggccagggagtcagacctgagaggccaagctcttgacctctgtgctcgactcccataactgatgggttgagtttcatttataactagatcattattaacagggaggcaacttgtgtggatcatgcttcctctctaccttagagagaaggaaaacacttaggaatgtcagcgctcaaaacaaccttgattccatattaataacagtgataatgactgagagtgagtagtgtgtccccctggttttcttgctgtgattgaggggccatctttgttcttacttactgtagaactggaagagtctcagagaaagtgcccgccatgctggtataaatttgccaacactttcctcatctgggagtgccacccctactggataaaactgaaagagattgtgaacttgatagttatggacccttttgtggatttagccatcaccatctgcatcgtcctgaatacactgtttatggcaatggagcaccatcctatgacaccacaatttgaacatgtcttggctgtaggaaatctggtaagatggaacactgtctcccgatattaggattggaatgtgttttgcctgtaggatatctttttctggtactgaaagctggagtttctttgaaaagaaagtaatagttaattggaagacaaatgcttccacatatgccaggacaccagctgcttttctgctcactgttgtgatccctttcctctttctgcagaactttgaagacgtcatttaggagctattggcagaaaaccaatgttggcgacagaatgggaggcctggtacagtgggttggtttcagcagcctgagccaagtacttctggtttttttcctcattctgtttctcacattgattcctgcattgctccagcaaatcagttcccctttcaccttaagtaacatctaccacaaaataggggagctcttatagtacactacatgtaactatggatttgcctgctctgtcaggccttaattacctaaatggggactatttatgggaaagttttcactcaaggctggtttccccctccaatccaacttctaggccattaaagtatgtagttttaaaaaaaatagattacaaagtgtgtattctgaaattaagtagctgtgatttgaggattatgtgctttgtttactacaaaaatcaggagttaattgaattttgatagatagtaaagaattagtgagaaagaatcccctaggtcacctgggccccctaattccttaggtgttaaccacaggcatgtccaaatctggctattaccgtttattaatgatttgagcatgatttctgcccagtttctcttatgtgtgctctctcactctctctctccctctctcacacacacacacacaccacacaccacacagttttgaccttaagtcctattactatactattagagcactacaatatcattttcatttctcattctcaaaacacatggcaaagagatcctttgtagcccattgtgttccctggtatacatccaagatgattctgtgatctttccagtctccatgtctgtggttggtgacatgctccaggctctctgcaatgatgtaaacccttgtgtgcagtccagtggaatgcccggagtcttgaaatgggacactcccacagactgtccaagaagtctgctgactggctctgaaaggtgcctgtcagtgggcacatgctgtgactggctgacacagtaccttggccatcaagcagaattttaaccctgtcaacaatatcatttagatataagcttgattttagtagccaagagttaagtaacaagaaatatgtcttgataatttttattgttgatgttggtggttctgttttccctgtagagttttgtttttctcaaaatctttacttttccttactttttacagaaccagtctttgattttcaagggattttgagaggctttttcacctatccccactagaactccagtcagaccaggctagcaaataatgttatttttcctttcatgaaaatttagagatttaggatgacatctaaattagaattgtaagtatgcagaagactttgctcagaaccatcagtaaaaaaagaggaaataagagaaggtcaacagctaatattcaggaactccatgagacaagccaacccagaaccaagttctagaataagaaagctcttaggtggcaagggttttcaaacggcaagtaaatgtacaattagcagtggggagggagcttagtatatagtccagcatactttgtactagatgtgagggtaaaaggaaagaaatcaagaatggtgcctcgatgtgggggtttaataactgagggaaaagtggaatgactgcaaaggaactggcttgacgtataaaatcaagagttctgttttggacatattaagtgtctattcactgagtggagatgccaaataaggaagttgggtacgtgctggacctcatgagtgttttctggacaataccagaaactcaaagatatactttgttgccaatcaacacgagcgctgagattggcagaaagaacacagaattggaagtcagaagatttgggttttcattcctattagatatcgtataaccttaaataagtcattgatttctgtccagaaatgtttcacatctgtaaagttaagataataccatgccatcactggttgggaagataaaatgagaacctatatggaagtctttgggatagctaaaagtatcttataaatcttaggaactgtgttagtataattcaataggagaattttcaaagatttggagaattgggtagaggctttgactgaacctgagaataagaggatggaaaaaaaatgagactgacttgtgaaataaagtatgaccttgtcctgtggttggaatgtgaggcttttcctatagccctaattgtgagttaagttgtctttgtctgtagacatacagaaagatgtttttaaagaaagatgagaacagtcttctgcaaattgaagatccctgcctcttctaccctccccaaaagagaaaataatagtaggaagaaccttagagataattcaatccaatccacatgttttatagaggaaattgaagcccagggaagctgtgtgacttatacagcctctatgttatgtagtagataaatgtaatgattcttttcctgccttttttgcaactaactgaatacaatagtaagtttatgaggtgactttttaaacattctgaatcttacaggaaagtttcaagtacagtacaaaaaacttcttttttttttttttttacaataaaagccttatcacatagccttatcacccccaaatgcttatagtgtgtattttttatacacaagtacattctcctacataaccatagtataactgtcaaaaccaggaaattaacattgatacattacaatgttgtgaagtaaagtatgaccttgtcctgtggttggaatgtgaggcttttcctatagccctgattgtgagttaagttaagggtctaattctcaggccctattcaagttttgccagtgatcccagtggtatcctctgtaacaaaaggatgcagttttaggattaccccattacatgtagctatcatatctctctaattttcttcagcctggaggagttcctcagtctttccttgactttcatgtcttgacattttgaagactacaggtcatttgttatgtagaattccctcaatgtgggcttgtctgatgcttccttatgattagatgcaggttctgcattttggtaggaatatcagataagtgagactatcttcttcacgttgtatctaccagttggcatgtagcttccatttgtcccactactggtgacgttcatttaatcacttgattaaggaggtgtctgccaggcttttcatctgtgaagttacgctttttccatttacagtaagtccccacttaacatcctctataggttctagatttttggaaactgtgactttaagctaaatgatatactgtataacaaaaccagttttaccataggccagttgatataaacaagagttaagttcctatggcatatagtacatcatgtggcttaaagttgctgttttcaagaacctattgaggacattaagtgaggacttactgtatacttaataggtatttgtgaggaagaccatttgaaacgatttaaatttcctgttcattcagattttgatttcttcctttatttatatcagtatggattaatggttttctattttatctgagttacaatccatttgatgtttagacttcctctgatgtggccagtggaaattccttcaagctggcttctgatccctttcacatgtcttcttcacttcctggctttctggtaccacaaggtattccaggatactttcgtgtttttccagccccagggctggaatcagccatttctcaagaagccctgagtcttttagtggaaaaatggcatttagaagtagagatctaggctgagtatcagctgaggcaggaggatcgcttaaagtttgagaccagccttagcaacacaatgagaccccatctctaaaacaaaatagaaaactaaaaaaaaaggaagaggtggagatctgagatctaggtatgcatattgctatgggagcagcatgcagcccctcttaggacatgatgagctatttatattgagctagccgtggatattgcaaaccatgagttgatcctgtcacttccaattctaatccaacacttcaagattctttctagttttctccctttctgtatttgtaactcctgcaacaataagaaacctcgttgccactatctttggtatacttatttgatcaaaaagccactgttaccttttatagcatgggtaccctcctcaccctgtataggctctgggtgccccccaccccttcagcacccgagccgtgtcctccatgtggacacctgctcacactcctcagcttggaacccacaccagtccaactcacacatggtttgccccaccctgcttagaccccgatgcctcacagtaggccttcgcctgcatggacatccttctcaccccacaccagactctcccctgacatagaagctctgtttatcctgcacagactcttaacacccctcaccaggccacccctcgtcaccctgctcatgctgccatctgtctgtgtgaacactcctggaagttctcacctggcccattgactttatcccaaactaggcgacatcctcctcaccctgatgagctctcacaccctcactgtccacctccctgtttggacactttcctcaccccactcgggatctgacaccccacatcaggccttcccctacatgagtccctcatcagctcacctggctctggcaccccttgtgagtcttcccctgcagggagtccctcctcagcccactccgggatcttctcctggagatgctatctttaccttacttaagctctgactctctctgctaagtcccccaccccctcaagtgtggacgtcctcccaccacacttgggcctcaacacctatgtggggtagccacgcctcataccacttccaactgcccatcctagactgttgcccaaagcggatgcctctccttggcccacaggctcagacagcccatgccagcctgctgccctgcatggacctcctcgctcccctccatgtctgactctccttgctgggccgtgcccttcctggggttccagcactgggcagcagcctccctctaccggcatgcccacctacagccttcaggactgagtggttcaggaggaaggggatggaaagaagagctagggtttaatctgacatataagtttaagttctcagattctaagcaaaagcaaaaaagcagaaagttattttcctccttcaccaaacataaatgaatgttatcatttcttaattataggttacctagattttcagctaaaaagaattcttttcagattttttctttcatctgtgcttctatagccccatatggatacttctttttaaatacttgtcacatgatttttagttattgttctgtcccctcctggttgggtaaccaaccaccttaatttgcagaggcctgaggaagcccttgcagttttaaaactgggacagtccttgtcaacaggtacgagttgatcaccctaactggagatgcaggatgcaggactttcggtgtgaaaagtggcaaaccaggatgagttacttacattctggcgactgagttcgtaaggaaccattatttttcatggtcacattttttttttcatgtctccattgcagtacacatagaacttttaatcaaattgaacttgattaactttgggcgaggatctactgcagaacaggagctgacaagcccttttctgagcacaaagagaggagcatgccagacgctcgtcactttcaaataaggctgaattttttctgcaaatgcaatgagggctgaaggaggtgtgtgacttctccccagaccccatagtgacgccaaagtgaaatataccccaatcttaggactatataggccttacttgttgacctggcattacaagttatcaggcatatgaccacaggctagtccaaactagactaggcatggctcatgcctgtcatcccagctctttgggaggccgaggtgagaggattacttgagcctagaatttcaaagctgcagtgagctatgatcatgccactacattccagcctgggtgacagagcaagaccctatctcaaaaaacaaaacacaacaaaacccaaactagaaagatatgatgactgtgaattcagagtattttatagagaatagagaaccattgttttatagaatattctgaggagatcaggactcctttatactcttaaataaaagtgctatgtctattgatatttatcatgtttgaaattaaaactgagaaaatttctaaacattcattttgtaattaaagaattacaataatatagctaggtgagtcccagctacttgggaggctgaggcaggagcatggcttgaggccaggaatttgatgccgaagtgctccaggaacacggctgtgaatagccattgctttctagcctggctagaacatagcgagaccccatctctacaaaaataaaaaaattaaccagacatgcagctcatccctataatcccagctactcaggatgctgagatgggaggatcacttgagctcaagaattcaagactatcctggacaacatagcaacaccctatctgtaaaataaatatcacaataatacacctatcacacatgaacataaataacatattggtgtggggaaactatattttttaagaaaaactggaagaatggcattgttcgacattttgcaagtctctttaatgtctggtttgtttgtttgtttgtttgttttgttttttgaggcagagtctcactctgtcgcccaggctggagtgcagtggcacaatctcggctcactgcaacctccgtctcccaggttcaagcgattcttctgcctcagcctccagaatagctgggattataggtgcccgccaccatgcctggctaatttttgtatttttagtagagatggagtttcaccatgttggccaggctggtcttgaactcctgacctcaagtgatccacccacctgggcattccaaagtgctgggattataggcgtgagccaccgtgcctggcctcatgtctggtttaatagaaggtagttagattctctttttctgtttctacattcagtctgttgtgatatgttattttagctaaagtataggaagaaaagcttgcctcacacagatatgtacagtagtcctctcttatccaagggggatacattccaaggcccccagtggatgcctgaaacctcagatagtaccaagccatacacacacacatacacacacatatacacatacatgtatgtatgtatatgtgtgtgtgtgtgtgtatatatatatatacgtgtgtgtatatgtacagccacgtaccacataacaacattttggtcaatgacagactgcatgtctgacagtgataccataagattataatggaacatatataaaaacttgttatatgccatttgatattggccttgcaggtcaagtaagagaaatgattgatgttaagtaaaggtgctgggacatttggttttccatattaaaaaatatatatatataaatgaaaatatatatataaggcctaggtttgtgtaagtacactctttaatgtttacacaatgactaaattgccaacaacacattatccctatcattaagcaatgcatgaccatactgggttttgtgaatctgataaccaagatggctgctaagtggctaaagggcaagtagtttatacagcatggatacactggacaaagggatgattcacatcctgggaggatagagcaggacagctcaagagttcatcatgctactcagaacagtatgcaatttaaaacttatgaattgtttttctagaattttttatttaatatttttggactgtagttgatggtagctaactgcaactgcagaaagcaaaaccacagatggggggtacttctgaagttggaaaagagcggaccatgtgcttcctgagagggccttagggactctaaggatcctcaactaccctttgagaactgctgcataagaacataaattctaaagtgaatatttgatgacattcaggagaacaacactgtctaagtaatgttaccacaacagagtaccatagactgggtaatttataacagacagaaatttatttggctgacatttctagagactgaaaagtacaagggcatggtgccagtacctggtgaagacctttgtgctacatcatcccatggtagaaggccaaagggcagaagaagctaacagtgagagagcaagagagggccaaacttgcttttatcacaaagcccactattgagataaccagcccactcctgcaataacatcagtccactcatgatggcagagtcctcacatgacctaatcacctcttatcagaccttgctgcccaacagtgttgcattggggattaagttttaatacatgaactttgggggacacattcaaaccatagcagacacttatatataattgctgatacactgcatgtaattcttccctttctcctctttgagaagcatatcacagtgcaaacaagagcatcataggataaccttaaatctgctcttctcaatttttaaaaaagcaattccttcacacagctaatagttataggtgtattttgacacacacccaactgatggcaacataccatgtgttgaagcaacatggtggctgacctctgtcacagacaatttctaatgcctggggccattcatcctggtgataggcaacaccacataactatgtcattgttgatttcccttaggaaccagagttcccacagtatagatattccatggtcaatcagccagtgcttcttcatgagcacttcctgtgtgtttaccaggaaccagtgggataacaaatcaagtctctacttagtgtgtgttaggcaggctagcatttctatgtggagaaacctccgatgggtttacactaagggtgaaatgtatgtcaggatttgatgagctgtctgtactttccctgaactcactcagagggatgttccatctatagatgcttaacttgtattatgaactttgattttacttaactggatctctttgtggaatttttttttcaattttagaatattgcatcttcaatctagaaacatgaggaactacagaaaagcatatgaacaccgaaaacctataggccacttatccattttgatgtattttagtcatcattctgtttttttattgctgtttattaattcagtatatttccaaacagcatctataatctaagtattttttactatttttaattttgttctcagactatatcttcagttttccttaaactgtttcatgtggaaacttggtaaacaggtagttacaagtactaatatattatgacagttttaaatctattgtaaaaataagtcctctcctctaaaaacataatattcaataagagtctgttgttatatggttagcctagaatgaaggtattggttttgtcaaaaccggcattcatgggatttgactttcatcctgcatatcacctcctaatgcctgcaggatatggaagtcatcgggaagtgcaggcactctgtcagcagaaaaatgggagatgggtaacatagggaagatgtcatttttacacacaataagctacaaatctaaaacatttattatgtcattgattatcctattgaaaaaaattaaaaggaagcaccgaagtctccaacaataggaaaattctttgaggatgtatttacccaatagaattttattcactatttatttatttatttatttattattatttatttattattatttatttatttgatagggcttgctgtgtcgcctgtgctggagtgcagtggcatgatccactgccctccaggttggctcactgcaacctctgcctcccgggctcaagtgattctctcacctcagcctcctggtccctggtaccataggcgcccaccaccacgcccaactaatttttgtattttttgtagagatgggttttcaccatgttgtccaggctggtctcaaactcctggactcaagtgatctgcctgcctcgaccaccagaagttttgggattacaggagtgagccatcatccccagccgccagtagaattttatacaggcagtaagagtgagagttgggagaaccgtgtagcaacatggatagacttaatgataagtgaaaaatcagacccaagatattatgtattctatgattttccaactctgtcaaaatacctgtgtatttgaaaaaaaaaacagaaagaaaatacatgaaaatgatagttgtatgcaaggtggtgagattatagatattatttcctatattttgcacattttggcaatattgtatgcttttacaccttgtggcaaatgtctgggtttggtaagatataatgtcaaattagcattaatactttatttttctaatcataacgcgagtgatttttttaagcaaacatcacaagtattatatacattcaaaatgactgctgaccctttgaaaggagttgcctggtgtagtattgccattgcttagcatattttctcaactgcactcttgaagagtttaaattgagtggttctggcaacaaagatgggaactttggggctggggacttcattcaagaggagaataagattttcctgcatcaggtggggtgctcatgagacatccaggtattgatatcttcagatgcagaatttaactaaggttaactcttgaggtttcttggacatgttgttttcaaaaataatgataaaggcattctctttctactatttatttttcttaccccctgcatccccctatttaggttttcactggaattttcacagcggaaatgttcctgaagctcatagccatggatccctactattatttccaagaaggttggaacatttttgacggatttattgtctccctcagtttaatggaactgagtctagcagacgtggaggggctttcagtgctgcgatctttccgattggtattccatatttctccaatttcttttaacatttcctatcttgcagctactagaaagagttctgcataaattaatttgatgatttaaaaaatatattagctgtattttactcccaattccagttatttggcttagctactaaaatactaaaaactttcctaaaatacctgatatggaagttagttgttaaaaatcaataagcaaacagaaatcaattttaagaagctctttagaaaatgctgcttaatctaagagatgtctaagatgataagtgaaaaataagacccaagacaatagatgaagaaaatgaactcccccaaggcccagtgtgaggtctaatttgggtttgctagtgaatctatttttttaaatctgaacatctccttgaaatggcaagaatttctccttgttcaaagatgactttcttcatttcttctgtcatggtagcccttccaaaaaatgagaataaaataaggtttttaaatacagatggttcccaacttatgatggctcaacttataatttttccgctttacattctgcaaaaaagcagtgcacgttcagtagaaaccatactttgagtacccatacaaccgtcctgtttttcactttcagtatagtattcaataaattacatgagatattcaatactttattataaaatgggctttgtgttagatgattttggccaactgtaggcgaatgtaagtgttcagaacatgtttaaggtaggctaggctaagatgtgatgttcagtaggttacgtatattaaatgcatttttacttacagcagtttcaacttaaaatgggtttattgggacataaccccatcataagtcaaggagcatctgtattatattgaaattagttgttgaacattggctttattttctctatcattagctaaaaaggagtttgtattaatgtatttgaagaagttagtgtttaagttactcttaatgacttaaaatgactctgaaagaatagttaatggtatcttcaaaacagctgtccgtaaacataagcgtaagtgatatcttgattaactcctcgagaaactgagttatcctgggggtatcccactcagacaaaggtcactactgcttccctggcattagaattggcttgggtttttcactccctattgggaagataagcacttggcaactgaaaaggtttaaagtttcttcattgagatattcagcagttctaagaaagaactggaaaaagtgaaactatttgtaaaacagagatttcactcagtcaaagtcacaaataactgccaaatttttgaaacctctgtttactactctttggttaggatccagtccacagtggacttttttgagaatagttattacctaggtgacaaaagaaaggattgagagtagccttagaacttatattcttaataaattaaaaagccactctgttgaaaacaatatgagtggcccagatgtctgcatatagggtaacacctggtaaatattgaactctctgataagataacttttcaattaaaaaaaagttaaaattgtgctgttgccttctaccaaaattcctattacattctatgttagttatttgttagcatatgacatctaatgatgatctcataattataattttattggccacactgccatagcctttatgcgttataattctcaggctgggccaggcacagtggcttacacctgtaatcccagcacttcaggaggccaaggcgggcgcatcacttgaggtcaggaatttgagaccagcttggccaacatagtgaaaccccatctctactaaaaatacaaaaattagccgggcatggtggtgcacgcctgtaatcccagctacctgggaggctgaggcaggagaatcacttgaacccaggaggcggaggttgtagtgagccgagatcacgttgctgcacaccagcctgggcggcagagtgagactctgtctcaaaaataaataaataaataaataaaaaataattaacactctgttagccaagatcttgtgattatttattacagaatatagatatttcatgattgacaggtactaaaagttctgtcctctgaataacagtataggctcttttcttttttttttttttcttagacatagtctcattctgctgtccaggttgaagtgcagtggtgtgatctcggctcacctcaacctccacctcccagattcaagtgattgtcatgcctcagcctcccaagtagctgggattacaggcctgcaccaccacacttggctaatttttgtattttttattagagacggcatttcaccatgttggccaggctggtctcgaactcctggcctcaagtcatctgcctacctcagcctcccaaatgctaggattacaggcatgagccactgcacctggccagtataggctcttttcataagatgactgatgtatgtggaactgcccctgtttgagagttgtgcttttcctccaagttattccaagcatatcacaacggttttttttttaatcagccattgattatttattggcaagcaaaataggtatttagaattttttaatgtttgcttttttaaggagatggatttttttttaaactgtccttcccatactagtcttttggtttcctacaaatcacattttatttcacttgtcctgtgagaagtcaagggaaaattagtaggaaagggatatgttcatatgtgggttttcaaaaagcagactgactcagatctaaagtaagggactaaggcagtattcctggcttctagttacaattttttcagctactctgaaattaatcagttttcccttatttatgtctcagtttctccccatttagtctgagacactgttagacagtcctgggaattttccaagggtgctcaatatatttaatctgatcttcctaattttatgtttttattttagccatgtggtgagaaaattgattgagtatcatttatttttttgtttgggttttttttttccttagctccgagtcttcaaattggccaaatcctggcccaccctgaacatgctaatcaagattattggaaattcagtgggtgccctgggcaacctgacactggtgctggccattattgtcttcatctttgccgtggtggggatgcaactctttggaaaaagctacaaagagtgtgtctgcaagatcaaccaggactgtgaactccctcgctggcatatgcatgactttttccattccttcctcattgtctttcgagtgttgtgcggggagtggattgagaccatgtgggactgcatggaagtggcaggccaggccatgtgcctcattgtctttatgatggtcatggtgattggcaacttggtggttagtactaatttgtagatatttttgttctacaccctgaatattctacccctggcccagaagcccaagtccttctactgcttagtccttctactacccgtcatgtttgttgatttttattctttcttggcccagaaaccctaaggtacaaatgaaggagaggagagagatacttacagagtgcctacttagtcatgacccccacaacttgtcaacccttttcctagagttaggaaagcaaactcagcaaaattaagtgactttcccaaataaatatagggcttgtatttgaacctagactttaaagtctgtgcccgttcgcctacagaagccttcctttttcttaacgacaatttctcatctgtggtgctattgacatcttgggctggataattctttgttgtgggctgtcgtgtgcattgtagggtttagcagcgtccctcctggcctctacccactagatgccagtagcatcctgagagctgtgacaaccaaaaatgtctgcagacattgccagatgtccctggggggcaaaattgccctccattgagagccactgctctaaaccatcttagagttttatttaatttatataaatgacaaatcactttattgctttactttgatctgtccacctgctctcttctacctctgtctttagaagagtcaccaacagatcttaacaccttgcttcttaaagtgtgatctgaggactagcagcaacaagatcactggagagtgtgttagaaatgcagaattctaggccccaaatcagaactactgaatcagaatctgcatttttaacaagatccttgtgtgactcaaaagtacactaaagtttgagaaaggactatcttacagatcaggcccctaatcccacctgcaagtgtagggcaaagaggactggaagaagacaagcttatctgtcccttaacatgctcatccacattagttctcttcctttttctgccacagagaagcatgacagtaaaaggctcctactcaccagcctctgaaccagctacaactattctgttcttccatttgacctacaaaaaaaatagctactgtaatgtttaattcttcctattctccattcccagccacctttccctcagtcctaatccctctagtcttctcactacttcagtgactataacaatggcttcccggtatgtagcatgatcaacattttcaagccctgactttgccaccctttcttcactctcctgttcttatttgtctcaaagacatctccccatggctgtctccagatacctgagcacttgataaatatcagctgttaccactaccccctgatgacacttttcaggttcccctttgctcagtagtccttctgcccatctagtttctaggaacctataactttggagtattttctgtctcttttctctccactcccagcaaatatctgatgtgtcttaaatgcatctttcttcatagtatttctgtggatatctttcttcatagtatctaagatctgccccttcctttgcatttctataattcattcagtactttataaaaatgtggtctcaagaccacctgcatcataattacacaagtttcactcacaaaaaaaggccaagtcccaggctgtataccaaatctactgaatccaaatatctttagagtaggctaaggaaatatttttaacaaacatccacacccctcactccctgagattctaatgcatgctaagatttgggatttctgtagcctaatccagacccttatcaattcatgcatgtaacagcctcctaacttctgcccttcccctctgtatgtagttagtctgaatgactctttcaaatctctgtcatcatctgtgactcctttactcaagaaccagtagtggatctaattaaataaaattcagatccctcagcctggccttcaaagccctctccaactcacccgcattttaccaaccatattcctttttaactctacaaatggtgcagataatccgaacacttatagttcatttattgtttccaccctcccactctgcacatgactgttatctcctcctaaaatgtatgccttactcttcttcccaagtatgacaaagtaaggaccaagtgtaaatcaagaagtgagcacctctcccactcctaaaaagtaagtcttaataaaaataaattaattaaccttaatgttcaatgtagtaaaataggagattaaaacaaaaataaataaagcttgtatctgatggcttgacatttggctatgcaaaaaaatataaaagtcaccatcactgtcttgctaaagcgattttatttttataaatgttaggaaaacaaaatttgttcttaaaatatgatgacatgaagtgtatttcagttctaccttcttggttttttgtatgaaaggatggcacttcaagcctcatttttttttctgacgtgggtcctctcaaactctgctcatgaatatgtggcatctgtacactttgtgaccctccccagtaatgtatattcacctttttattttggggaaatgtccttccaaaatggatacagcctttgttttttctgattataagagaagtaatatattttcgggtacatatatatgtatgtaaaactataaaagacccaagaaaagaggtgctaaactccttgtattacaaccaaaaccaaacacattcccacctggtaacatgagcattaaaatactacgtgggccaaacacaacacaacagagcctctttgagtctgtcacgtgaagtccattggcttccagtttgcaaccctgagttcgatggataacttttctgcatttgttccttttttccaatgctactggcataggtgctgaacctgtttctggccttgctcctgagctccttcagtgcagacaacctggctgccacagatgacgatggggaaatgaacaacctccagatctcagtgatccgtatcaagaagggtgtggcctggaccaaactaaaggtgcacgccttcatgcaggcccactttaagcagcgtgaggctgatgaggtgaagcctctggatgagttgtatgaaaagaaggccaactgtatcgccaatcacaccggtgcagacatccaccggaatggtgacttccagaagaatggcaatggcacaaccagcggcattggcagcagcgtggagaagtacatcattgatgaggaccacatgtccttcatcaacaaccccaacttgactgtacgggtacccattgctgtgggcgagtctgactttgagaacctcaacacagaggatgttagcagcgagtcggatcctgaaggcagcaaagatgtaaggtcccagcctagaaacagccttgatcctgtgtgagagcaaacagggtgctgtcagccttggggattggttcagctatgggcttggtagagagattctggaataaccaatttacttggagaactaattccaccatcccagtatcattctaggcctttcctaaatgaggtggaatcctaagatgatcctggacccacctgtgtcacttctggatcatctgggtcagaggctgggataagccctcgagtacttccctgccattcatctgagttatagccctgaaaccaacctatagccgcatttagctttgggtgggtcattgccgtccgtgagtaggttttgatgttatatcccatctggacagaagttttgggggcccgtggatatggtttgcttatcgcgagttgtagtaagaattctagagaggagtcagagctggcccctcatccccaccagaggcagagttctcagtgtggagtgggcatgttgcctcagagctgcctgatctcccttttccttgcgtgtctagaaactagatgacaccagctcctctgaaggaagcaccattgatatcaaaccagaagtagaagaggtccctgtggaacagcctgaggaatacttggatccagatgcctgcttcacagaaggtgaaaggggatgaggagcggatgggctggggacactcgtgttgctcacagacacagttgtgccagggctagtggtgggtgaggggcagctcagtggctatcttcaagaactttgctccccaccccaccattttgaaggaaacttagattgtttcccctatttgtatctgacaagtatataacaagtttctattctcacacttttcatcatccattttctcttggcatcagcccaaaaatttccattagaatgtcctgttctgtcatggctgtgcctgcctcctgactacccttttctcctccctctcactgcttctttgtaggacatcttcttgactcctgagggccttgccccattagcctttgcagcatagccccagccctgccaccctctccatttctgaatcagacattctgattcagccactgtcctcctggctgtgtggtggggcagcacctggcagggcctgggagatggaggagagggcaggtctgggcggggcacgtttccacggtctgacccgcctctcccgctggtgccaggttgtgtccagcggttcaagtgctgccaggtcaacatcgaggaagggctaggcaagtcttggtggatcctgcggaaaacctgcttcctcatcgtggagcacaactggtttgagaccttcatcatcttcatgattctgctgagcagtggcgccctggtgaggtccaggggagagtgtgaggagggattggctggggaagggtgtagagaagccagtgggaaaaggctgaggccaaagcccagtggctctgaaaacagattggctgtggtcccaagaagaatgatctgttaaagtgctttaggctgctgctttgagcctgtgggattagaatccatacttgttcacattgtgatcctcttagcactgtccctctcatgtgtccccactgcctggtttaccccatccttagcagcccctaaaatgaacttccctctcttacctaataccccagatctcttgttctttgcttttcagttacccaggatgggagggaggtgttattcctccacttactgtcccttcacagcctactggatttagagaacccatggcattagcaaatgtttagagtcagatctctggtacaaaggttatttatattcacattgtcctaagtgcttattaatcagtgaaacatacaaggccctgaacacacaggctcctccactgctgagactaattatcttggcatttgcttttatttttagctgggttataactgaggagacctggacagggtgtggtgtgagggagttgcttgctggttgaatagttttgaggactgccgggactagagacagtacacactttccttaagggaaaggtgaagaatgcataatgttgaagtatatttaaagaaggtgggcacattcatgtaggtgtggaatcaaagcttaatctggaagcaaaaaaaaaaacatagcaagggagaaaccccaaattcagtgttaaagattttgacagtgacttgggaagtttcactgacttgtgaggcaggagaataagaaaagctgagagaggcagcagtgtgtattaaagacaagcccaagggtgaagaagacagctttcatgaaaagaggaccatgggaagtaaggggaaggtttacacaggaaggtgtcaggattaaagtaggaggcaaaaaagatggcttggtagccactgatctgagtgaaggggagccagaccaccccgcctgcccctgggccacttgttgcatcaacgagcattcacacaacacttcctgaggtgccgcagaggcacccaaaatgacagcatggtctctgcccttaagaaaagagaggatcagactaagccgagtgattggagaaaggcgttttattattgctgtcattgttattcttcaaatctagtgaacaaaaatctaaacagtatgacccatcatttggctcttctctttcccatctctacaaaaaagaataaagcagtagtgaactaaaggttttgaactttctttactgctcacctttgacagtttttatttgtcttaatgattaagcaaaggatatttggttcagtacctgcagaccctgtgcaacagtaggcatgagatttaagaataacaaagtggcccggtccagtggctcacgccttaatcccagcactgtgggaggccaagacgtgcggatcacctgaggttgggagttcgagaccagcctgaccgatatggagaaaccacgtctctagtaaaaatacaaaattagccgggcatggtggtgcatgcctgtaatcccagctactcaggaggctgaggcaggagaattgcttgaacctgggaggcggaggttgcagtgtgccgagattgcaccattgcactccagcctgggcaacaagagcgaaactccatctcaaaaaaaaaaaaaaataacaaaatgaagccacagctaaaatgtccaagaagaaactagaacgtggttacaatgggactaaagagggtggggattagggccctcagtgacatgagatcagtcttgggcatctcacataccttggattatagaagggatttccaacagatggggttaaggggaaacctgacatggaagctgttgcctttttgattgagcaaaggggatttatttgcaccgagaccctgagtaggactgtggaacccatgacccctgtcccccccactgcctgttgatgaaagtggagccgggcacggtagctcacacctgtaatcccagcactttgggaggctgaggcgggcgaatcacgaagtcaggagattgagaccatcctggctaacacggtgaaaccccatctctactaaaaatacaaaaaaaattaaccgggcatggtgtctcacacctgtaatcccagcactttgggaggctgaggcgggcgaatcacgaggtcaggagattgagaccatcccagctaacacagtgaaaccccatctctactgaaaatacaaaaaaattagccgggtgtggtggcatgtgcctgtagtcccagctactcggaaggctgaggcaggagaatggcatgaacccgggaggtggaggttgcagtgagctgagatcgcaccactgcactccatcctgggcaactgagcgagactccgtctccaaaaaaaaaaaaagagagaaagtggagcacctgatatccatgtgcctccattttggaaggtgacgctgcagacaacccaattctattcttctggagctgttcagagcaagcacttcccattgtatcacagaggacttcctccccacctccacaggttgtcctatgctttagcaattccctcctcttggcaccatacctgtatagtccaccactctgcagatgggaatgctcacaccaccatataagggattatcccattcatgaatgccaaagaaataaaatagtgataagattttcttcacctgagtatctcccacctgtatgaccctccacccatactgtggtgtcaaggaactaaaaggaggaaagattttgtcatttcttttatatatagtattggtgaggatgtggagaaattggaacactcatatgcttctggtaggaatgtgaaatgatgcaaccactttggaaaacagtttggcagttcctcaaaaaattaaacagttaccatatgactcagcaattccattcctgggcatatgccctagagaatgaaagcatgtctacctaaaaacccatacacagatgttcacagcagcattgttcacaatagaaacaatacacatgtccatcaactgatgaaggataaacagaatgtggtatatccatatattggactattactcagccgtaagaaggaaaatctagagagagaaagtaggtgagtggctgcctagggctagggggttgggggtttagggggtgatagctaaagggtgtgggggttcttttggaggtaatgaaaatgttctaaaattgattgtggtgatggatgcacaactctgaatatactaaaagccattttaaatggctgaattttatgatgtgtggattgtatctcaataaacctattaaaacataaaaagcctgtgtagtcggggagtaaagcgaaggagacagggagctgatgacaggccagcccatgtgggacggctccctgaggatagcagtgctccctgtggcctgcttgcctttaggcactgtcataggcagctgctgcctctcttttaggccttcgaggacatctacattgagcagagaaagaccatccgcaccatcctggaatatgctgacaaagtcttcacctatatcttcatcctggagatgttgctcaagtggacagcctatggcttcgtcaagttcttcaccaatgcctggtgttggctggacttcctcattgtggctgtaggtgtcttgctttctgtttcccaccccttccagcaggaacacagaaacaggggtctctctttttctaatggcagtagctgccctgggcccaggttatagatcaagatgtagatgtaggtgtgggtaaagttcctttcatagcactgagatcttcatattaggaaggggaactctgaagtccctgcatttgctccagggggactaaccaaccaactctttagtctggtgggtttggcttaacttagattcagagattaggagaagtggaatcactggtctcaaaggcccttgttattaggctggggacaggaaagttcttgccccaggccagcaggatgtcttctttttgtggctgggagaaggggtgagagaatgagatgggggctgttgggacgaaggtggtagtgggatctgtggtctctcctgctgaccattcccatgaacacttccatccaactcaagtcttgataccggactcatccaaacaagtcagtttattaggtgaggggagttcatactgaaataaaatacccccttcttcccacacgttgccattctacagtgatcatgaaacttgagaaatccttttttcctccaggttccaagactatctccgaggtttgctggccatgacctcctgtgttttttccaggttggaagtgacatcctctctttctcaccccaccatcacttgtcccttgtcagctttactaaggatgatgactggtctcttattctatgtaataactaaagcttctttctttcagccaagtcagcattttaaagaaaggatgaatgggatttgtaggaccagggcctgtggaaaatttacttccttctgagggctgttaagtgccaagaaagtagaacggtggagactagactggtcatgtagaatgcaggtttcattggctgcatggtgaactacctgtagagtacctctgggatccaggatagagcagcatagaaatctctctgatggcaagtgcccaatactgagccatgatttctgctctataaatggatttcttttccaatacattgtctgcaatttccatggttaatgacccccttcccagaactgtcactgtgccctcagttgcatccccatttcaaaaagccagcctttgggaaatgcctaaatgaggtgaggaccccagccctagagggtaccaacgtgagaccctcgcagcgagagatgttagcatccctccagcaactgttgataccatcctgtggtggaaggacctgtaccccccacagacagaaagctggagctctaagacttaaagaatgggattgagataagacccagagagccaaagtgagactgggccagttctctttctggagaaagggcaagtgccatagagtcttcatttcacaatagctcctcaggactacctggcgtcaggtgggacacctgaactcaaactggtactcccagctgcctggggaggctgtgatttgaaacagagcttccccaccatgacctaccctcaccagaacacgttcttctcttttccctagggtgagctacccagaatttgaggatattgatcaggtatcccacatgcccctgctaaacaaataagctgctaaagcactaacagtcctacacattagcatttatttattttttgagatgaggtcttactctgtcacccagcctcaagtgcagtggcgccatctctgctcactgcagcctctgcctcctgggctcacacgatccttgcacctcagcctcccgagtagctggggctgcaggcacacaccaccatgcctggctaatttttgtatcttgggtagagatggagtttcaccatgttgcccaggctggtctggaactccttggcctcccaaagtgttgggtttatagacatgagccactgtgccaagccagcatttatttcacaaactttttttatggctatacgcaaggtggaagggggtaaagagcataggacaggcatgcagccaactgacactaattcataagctcctctagcttttgggggttgcttgatcattacattactgtggtgcccaactggctcctgtgaagacctctgtgccagttattagtaaataatatagttgaatgccattatctgtgtagaattgctccagaagcaataaggagaaacagaggttatccttgttgcaagcatgttcccagcccctggggagcttacactagcttccatagcaactatgtcctgactccaggcttgtgctaggtggggggacattcccaggccatcacagtggctccaatcgctgccgcttttgaattgtggatgaacaattagtcttggactgtcacctgaacagttggaactgctggactttttggtgtccatttgagtaaagtgtctgatttctttggcattttagaacatccagaaggttaggtcctaacttagcaccatccactggtgacttgatgtctgagtctgttactcatcgcatttgtttccctaattgattttcattcttccttgttgcctcttaaagctgtgagtacttttcagagtcatgggattatccagatgacttccaaggttaattccttttatttataatccatatgagttcccaaacaaggaaaacattctgttttgctcaggtccttggctgcattggagattgtgtcctgtaaaagaattttggcatcttttccccaggacatttatcccactgtatgtggagatcagcaagcctgtcagttctggaggtggggacttgcagagactacttgccttggcctgaattcagactgctgaaaacattccccgtttgaaaatattcacatcattttggaaaaatcacctaatgtctttccccctttttttccagcctgcaaccatagatgccctgaatttattttttttttcatttttaaaatttttttaggtaggtctcaccctgctgcccaggctggagtgcagtggcacaatcatggctcactgcagcctccaagtcctgggctcaagcagccttctcacctcagcctcctgagtagctgggactacagacacgtgccaaggcgcccagcttgatgccctgaatttgatgtctcctcaattccttttttttgttgtttgtttgtttgttttaggtttgattctttccttaaagaatactttaagcaatgttaggattatctccaggaggggcttaacagagactcagaggattataagagagccctcaactactaaagaataacccagataagacccttattgatcctgtcctgggccagattaatcagctgagtaacagcttatctcccagcaacgtttagagccagccactgaattggcctttagacctcctccttcattctccacactgtgggcctatttgttatcagataagtcacccaccctgaagagctgggatcttcttaccttatatggtgcctatagccactcaaagcttagtttcttgcaatctttacctgacaaagtttcgtaagatgaagctgacccaggggactgttgagtccaggtacttggttgagaaagaatagcttcccttcagatatacttattaaggcctcatgaagaatctggcaactttcaattcttttggagttaagagttggctgcacttggcaataatagggaagtagatacctccatataaattcttattgataatgatggatagatggagagaaagggattagttggtgctactatgttctagatagggcttttgtggaccatagtttaggcagacattgaactctggaccatctgccttttcatgaaaattagggtagcctaatagggcaacatttacttccggatttgctttggacattgcccagggcttcagagaagataactacactggtggattatgagcacatgcatagatcaaggtccatatccctttttattttatttatttatttatttatttgagatggagtttctctctttttgtccacgttggagtgcaatggcaccatctccgctcactgcaacctctgcctcctgggttcaagcaattctcctgcctcagccttccaagcagctgggattacaggcatgcaccaccacgcccagctaatttatttttgtatttttagtagagacggggtttcaccatgttggccaggctggtctcgaacttctgacctcaggtgatccacccacctcggccacaacacctggccatacctgtttttaaatcgaaacctttaaacctgctcatcctgacccttgctaggtcatacaccttccgcttctaccccctgccagtcatgctgcttaattataaatgtcttcatttttttaaaaattgtgtgtgtgcaattcacagacacaggatcaaagaattaaagccctaggatagagataaaaagcagcaaatgaaactaatttgtagattgtttctttttttttcctctctaaattttctttaaaatatcatcaatttaagtaagctaagctgatatgcaaccaccacttcccagtaggaagaatttaagagctgttgatggaaatatcttaacctatcctagaatttgtgttgtaagaaacccagaacccagccaggcatggtggctcaagcctgtaatcccagcactttgggaggccaaggcaggcgaatcacctgaggtcaggagtttgagaccagcctggacaacacagtgaaaccccatctctactaaaaatacaaaattagccgggcatggtggcacatgcctgtaatccaagctactcacccaggaggctaaggcagggagaattgcttgaacccaggaggtggaagttgcagtgagccaagattgtgccattgcactccagcctgagcgacagagtgagactttgtctcaaaaaaaaaaaaaaaaaatagaaacccagaccccaaacattctggagtttgactaactaaaggtatttttaggtctgctctcccctgaaaaattctgtaactctcagctcaggcccaggaaggcataaatgtagttagcatggtgttgagaaagcatcgtggtaactgctctgagagctctggtagaacaaggtaagtttgcctctggcagagcaggaaagtgtttgaccatacgtctaagcctggaggtctgcaggcttcttccccctggtacggcaacatattcaactctggattgtccagatagtcctgttggaatgttgttgtgtaacctgcccactggggacgtgacctgtctgtggaagaaaaagcattggcctgggagtcaggcagtggaggtctttaatcttggctgcagaactgccagtgtaaccctgggcaaattcttgtgtacgggtctcaatttcctcatctatcaaattttgttttccaataattcttccaactgttattctaatgataaaagttatagaagattgacatggaaatgacagacctgaggataattcattttggactgttctggaaggaaagaatgagaattataaggaaaagtgtggattcagttgtccagactcacccaagttcttgtggccatggaggggtcctggttgtagttaaaagtcagaaggttattttagttaaaagtgagagatagaaggatgtatttaaaagatagagatagaactcacttaagcgagttctcatggagccacagttcttgggaactgcaagtcagccatggtacttattgaacgttttcattgttgttaatgtcgtgacgcatcagattctcaaacaaatggttttttgtcaaccaggagtaaaagagcttgtccctcttggaaagccaatggtgaatgagctgaggagggggcagcttgtgtggagtatgtgtatttatctgtattcttttccataggtaccattaaatttgtctggcttaatttaatggggacttctgggacctgcagagactgtaaagggcgagggtaaggctcttgtcgtctgttcaggctcctctccttccagtggaacttcctcactctctccctctcctgtcagcctctccccttttccaacttgtgtgtatgttctaccgccttctcgattttctcttccctgttgttttttcttctgcctctcaaccacctttccttccaggtcatttgagtcaagttgaaataggcagctggtgttacccacttcctctacctggggggcccaatctgtgtctgcagtgctaggggctttattctaacactctggaacctctgttttctttctttttttttttttttttttttttttttttttttttttttggttaccttttttgtttttgtttttctcttctgtttctgtgtaggtctctttagtcagccttatagctaatgccctgggctactcggaactaggtgccataaagtcccttaggaccctaagagctttgagacccttaagagccttatcacgatttgaagggatgagggtaagatactaagagcagctgatccttctgcatgccagtggaaactgtttaagcatgctagaactgatcacatggtggaaagatcattcaaacacgaattctgtgatgcagctgctgatttgatcctccactctctcccccacacctgccccgtgcaaaggggaattgcgttaagctgcctcatcacattaatattggccccacccccaacaacatgccatcgcagaacatgttaacattggctattctcatttggcctggcttacctgtagcactcggggcggctttctgggctgttgatttaatagggagaatcaccaggtgcaaagaaggggaattgtaacccacagacccactgaaaagcacaagcttcaggcagggagagtgctgtgtaggggcatcagccaggtggggactgtggccttggggtcactgagaaagcagctgagaatgggcttgaagatatgacggcaggcctggaattggggatggagcagaatttggcatggccctgggagaagaaatgcttttctttctattcagattcctcttattgcaccttgttgttctcagcccagtcccaaatggactggcagcctctgtctgatagcaaagcttttttcctcacccccaacccctctgcccatgctgtatggtcccctaacactgtcaaaatgacaaccaggtatgatgctagatgactgaatatcagctagttctcctgaaatttcttgatacctcctattcctgctttggtgatactccacccaaaacaatacaaggtgttgtcaccctaccaacttagaaacaaggtgccttcttggtgccattttcttgtctcttttggtttaaacaattgtgcgtgtgcgtgcgtgcacgcgcacgcacgcgcacacacacacactaaaaagtcaatttcttaaaatcaaaggggcaactggctttggtggtaatagttgtcctgtggtgatcagagagaggtctgttatacttaacgagaccaagaaaactcgcttcaattcagatgttgaatacatgcaggagagcaaaccagaggatatatttttaaatgtgcaaacgtcagaatgtaagaataaaaattaaactgttacgatagtctacgtgaagcaagaccgattggaaaaactagataccaggacagtgctgctacgttcattcctcatctgtgatccctggctgttactccgtgaagccacccacagttgtataggaagatgaaaacttaattgggacttgggaattttattatgttaatttatccagacaaatgctttttgcaacaaattcatgtttcttctgtagcacagtcacagtttggtgtactaaatgtaagctttctgcaactctcctgaaaccatctgcaggaagggcagttccacagtagtgtaaatttattttaatttttcaaaaaacttgggattttaagactttgtcccacagataagagaggttttagaatgtgcgcaataaggtcattgctatgctcaggctaaatttaggaagagagtttattacacaagattcagtggtttagacagccacggtgagattgaaaatgtggttaaaatgttcttctctgctccctgcacctttgcatgttttccagagggagctaataaaatgttttaataaactatactggttttgttataaagttgataatccactttggtgactgaaaaactgaggacaagatgcaaccaaaaaagtccactgaagacagtacttgtcctgagctcctccgcatccccttacggtgatccctgatcttccaaaaagagattggtaatacctgaagaaatccccccatccccctacaaaagaaatgcccatctgacccatctgacgcttgttactaactatttccatctagatgctcattactgtcactcctgtccaggcagacagaagcagtcctcatggccgctgaggccagtttgctcatgaggcagttatttgaataacctggatgcaggagccgttttgggagccacacctcttccctttagctgccccttctttctgtacctttcctggaccctcagtttccagtcccctaaaaactttcatttgtcaacttgaaagtagtttaggagcttggaggtcccgaatgaataatcaaaacagtagataattttatttgaaaagcattacgatgttttatttgaaaagcgtctacatcaagatttttttcggtaagataatatggtcaagaacaagtttgaacccaaagctggaatttaaaacaataaatgcattaagggaagctttggaataagagtgccacctcatttgattgactccagccaactaacagacagtattgaccatggctggttggacaggtgaaaagggatcagggatccattcctgccctgtgggtttcctagcccttctgtgggagagtaactgcaagaagaaaagattggatttggctaagcgtatagtaagtcccccagtaataaacagaattaggtacacatgttttatttaaatgttgtttttctatggggcattttttttttattctttggttttggttcttctatatgccaacacttgagagattacctttagaatattttaaataagaaatcttcataaactgaacaccatccatgcagatgggctcaactgtcactgtgctgctccaattacagactcagagcttcgcttgagagggagcatatgacccaagcctgtcctggggcactgacttcagtctcctcttcttcctcaaaccaaagaccaggaaaactgaagcacttgtgctataggcaaaggaatacttaatgtagttctttgcttttctctcctccatagtaatcttcatttaaagatttcgctgtgctgttaaatttttgagggtatataatattagtgccatgaaacatgcatgcatttttgttgattgtcagtacatagttgtccattaaagccatgttccctctgccagatattaaaagccagctgacagattttatagtatttattgagcaacaataatgtccgagacattatagagaagacaaaaatactgtaagaattaatatccattggaattttctcatcaattaaatgggatttgtatcaattgccaagtataaacttccattgataaaagtaactttttatagattactaaaacctagctttgagtgatatttccatgtctagttcttaacaataatagatttcatgataattaaaggcaatgtagagtaactagagaacttgagaagagaggatcaaattcattaagtgactaccagtggaaatttgaattatcatttataatatatctttagtgtgagagttcaaaataagaaatatgatctcttgcccagtggttgctgagaataacagcacaatgatcattacatatggagcacagttaaatagtttctgcttaacatattgcagcttatcagctaatgttcaaagcaaggaagaattattagtacgtttaatcaactctgggctgggcatggtgtcttatgcctgtaatcccagaacttttggaggccgggatgggtggatcactttgaggtcaggagtttgagaccaacctggccaacatggcagaactccacctctactaaaaatacaaaaattagctgggcacggtagcacgcacctgtagtcccagttactcgggaggctgaggcaggagaatcgcttgaacctgagaagggcctccccttctcagtgagccaagattgcaccactgcactccagcctggtcgacagagtgagaccctttctcaaaaaaagtaaataaaaagttttcctctggttatgattaaagtacatttgcatcttataaaactttggattttataggattttatatcatatcagagaaaaaggctctgaatatttttgtatattgattcatttgatcaaatggatcaatatgtaaaattttctatatactttatgagaataaaagttcaaagagatcacgttaatgtttcttccctatggtaaatattaacccatatttaactgtaacccatagtatgtgggacaggttagactgggtttgagtagaagcatagtcagaagagttcctggaggaagtaggttctgaattgagattaaaaagcagcatgccttggtttcaagtctttggggcctacttcctgtgccacatttgtaatggtctaacagaaagtcacgatctcccacctaaggtctgctgtgaaatgctgtcacatagacttgagcttttgaatctttacctaatctactcccgtattgtttgagaaattatttttccatttgtggatcatcctccttttgcctgttcttttgcacatttcattgctttttggtgctcccgccaaagggtgagcaactgtagaatgaggaggtaaattcaaatctgggtacatgacaaatttggtaacataaataaatatgaatatcattctccaaaaaaagtgaagattttccagatttcagatatcctggctttccttgctcaacttaataaacaaagtaataaacactttaatgacagagctgtcagatctagaagagatttcttggtctaagaattaagaaataactgcctctcagtctaaaggccctaatatatgaattggagaaacacaaaatgaatattttaatctaaaaggaagagtgactccttagcagaagaatatcattgcattttttacacaagatagaacaggtagctctgatcagccacatgtcctgatgagtgacaatgcagtctaaggcaaaaccagaagataaggaaaccctaaactctaaattgtgtgctgctctgactgatactgtaaagcaaaatcaaagttgaaaacaacccagaaactttgattcctaaggggtttttttcttttgctttttttttattcctgagcttactgtagtcagtgactttttaacaatatgccaatttttttagtttcaagagcagtaatgatctaacccaaaactctcttaaaaaccttaagtcatccctatttctaatacactgtgatgagtggagtcaagccctggaatgagcagagagacgacagcattagccaagcagggagcgactctgatttaaaagcctacaaagtcagaataaaaaggctggagaagtataatgaaccttgagtgaaagcacatctgttcagattttattttatactgtttggtagagggaatatagctttttttttcttgagcctgcaaaatatgcatgctcagctattgcctgaaataaaataactggccttgcgtagtcataaaagagacattatgtactgttaactggctctctattaaccacaacgggtagttctctgtgattttgaacaattataccttgtttttcagagggggaatgtctgttgaaaggcaactagcaagctgaaagttactcatattttcccattgggcatattttatgaattgaggaagagggagactggactaagaaataatttttcagtcccaggctgatgcataggaaagaagacctaggtcagcttggctggggaatttgtgttagtcaaaataaaggtgtaactttttaaaattccttcaatatagtcctagacttagaaatttttggtcctacttgtcagtctgtccagttactctaattccaaagggaatgtaatgtttccatacagaacaagccacacaatgtcattcccctcctggaaatcaaaaaatgtgcttgctctcatttccacccaacactgagcaacctccccttccaatgcaggtggtggtgaatgccttggtgggcgccatcccctccatcatgaatgtgctgctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggcccttcttcaagtagtaagtagtgtttttgtttttgttttttcagttctgtgaaattcaggcagctagcacaaatcccatttggcttcttctcaaccctacttctagaatcaggattattctcaataagtccaagaaaacagtattgttccccaaaccagtttcagagagatacctttcctgagtattctctgacttctacaagatctcactcaaaggaaatctctcattgtgctcaggaacagagctgtgcccagcaacaaataaagattcctgcagtgtaataaagtggcagagagatcatcttcccttcccggtcagagagtgcagttaagggcaaaaaaaatcaagataagcacatagacaaaaaagtaatggcaattgtgatggagcaaaataatagtacatactcaccacactccagttaacttaggaaaaaaccatggcagtgccttggtgccacactcacctcagctccaccccagagaaaggtatcagattaatgtatcacagtaaggaaggatttaactatctagataattttcttttgcctaatttcattctttcgtgcttagttttcactgcctctctcaccagtgtttcagaatgtgtgacaagacaacataatgcagtgaaagctcgtaggctttgaaattagactgttatagatttgaacatactctgatacttactggatatgtaactttggacaaattattcagcctctctgattctctgtttcttcatctattaaatatagataatgacactttgcatggttgttaagaggatttgtgatttttaaaaatttcttagcacaattcccagcatataaccatgcttaattaatgaaaattgctattaagtatttttgttactatatttccatgcctatatcatacagttcttgggagactaactgcaataacagatgaagctctcaacctaaccttacatatagtaagcactcactgtcaactcatagtagaaggcaaagttcatggaatgaactgtagtttttcctaccccaaagcttttttgctgttgtatcccagttcaaaaaattggacccacaaattgaatccgcattggagcatctccagaaaaccagtgcacatccacaagccagtcaaacatggtagtcacagagtccctgccatatgcaagatgctgtgcttgacagtacagtactagggccctcagatgaataaagaccttcctgtgccctgaaaaaaccttagaatctggttgagtacataaaacacggtgaatagtacatggattatccatatttgtttccaaaatcagtctagatatagtagactgaaggagtagaattgggaagggactgtcaaggataaagctggtattgctactacataggctatacatgtgtatattagtaaagggtaagtctgatcttgtttttctgttaaatccaactatgagtttttccaacccccatcgcttaacacctttttttttttttttttttttgcttaccacctttttaaaaaatgattcctcagtggaatggaatgctaagttccaagcattttcagtagattcctgccattcactcataaaagttttccctaactttaggcaggcttctcaggcccatgtttttgagtcctttcgtaaagccttaatcccattaccattttcaacatgtttatttgccaaactttgttgttattttcaggaacaaagccctcctgggacctgtagtaacaaacagaaaattctgtgtccaagggaggctgcacccaaacccctgttctgtgttctcactgaacctaagcctggcctttgggacccctgcctagactcccatccactccctttataggcaccgtctaatgactgactctgtttgccaggcaaccttcaaaggctggatggacatcatgtatgcagctgtagattcccggaaggtaaggatgtacatggcgaaaataccaccttctcagatggctggaaagcaagcagcatggtataccgagcccaccaagaaagaggaagggatgaaggaatggaggagttgacgtttctctttggaacatttattgcttgtgttattgattatagatcattttcctcgtctcagtaagtcatcactctcttacattggcccccgatgattagactgttgattttttacgtggccccagtgaagctgtctatgcttcaatcctgcttcatagcaaaagtatggctcctagcagacagccctccctccctgtggcctcatgatttgcatgttctccacatgagtcagaggacgactagtgtcctctcaaggcaggccatgccagtgtagagaaggaggcaggcagaaagaatctagggctctcccaccccaagatgtttagcagctcaaatggtcacagttacggctgatggccttggcgtgtcaaactccaaactaggagctgattctcttccttttatcctgtcctttgacagcctgatgagcagcctaagtatgaggacaatatctacatgtacatctattttgtcatcttcatcatcttcggctccttcttcaccctgaacctgttcattggtgtcatcattgataacttcaatcaacaaaagaaaaagataggtctcctcccctcattgccagtggttggaagtcagcccagataagaggcacctttgtccctatctctagaaagaaaatgtccctctttctttctctaaaatctatattgttagctcactgtgaccctggcccccatacgttagccccaacccactctttctgttcggggctggattttgcagcatgtagtttaccacacttactagcagtcttttattcttgaggcctattactggtcttggtctcccaccagaagcaggtaggtcagagagtgcagtcgagcaacagagatgaaaaggaaagaaacagatgaatagctatcgcaagaagtagaaactgtctagacttgtgattatctagtcaatctctgagcacaagcaaattgggatttgagagacccacctttggaaagtttacttccttacttgttctagatggttaacaagttttacaaagcaaattgaaaaaattgctcgttgctcattttgtaagtcaagtctatcccagcatactccaagacaccctccaaattgctttcttgcaccagaatttccaaattttgggtatcatctaaaataaattggctatcagccaggacacaaagatctttttattctaaaatgtgttttctagaatgtatcaggaaagctggcccccagaaaatgagactctgagatatgactgccttcagagtcactgctctcaagtttaccctttctgagggtctataattggatagtccatttcctttctaccttgggactggaagatcttagaaatcctgagctaaaaacaaaggcaggtatctctttagagctgaatgattatcgcgggtctaccccactctgggacagctattagctacaaaggaaagggataggtctcccctcagttctcagtattgaaccttaggtccaaacccatagcatgttgagagccagttgtaattgtctgttttcttcttccctcctttacttcggaggtcaggacatcttcatgaccgaagaacagaagaagtactacaatgccatgaaaaagctgggctcaaagaagccacagaaacctattccccgccccttggtaagtgcattgtgcaggctgaggccttggtgagaacccatataggaaaagtactagtagagttactgcaaaggaaggaaaaaggtaagtgattggctgctttgtgcctaatcctctcctcaccacccatccaaaagatctgaataggacagcagaagaacagggattaaggcatgggggcttttacatcaatcctcgacctatcctctgagccttccttgggcagccaccaagaatcagcatgtgaaccacattggctttggccctagtagagagatgtttttagagacaaccaaaagtcaacaagagaaaatgaaataaagttgctctctttcctgccagttcaagataggatttggtcataattttttcagcttctctctgctcaataaggatgtctttgcaggatgtatctagaagttaaaatcatgcttctggttatttgtgggagcagaagagggtaaaactatgggagtctggtgccctgattgcctctcttgagctgagccttttataaaacagattagggggctgagattctgctccattgttccattggtgatggttgtcttgtttcagagaaggagaaggagataccctgctcctgattccatatatccggttggatgggacatcacccccaaaagccaggcccaaagttccttcttctgtaacttccatttagcaactttaaaaaacagacacaacaccaccaaaaaaacccagcagaacctttaatacaaaagcttccctgataatctaatttgtagaaataaaagtagagtgactatgtttgaatcaagagttatagttccagaacgttttctcccctcacccccacacgccgcacgtggtacatctaccgcatcaacttttgaaggaaaagaaattctagggctttgcagggcagattgaaaaccaccaagttaaagtaatcctggaaataagcaccagcccaagtatctcagtacttcaaacaaacaaacaaacaaaaaagcaaggaatctcaagaaagagaacatttggggttttttatttccttgatgttaagccttcattttgtgatagaaatgggactaaagggaatagaaaagggttaacatttctaaagttctgtttagtactttccatatgggaacctgagtgtattttcttccacattaaaatataacttccagcctaggcaacataatgagaccccatctctacaaaaaaattttgtaaaaagtagctgggcgtggttatgtgtacctgtggtcctcactacgtaggaggctgaggtaagagaattgcttgagcttggaggccaagactgcagtgagccatgaccgtgccactgtactccagcttgggcaatagggagggaccctgtctcaaaaaatacaaaataaaataaaatattttaaaaagtaggaaacattaataaagagtgattaacattcatttagcaaatatttatcagtctttactatgtaccgtgcactaagcattatgtgatgaacaaaaggtagactgctgtcatggagcttataatagttggggagatagataataaataagtaagcaaacagctacaataaaatgtggaagattgtaggaaaaaaattaactagagggctataagtggtggatctactttaatatagtagtcagagaaagcctcactaaggagggtctacttgagtggatgagaaggaactggctgggcacggtagctcatactgtaatcccaacttgggatctagaggcaggcagatcgcttgagcctaggagttctagaccagcctgggcaacacagtgaaaccccatctgtacaaaaaaaaaaaaaaaaattagccgagcctggtagcatgcctgtagtcccagctactgagaaggctgaggtgagaggatggcgtgagtccaggagtcagggctgcagaggatatggtaagctatatcatgccactgcactccagcctggggaagacagcgagaccctatctcaaaaaaaaaaaaaaaaaaaaaaaaagatggaaccaaagagctggggaaagagattcctggcagaatacacaagaccccagaagcagaaaacagtgtggccagggggtggcgagccagaggagggacattgatgagcagagtcagactgtgccaggtgtctccccgtaagccaggttaacaaatagggattgtgttgcaagcccagtgggaagctcttgaaaggttttaagtaggggaatgatgtgatccatttgttttttgttttatgttttgagacagagtctctctctgttaaccaggctggagtgcagtggcgtgatctcggcccactgcaacctctgcctcccaggttcaagcaattctcgtgcctcagcctcccgagtagctgggaccacaggcgcctgccaccatgcccggctaatttttgtatttttagtagagacaaggtttcaccatgttgaccaggctggtcttgaactcctgacctcaagtgatcaattttgggaggcctcggcctcccaaagtgctgggattacaggcgtgagccaccgcacctggccatgatccatttgttttaaatcattacacttgctattatatgaggactgcattggatgagggcaagagaagaagtgggagaccagttaagtggccatacaagtccagatgagagatgatggtggctcaggttagcatagagccaataaaaatggaatgaagtggatgaacccaagttataattttggaggaagaatcaacaggcccttcagtggatcagatgagggagaagaaagagacaaagatgatgcccagattcctggcttgagagcctggatgaataattgagatgagaggaacaagctgggtgaggggcagggaacagacttggctctgctttggacttaactgtgagaggcttggacatggtaagtttgagatgcttatgagtcatcaagaagaagtggcaagaaagcaactcaggatcagaggaaaggtatgggctggagaagaaaagcttaagcataagtacataggtatcacgtaagcagcaggaatagatgagctctcatagagcaaaaatttagagaaagaagggattgagagaagaaatggctggcagatgagaccaaaaaaggagcagctgggtaagtaggacgacagccagagtgtgtggtgtcacagacgcaaaagagaagtgggtcagctgggtatagtggtgcacacctgtaggcccagcttattgggaggctcaggcaggaggatcacctgaggccaggagtttgaattgctatgtgctatgatcgcgcctatgcatagccactgcactccagcctgggcaacacagtaagacccgtctctaaaaacagaaagaaaggccaggcatgatggctcacacctgtaatcctagcattttgggaggccaaggaagacagatcacttgaggccaggagttcgagaccagcctggccaatatagcaaaaccccgtctatgctaaaaatacaaaaaattagccggacgtggtggtgtgtgcctgtaatcccagctactcgggagactgaggcatgagaattgtttgaacctaggaggcagaggctgcagtgagtcaagatcgcaccactgcactccagcctgggcaacagaatgagactgtgtctcaagaaaaacaaacagaaaacagagagaagctggtaactttggaaagctcttggtgaggtaatattgatgttggtctccatccatgctcctgatagagcagcagagctgaccagtattacagaaaaggagggagagggtacctcgattagcagggtgacagcttccataggttggcttggaaaggttttcatgaatcttttatcttttccttcccttcctccccagaacaaaatccaaggaatcgtctttgattttgtcactcagcaagcctttgacattgttatcatgatgctcatctgccttaacatggtgacaatgatggtggagacagacactcaaagcaagcagatggagaacatcctctactggattaacctggtgtttgttatcttcttcacctgtgagtgtgtgctcaaaatgtttgcgttgaggcactactacttcaccattggctggaacatcttcgacttcgtggtagtcatcctctccattgtgggtgagtggggttggggaagtaggcgaggggaaaggggacctgactgattgtgaggatgagatttcccaggagaggaatgaatgacacaggtctgaagtgcaggcaagataccctcatagcttaagtccatgtgtgcccctgagtcatctcgggggcctgcctagcaggttccatggtcagtgagtttctactgagtgttctcggtagtcttggattataaattctgtggctcagggaaaaaagaaaaaaaaagaagattggttcttgcttttaaggagtttaaagtctaacagggaaggtaaaagaaagttgtcattaaaaaatgtagcacaatagaagtataaaatgaaagaaggaatgattgctaagttggccattaatgaaatagtctaggtaagttctggtggtgatggccatggtagtgctgctgttactggcagggcttgtttactgagattttactgtgggccaactacagtttgagagtttcttcacctgtgttatctcatttgattcttattacatcccaggaagcaagcttctttattatctggactgtatacatgtccacagccactcgctaggaggtggtggaggcataactcgagttgatcccaaagtccaagttttttaacagtgactgtgtgcattttgcttcaacctaaaagtgtggggggatgatgtcctggcaggcaggcagaaggaaatgccaccctgttgattgccctcccaaaatgtttccttgccttcctgaaaggcatcttttgtgataaaactcagccttgtttccaggtaagtttgactcatttacactagagagagtgctcgagacccatgggaccagccccagagctccagcggccatgctgggcctagtgtagtggttataaggtaccagaaggcaggggtctccccttggcctgtgccaccctctagttctgtcctccagagcagcatgtccaaaagtgtgttgatatgtggaacactaatcctagacatttctcctcaagaaaagaatctcatgagggaattactttaggtaacactgcctttaattttcctttgaggattcacagtgcacattactgaattctcttggaaatcctacggtaaagaattctgggccgggtgcagtggcgcgtgcctgtaatcccagcactttgggaggcaaggcgggcagacaacttgagcccaggagttcaagaccagcctgggcaacatgataaaactctatctctgaaaaaaaaaaaaaaaaatgagccaggcatggtgatacgtgcctgtagtcccagttacttgggaggctgaggtgggaggattgtttaagcccgggaggtcaaggctgcagtgagctgagatcacgccattacacttcctagatgacagagagagacctagtctcaaaaataaagaattctgtttaaatgtaacatagcatcccacctttattagaccagtttcctttttttcagtaataataatgatagctcacatttaaatggaacacattatgtgccaggtaccataataagtgctttaaatatgttaattcatataatcctctcaacaaacctctaagaatcctgaggaactgaggcacagagaggttcccaagacatgtggctggtaagtgagcaagtggggattcaagcccagcccctggcctcaagtccattctcctaatttctcacaaaacacactttggacaatgctacccttgtccactgctcttgaaactttcctggccacttatcgttgagtgacacagaaaatccacagaccaaatcataccccctattttcaaatggtactctaaaaagaggaagatgtttttgatgatggggatttttattaacattaatttgttcagaaacaaaagtatagaaatcatctttttaaagtaagaaatgtattagagttttgtagagggacaaaactaataggatagatgtatatatgaaagggagtgtattaaggagaactgactcacgatcacaaggtgaagtcccacgataggccatctgcaagctgaagggagccagtagtggctcagtctgagtctcaaatcctcaaaagtagggaagctgacagtgcagcctttggtctggccaaaggccagagagcccctggcaaaccactggtgaaagtccaagagtctaaaagctgaagaactcagagtcttatgttcgagggcaggaagcatccagcgcgggaggagatgaaggccagaagactcagcaagtcagcttcttccatcttcttctgcctgctttttctagctgagctggcagccgattagatggtgcccacccacattgagggtgggccttcctctcccagtccactgactcaaattaaaagtaatggcaaaaactgcaattacttttgcaccagcctaatctctggtaacacccagaaacgatactttgcatccttcagtccaatcaaattgacacttaatattaaccattacaagtccaccccttgccaacttgaacccatacacatctcctgaaatcatacttaatctccaaataaatacaataataaggtcctaattacgcctaacataatacagctatccttcatacaaccagaagcgcactaatccttaacctgaatgctattacataaagttaacaacacttaaatgctgatacgaagtcaacaaatcttacgtcacatgataaaggaaaaagaaaagaactaaaatgaagatattttcctagtacaagtgtatacatgcacaaacatgttcttaacaaaatgaggaaatactcatgacaatagtcttcatttctgcaactggtcacgtggtcgtagctggtattgatgactaccttctactactcattctatattcactttgccttcagcaagcaccacggctggttgtggttatttacctggtggagtgacccaaatcttcattcctaaagggtttggggcatttgtagtcctacctggattgggctgttgtagtttcccattgaccttaatcacagggcatgctaatactaagagacgccctaagggatctcctgtattccatgcatactcttccatacctccattgtggagcagtagactgatttcatcttgatagtctgggtcagtcaccccagccaacactataactcccttcttagactgttgacttagaggtagcccaaagtggctaggtggccatcttaacttcaggtttaatggaatcattgttgtgtctcctagtgacagcattcctccctctggaactaagacctttaggccagcagaacataatgtcgcaggaacaggaggcaaaaattttgctagccggtcactaggggtgatggggagtggtgccacttccatttccaccccttgattcctggacccatgaatcctggctatgggagaaacagtaccatatattggacactgattcaaagcatacatggccttctggagaactttgccccagccctgcaaagtattgttacctagttggcattgtaatcatgacttcaaaaggccattccaccatgctatcaatccagctgcttcaagatgatgaggaacatggtaacaccagtgaattccatgagcatgaacccactgccgcacttcttagctgtaaagtgagtgccttggtcagaagcaatgctgtgtggaataccatgatggtgggtaatgcattccgtgagtccacagatggtagtcttggcagaagcattgcatgcaggataagcaaacccatatccagagtaagtgtctgttctggtgaggacaaaccgctgccctttccatgatggaagaggtccgatataagcagcctaccaccaagtagctggctgatcaccccgaggaatggtgtcatattgagggctcagtgttggtctctgctactggcaaattggacactcagcagtggccacaaccaggtcagccttgatgagtgggagtccatgttggtgagcccatgcgtaacctccatccctgccactatagtcactttgttcatgggcccattgggcaatgacaggggtgcctggggaaagaggctgagtggtgtccacagaatgagtcatcctatccacctgattattaaaagcctcctctgctgaggtcaccctttggtaagcattcatgtgggacacaaatatcttcacagtttttgaccactcagagaggtccatccacatacctcttccccaaatttgtcaccaatcatgcttctttgaagtccctgaccatccagccaaaccatttgctacagcccatgaatcagtatataatcacacatctggccatttctccttccatgcaaagtgcacagccaggtgcactgctcgaagttctgcccactgggaagatttcccttcagtgctctccttcagggatgtcctagaaaggggctatagtgctgcagctgtccacttttgggtggtgcctgcatttcgtgcagaaccgtctgtaaactaggccctagtcttctcttcttctgtcagttgatcatagcgaactccccatgaggccatctctgcaggctctgggagagaaggtagggtggcagcagtggggaccatgggcatttgagctacttcctcttgtaacttacttgtgcctttaggacctgctcgagcccaatcaggtgcataccatttccatttgacgatggaatgctgctgtgcgcacccaacttcatggctagatgggtcagagagcacctagttcatgagaggcggttcaggccacatggtaactgggtgacccatggtcaaacgttcagtttccaccaaagcccagtaacaggccaagagccgtccctcaaaaggcgagtagttatctgcagaagatggcagggccttgctccaaaatcctacggacctcctctgtgattcacctatgggggcctaccaaaggctctaaacagcatccctatctgccactgatacctcaagcaccactggatctgctgggtcatatagcccaagtggcagagcagcttgcacaacagcctggacctattgcagagccttctcctgttctaaaccccactcaaaactggcagcctttcaggtgactcaataaatgggccggagtaacatactcaaatgaggaatgtgttgcccccaaaatccaaataggcccactaggcgttgtgactctttcttggttgtaggagaggccaaatgcaacaacttatccttcaccttagaaggaatatcttgacaggcccctcagcactgggcccctagaaatttcactgaggtagaaggtccctgaattttagtctgatttatttcccatcccctggcacccaaatgtctcaccagtaagtccagtgtgtttgctacttctcgctcactgggtccagtcggcataatgtcatcaatgtaatggaccatcatgatatcttgtggaagggaaaagcgatcaagatctctgcgagcaagattatgacacaaagccagggagtttatatacccctgaggtaggacagtaaagatatattgctggccttgccagctgaaggcaaattgcttctggtggaccttatggacaggaatggagaaaaaggcatttgccaaatccgtagctgcatatcagataccaggagatgtgttaatttgctcaagcaatgaaaccgcatctggtacagcagctgcagttggagtcgtcaccacttggttcagcttatgataatccactgtcgttctccaagatctatctgacttctgcacaggccaaataggaaagttgaatggggatgtggtgggaatcaccacccctgcatctttcaagtccttgatggtggcactaatctccacagtccctccagggatgcagtattgtttttgatttactgtttttctaggtagaagcagctctaatggcttccatttggcctttcccaccataataggcctcacactaccagtcagccaatatggggattctgccagttgctaagtatgtctgtgtcaattatacattctggcactgggaaaatgaccacaggatgaatccgggacccactgtaagtcagacctgagctgaaacttcattaattatctgacctccataagcccttactctaactggaggaccacagtgatgttttgggtcccctggaatcattgtcagctcagagccagtgtccagtgtccagtagtccccgaaaggggaccagttaccctggtaaaagaccggaggtctccttggggaagcatgggagaaagattagcagtataaattgtcagtagtgtagtggggtccttcctcaaagggaccaggcctcccctttattcaaggggaatattattctgggtctgtacgctggttcaagtctggaaattggttgagggggcatgattctctatttttataattcaaattagccttttgtccacttgacctggaagttttctgcttacacaaatcaagaaagaatgtagtaggcttcctatcaatttcacttctaggaacaccatgattaattagccaatgccagagctctacactaatcagactattctgaatgctgctttgcctctgctatccattatggtagctacgcccaccttgcctttgacagttgagtgcccccactcagcccctgccaccttgggatccaattattcccattgcatttaaattatccagttaagtgactgcagttcccactgtaagatctggcatacagggaagagcaatcacagagctcttcaaggatgcaggtgctcccctcacaaatctgttttgcaagctattaagggtatgtcttctggaccctaccagttgggatgagtaggtctaaggtgactaatccactctagcattccaatctccctaagcctttggatcccttcctctacattaaaccaagggagatcaggcatttccagcttactcacagtgggccatcttttgatccacgtttcagctaaccaagcaaataaactattagaacctttttaactccccgagctgcgatattaaacacagaatccctgcttagtgggcccatatcaataaattcaacctgatccaactttatgttccttccaccgttgtcctgcaaccttaatatccattcccatacctgttctccagatttctgcttatacaaattagagaactccagcaggccaggcgccatagctcatgcttgtaatcccagcactttgggaggctgaggggggcggatcacttgacgtcaggagttcaagaccagcctggccaatatggtgaaaccccgtctctactaaaaatacaaaaattagccgggcatggtggcatgcacctgtaaccccagctactccggaggctgaggcacgagaatcacttgaacccaggaggtggaggttgcagtgagtggagattgcaccactgcactctagcctgggtgacagagcaagactctgtctcaaaaaaaaagaaactcaagcagttcttttggagtgtagctcatctcgtgagtcacactctgaacctcacttctagagagctgccatgacttgagtctagttacaggtctagaaacaaacaggggtgttgggggtgggttcagaagagaatcagcattgtcttgcttcaggggagaccactgttgcctcaagcattgcagggttaatctcagacaaatgtggaaaggctggtggcagcctgggtgggggaagggatattgccaccactgggggtgaggaggctgttttctctggcaaaaaaggctgtcagagtttacaagctcagtgtccccagcttcatcagggtcctcccacacatccctattccaagtcgcagggtcccattcttttccaatcagtgccctcactttaacaatagatacctagggaggctacgcatgcacctttccttgcaggccagccacttgcgtggtaagaacttgtgtctgattttccgcaaattcagccctttgtctacaggagataagactcagggaaatcttagaagacttgaggctcagtatgtgctctggagctgggagttagaatccctgagctcatccttttctttcattactttctccagtgaacttaggagaaccaaccaacttcattatattccttggttctccacatatggtcaaatgtattacgtacagagtcactaaactccttgcctctcaagaacgacgaatcaggaatatcaaatgccatctattttgcataactctctaaacagttcacaccagggactatcagtgttctccatactatcagaagtagagtccttagcatttttgggtctaatcagattaagcagccaactccagaaaccccaaaaccaactaaagaaatctattcttaaaattctgttcctctagacccactcctggtaccaaaatctgtcagggttttctagagggacagaactaataggatagatgtgatctcacatgatcacaaggtgaagtcccacagcaggccatctgcaagctgaggagcaaggaagccagtagtggctcagtctgagtcccaaatcctcaaaagtagggaagctgacagtgcagcctttggtctgtggccaaaggcccgagagcccctgtaaaaccactgctgtaagtccaagggtccaaaagccaaagaacttggagtctgatgttccagggcaggaagcatccagcgcgggaggagatgaaggccggaagactcagcaagtcagcttcttccaccttcttctgcttgctttttctagccgagttggcagccgattagatggtgcccacccacattgaggatgggtcttcctctgccagtccacagactcaaatgttaatctcctctggcaacacccagaaacaatgctttgcatccttcattccaatcaggttgacaatattaaccatcacaaggaattggggtaaaactagctctgaaaccacctacagtaccccttaaatggtgtttctactgcctacattactgtctgccccatttctccctttttctatggggacaaacacacattcatccttcaaaacctacctcagccatcatcttctctctgaagccctacttgcccaccatatatgggctgcaagtatcacatatacttgaatatatattatataacctgacttctttggtcactggttatgatttaattgagaagctgagaaatcatcatgggtgggtcctggctaaggtagagattttcttgaaggctcaaatatcccatggaattctagctcctgaagaggctccaagaggttacttgacccgctcgctgaacttaccgcatcttgtcttttcctgaaaagctaagattcttcaaaggggattctatagccttctgcagttaactgccccagtgtttatgcattcttatgagtgagaaatgtttccttaaattaaatccctcatgtcagctgaagctcccattgtcttgttagtgcctggacggcaagagaaggtactgaacgaagagaacatgtcagtgccttcccttcggttgtcatttcccagacttttcaactcccttccttctgtggcccctcatttgggtcccctcattgctctgtagctttaaagaacaagtggcctggttgaggtgaatccctggacgaatataactagaaaaaggcgctccgatttgtacactttcaccttctgcctttatatcctaatgccttggcatctttacctgctgatactggtttcttttctttttctcttttcttttttttttttttttaaagacagagtctctgcctgtcgcccaggctggggtgtgatctcagctcactgcaacctctgcctcccaggctcacgcaattctcctgcctcagcctcctgagtagctcgggttacaggcatgcgccaccgcgcccagctaatttttgtaccttttttttttttgagatggagtctcactctgtcgcccaggctggagtgcagtggcgtgatctcagctcactgcaacctctgcctcctgggttcaagtgattctcatgcctcagcctcctgaatagctggaattacacttggctaatttttttgtatttttagtagagactgggttttgccatgttggccaggctggtcttgaactcctagcctcaagtgatctgcccacttcagcctcccaaagtgctggattacaggcatgagccattgcgcccagcctgatactggtttctgattcacgacttgcagcacaaaatctatcagctcagagttgaaagtcactcctgagagtccctttagttttctaggctagtttggtagactagggaggtagggctatgggaaaccaaagatgttttttcagagcaaagaagaagatactttgaaaattgctagcattagagaataagtaagacatcaaagttaaaggataatgaggttatgaggtgtagccaggacctctcatttattgtttgtggatatggaaatttgattccattgtggagagtatcagtatcatcttggaaaatcatatgtgcacaaatctggaaaaaaaacctaatcattcttgagtagaaaaacaagtaaatgaggacctattcataaaagggactaccactcaattgttagaatgagtaatctaaaattatttcaacatgagggatcagtctcacaattgtaatgttaaatctcaaaaacaaggtagagacctaaatagatggacctcataagacaaatacagcctggatgtggcagttcacacccgtaatcccagcactttgggaggttgaggagggaggatcggattgcttgaacccaggcattcaagaccagcccgggcaacatagcaagacccccatctctacaaaatatttaaaataaataaataagacagaaacagtataatttcctaaccatagtaggaaattatatatatatatatgattcttacatagtaaatctataaaggcacacactagaatgatacataccatcttcagcattgtggatgcttcatctgggaatgatgaaagaggaagaaaaattggtaaaatgctagcctctattaaatctgtgttccattccagttactcaggaggtctgaggcaggaggatcacttgagcccaggagttcaagaccagcctgggcaacatagcaagaccccatctcaaaacaaaaaacaacaacatcaaaagacaaatgtgtgtgttagttatgtgtgttaggcacataggtgtctattttattgtttacttttctatatgtttaaaatgttactttttttttttgagacaagaatcttggtctttcaccaaggctggagtgcagtggcacgatctcggcttactacaacctccacctaccaggttcaagcgattcttgtgcctctgcctcccaagtaactggaattacagatgtgcaccaccatgcccagctaattttttattttcagtagagacagggtttcaccatgttggccaggctggtctccaactcctggcctcaagtaatccacctgccttggcctcccaaagtcctgggattacaggcgtgagcccccatgcccagccaaaatgtcactttttgagagttcagactgaatagtaaggcacttattctgcaaagccctttgaacctaagggttccacaatgccaggtaaaaaaaataaagagaaagggtgtctcccatctcaataacataacttcttctattcctcttcttaggaatgttcctggcagatataattgagaaatactttgtttccccaaccctattccgagtcatccgattggcccgtattgggcgcatcttgcgtctgatcaaaggcgccaaagggattcgtaccctgctctttgccttaatgatgtccttgcctgccctgttcaacatcggccttctgctcttcctggtcatgttcatcttctccatttttgggatgtccaattttgcatatgtgaagcacgaggctggtatcgatgacatgttcaactttgagacatttggcaacagcatgatctgcctgtttcaaatcacaacctcagctggttgggatggcctgctgctgcccatcctaaaccgcccccctgactgcagcctagataaggaacacccagggagtggctttaagggagattgtgggaacccctcagtgggcatcttcttctttgtaagctacatcatcatctctttcctaattgtcgtgaacatgtacattgccatcatcctggagaacttcagtgtagccacagaggaaagtgcagaccctctgagtgaggatgactttgagaccttctatgagatctgggagaagttcgaccccgatgccacccagttcattgagtactgtaagctggcagactttgcagatgccttggagcatcctctccgagtgcccaagcccaataccattgagctcatcgctatggatctgccaatggtgagcggggatcgcatccactgcttggacatcctttttgccttcaccaagcgggtcctgggagatagcggggagttggacatcctgcggcagcagatggaagagcggttcgtggcatccaatccttccaaagtgtcttacgagccaatcacaaccacactgcgtcgcaagcaggaggaggtatctgcagtggtcctgcagcgtgcctaccggggacatttggcaaggcggggcttcatctgcaaaaagacaacttctaataagctggagaatggaggcacacaccgggagaaaaaagagagcaccccatctacagcctccctcccgtcctatgacagtgtaactaaacctgaaaaggagaaacagcagcgggcagaggaaggaagaagggaaagagccaaaagacaaaaagaggtcagagaatccaagtgttagaggagaacaaaaattcagtattatacagatctaaaactcgcaagtgaaagattgtttacaaacttcctgaatattatcaatgcagaacagctgtggagactctaacctgaagatctataccaaacgtcgtctgcttaccacgtaacacagctgcatcttgagcagtgacctgccaagggcaaaggaccccgctccctagacttacagattttctaatgcttgggcaggtggttactgcatgttccacatcagtcaatgcaacttaggacaaaactaaccagatacagaaacagaagagaggctgccgggaccagcatatttccgttgcagccaaatggattttattttttcattttattgattctcagaagcagaaagcatcactttaaaagttcgtttgttcatgcaaactatatttgcattcttacattagttaagctaagcagcaaaaagaaaacacacacacacactcacatttagcccatgtcatttaattgtcagtttctttgacataaagcgcatcttctccacatgggcttcacgtggtttggagatgggtgggggaaaacaatcaggtttcttcaggctgaggaggacttgctcaggccgattccaaacattgtgctcgttcaatgcgtagaaatgatttgcatgatggcatgccgtgatcagaagtcatgcatgagatccatacaccacaggacactactaatctagtcccttgcactgggtcagcctttggacaggacccagccctgcaccgttcactgtatttggagaaaatggtaagagttccataccggctacaattctttgagttcttaaaagtccttcatacaccttctgggtagggaaacaaccaactaattgactaacaccaccaacaacaaaaaacaaacccaatccaacaagcagatggatccgttgcgtgtatatgtttaacagacatctctaacatacagccattgttgcacattttgcaagatgaactatttaatgctgctctgtgtccagtacatgggggagactttgatcccaaatggcttgtactatttatgtcactgtaaaaccaaatcctagggctaaaaaaaaaattcatttgtatcttgcaatatttatgacgatcgtttagccttcatactggagaattgacacttatttggggtagagataaaagtgcttttcaaagtagcaccagttatctctaggggtaatttggggaacttaaaatgacctttcattgggagttatggggtgctcatttcatttcgtatcatgtcctctgcattgtggctttctccaggcatgggtcgataccgcgaggggttcagatattctgaactgacctctctcttctgcagaggggtcatcgcatactcacacactgcatggctccccctgcctccatcacatttctccactgagcagggcttcccttgcccacagaggtgggtgagggtagcagcattggggttacggctgtggtttctttcacttattattagaataatagtcactggtgagacctgaggtagagatggagccgcctctgaaccaagcccacttggtttctttactgcactggttttcatgagaaagcaatttaatattaattctttaggatgttccagcttccctcagtgcattcccttgcagccagttttgctatctgcttagcgacctgcccattgtcattgaagtgtggcttctgggggagcgtcatatcttccattccatctcctgctttaggaaagacagtttttagtccaggggtttctcacctaatgactggatttcaaagccaagatgctgcagttgaatgtgtcaggaagtctctatacaaagagtgaaaagagactttagcatgtgaaccaaatccaaataaattcttcctgaaccatacactagagggggaagaagaaccaacccataatcagacacaccgatctgccttgcagtagaagcactttgaaggtaatttcacagtccaccagactagttttgcatagaacaaaccacagtaagtcggcaagcagagctttctatcttgttggaccactagaaactgtccagctctcttaagcctgcttctgcagcagcatccgtagaatttttgtactacacccaataccagactgggaaggcctatctttcagtgaccctgctaactgctaggatgaatgtatagtaacatgtacaggctacattgtaaacagcacaaaacagaagctgacatgtgtggttattctttttaagagaattataaatactgtaatatataattttattttattggcatgcctttttgtaaatacaaattattaacttattaaataggaaatggcttctggcttatgccattgtcatgtttatttttattttttatacttttctttcttcttagaacttagatgctgtcagccaatgtacatccccaaaccagacagacagacaaaaaattttttattgctaatggtcttttccaaaacaacaaaaaatatatatttttgttccaatgtgcaataaattctaaccacgtctatgcaagatttggctaaacttaataattgttcttaggtcttgagatgggcaacagagctgtaagatcccgccaagtacaccatgtgctcatgctagtgatgtcattaagctactagggcatagtgatgagatttttctgagatctaaccgtttccctccgctagctcctgaccccagcccagcaggctgtctcctcagtaacacatgggccttggtatctggcacccatcagccagcctcataggaaagaagccacctccgctgtatttgaagtttcactttttaaaaaaaaaatgtttcccacctttttatccttcacccactgtccttccacctgctcactcactcactctctcacccatcctgctccacacttctttggtagtaaatgacaccatcaccagcagtttacacccgcagttaacaggcatcgaactgaaagaatcagtgatgacgtttttgtgcatcttcgctgagtgggtaagtggcaatgctttgccaaatattaacgaagccaatcaaagagcagcgcagccacagtatcactgcacatatatatatagatatataaatataatataaatatttattttttgtagccaggtccttggtgcagtatttatactccacaatccaccttttaaaaaaaggacaaaaagcaaaaagatgtgtgatgctgttaataatttaaaatgcagagccaaagccactgagcagcagctgacatggttgctggtttgtgtgtgaaaaacattttccccctcttctttccttaacctccttgttgcttaggatgaggagactctgtaatttaaagcagaggacgagaggaggaagaaacttccatgttaacatggcctactctcactcctttctaaacgagccacttttggcgtcagaagttgactggagagagataaacaaactcccagtcaaagcccctaaagcgacagtgcccagagttcttttattttttgctgcaaccaacgtaaacctgtaaaagaccaacagtgaagattagtgtattagtgaatgcatggaggccaatgctgccctaatgagacgtgataaaaagtccatcactcctctaagccaaaaggaaacaaaataaaaatgaccctttttactgtacaagggaagcctgtcttggtgtgtttgttgcttgactatcccaattcttgagtcctgggaggggtctgggaattgggaccttagcacatttggggaaaggaggggaatagagggaagagaaatcaaaggggctctcgcaaagttctggctaagaaggagagattggaagaaaagcaaggtcctgaccccccccagatccccactcacccattgcatgtggcattccccactactggccggtgcttagaggcccataaaacctctcttcacctaatccacctggcagagccctcagagatgacgtcagccaacccagctggactggccttacttctgcctttttcacctgtatgttaaaaaacaaaaacaaaaaaaccctatccctgtgccccaaagctagggcatgtgcgatgcccaacagcctccactctgcaagctcatactgggccctgccctccatcgccccagacaggcccacagacgagggctggtctccttcacatttgtgtgggggtgggggcacgcttcctcttccttctctccctgtccccctttggggacatccctctctaggcctaggccatgtctcctggttcaggaacactctctcaggaggatctcgaagtgcccactctagtccgctccagtagctccactctggagcgagatggctggtaggtcagtccccatcctcctcccctcggcccccagcctccaggcctgctgtggaggtgagatcgccatgggtcatgactttgtgacttgagtcctgggcatcttctgtaatgatgcctctttcttttctcagatgttgcccacagtttagcaaaaagcttcgttcattttcaggtactccccaccccctaaagaattggctgcaacttgccagccagggggacatcaggagagaagaggaagtctgggttgggaggggcccaagttttgcaacagagtttccattgttcagctctgtgctttcttggattccctttccaagattaccaagatttcctccattaaaactcctgaggcaccccctgcccctgccccccactgctgtttgctgtacatagaggctaagtggggtggggtgggtgggtgtgcacatgtggtgtgtgtgtgtgtgtgtgaagaatgtatataggtaaaggggagtgtggtccagtggttccagaaaagggacagaactgtgttctgtccctagcttgaccgctggctcgctgtgtggccttgggcaagtcacttaacctctctgtgcctcagtttccccatctgtaaaatggggataataatactgacctacctcacaggggtgttgtgaggctttaactaaatgttttgtaaagcgttttgagatacagaggcaaaggcgctagggaagggcaaagtattattggacttaaggaagctgaaatggtaccataaatgctgctattctgagagccattttaaactgcactgctccaaccacccccgcttctcatcaccaggacagcaggtcgagaaaatgtctttcctttcacttgcttctggggtttgtgattattcaagacaattttttccccttgctgtatctccttccctcacctcctcgacttgttccctgttctgtttatgcggaaatggcagaaatgcttgagaaatgagaatgtgtaagtggattggaagtttatagtatgaaatttcaattttactttgtactgtacatctttttactttagaatttgcaataaagggttacgtcaatcttgttttcaactctc

SEQ ID NO: 41 - DNA, 180817 bp, Homo sapiens
  source 1..180817: mol_type = genomic DNA
tgccctcggggaggcggggctgctacctccacgggcgcgccctggcaggaggggcgcagtctgcttgcaggcggtcgccagcgctccagcggcggctgtcggctttccaattccgccagctcggctgaggctgggctagcctgggtgccagtggctgctagcggcaggcgtcccctgagcaacaggagcccagagaaaaagaagcagccctgagagagcgccggggaaggagaggcccgcgccctctcctggagccagattctgcaggtgcactgggtggggatgatcggcgggctaggttgcaagtaagtgccttttcttttgctgcttctgtggggaggggaggagaagccctcggtctttcgcccgtgctcgcctcaaccgccacacccacctgtgtctattttcacatctcggttctggaaccctgtattacgccacctggaaagaagagaggggagaagcttgaccgggtggttccagcaatgggaggaagaagggctggaagcgtagttatttcgatagctgggcagctcctgtgcggttttgactctgtgggtttgctgccaggttctgaaactgtggaaaggaagggtagcaatgcctggtggtttactgtcttttatttctgtttacgctagcagagttgttagatggacttcaattcaaggggcagctcacattttttacgagcaaaaagcatgtgctgtatttcccatctgcaaagctgagcgtgcagaaccagcttagcagatacaacctgtggggacagaaaagaaccccgcaccccttaagagcacacaaacacaaataattgacaggacagctctgcccctatttctcagcgcagattatttatttattttttcgaataagcactttatagtgaaattcagaaaagatgcagaatccttttaactttttatcgaattcaacttgggaaactcatttacttttaggaaaaaatggatattttcgtgccttatattcaagacaaaaatcagaacaagaaactagaaacattaatgccagtttttgtgattatagtaaacatttcactcattattttagttttttttttttaagttggagcgttcatagattatatctactctgatgttaagagcaatttacatgagaaacttaggggggtttttaagaagctagtgtcagtaagataaaagccaaatcaaagtaagctttcaaggaagtgatagcttgtcagttactgaataggaagtcagtgttgggaagttcagttcttttcagaaacatatttattattcttttctatttcttcttccctgtagacaagataaagattttctttctctttctttccttgttatttaaatatattttataatttttgctttaacatcaatataaacctattttatataaactgcaaaccaaatccaattattaaactgttcattttattgcaaattcttcagattttttccactatttaaaaaagtttataattttttcttataattatggtgagattttttaaaaattattgattagtttgaaagctagtcttatctgatccctgtgtcgcaaattttcatgattgttagactagcttatcaacaacaaaactctagacagaatatggtatttgatgtaaagaagaatgtgccctctatttaggcaactgatagtttggcttaagacaagttttttaaaattttgtagaggtttaaaaggaggtttccttaagtaagccactgtgcagttgtgggactcagtgatgtgtttttacagtgactggatatatgatatgccttgattcctatggtgcagggctaggctcacagagtacctgatgcttctacagaagaaagatgagtcaggtctggctctctgccaaaagcatcttgggcctcctttcccctagggcctgcatataatcatgggagcccttctgtggtaatgcttctatgtttttactacctgttgctgtgctgagtttcagaagcaaaatagataaacaaataaataaattcagaagagcaatcagtagggttctatttatttaatataatcaacccactttctctgtggcaaggaaaaaagtagaatttttcattttacatgaataataaaatctattttttatccaatttctattcctattagttatgcaaaagagtgtgaagtgctagaaggatttatatggtacttttctaagacaagtcatgatcttgtaaaagagcttaaagtttattgatgtaaatggaacattctagatgtcataatgataataatttatgactttccctaaaactctgtctcagattctttcctcccatcttcattatctgaataaatgccttcaccatccaagtattgaaatcacctttgattgctctcttccttattactccatttcagccctttccagcctgtaagtagatctatcaatcttatctcccaaacttatttctatttcatcatacgtctcagatgcctctcattcaccctcttttctgtatctacacggccaccaaattagttcaggtcatcatcataatttacttggaatcctgccacagcctccatatcaatctctccacttctgtaattttctcccctgcaattcattctctatacaaagcaataccatcctgtctcccctaacaaacattggctcacaactgcatttaaaaaaaaaaaaaaagaggaagaagaagaggagaagaagaaataaacatggcaacacagagaccaattagcaacaacagtaaatgcctttcctcagcatatggtttactctctgttctgtcccttctctccaacctcaccagaacctattctcttctcattaaggtgctcctgcccaggtcgtggctaaaacacatgaaacaatagcactctttaaggccttttcaaatgctgttcccaatgcctgaactctatgcgtgcttactccttcttaaactttaaatctcaactcgaggtttttttgttttggaaagatcatttttgatcatcttgttaaaagtaggttgtcccgtgttggtcttgatgttggaaccttgtttctttcatactgcttgttacagcatgcaggtattttgtgaatttgcataccaaatactccaagggaacccagactatgtcttcattgttgacttagcttccagaatagtgcctggcatcaagtagtagggggttcgtagatatttatataaataataaaatacaaaaatatggattcttccagaataaagcatattaaccctggaaacatgaattttgtgattctattttttatttgtcaagcatttagtatttttacaatatcatggtatgatattgaggaggtaaaattaaaatatcctgagatgtattctctcttttatcagtgtaggtgataatgtacttaaaggtaagtaatttgtaatgcattcttagaaaggcagtgaccacaaatgtattaaaatatattttaagaaaaaattggattgcataaactaatatggttataagtgactccaaatctaaaatgataaccttgttaggtttaaatctgtatcatctaacagaaatttgagggccagtcaatagtcactgactatgaatttaaaatattcttttaaaataaacatagatgcttatgtgagctcagttgatagaaatgtagtcagatgaggcggaggccataagttaggtttccacacggtctaaattgatgtttgccccaggtacaaagggcacattatccaaatatttgaagcattctctaaggaaggttcagagaggcaatgtgggcttatccatgaagacccatcactgttattagagtggaagtaaggactgcaaacttcatgctcataaatgattgtgtcattttcatactagaattttaccacacacacactcacactcacacacacacacacacacactttgtatggtgatttgcctcccccctttatttttgcagactatgcttaaagatattaaacaaacaactagttttgctattaacatttggttgaaaatttagctttcaattaggtgacaaactgattaatgatttttttatgtagcaaatggccagccacagatttttggtaaataatttggttaccacattacatcttgaaggactaaattatttcactaattgtgagcagggatttttaaaaatttgctctgaagaggacatattgtggatgttgtattggagggcatctgtgtactaattgaagatggtccttcatattacacatcacaaattagctaatttattctttacagaagtattatgacatcttcctttagaactgtgtagagttagattaccacttgagaggcaaggtcatattaaaatagatattataaaattgtataaaaatattttatatgaggatttatgagagcatccagagaatgtgggtagaatacttttgtggaatatgagataacaattttggtgtcctgccattctaaaaaatgaaatttcttcattgaaggtatcacttaccctttcctctgccttgctggaaggaaatggctttaggcaaaagaaaaagccatcagctcttggcagctaaaggtggaatgaagtttggaggaatgaaacccttctgggtggtgaggaaaaatgccaggccatgataaagtggggaaggaagaggggaatgccttgaacagtgccagtaagcataatctgccacagacaagtttgaattgacatatgtagaactgaattattctatatctttttagttctatagagaaaaccgttctttccacgtctctttttaaaataacaacttactgtaagcaaaaaatatgttgttgttgtttctttaacacaggagatgaactatctttagattttttaaagtgatataacatggagccaaaaatgccatatattactgttgaaacctaacgttactttaactgtaatttccttgctattcattttatgatttcctcttgttatgtcaagtgttagagagactgctattactgatcataaatttctttaaaatgtctccttggattttttacaaagctttctgaatcatttatcaaaatacaataaagctctaattgcacctaggattgttcacttggaaatttagaaagagtgtgtacatttacaattaagttagcatcctgccctgcaatgaatgccctttttctttttttttttccttcttctctcctacatctcatcttccaaatgtttgatatgtacgccagtaaggcaaattttactccacttttaggtcaaactattagtacaaataattggaaaattgagcctctaaagaaagataaataagattagaagcatgcattaaaatataagtattaaaaacattcccataagatttttaataaaaattttatgtgctatatgcacacctagactccctgtattatctgatttttaaagattcttttttttttttattttttatttttttgagacggagtctcgctctgtcgcccaggctggagtgcagtggcgcgatcttggctcactgcaagctccgcgtcctgggttcacaccattctcctgcctcagcctccgagtagctgggactacaggcgcctaccaccgtgcccggctaatgtttttgtatttttagtagagacggagtttcaccatgttagccaggatggtctcaatctcctgacctagtgatccgcccgcctcgacctcccaaagtgctgggattacaagcatgagccaccgcgctcagcccattatctaatgatgatgatgatgattattattattattattattattattattattattattattattttaactgggggtaatttcactggatgtggtatctgtcaacttttactagttgctcctacactatatgtttttaaatccaatgtaattattttaaaaatatgtcatcttcttgagagtctatactttagaatttgaaaaaagaagtaaatgtagatattcaaatccatgcagatgagtaaaacagggaaaaatgagaaaaatgtttcatgataataaaatattatgtcaggcacagctggtcacccctgcaatcccatcactttgggaggccgaggctggaggattgcttgatccaggagttctagatcagcctgggcaataaaaggaaaatctgtttctacaaaaaaattaaaatttatatttcatatattgatttaagctctactaaatgactattctttcaagtctaatagacagtgtatcttttagggctcagagtaaagataatttattgaggacattttgaataggatgaattaaatgctttattggtaagtgatgcctttatctgagtgattccttctaggtaaatattatgggaccaatctttgtaaatgatctttgcatggaacaaaatattataaagttgaagtgatgaatttgtttccctcttaacaaaatatgtattcttgttaccccatttacaaacttggctcatggtaattcaggtaggaaaaagggaagtggcctactcagggatcaactgggaataaggttcttataatcccatgagatcagctgacagacttttaggaatgaacacttgtagaacagctaggcagagaagtgcctttcaaaatttatattacatctctactatatttcagactgtaaaatatttttataaagtgttaaaagcacagataaataaatttgagttcaaattagtatagtgaaaggaagtttatttttcccaaatatttcctttactcagtatgtggtcttagtcaaatattaatttcttaaatattgctttcctgtaaattagtagtatttacttctaaggactatattatatgttatatatagagtatattatatattaggagatatatatgtatatacatcgtaatttgttttttccaaaacagccactttagtgtcttacacatgataagtagatatgagtagatgttcaataatggtatctaggcatttaataacttagaatattataatcaaaatgcattcttttttttttttttgagaccgagtttcactcttgttgcccaggctggagtgcaatggtacgatcttggctcactgcaacttccgcctcccaggttcaagcaattctcctgcctcagcctcccgagtagccgggattacaggcatgagccacctcgcctggctaattttgtatttttagtagagataggatttcaccaggttgggcaggctggtcttgaactcctgagttcaggtgatctgcccgcctaggccccccaaagtgctgggattataggcgtgagccaccatgcccagcctctttttttttttttttttaattaagtttcaaggtacatttgcaggatgtgcaggttttttacataggtaaaggtgtgccggtttcactctgttgcccaggctggagtgcagtggtacgatgttggctcgctgcaacctctgcctcccagattcaagtgattctcctgcctcagcctcccaagtagctgggattacaggcatgtaccaccatgcccggctaattttgcagttttagtagagatggggtttcaccatgttggccagactagtctcgaattcctgacctcaggtgatctgcccacctcggccttctaaagtgttgggattacaggtgtaagccactgtgcaaggccagcaattatgctgttacaaggaaaaatacatacggaaaagtttacatcttgctaacattactgataatattaatgtaacagtcttatgtatggacgtctccttaatgctaactgagcagtttgttaagggattttcatatgctccgtttaaatcctcatgaccaccatttgaggtgagaacactaaggctcagaaattacctaacctttccaaagactcacaatggttactaaacttgaataacatacacatttcttttataggaaagaaatcttatatattccaagaatacgtttgcacataccccacacagatatacctggtggttacgctaccaagcattctatcaaatatgtttaacccttaatggagctaaaataaaattacatttgcaatcaaacatactaaatcatgtaattacagctaatagaaaacaacaaaaaaagaaagatggatgactgtttcaattttcttcttggacaccaattcctgaggggtatattgtgttaagtcaaaatagagattttggtggaagtttgaagacattatgaaaagagtacctatgcatttaaagtgtttttgaagttgttttataggttgaatgacttcactttcctggtctaggagtattattgcactactgtgacttgactttgctatgattcgcatattttgttttaacattaaaaaactgaaatgggaaaaaggccttccccaaggtagaaaagatttgaaaaaagaggaatggtgtaattaaaagggaaatatgtataaaatgtctagggtgggccaggcgcggtggcttacgcccgtaatccagcactttggaaggctgaggcaggctgatcacttgaggtcaggagttggagaccagcctggtcaacatagtgaaaccccatctctactaaaaaaaatacaaaaactatccaggcatggtggccagcacctgtagtcccagcttctcgggaggctgaggcaggagaattgcctgaacctgggagatggaggttgcagtgagctgagatcgagccactgcactcctgcctgggcaacagagcgagactcagtctcaagaaaaaaaattaaaaaaatgtctaggatgaagtttattctgaaatggagaagaaacagggaatgaagttacacacgttgagatcctggagctagcagatggagaagtatgaaaagcaaagtgatcttgtgcaggataagatgatggtgttcattggaagtatttatatatcttggaaaataaaaatttagatattctatattggaggagtacaaatatttagagcatcacaaattgatacacacaaatgaaacctaaatcacagtacttattgtcatgaagactcaattatctaagtcagttaaattgtctaacatcagtaatgcaagaagttgacttttaagggttttaaaacagttttggaaaactaatttattttacattatgtttataataatttttgcatgcaatttttttaaatatctattatccacttagatactgtactttgggatataaaaaccatgggaaatttggcccttgagttctatgatacgtctcaatctattttagtgatttgtggattggtagcttatcctctagactaagtggttaaggttttatcagcactgcaatgagataatcatctcacacctgttaagatggctgttataaaaaagtgaaaggtgttgttgagaatgtgaagaaaatgaaagcattgtccactgttggtgggaatgtataatagtgtagctgctatggaaaataatatggaagttcctcaaaaaattaaaaatagaactaccatatgatccagcaattgaaatcagaatctcaaagagatatatgcacttctgtgtttactgcagcattattcacaatagcaaaaatatgaaaacaacccaaatgatcatcaacagataaaagagtaaagaaaatgtggtctgtatataaaatagaatattatctagccttaaaaaaagaaggaaatcttactatttgtgacagcatgcatggacctagaagagacatgctaagtgaaataagtaaagggacacgaaaacttttgacagtgacagatatgcttaacaggtagactggcagataagaaaaaacaaagttaaagctgaaatttccaactgatttatcttagcctagggattaatcattagatccggtctagttggcctccaaaatgtgtaggtcaggagttggcatccaagttggtattggtgccattgaggtttgtagggagggaagacctggcagagatcccaagggcagtggtaagcggctgctgagtccctccaggccagttccaagaactcacaacctcactcctctcagcatttatactcttcctggaatttaaaagcaattccttctttccttccctctttcttttttccctctcttccttcttcataaagttttattgtagacatcagatatagcaatgaacaacacatggagatgtgacgccgattttaagagataatgaagagataaatattcgccactatccatcattgtaccataagatatgctgtgaaaaacaataaaacaggacagagaattgagagaaggaggtattatttaaagtggtctgaaaaattttatacagggtatttgagtagagacatgaagtaaatgaaaaactaagggagctagctaaacaactgaagaatcattctagtcacaaaaaacagcaattgcaaaagccctaaggcatatttgatgtatttaaggagaagcaagaaaaccagcatggttgaaatacagacagcaagattgaaagcagaagatgagggtttttcttgattttgtagggattactaacctgcgtcgagggctgcgtgataaaccaatgctaaaattaccagcatgggtacaactttggaaagggatgagtgtgctcttttttaactggatctctttctggacatgggtaacataaaaccagaaaaaaatgtttgagaagtttctaatttctatacaaaaataatgtttttgtctttttttgtgatttagatgtaaatgtatatgtacatgcatgtatatgtatttatgtactgatttactatttatgtatatgtaaatgtatttatatttaaatgtcctatattctcttcctgtctgtaatggattggattcttggaacctcttactatttggggcagggggcagggctaataagacaaagattacaattgagagtaactttaaatgtttgcattttggaaacttaatggtgggagtacagtaatattttgtatatttcgatcaattttgatgtttattatatgattatttctcatgaaatagtggtactgcatagatataaatgactactgcctagcaaaacagataccaaggagacaccgcatgttgtcagggttgaccggttgctaactgctgtgattttgttctcttactgactctttctgccttacggatctcaaaacacgctagtgaatttaaaaatttatattttggtaaaatatatataacaaaatttaccattttaaccatttcaaatgtacagtttagaggtattaagcacattcatgttgtacacgatcaccaccatccatcttcagaacattttcatcattccaaacaaaaactcggtaactattaaacaatgactccacactcctctcttcccctatcacccagtaaccactattctactttctctatgaatgtgactattctaggtacctcatgtaagtggaaccctatagcatttgtcttttcatgtctggcttatttcacttagcataatgttttcaaggtgttcatccgggtcgtagcatatatcagaattttattcatttttaaggctgtgtagtattttattgtgcatttatacacattttgtttatctgttcatctgttgatagacatttgggttgttttcactttttggctactgtgattagtgctgctatgaacattggtgtacagataactacatgcgtcccttctattaattgtttaggatgtataccctaaagtagaattgctggatcatgtgatatttctgtttaattttttgaggaaccaccacagtgttttccacagcagctgcactattttatattcctatcagcaatgcacaagggttacaatttctccacacccttgtcaatgtttcttttccttttttttttttaaacaataaccatccgaccaagtgtgaagtgatattttattgtggttttgatttgcatttcccaaatgatcggtgatgttgagcatcttcccatgtactgattgactttctttggaaaaatgtcttttcaaatcctttgttcatttttaatctgcttgtttattttttgttgaggagtaggaattttttacatattgccaatgttaatcccttatcagatatatgatttgcaattattttctcccatcatatggattgccttttcactttctagtagtgttctttgatgcacaacagtttcaattttgacaaaatccaattcagctctttttttcttttgttgaccgtgcttttggttccatgtccatgtgccaaatctaatgtctcgaagatttttccctatgatattttcttagaaatttacagttctaactctgacgtttaggtctgtgattcattggtgattttttaaaaattcctatataattcgtagactctaagagagtttccagctttcccatacccattgtccccagagatctggtttttagtctgaatgtgccttactctgaacatgtgccttccatttcaagaactcccatttcattttgttttgttctgttttttcttttataccagtattaaaacttttgagttgttgtataaatatactagcaatttaggagaattcctgatgggaaagaatatccttgcctagctagttaatgaatttagggacccttcattttctaatcctagatatgattaaatcaaacaaggattcattgtgctgtagttgtaatccacacagaccattttacaaggctttgcacagagaaggtgcttaatacttgagtaaacaaattgaattaatgagtaagaaagaaaagctatcttgttttctcaacggtcaagtagatcaatgatttctactatttagaatcttagatttattttaataaagcaagttcaaaaatctcctctctctgttaatttttagtaaagtcacttatttttcactcagttttgttaaagtgttttcagaagagtttgttaccgaaaactgaagttttaaggttagtgtttataccacagatatttcttgtttttagacaatccttgtggaggttaagtcccctaggcaataccttttcccactggggagttacaagcaaatgaaaaatggtgactatttatggaaactccaggtcactaagtaaattttgcattttcatgaaaatatgacatatggacatttaaaaaaatgaacaggtcaattcatcagttagaataataaaaagaagtctgtaaataaaagttaagcacctttgtcattgaattgttgtgaaccgtttttgcctatgcacttgctttatctcagaatccaagcctcctggtcaaagttatattcctaataaatttaaaaataataatttaataattttaattccttctggaatataaatttgatcaggagtcttggattctgagataaagcaaatgtttaggcaaaacacttccttctggaatataaatttgaggaaggataggaattattttcttcctattcatttgtgatcctgtgattgttatctaatttggaatattcttcatgactccaatcctatttatatctgtgaggttctgaaaattctgccccaaaatggcagaaagtaagaaatactatcacacatttaattcacccttaaaaaaatagccataccctttatctttgaatatatttttaacaacaacaacagaaagagaatgcattttaaacaatatcacatgagtttcatcatattcccagattatggtgagggttcctagataccttgccataatcacagcctttagttccaagagagagcagagaaataagaaacacaggaagtcatatctatgaacatgttagtttgcaaaaggtttgttagtaaactcatgttatttataccatagtactttaccatctccagatgaatttccactaaataaactgttcctttagactcctcaaaccagattacccccttcctttgctaatatagattctcaaacaatgtcttcatcaaaaatcttatgagtagatgtcactagttttgacaatgtccacaaatgttccaaagaatactttggcatgcatgcttcttaactcacttattttgatattgaattaaagggcttttaacaattcctgccccatcaggaatatttcatcagcagctgttactgtgcttggattttgccttcttgaatgaatacctagtcttttctcactttagcattaagttctggagcatccgctgctaatgaaaaatcctctgactcatgctagagcattttcatttttttaaaaaaacaatgttccttgtatcttgctggctattgcctaagctcattattttaaacttttgcataattctgctcagtcctagagggtcatcattactgtcaatgattaaacttttatgcacttgccacatttattattttcttactttcgatcattttattatttttctttggttcccatgatattccaatgtttttgttattaaatctttcaacatcctcggtgtgttcagtgtatccacatttatcaaacctgatggatttaagaatttatataaccttgaaagcaaggcccacatcctgtagacactgaataaactaatgaactttgtattggcaggactaaaatggctgtgtgtggcatatattgccacctgttggtagaaggcaatgtagtcttggttttgctataagcatacattttagtctttaaaatattctgagttgaaagctccctaagaagaaaaggttttgtatatgcaatacaaaagcttttctattataaagtaagcaaatatattctcgttcctaagaacattagctttaggtatacaaaatcaacttagaagaaagttgctaaaatcactaataataacagttacaatgtattgtgcactgaaagtgtaacaggaaatgtgctaagttattaaaattcagtgtctaattttttccactaaaataaccttaaaggattatcattttcagctccggtttgctatataagaactgagctttagagaagttaattaaattccccaaggacataagctagtaagcagtagagatgggatgtgaacccatgcctctctcactctggagccatgaatttaacaactgggttatgctgtcttactattttactgcagatctatattttaaattaaagccataaacatgtttggcaagataaaacataggtaacaaatatactccacataagattttcgtaaggttttgtgtttattggccaactcatggcttattatttaaaaatttcagtctgtatagggaagaaggataataatcttgctgttatttatttagcctaggcactgtggtaggcactttaccaaaaccatttctattctacatgataactttataagacagatatatttctctctttcatttatggggaatttgcataatgctgcagagctaattatatggaataaacaggaaattcaaacctaagtctgcctggtgccaaagttattactatgcactttctcctaaatcatgttgatgttttgagggaagtggatacatgtataataatattggaaatacattttctctctaattatttaaataagggtatagaacctgttctgcagccataagtctgtgataattttgtgctctcaataaagtcttaactaacagagagatgggatttaacgtgaactaagaagtattttctgtcttcctttatacatgctgtacagataagactttatgaattttttattaaaacgttcagatatgccagcaaatgttgacactaatcttaagttttcccagggtaatacacttcttaagattataaactttaatttctttttttttttttcttttttttttttttttgagacagagtttcgctcttgttgcccaggctggagtgcaatggcccgatctcagctcactacaatccacctcccgggttcaagcagttctcctgcctcagcctcctgagtagctgggattacaggcatgcgccaccatgaccagctaattttgtatttttagtagagacggggtttctccatgttggtcaggctggtcttgaattcctgacctcaggtgatccgcctgcctcggcttcccaaagtgctgggattataggcgtgagccaccacgcccggcaaactttcatttcttataaacttgaggaatactatattttaaaaggctatacataagactaacttctatcttaataataaaataataaatataatataaatgattattacagggtattatgaaatacccaaatcacaatattttaataatcatagaatttagaaatagtccctatcagttgtctgaatataaaattatcgcatatacagcttaatttgttttgcataccagttgttcaactactataaaatgccataaaattgaatgattttaggacatgaaatattgaactactcttgttgaagttattaaactgatttgccatctaccaaattaagcatttctaagaaataataattattttaagaatttatttacatgattaacataatgttacttatgaaggatgcaatggtaagatttcagcaatcaggcaagtatttaatgaaaagtatttggtttcatatatattgtatttgatttcatatatattgatacacttaacattagaggttctaaaatgagtagccagcctgcctgtttttcttgtgatattatacttggcatactttgtttttataatctaaagaagaggtattaaaaaaagagtcagagtgcttaccattggcagttccttttaaccttttaatttataaagacattgcaatcccaatgaaaataaaaatagaaattttcccatttggaattagataatctggatctagttgggaaattgtacacacataaaagagtaatatctaatagcaccaaccctaatacataatgttattttatgcaaatagggtaattaaaatagtatggtgacctacatagatagttcattggaagaaaatacgatatccagaaatagacatagttacatatgagaattataaaggtagcatcttaaataggttgaaagaaatattatttaatagttatcattgggacacctgggtagtcatgtggataaaaataaattcagattactgctttgccacctaacccaagatacattttagtggaatcaaatatttaaaataacatacaaaccacaaaactgctagaagaaaacatgtgaaggttttgttttcttttttcttttcacctgagatggataatatatcaatgtcattacaaggtttgagggaggaatatctcacatatgcatgtgaaaacccagtcatcacacttatgaagtacttgaagtagaaattattttctaagataatataaaacacaggagccactggagaaaggattggtgaattcaatttaattaaaatgtagatgcttttaaaagataaactaccataaaccaaaagaaacaaaaacagcaaacttacaaaaatatttgtattgtataccacagaaaaaaagctaattttattattttgttaagagttcctaaattaataaaacactgatagtctattaaaaaagtggacaagactacatacagacagagcacagaaaaaaaagcacaaatggcatctgaggatatgaaaagatccctgacctcactcacaaaagaaaatgcaaactaaaatgataagaattaagaagttttcggccgggtgtggtggctcatgtttgtgatcccagcactttgggaagctgagatgggtggatcacatgaggtcaggagttggagaccagcctggccaacatggtgaaaacctgtctctactaaaggtacaaaaattagccgggtgtggtggtgggtacctctaatccgagctactcaggaggctgaggcaggagaactgcttgaacccaggaggcagatgttgcagtgagctgagatcgcaccaaggcactccagcctgggcaatgagagagcgactccatctcaaaataaataaataaataaataaataaataaataaataaataaataaataaaagttttattccccacttattaggctcacaaagatgaaaaaaaatttatgaaatactttattgaaggtatgtgcaaacaatccctgacacattgtttggggagagcatggattgataggcctttatgaaggagttaccaatataccaataacctccttggtagtttcaaaaggtggcatctttccctgtttggtattggagacccaatacaagaaatgggaaagtgagcatcaagcaatgcaagctttattcgatggccaaagaatggagaagtgcaagtatggcgcacaagctaacttcttgactagtgaggagtgaggaaattgaaatagaaagtatatctaatgaagaagttggtcattaagagtgaggggaggaatgttcatgtcttttccagaaataggtggtgaacttcttggaaccagagtgccgccttcctttttgtccttttatggcttcttctggtcattgtcatggggattatcaactgtcatggcactggtgggggtgtcatttagcatgaaaatgagattataatgatgcctgaggtcttcttgaagtcctttagtcaactatcttggttctaagcaatctcagctgctctggttacaaatggaacattttacctgtttcttaaagatcagcagagttagggtaggatagaaattcagctatggccctgtaggcgttacactaggtaacaaaagagaattcggcaatattttattatggcaaattaaaaacgcacatacaattatgactcagcaatttcactctgaagcatttgtcttacaaataaaataccgtactgtgaaactattcaagagaatgtcctcacttataagtgagagctaaatgatgagaacacatggacacataggtgggaacaacacacactggggcccattggagggtggagggtggcaggagggaggggatcaggaaaaataactaataagtacttggcttaagaccttggtgatgaaataagatgtagaacaaaaccctgtaacacaagtttccctgtgtaacaaacctgtgcatgtacccctgaacttaaaataaaagttacaaaaagagcccacaaaagagtaggttaaaaaaagaaaaaaactaatgagaagataattattgtagctttgggaaacaacctaaatgttctacagtgtgggaatgactaaataatttgggtacagctgtacaataggactttatgaagctgctataaaaagaagtagctttatacatgctgatacagaaagatttccaagtctgatttttaagtgacgaaggaaggtatgaaacaatgtttatatagggtattatttgcatgaaaagaaaaatgaatagatgtatacatgctgataaaaccacatggatggatacacaaggggttggtactgtggttgtccacaggggaggaatttggatggctgggaaacattgaagagtgagagaattatttttcgttatacatacttttgagttttgtggctaaatttattcttcaaaaataaatataagaatgctatttatggggaaaaaatgggagtcataaacctgcaatttggacctaacttttcaacttaaaaatgttctgttcttggagttactaactgctctgatgcttaggatgataatcaaataatagttcctctaaaatatgtctggaatgaacttgaatgaatgaatgaatgaatgttttttgcaaaccattatgtgtgtaaaaatgtagagtattaatataaggtttatttagaatagagtcatctgcattaaagaaacttcgttatacaaaaatctaaataaaaaaatgttgtacagtagctctgaggaggtggatgacccaaacactgagaaaagaaaagaggcagaggctgagcaggatagttcagtttgaggtaaagaagcagcctcacccagcctcagacaagactccagggactgtgtgaaaaacctcattttggccaggcgcagtggctcacgcctgtaatcccagcattttgggaggccaaggcgggcagatcacaaggtcaagagatcaagaccatcctggccaacatggtgaaaccctgtcgctactaaaaatacaaaaattagctgggcgtggtggcaggcacctatagtcccagctactcaggaggctgaggcaggagaatcacttgaatccaggaggcagaggttatagtgagctgagatcatgccactgcactccagactgagaatctgtcaaaaaaaaaaaaaaatctcatttctaggcctatgtttcccagaaatatgtcatgaaaataaaactgccctcccaatgggaaaacatatatatgcacaaaaaggtaaatatttttaatgttaaagttactgcataattcctttaaagagtaattatatatttctattcatttttgaaaaccagttttagtaaagacaaagttaaaagatgacaaactggcaaaagaaaaaaaaaagaaatttttgtgaaaaggtatcaatatccttagcgtgtgcacacacacccacacacacacacaatcccttggcaaacaagaaaataatgaatatttcaatagaaaaaagatcaagagactaaagacactgaccaaagaagaactagaaatgtttcacgaaattcacattttagataaaaacgttttaaatatcaaattatgaagtttttttttaaatgactatacttaacattgtgggaaaatatatgcttacatgttgctaaaaatgatatacatttttatagcctttctggaaacattttgtcagtatgtatatatatataaaagaagacaggttgggtgtggtggctcatgcctgttatcccagtgctgccaagaggcagaggttgcagtgatggagtgagccgagatcatatcactgcactccagcctgggtgacagagagagactccattaaaaaaaaaaattagccagacatagtggtgcacacctgtagtcctagctacttgggaggctgaggtgggaagaacacttgagcccatgaggtttggaggttgcagtcagctatgattgcaccacagcctgggtaacagtaggagacattgtctctttaaaaaaaaaaatcagtaattttcttggaataggttaatttcatttatttttttctatgcttttcagttttctaaattttctcccaatgaaaatttgctatatttatattcaaccatattaataaccccaaattagtcacatgtgcaactttctgcaaataaatgtgtcttggatttaatggaaatgaaatcttttcagtatagcttctccctgttatttgcgtacaagcttcaaactgcataaactattttaatggcaaaaattaagttagggttaatcaaccatctaggattgtatctgtgcctaggtttctaaaacaattaaatacttgatcgctttgttggatgttcaaagatttggcaatttgtccttaaatatatgtttcaaataaaatatctacaattttaaggtgcttaagtactggtgaacatgtcaaaatgtgcctaatgtatttttaagttctgctgtgaacttaaaaactttgggatttgtgtaatcccaaattagagaattttaaactttagttggtgtccaccatattgtcccccttttcatccatctgaccaaacttttaaccttcctgtttatggctggggaaaaaaaaagctactttaattaaacctaagcagatagtgttgtttttaaattgtatttcgatgtcactaaaatggggaaacaggttgtaatagcagaatccttatattttttgcacatatcagcctccataaaaggatggaaattgctttgtttttcaatgttttaatttttttaatgaggagaaaaagagcaattgagagtgccataaattaaagatagcgtttctgatgtaaaatcaatgatagttatggattattgtaaatgtttgaagatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctgatgaagggttgaatttatatttgagggaaggaaggaggcgaagtcagatcttttcatacaagaggtattgagccaaatattacaaagcaagtaatcaggtgatcaggatagttgaaactgttcagataaagggaacattatgaggatgcagaaattatctagctgacctttggggaaattaaacgtagaataatgtagctggaatgtagactgcaaatagggaaacagaagaggctgtcagcatcaggttagtaaaaccttctatgacagaccaaagacatgacaggttattctgtacatagtggggagctgtagattataatttttttttagtcatgggaagattatcaaatttcctattgcagacaaagggtctcttgttcattgaatgaatattacataatttattcaaacttgcttggtgttaggcaactaaatgttttaaggcatttttttgtagcacagctcttttttctcttttttttttttttggaaacagggactcactatttttgtatttttgaagggaaggggtttcatcatgttggtcaggctggacttgaactcctgacctcaagtgatctgcccacttcggcctcccaaagtgctgggattacagacattagccaccacgcccagaaagcacagatcttttttcaaaagaaatttgtgatgttttaataagaaagaaattaaaaaaaaaacagatacaatggaaagatatcgatcctggaacttttaaatcttggtttagagaaaacagtttattatttgaacaacttcaaacactcaagttaaaaagcactaacaaggcacatctcacttgcacaaaaatgataccaattatcaattgttggtggcaacagaatggagcagcacagaaatctggagacccgttttcagttgaatgctcatagttctaaaataggctctgatttggaattccttgtcttacttttcagtttgattaacgtggaagtctcaatatcttcttatgctgtgtgtaggaaaagtatcttgatcagtatatagaagaatatcccacaatgttactgcaactaagaaaaaattaacccattggagaaaacatttttaatcagttcattaagagtctaatgaaggtgcatatacgaaaagcaagatgtactttaattaatgattgatgttttgtgattgaagcttgctttcctaaataatatttctatacttcagtacagaatgtaaggtccttgctaatgccttatttggtttcttagtttcagtcttactgcagtctgcttttattgtaggcttattacatttatcaccatcattaatttaccatggtgttttatctttttaacttgttatttagatcacattgtataatgctttatttctggtcttgtagcaaaggaatgcatacaacaagcatgtaaaactttattgaatagaacagtctttaaaggggaatcatccataagtcagataaatccatgagtagtatagatttatctactgtaaattttctgtcaggctgttaaaagtagggccgtgtaaatcttactgtcattcacattataataggcacacttaccaatataccaactttatagttttttctccccattttacgggtttagggcttattttttttgagatgtcaagtactattttaacattgtacgtgtttcttaagaaacgccatagaatgaagacaatagggaagtctatttgtgatatattctagctcacttacattttttactgtatcttacaacagtaaacatatcacactatacttgaatttaaattttttcaagtatcattgcattattttgcacataaacatattcttagatggtatcaggttgatgatgatgagcttcatggtaattatttaaaactccataatgagatttgtttccaatctaatcaagaagggtaagaatttggggaaaaaaaatctgttctatagtaattaaagttagccatatgggcacttggctctaaagacttggatgtagtgaatctacccaacccccaagactaatgacttggatggtcttactgtattctcttgtccatagcaaagactgatgaatccagccagggaattctccaccagctctgcttctctgaaaccacaaagtcaggaaatgtaatcagagtgctcagctgaaccagagcaagagctttcctaatggctaactgtgactttagaaatcacatccattagataaagtgattaaatatacatcagtcttttggcaagagagccatgaagatattgcaatagaaccttaccacatgacccacatcttttgcttgaaaaagaaacatgttttcacctttgacacatatcatccctaaattcctcagctcagttgcaggaagcaattttttcatgataagttgtatgcagttcataattttatataaaccataaagtaattgtgtggttgataaactttataaggaaaatgtttctgactttctcatttcaccaccctgatgtgtgggtttttgttttgtattattcttctttttaggcttttcatgcttcaagacttcaagatattttgttaaattcttcccttggaagcctttgtgtcgccaaatcagatttttttaaaacttagatatgaatgtcttaagtgtctacttaggaaatatgtgtgtatgtctgtgtgtgcgtctgtgcttatatatagagagcaggcaaattactcttagcactctgaaaaagctttttttgttaaaataatgttttaaaaatattataaaaaaagtcaccgtcaaaatagcattcgctttatatttgtagttgaaataattcctgtttcttactcttagttataaccatcttttgattaataatatactgcccttcacattttaatacacatgcaactaagccgctgatgtaatacatatacttaaaatgttctttttgagctttgaataaccttttgccttttccctggtgatcaccagtgggcaagatgattgacagagaatgtgtttacaaacatggaatcattgatgactaagttaaaagtgacctcataaaatatagttctaattcttatttacagacaaaattctaagagctcaattcaatgtgtctaggataatagtgggcatagttaaataaataataggaagtgattatcatttacaaaatttcattagtgaattactaaagtatacccctatgcatactaattcctcttccccaaatcaaaacttctcatattcttaaatttctgaattcctaaaatcagcagagatgaagggatggaccagcaactataattttgttgtgttttgtgtttctgaggcacatatagggatacctagtttcatgaaaccaagtggtggggacattacacacaaagagaaagctgttaaaggcagaatgcccagacaagaatgaaaatgaaattcctggaggggcatccccatagtttttctgataatctctctccttacataaaaagcttgaattactggtaaattatccatgcaggaataatagaatcatagaatttttgtagtataaggaattttattgacatcatagttgaaagcagtcattttgtaaatgtttttggtgcccagagatactttaattatggcagaggaagttatagacaagtccacgaaccaggagtagaaaagttttcaaatgagaaatattgcagaccaagcatgttaattttattttattttttattttttattttttattttttttgtgagagggagtttcactcttgttgcccaggctggagtgcaatggcgcaatcttggctcgccacaacctccgcctcccaggttcaagcaattcttctgcctcagcctcctgagtagctgggattacaggcatgccccaccacgcctggctaattttgtatttttagtagagacagggtttctccatgttggtcagactggtctcgaactcccgacttcaggtgatccacctgcctcggccttccaaagtgctgggattacaggcgtgagccaccatgcccggtctgaggtattgttatatacacggcaactctagccttataatgcattgcccttatagtctacttagggtttttaggaatattgtgacctaatttaaaagtttgtagagagattctaattttcagaattaacagtactttcattttctctgaccattgaaatactcctaaattgcaaaatgaagtggaagtacacagtagattagtaaaacatatggttcaatgcataaattgaaataaataaaatgagactatttagaaaatgataacaaatacaacagtaaaaagaactcattacataactttgtgacttttttctttttctttcattggttccttacattttgaactctttctcactttttctgtttccttctttttaaagtaaggaatagagaaagagtgtatacaactgaataagtatttattgattaccttctatgtaccccattgggctaaatatgggagtagaaagatgaataagatggtcacagcttgggggagggtgattatgtcaaatcatgatgagaggagttttttgtttgtttgtttgtttgtttgtttgttttgacggagttttgctcttgttgcccatcctgaagtgcaatggcgtgatctcggctcaccgcaatctccgctcctgggttcaagcgattctcctgcctcagccttccgaggagccgggattataagcacgcgccaccacgcccggctaattttgtattttttttagtagagatggagtttctccatgttggtcaggctggtcttgaacttccgacctcaagtgatctgcccacctctgcctcccaaagtgttgggattacagacgtgagccactgcacccggccactactttggaggtttaagaaaagtagttgtaggtttaaaactcttggactggctcctgagggaagaattaaaatgccctattggagcatagccacctatctaggatcttgagtcctagataggtgggtgggaatgagtatcaggaaattgggctgggaccacttaggacaggcccttgtgggttaatcccataagctattgagaagccactgatgattttttaacagaagagagatgtgatcaatttttaattaccactctgacagtactatatattctgtggataagacaaaatgagagtggaaacctagagacttggagaccattgtgatagtacagataaaagataaagagaaaaagcaaagggaaagggtttagggttgatttagaaagtataatcaatagcccttgttgattagatgttactctattctgagttcccagggagtaaatggtactttttattactagcactggctactgactggcaatcatttaaatgagcgggttaaaataagagtatatgaaaaattagagtttgtggaacttgaggggcatatctaggctggaaaatagctacttgtcattttttttttttaatgttggaagactttctattcttagtttgtaggaaaaatgtacatgataatcaacaaaccgttacacatgtgctaaggtggtatattaactaattttcattggctcatgagttacatgctacctggcatcctcttgcctcttcctctctggagccacagattgttagcagagaagctggaagaacctaccatcttgccataggaaaaaggtttggtccttctggaacatgcctgtgaaaagttgccaatttcctatgtaggtcctggacttatctggaattcaaatatgactagacaccatgtattttatctggcactccgatcctatgtgtttttttttaaatatttatcctcctttgtctcttcatgaccttattatacaagttctagatcagagtgtaacagcctctttaaattctgtggcatgaactttaaatgcctgtgaagaatggggctgggttacgattggctaccagtgaattccaggtaatttagacacttcctggatttgttttccgtgtcatcatttattgattacttcatataaagtcttaatgtgtttattactcaggaaaaatgatggaatagtagcagcaatgccacaggtgtgttgtgaacattaattagttaattacaaagcatttagttgagaggcattctaaatagcacagaactcaaggctttcctccccaaccaggggtccacttaaatagctctttactaagtcaggagaaacaaacacatcttgtacatgaggtacatcaaccactaggcatgttgatctcccagggtgattttctgcatgaaaacctatcccctgggtgtcaagagctttctaagagcaatgattcatgaaccctctggatttaggacaatgctatgaaattattttcatctgtattctgaaataattacttgatgtcctattaaagtattttatattttttgccagaagttgtaggtgtaattggaaacaacagaatactcaaaaaaataaaagatcccaaaggagaataagaagaaagagagagaggaatgggctataaagacggcaagagtgatggaccagtgcctaaagattttagacagactctcaaatttactcttcttatgttctctctaaacaccattcttattagttcagcatcactgtaataactaaaaatattttaaaaagtggacaaggcagatgtcagcaaattgatgtggagaaatgggacagacacatggatgactcactcccagtcccaattccctattttattttttcatttgaaatatccatctcttcagagttctgtctagtgtgaggttcaaacaatttaaatgcttttctcaaaactattgtgcaaatgtctgtttttctgtatttttgtgtctttctgatgttcctctcctggcttttcacctactatcacaaattacatactttattatgtacttttatatatcatatacttttcaatgagcttgattcccacctgaacccacgctttagagagaacaatgataggtttctctgcacctgctccatatttagtaagtttccaattccttttggtgtcaaacaatagcaggtatctctgcagtcccttaggtcactaatgtgcttggttttgttgtcagggtagcagctgaaccatatctttcacaaacaggagatacatattttttcccagcttgagcagagcatctcacatttattaggagaaatgcccctagaggcccatctgtgtgtctttgacggctcaagtattatgtactttaagaagtttaatacattttctactggacagtattgagttgttttaaaatattaaaatcttactttgctgagataaataaaaggtattcaggcttttccaagacaagtatgagaaatgccaagttacaacaggttcactaatgagggagaagaaaagtttcatgataatactatgatctttgctattgcatttggaatttagttagacctaaataatgagaagacttttgtgatgatctattcaatttttatggcctatggtctttttgagaaattgattaaggcaggggaaaggggatagtggtagggcatcactgactcttgttttcttgcttgtttactcttttcacgaagtggtaatacaaattacctcccacagcagcacaggttactcaaaagcccagaggagcaggagaatgagacattccttattcatatttcagtaaggtattcttctccatctttgttgtttcaaggcagatgacaaaatttagtagccattttagtgcagaatactcccaaattcagggaggaagctagattcagttgtttttcagtaatattggaaagtgtaatgtgtaatgcccatgtttaaacagttgctttcttcctaacatgataaacttctatcgttagaagatattctcttgggatgaaaataaaaagatatagcataggccccgtttattttatttggggaggaggtagtagtagcggaaaatataaccagcgataccatcttcattactaatgatgacaacttacaacatcaggagctcaggaagaaggaaagcaataaataccttcatcttcaacaggattttctggcaattatatctgtttttgtttgtatgtttgtttgttttgtcctctattaatttgaaatgcctagattgtttttctggaacttagttttatatcaatcaataaaccccttttccctacttttttttgttactttttttcaagagcatactgacctcaacgtggtgaaagttttcaaaagaggcggatataagcttaaaacctgcctctgcccactcctgatctatctcaaatgaacatctgtaactctccatgaattaaaatgaggataataacatgttctaattgttatagaaaaaattacatttgtagcacagggtagctgctttatgcatatttttttctaagttatgcacaccacaattcagtactaattttgtcatgatgtcctgaagaaatcctaaaaatagagattctgtgaaagaacattgagtaccacataatcaagatatatatgtcttgattcattgattgattcattcattcagggcattatatagcagtcatttttttgctacccttccacatggatgatagttaaagactctactgaagccactagatacccatcttatacacaggctgtaatattttaactcctggagtaattggggtatattcacaataaaatcagctcaaatctaatttatttctttcatgaggtctgaaatgtagtcaaagcttccatttagttcctcgagaaaaagcttctggcaaagataacaaaggacatgattcaaatgctttctgtcttacactgctgcttcacatcaggggcagaggattttatgtttcatggccttctcctcccacatattttgggttttctcatctaatcatacagctatgatgtcagtgatggaaatttccacctcttagtttggtatcttgattgttttttctttccctgtttgcacaaaggattgtaggtggctttccagaaaagagacatgaaaaggatcactaaaaggagcttcaaaacaaattagattatttgttgtggggagaaaaatcatagcagcaggaaatttcattgtgccttttacacaagatctaacatgctgatgaattgctagtataatgatgatttatagagctgagtttcttttgaccaagcccagtactcttgcaaggttaaacaattctaatggcggatgacttgaaggactattttctaagcgaatgtacaaattacaagtccttagtttcgtaagatgctgtttcatcaaaggcttttctttgtggtttctcatatttcatattcatgttgactcccaggtgatagttaatggtatcttttttagtagtgctattatcagcttcaaatgaaataatagataataaaaagccttattattaatgtcatattttgatatatttttaactttataaggctttttagtattattaatgtcatattttgatatacttttaaccttatacttcatttattctaagtaatgtgatgtgatcaataatttttcaattaagtacttttctttttgtctgtgctagtttagtttagttgattggaatatgatgttactgtaactaaagcaaagtttggattcctgtaaaaagacttagcatttctccatagaaaggcatatgtacttttagataattctccatgatcctaatctgttatctcacaagtaaagaattgacacttagcattttgagatttaatatgtattgagtggttcttgtgctttgcccctctactcactttacattataaagcatctacataaaatgatttgtacattatctattgtaatgcacacaataatataatgaagatggggataattgctatctccactttttcttttcttttcttttcttttctttttttgaaacacaatctcactctgtctcccaggctgagtgcagtggcacagtcacagttcactgcaacctccatccccaggggctcaagcaaacatcctgtctcagcctcttgagtagctgagatccactcccctcggcctcccaaagtgctgggattataggcatgagccatcacacctggccttccactttttcaatgaggaaaccgtggtttagagaagtaaagacatgttatcacatgcaacaagaaaaaaacagaactgcaattcaaatcaggttctttctcatagttcttaataccatcctatagtcctcaaaccaaaggttccctcttgcttgactttgagatgatgtatagaatcactcttgaaataaaataaatattttatttaatttttttctttttcccagaaaagtaatctagtattttgtatcaatcaaaaacttctattttgaaaatacaagcattcctagttctataaaatatcaacatatgtaaagtctcctaaaagctttgggtttttatatgtgaagcctttacttctgttttctttttgaaataaaacattgattagaattctaaataggttatcacaaatctataatttttttcctataaaacaagcaaagtatatgacaaaaaaatcggtgctcttttttcacctcaccaagaaaattagtgtaattatttcatatgaataagactttttacctgcactacattatttagttaattttacaggctctagaaagatgttatgcaagagaagacatttcaattaatctgatgttgaaagaatgctagttttaaaactcaatgcactctatgtgctaaaaacgtttttgcagcatgaaggtagggatggacagggacatgtttgcctgagttctccagggaagctttggtggtggatgtatgcaaagggcataatctgtggtttccaaagttgaatatgcacacctaagaacaatgctggaagagctttgtcttcattcttatctttaaaagtttcaattttattcaagatcaaggtaatgatagatttaaaaaataatgataaaataaaaaatagtttcaattttgtgtatatttttaaatgcatatgttttacactgcatgtgtagattgtttataatttagcaagcatataaattcatttattgggagatcttttattattattggtattgctattattgagctggtaagggtgatgatcaaaaataattggagactctattctaaacgtgaggtagaaaattttctctgactctaatggtttaatctttaaaaaacagtttaagccacactataattaaagccataatgtttgtaacacttaattataaggatggaaaacttggtcctatagatattatcaccttaaggaaaggcaggaaagctaactgcagtagttgaccattggcacattgaaggggtcatgactggcctgcagtgtcaaaaagtgaccaaacagggacatctccatatggcattcattgactagattggttctattactgattgaagtcatttgtgttttttgtacaaactttaaatagcccaaagattctaaacgattttaaagtaaatgcaatatattattagtattatatagtctatacatacgtgctgatgtgtttgtgcgcttttctctatttatagggcatcataatttctcaaatataaggtataatataatcaggacaagacttgggaacaacatagtatacataataatcacatagttattattttgacaaacatttatgccacacatgcagaaacacaagtctgcaaccctccctatgtattgacattattctgcaagtatgcttacaaaacaatataagagagatcagaatatcctagtattcttaaggttaaaaccgaaacctttcttgtatttcctgaatgaaatgacagattaatgttattgatgaaatgaatatggcttggcttccttgagacacaggctgttagtaaaaaagcaattaagaaaataataaagaaatgaaacagcaattcctcttcctttttcctttcttctgtactgtgtcatagcaaaagtaatataatagcaactaattataggaaatctcccagactttgtaattggatctttcattttttcccacagcaactgtgaactaagaatttattcacagagcagctgtagtttgtttccagtaactcttagcagtgtctctttgtggagtcttaaagagacccatgtacatatttaggcatattggctaaactagtgccttttaaaacatctgcaggtctattgttgccaattctttcattgtcttctatcaaattaacttttcttagacggtataaagtgggagaagccactgaactcaaagctcaaagcctgacttctggtcatagcttcaatgtttccttaaacatgacttggtaacaagcaccaaactttgtaaatctcaatgtcacctttggtaagaaaaatgaaaggaatctttgcagtttatattttagagcattgctatatgtgaaagagctgtgaaaattataaaccagtgtaactcaccatgtcattatatagatatgtctaagttattcttgaatgtgaaatttccatttgcttgacaaatgtcactctattacatacatgatagttaaaagcatcttattttccatttgttccccagcccagttttcaacttttcttctaaaaaggtaaggtcaattaagagatatttccaaaggaaatagttctttagaaaatactttagtatatcaatgcacataataatacaaagaaatgcagttataaaaataaaatatagaataaatacacagctaccatattcttggcatatatttgtacatgaagaaataaacttcaaagccaggcaggacggctcatgcctgcaatcccagcactttgggaggctgaggtgggtggatcacttgagcccaggagttcaagaccagccggggcaacatagtaagaccccatttctataaaaaatagacaaaacttagccgggtgttgtggcgcctgcctgcagtcctagctacttgagaggctgaggtgggagggtcacttgaatcccagaggtggaggctgcagtgagctgtcaatgcactactgcactacagcctgggtgacacagaaatacactatcaaaaaagaaagaagagaaaggaaagaaagaaagaaaaagaaagaaagaaagaaagaaagaaagaaagaaagaaagaaagaaagaaagaaagaaagaaagggaaagaaaagaaaggagagagggaaggaaggaaaagaaagaaagaaagaaaaaaagaaagagaaagaaagaaaacgttgtgatatgattagaggactaagtcttaacgattagaagcctgatttttaaaaaattcaaaaaccaagaatcagtagtagtagttgagaaagtaaaactgagtgaaaagtagttttgcaatcaatgtggaaacactatttggtaaaatgcacttgtacttgaccttcaagtaatagatatgtcaatgttaaaatggcatgttttgaaagaaaacccatgtcaaatagtcgatataaattatagattatatttctcagataattataaattataaaatttctgagtacattcttcccaagatgtgttatttgaggcttttgtcttcactcattttcattaaggagactggtttcccatttgttttctcttttctttgttttcaagctgtaatactgtagagtaaaccctagccaggtgcttgtcctgccttacttcatcccctctttctaacagactacccgtgtaacttcctcaccagtgaaataggagacatagttcctgaggttaaatcatttactcaggttcatacaagagtggtaaagccaacatttggacttataatttcctacaatatgctacctctctagatagtagaattaaatttcaaagagaaatgtcaggagaaattccatattctacactaaggttctcatctattttattttccaccatattattacatagaagttatttaatttaaaagtctgattttaaggtaacctttatactattaactctcctccttgaagtgctacatttacaagtaattaacaaatactgtttgagcaagcacttgttcaggtgccagggactccagtttttgttaatttaaatatagatgcttgatatcatttattggggtgaaagagaataaaacaccttctcacccaccttcctaaattcattatagttaacagagggagtctataaaaatactaggacatagggactcattacattctaacaaaattctaagaacatgcatgtctttccccaggcatttagcttcccctccctcctcctattttttcatatcttaaagtaagatctaaattaaaaatttagaaattcccaaattatgttgctgttgataaaaggccactacatgtgaaatcagccttttctgtgatacattatatatcagagagtcagctattacttgtttgtgcctttaagaaagttaagaccaacttacctgtcattttaaatttgatttccgaagagcagtgtgccagaaatttggcttaaacagaccaacaaagcgtggcttctaggtgttcctgatgggcaggcttttttcaattaacttcctggggattgttttatttaattacaaggacagtttaccagataaactactcactgattgaatttctaaactcaagtctgctgaataaagccaaatgagtcatcgataaaaattcagatgccaagacctttgcaacaggtacatactctaagccatgtatttctgcattttaaagttttaaaacatccttcctctaatgttatcttttttttctatactggcctggggagtaacagatcttagttcaaatcctggctctgctacacacagctgtgttaccttgagcaaagtatctaattccatagataacgctttagtttccttagttgtgaattgaaaaattcagtgaacccaagttgagacgcattctacaaaataactgatttgtattctgcccaattgtcaggtcacgaaagaaaagaaaacaattgaagttctgttgcagataaaaagagactaatgaggtataacaactaaatgcaataaaaaatgatgtaatttaagtaagatttgcaattcagatagtaatatcatactggtgttaattttcttgattactatggttatataattgttaacattataggaagtggggcagggggtacaagggaatatttagtactatttttgctcctttcctataattagctcacaataaaaaatttaaaaaacaaataaaagttatggagagaggagaagccaacaaatagcataagtatagaactgtttttgtacacatgggcgttagacagatagtaatagtaatatcttgtataattttaatataaagagcaccgaaagagaaaaaaaaataagccctaaatcaatgccgagggtgtcatctttctttggaacccccttaatgcagtgactcctgtaagtgggcatgtccctttcatacagagttgcagttgttacaattgataagggttcatgtgagacaagcaattttgaagcagggcaactcccacaactgctcaatgtggacctcatctccttgtatttgcatagatatgctttgctgcatggattgctgcaaaattgctgaaaagactcccatacaaggagaatgcctggcactactcctccgtttgaaagctctggtttctctcttgtatcctgggaagagtgctgccaagtagtccatagacctcttcttatttccttaacttgctgtgtacattttgaagcatttatgtgtcagtttatttaactccccctgcctaataatgataataacaataatagaggtatgtattgagttcttattggttcaagtatgattctagagtgtttatatgcattaactcatttaaatattcaaaatccttttcatactcattttaccgatgagtaaactgagatacacagttaagtaacttaactaaggtgacctagcttttcagtgttggagtctggattaaaaagaaggtagcctggcttgcacttttcagcctttagaaatatacatacgaccatatccatctgctgaattccaactcaactttccttctttcctataccagctcaaaccaatttctaaccccttgtgtttccaaggtacttttaaaatacttccattcaagctgttttgccatgttttgtactatgatcatttatgtacacgtctttcttaaaaaccattagcctcttgggactaggaatattcctgggcaatgtcaaaatactctttatatgctggtgtctccaaagttactatttccaacccagcctcccattttaagttccagagtaacatggttagctacttattggacctgtctactttgtgtctcccaggcatctcaaacacaggatgtccaaaattggatttatcatttttcttccctgttctttaagcctcatcctcctagtttcctctcataagaaatcactggagtattaacttggcaggccaagtcagatacctgaaagtaatcttggatgctcatctcacttctggaatcccgagttcaactgccatttccagcctttcattatctttcaaatgtaaccacatacctatacctcaatatgtttccatacccccaccaatcatatcagttttattcacttggtaaccgatctttctgctgtaaatttaccctctagactatgtgaaaagtgagttttacaaaatatggacttgatcattttcctgcttaatctcttcaaaatcatacatctaccttcctctggaccccctttctctccactttctttgttaaggaaatagtcccttaaaaataatgaaaataatcagtcaatattttccaatgagttagtgtcaatgcccagggtctacaactcagcacaggtatcctttattaagtgtactataaaaggagtaccaaagcttagagcttaatcactggatgacactggaatgattacaactgaaaacagttagtgattagccttggtggatatattggaagcctagaatacctctcagaagatatagaactaaaaacccagccagcctctcaggccgtttacagtgtaaacaaagcaattagagccaaaggagcaagtaagttctaaggaccctggcattgttaaatggaaaaagcctccaggtgaaattgtggtctaagcataggtttctcaacctcagcttaatcgattttgggggcattcctataggaactttagcagcctctctgtcctctacccaccaggtgtccatagcaagcacccttcttcctccatgttcccatgagggaggagagtccgatatctatacagtatatgaaactaggaaatgtatgtaatgattttgtcctgcaccctttattggctttgtcaagacagcctaaatttcctgtatcttagcttttttcaataaattacaaaaatttgacagttggagccatttttctgcgacagtaattggtgattaaatcgcttaaatgccaacattagccaaaatgtttacctctacaaatgagaatctttacaatccctatcctctttctagcaggtttggctaagggaacaccaaaagcacaggcagaaaattacaattacaattgtccctcagtatcagtgagggattggttctaggacctcatgagatactgaaatctggagatgctcaagttctttacataaaatggtgtaacatttgcacataatctattcacatcctaccgtatactttaaatcatctctagattacttataatacctaatccaatgtaattgttgttattctgcattcattaggaaataatgacaagaaaaaaaactctgtacatgctcagactgtgcttatttttcatattcaagaaaggaaaagaatggtctttaagcccaagtttcaagttgtgaacaggtaatcatcattatttatcattaactcagaatcagtacacaggctctgaaaatcagctaaatctgtgaaattctcattccagtggccatgtttctgaaaataaaccagtcaataactgcctcactccagtaactatgcttctgaaagttagcaagtgaaggccagtccaagcttttgaaagtctgctaatgataaactcccagtcccgaacatcaccctgtcagtgcctgcccctatggtgctagagaacagccaatcagtaagtgtcccactctagtgaccatgtttccaaaatttagaaggtcaacggcagtcttactccagtgtccacactaacacagctggaagtccttgagtctctaaacactctgcacatttccccaaaccttatataatgtcagctgtggctttgttccaggaacttatctctcacaaatacagttctctcttgctggcaaacagaacgtttagatttttggcatccaatatttagttcaatttactgtaagttcacaagtttgcaatcctttcattggctcaactcttgtttatgtttagttatgagtttgtacctgtgagtgactgacagtgacaaagctgtgagattatcaaattcaatcttttcaattcctgggtcaattactaatatccattttttatttgtgtagaagtaaactcaaaaatgtcaaaatgcaagtaagttttgtgataaattttatgaacaatggatgtgcattaaacaaagaaaaactccttttgaagctctttgtgcagcatacaattgtttagctaatattgaaaatggtgaaaacttggatgtaagccagcaaatactaacagctaagcaaatagatgtatgatttcctcaacttgtaccaaagaaagtaataaaatcacatcttattgaaagaaattcagatgaagaagataaaataattgcagcacaagttgtcttccactttgtatatcatacaaggttttaagctcacatgacttaatttgaattgtgctacaagtattttttaatgcaaaattgtaagtaaattttctagtgctataggacaaaatctactgccgtaataaaaattagaataactccatttactgttacagagattaccacagctcaaatgttttacttttttatggcatagccatgaatgcaagtaatcacaatttgggggaaaaattcctttactcgtataataattttctcataaaaagacttgcttacaaggctattgtaacacgccttccagatgagtcttcagaaacaacaagaaattgttgcagagaccctatgattgagttagtagtcataaaaattatacttattttgtggaggtaatacaaatataaattggtggatatttgcataaaggtgtgatatttattgaaagttaaagcaaagtataaatgggactatgaacagtgttgcctcttctgccatattctacatgacgctgctcaaacagcatctgatatcagtaaagtaattgccagtaaagaaattgtcaagaaattattctatttcagcatttattctgttcagactctactaatgaagaatttttgtaattttgttggcattcgttattttcagttctttcacattttaaaattcactggctctctttaatagatgcagttgagagaattcttagtttatttaaagcaccgaaatcatactttaattctgaagaaaaggtctcacaaattcttgctgacttttaaaataacccattgagtaaagactacttatttcttgctcatagcattccatatcttttagcaataggattatgcaatttgaaagaagagtaaacattgttaattgatgccctccattgcttacaaagagttgttgaatgtattaaagataaaatggatgaaaagtttatcccttgtatgccaaggctgttttaagaggaacaacacaacttagggacagggaaaaagtccgtattgaagtggataattatttttacatttgtcatgagtatattttgaaatgtattttatcccttgaagaatttgatcctttaatggaacaggagaaattatatgcactcaaagaagggaataaaaattcatgacaatgttctgttttgtcagtggaaaatatttttaaaagttgtagatcaaaatatgcaatctaatcctgaaaaataaaaaaaaacaagttatgtcatgaaatatggtattgtgttctttagcaaaagagtaagtcccagagttaactttaagtcaatacatgttcagaagtccagcttataaggctaacactgaacatgttcaataagctggacttataagctggacttcacgatgttctcattaatgaatgttgaatggagaaaagagaaaatttggatgtgaccactatggaagacatgttacattgtagggggaacataggctttaactataaggaattttataagtcaactctgcaaaacaaggagctgttaatgaaagccaatcatcgaggaaattttcagaaaagaaatctctaatttacatactgatcatttattttagataaacaattagtaaattttaagattaagactgttctgtaaaaacatttccatttatggtcagaatatgtatacacaatgataaataattcaaatttaactgactgtgtattctttttgctaactctggtaactccacctggaggtagggaagaattatcctgttgaggaccactggtttagaccaagataaaatattatagcattcttacaattattatttaataactttattatactatttatatttcttaaaataaatatattcttggatttgccatattttcttgaggacaaaaatatttttgaaatataataaaatataattttaaaagaaaatttaattttaaaatattttagagtattgaaagtttgttttattgtagtaagttagcatcatcaggttgcttatggaaggcttatggtcctgcaagattaaataatggcttggttttgttatatttacatctgtgatttcatttttaaaaactaagaataatagtgtagaagatataaaagcagtgtgtatatttaaagtgaattttaaggacggacttagtccaaaataaaagttttggactgtggatattgcagaaatattattaataaagataatgagcaaaatcatcatatctattttatagtataagaagtaatatgataggaacaatattgaaatggattctgcatttacagactgcattatgtttcttttaaatcactacttctgaggtcaagtgattaattttcaagtgattcagaagaaatgctttaatcacttagcaaaactgtcatagccaaaaggagcttgttttggtcataacctagttcccacaaagtgagccaaaagtaatttctcatattaagcaaagatattgattacaagcaagagaaacaaacactggctgtcccaagccaaatggagatttattggaagttgttgggtactcatgcattcattggaaggctttgggaaactagagcagctgtataggaaaatgagctgacaaaagggaaatctagaggctgtttggcagacccagctggctagactactggtcactgctgccacacaggattctactatagctgtacatagacccagcacaagggaatttcaataaaatcttcctttatttggcttcattcaccaagttcaaagtaaagggcaacagaatccatttgaataagcttaggagatgatggcctcaccacttaaaataacaggagtggaatggaaatatagtcactttagtcactttagctttccacggcaggtgtcaaggctctgaattccatcaccactacacacaatgggaaatacctgttcattctagataagaaggaagattggatattggatagaaaaaaaagtagacatataattaggtcatatcatatgacattctttgtcatttttgactttttatattaaagtagtgatggaaagttagtggaatatgaaacaaaagttacaaggatgagcaataaaataaacagaaattatattaacattgagcaatgaactataacaaagttttgtcataccagaagcaaaagtaaaaagtattatttctcaaagaagaagacactcatctcttatagcactattaaataaattcttggattgtgtaataatccagtttataaagaagagtgaatcatatgaatatgttgaggaaaaatattaggatgtcttgctcatttgccataaaatggccaaacatgttgagataacaaactcttcatacatcactacattgaggatattgataacagagtggttgggtgttgtcgatttagagtatataagattagcttctgaataaggacactgtacaggctctgatatcttacaactcatatgtgaaagaaacttgatggaggtgttcccaaatttgacagtaatactgaaaattttcatgccattaccaaaaacaagttgtaaaactcagagaaatttgctcaactatcagtaatgaacatacacacactatactcagttgtggtaaaagaaagactaaatttttctatcttctccattacaaaattgatacaaagtaaagggaagatcaaagagaatgaagccaaaaatgaagggaagtcctaaagaaatgtgttaaggagtaaattaataaaattttggaatttatggtattggttaattatttttaatacagagacaacttatttaatttttgttctcacttttaataaacattcacttttatattaatctgtcttttgtgcctaatttgcccttgtatttttgcattttttctcaacctcctcccccagttgtataagccacagatccataaaacctggatctgtttataggccacagtgggttagatcaggggtttccatcccctgggccagtgacagatactggtccatggcctgttaggaaccaggctgcacagcaggaggtgagcagcagcccagtgaacattaccacctgagttcttcctcctgttagatcagccttggcattagactctcagagaagtgcaagctttattgtgaactgcacatacgagggatctaagttgcacactccttatgagactctaactaatgcctgatcatctgaagtggaatagtttcgtcccaaaacctacctccttccctgctgccctgaaaaaattgtcttccatgaaaccagtccttggttccaagaaggttggggactgctggattgccaggtgttatcactaagagagcaaataggtaaaatgtctggtaatatacactggaatattatgcagtagttagaagtgcagattagatgtatttacaacaacatgaatgctaagtactttaaatcatagtgcttagtaaataaaaacaaacaatgagaaaatgtatgtaaattagagattcatgtgtacaatattcaattttcaagaaaacagaaagatgttcataaacacattataatggttgctaagcatgggaatgaaaaacaggtagagtggcagagaatgggatatgggggcaatggagaaaaaatattaataaaaggaggctttgcatggccaatgataacaattggccacaaactgggaatttaacctggaacttgaggttaaaaaaatctgtagaatgcaggaactttggttgatattatccacaatacaagtaagttatgatttaacctttagaaggaaaataagctttgtgcatcctttaaaatttttaattagaatagtttgaagactagacaagtacaggaatagaaaatctagagagtttatgaagctatatatttcaaattccatcgaaggacaaagccaaagatgattttttttcttgtttggaaaagttgagagtaagtaaggacaatcagacttgatgacaaagccaaaaatgaaggagacagctcctggatcatagcaaactgttaacacaagagggaggaattgtaggagatacctgtcatagtacagaccagcaaatttctactcatcttccttccctgaccaaaatctttcttcctaagtccaagttaggtgccttttctgtgtgttctcattgctctcatatagtaggtgtgttgtaattgtttacctgctggttttccccaacagactgtaagccctagaggacaaggatcaaggccacctagttagtattgtgtcccaggcacctggcaccttaaaaatatttgttgctcttacctccaaacaacaacaacaacccccccccaacaataacaaacaacaaaaatgggtaacaactagagatggtagatatgttaatttcctttactatggtaaccttttttttactatctacatgtatccaatagcatcatgttgtataccttaaatatacacaataaagtgtattttaaaatatctgttgaagagtaagtaaaatgaaatgaacctattaaaggaatatcagtataatatttcacacatgtgaccattattttcataacttgctgcgggggtaaaccttaaaatcaagactaccttcattttgttttggtaatttgaaaagtaaggaaccgataatatttaggcatttttttactttaatcttttgtagtttaataaagaaaaatttccaaactacattctgttaattgtgctagcaagttattatgatggcattttaaaaaattaatgcaaataataatgatgcagataatcaatttaattgatggctggtcacttaagatcgctttctaattttcagttattaaaaggtctttcaaaataaggctacttttgtaaaaaaataatttttatactatattgtacattaagggaattcatggatggtgttttctacacaacagagaaaaaattttatgtaaacctgagagcaattactttaccaattaaatcactcaaatgttgtagactaaaataattgaaagtcaaaataagattaaagaaaatcagttttcatatacaaataatggtaagggattcaagaaaataaaaattggacttaatgcattttaacctatatagttttgaaaaccataaaacataaaccttattgctttgtgtagtcatttttcacctttgtagagtccatttttccttacatgtaaacaggcgcctattctaatattcttcatttcttgctgtgtttccattctttttgtctaagatcttttccttctgcctaaagtacttcctttagtgtatattttagtacaatgattaattctctcaacttgagttttcagaaaaagaagtttttaaaaacattttacgttcatctttttaacttttcattaagtataacatacttaaataaaaatgcatatatcatgttctcgcttataagtgagacacatagaggggaaaaacacacactggaacctttcaaatacagtagagggtgggaggaggcagaagatcaggaaaaataaccaatgagtactaggtctaatacctgggtgatgaaataagctgtaaaacaaacccccatgacacaagtttacctatgtaacaaacctggacttgtactcctgaacttaaaataaaagttaaaaaaaaaatgcatatatcctaaaaatatagtttgatgaattcttcacaaacgaaacaaaccatgtaaccaatactgggatgaaaacacagaattccttcactctagaataatattttcactctctctaatgttccagagtgtcagggactacaaaggctacaaaaccaaatgacaggtctgctttgttccaagcaatgttacaggctaaagatacactgcttgtaggatttcatactcttaaaagttcccaggtacataaaattctactaattagttaaatgaagctgtgtattcatggacaatagttaaattgtgacacagatgagtgtacctagcaccttgttagagaaagctccttagtatcaatgagatgtgaaggacatctaagagttatcagggctagaggtctggggagagttatcctggctcatgctagtcttttagtgaaatggcctggacaaattcatagtgaagatgggcagtcaattgataagattatattatatttgactgtttatttctaataagattataaaaagattataaagttaaaagcaaattgaggtgttgtagtgaggaaagaggattgtatagattcataatggctggctcaattccagtgtttttactctacttaagtgtatagatttggttaatttttaaaatttcaggtaacaaataatatggtcatcattgaaatccctaaatataataaattacaaccattgtttttactgaatctagactaggggaagagtaagataaaacaagataagtagaatgttggcaatttaaaaaattgtgccaggctcagtggttgatgcctgtaaccccagcactttgggaggccaaggagggcagatcacttgagcccaggagttcaagacgagcctgggcaacatggtgagaccttgtctctacaaaaaatgctttaaaaaattagcccagcatggtggcacgcacctgtggtcccagctacttgggaaggtgggaggtcgcttgagtgcacgaggatgatgctccagtgagccgtgatcacagtattgcactgcaacctgggcaacagagtgagtgagaccttgtgtttataagaaaatttatacctttcaaaaatttaaactcatactttctgcccatattacagctgcctccttctgtggtataaacgcaatattaaatattgtgtttatttttatcaaaataagacagaaattctcaagacagaaaatgaaaagttttgtcaaggggtttcacagacctttcattgaattttaattgcaatgctaaacaatatttgaagataacccatagtggtcccagtcttcagcctgaagtcaagaacctttagttatctgaatgttctcaagctccaagactccctaggatgttatttaagcaaagtgcaggatttccaaacactagtgattaatatatgacatctgcttactacagcactgttgtgcagccacaaaatctttcagaaaagttcacaataactatggcttactttgataaagaatagtcagtaggatggttagtctaatatgctctcataaaaaaagaaaagtattatgaggtggtgccaggaccttgggtcctatttggctatttctccaaggatctctcaatggtaagatcatcatatatctaagcttgcctagaacagtccaaggtcattcctgctgtcttggtattttctgtgttgtgtagcatttattcttgacacaaaatcctggcttggaacataaatgctgtagacatcctgccaaggattgaatcaaatttataagtgtaaccctgacagctagggtagagctgtctatttccttcctccaaagatgttatcaggtatttagattagtaaaatgagaaatactgagatacccttataattcaaggagcacataggaatggatatagacttggtttaagtattatttttcccctgtattctccagattcaatcgtttcgcacctttgactttcttatctaaactgtagagctattcaatgactaaattgtacttcttattgtctttgaatgtttcagctttatcttgttattgacatatagaatttttattatcttgatatttcacttattcaatcggaggccaggtgtaggaaggactccaatattttcttggtgccaagacatagaacagagttttcagatccatctggaaatttttctgttttcatgggagaaggcctataagagttcatactggaaggaaacattgcctctctcatctctcctgatgacatatttctcttttatcatgggaagtcttatgttatgagtagataagttatgaaggtgatgttatcgaacataggagagtaatttaaaatattattgacaaaaggggcttttgtagttataaaccagggttaagcgtatccttgtcagccagagtggagctgtatttttgtcttgctctgatgatgttatcaggtgttcagagctcagtaaaatgagaatctcagagtcaaatacatttcttttatctctatgttacctcacagttcctaaagtaacacagaaatcaaaagtcagccttttgtaccttaacggcatcattaagatggatatgtaataaagcttcaatttaacaacttaaaagatatttagtatgcttaccatggttgagggagttaaattgtacttattctaaaagaaaatacacacagattccctcataagtgtatttttttagcctattataataagacataatgactctcaagtataattaggactcagacattgtgactccagtttagttctatgtttataagtcataagctcattcctgacccaggagagtgcatttatagaaaattatcctcccaggcatgattactttaagaaaactgatcagcatttctaatggatctcctattgatcaaagcaatgctattttgtactgtgtaaaatatgtatttttaatgtattaattgtaattcattttaattaaaagtggttcaaatttatgtctattatcacttaggtatattatagataatatagataatggcaatgcatttacctgataaattcaaattcactgagctattattacctttatttaatattagaataattctacatctgtgatttccttttgcttaaacttttgtcttggaatagatttatggaaaaatggtgcagatagtaaggacagtttcaatataccccacatccagtttcccctgttattaacagtttatattagtatggcgcatttgtcacaattaacaaaaccatgtgatacatcattattattaacaaatgcccttaccctattcagagttccttagtttttcactaatttcctttttctctttcaagatctcacccaggctaccacattacatttaaccatcataccatcatatcaccttaagcatctctaggctgtcgcaatttctcaggctttccttgtttttgatgatgttgatactttgagtgagtataggttaggtattttgtagaatgttcctgaattggtatttgtctgatatttttctcatggttagattaaggctataagttttgggaaggaagatcacatatgtaaaaggccattctcatcacatagtatcaatggtacacattgtcaatgagttatcgttgttgatgttaactatgatttaaataaactttttaggttctcatgttctgattctatggtgccttgagaatgctttaaaaattaatggtacttcagtcaagattttacctgcaggaaaaaatcactatgtgtttctagagaagtgacattttcaaagcagtatttcattttacaacagttagcatcaataaaaatgtattttttatttatctttacatttgtccactgtcttaaatatttatactgactcaatctcattcagattttggcagatcttccaaatgattaattggaccaattttaaataaataaatttatttatttatttgagatggagtcccgctctctggttcaggctggagtgcagtggcgcgatctcggctcactgcaacctctgcctgctgggttcaagtaattctcctgcctcagcctcctgagtagctgagattgcaggcgcccacaccacacctggctaattgttgtaattttatcgaaataagattaagttatttacaggtaagaggctcagtgatggaatgcaaaacagcctgaaattattatagagttgtgagcatgtagctattttcctgctccttgaaataagaaaatatagagttgtgagcgtgtagctattttcctgctccttgaaataagaaaatgtcatatcatagtccctctaatcaagattaaagaaacaaacaagtaaacactacttgctttctacaagagatgtcaaaagttatcaaaggaaacatactgtttaaaggaattatctgggagatatttttaagagaataacttattctcttaaataaatatagctttcatatataagataaacattaattattacaaaagcacaacatattacaaaattatatggacataatatgcacatactctaactgagccacaatagaattggtgccctgacactaataaatcatttgggaactgcagtttggagtatttagtacctgttatgtggccaagaaggtaatagaggccactgagaccttttccagtctaatataatgggcacaactcacattttttccttttagttattaggtaaaaattagtgttggtgtttacttcagtgattttttagaggatttacaatttttactgtgaacacttagggaaacccacttcccacctcatcctatagattttccctatgtgaagggttttcatagtaccttggggatgaaaggaagtcccccaaataattttcctgatgtctgcttccaatatttgacttcaagaataccgttttccaaatagtatgttcagagccataccaggcacacagagtctctaaaactctggagagactgtaatatttctttgcttgaaggaagggatcattcttgtattctgttcagagattacattaatgatatttaaatgtttctcagaagataaaccaagtgttggaatttatttgcttttgaccctgttcagcaatattcaatgaataaaaaagaaaaaagtcttaatgatagttcttgagccacatgactttgtctaattaaaaaatattttgcaagtcttcatataaagttcaaaacaacaaaggtgaaatgatgggaattttcttaagaaaggaaattctgcagtgacccaatcctttgagcaatcaacagtcattctagggatactcttgtattgtttaaaattacattttacaaaataaataatgtcctaaatgcctcaacatttttagaatcagaaaagttgcttaactgggatgtccaagatcatttagctagtaagtagtgaatccagtattcaaaacccaggctttctagctcctgaacttgtcctagactcactactctaaactaaatctctgtttaatattacatgctcatatgaaatgtttcatgtttaaaaggccaatacattcccataaatggaaatatcctcatttaatataattaatatattttaattatggaagcatgataaaattatccaaagcaaggaattaaaatagaaggatgagacaagttaataatcttatgagctccatgaatacgtgttcattatgtgcaaaactcttcctgttaagcactttatatacagttaaccatcacaatctaaaccactcttcggagcatgattattaactcaatttttcaaactaggaatcttaggctcagagaggttatgtcatctccacagggtcaacagctctaaaatgtggagcacaaattgtaatgggaaaggccaagatgattattgacctgtgagccactgaaaccagtgtgaattgttctgtatggaatagaagtacacttcatgatatatattgtaactgttgctgaaggattttattcattttacattggatcaaatggaaatcgagctgtatattaaagattttacaaaagctccaaattaagaagaaactatagaaactcaaataaaatgaaattttttttaaaaaagtgttttctaagtagtgtttcataaagtaatacaaatttttagttattaggctgataaaataaatctatttcttttagtatctttgtcctttctttttgaatgttgttacacattcctgaaagttggaagatcagcgttttaaaataaatgctaggaaagacctaatgtaactcttgattattttacagcatcaagagttcttccttcttcttgcttattgcttgacaacagattgactgaggatgctttagagctgacaggtttggaggatgagggatgagtgagtatgagcaaaactctgaggaggagcactgcatgcctcaaaagaacttggagagaataagagttaccaaaaaaaaaaaaaaaaaaagattttgccaggctataattggaatgaagtgatataagtgacatgaatgatgcttaaaatgttgagaattaaaaagtaaatattaaaacattgaaaaacttttttttaccctttttggtttatcatcttccttctctccttcaacttccatttttttcattcagtttttcccctcattccaactcttctttctttaattgaacataatagagactcggagttcaaaatatgtgttgtttctattgaattgatagattttttttttttttttgagacagggtctctgtctgtcatccaagctggaccgcagtggtgtgatcatggctcactgcagactcaacctccccaggctcaggtgatcctcccaccttagctactctcaagcagctgagactacaggtgcacagctccatgcctggctaatttttgtacttttcctagagacagggtgtcactgtgttgcccatgctgttcttgaactcctgccctcaagtgattcacccgccttggcctccgaaaatgttggaattacaggcacgagccactgtgcctggtctattgaatggaatttatgtttatcctttccaattttaaaatagttaactttaaagttgtgtattttacattcattgtcttcaaaccaaacaaaatccaaaaacttttctactttttgaattgaattttttctctccttttgaataataaaacctggtcattgatgtatgtgtactcatctgatatttttgatttaacaaaatcaaatggagggttcacgttagtattttatgctttttaaaagtagacatgcttatgctcttccctaaaacttttatttcagcattacttagataagccctggcatctgtatttttttaggttacacagatgatttttttgtataccctggtcaatagccacagtggagtatacctgcattctgatatatacactcttgacaaccatagagacaaatgatacttagctgcatttttaacattacctaacataagtgaaagggattttaaaacagtagtattttggaaaacagcagataataaaacattaattttgtgttgtgggttattggtattaagtatcatgtaatgcccacatctcaaagctcactatggaagaattggtgtcagataataggaagattgatattgttgaaaaccatgcattcagcaagccagccattggtagcacccaatgaagtgttcagtattcatctaagcagagaaagtagaagacacaatctttactgtaactttgagtgtttgcagtgtgtcagatggtcccttgaagaagaaatattaataaaaatgaattgcaaattgtctccaatttacctgaaagagatcaaaataatgtatctaaatatatggtgtttgaaaggtgtagagtcagtccatatttttcaagcccagtgaaggtaacagaacagtttctacttaagcagctgtttgttggtttctttggctcaagagagaggtataatatcttcttttattttacagctttttaatcataataataactattataaaattaacaaatgcacatggtaactaattcaaacaatttttgctttatccctttaaagccattatctagggaataatcacttcccgcttttttaaaaaaaagtttttctgatattttcctttttatctctaaataatatgcttatgtctcatttttatttcatcaacttatgtaatgttttctaactttctaatttgaaaatgaggaatttattttatttatgtaaacttttctctttctgccccattctcaaattccaagcagttatgttttcatttctaagtaattctatgggttggatttatacctttaaatggaatatacctgaacctctatttcttgttacttaaactttagccaggatgcactaactgccttcaatgtaagataaggggtcagctctccaacttttccctcaccactaatccccctctacctctcaatttttgtaagctattccattacttttacactgataatatttaacacatatatgtgtatatcttgtctttgtgtaaataaagttctataattgtacttacattttatatatgctttggtaattggcacatttgtgagatgattaactgatacaatttaacaatattataattatgtatgtatttttcattttaaaacaagtaacatggtttgatctagaggaggaatttaaacctctcattcaaactctgctacttgaagaacacatcaaactcaagtggatcctctctgcttcaattctaccagttgttcaagttcatgcctcattttgaattgattcctatttggacaatatggctatttacacgttctaaagaaacaaattccctttgcttttattcacactatttgtgaaacatcttgtattctatgtgttttagaagtacttttttttttttgctctaccttaatccaaagtaacttaaaaaaaaaagataaaaaggagttaaattttgaattttcttatacctagaaatatattttgtttgccatcacacttgataataggttgtctgataatagaatttgattcaaaatattttctctcatcacactgaaagcattgattgtgttctagtgtcaattatggctaaggaaattttaatggcaatctaattttcattctttttagttagttatcttatttttggaagattataaaatcttgtttctattgttaatgctctaaactttcacaagaatggaacttttaaattgatcttcttttgtacttttagcttgatgactcttggtgaattttctgccattactttgtttattatttcctatctactatttgctgctctcttgagactaatgtcgaacaacatggattattctgtatcttctaagttttattttgtacttttttaatttttaaaattctcctaaaatatatagaaaaatctaagatatagaactccatgcatttttacatatacatattttcccatgtaaccatcacatagatcaaggtatagaacgtttctagcacctgagaatgctcactggtgccccattctggtaaagtgccccttttgggtaaagtaaaaggtaactacaattatgacttctccttttcagcaagcattctactgaaattttttgtttcacaaagcatgacctttacccagaattgatgttgttgtttttggtagcctattttttttttttaataaaagatactctgtctcctcaaatttctctaggaatactaactttaacttctcaatatcccacaatgtttgcttttttttttctaaagttaaaagtttggtctgttcatcttagtctttcaattttatgtttggtagatcttcattaccaatttattcttgataatctattaatatttatggaagaaaggccaggttggtgttggccaggtttgcatctgtctttatacaggtctgtttcccagacaaatcctctcttgaaagagagggatgactgaaaggtctgtgtatatacatgtatggtgtactgacaggcaggctacattttaggatgtatggatgaggagtagataagggagtcacctttccctcgactccaccctggttctagctaaaatggacatggataccctaggagtcctaccttaattaatgcagatattatccttttggtgatagcttggagataaaccactctgctacatatttaacatagagagggaagtgggacaatgttttctgcaacattattgaataaataatccatggattaatcaacttgttttctgatctacatcacatatttgccatagaaatctgtgacttctctgctagaaagaaattctaacattctcagatgagtgttctagactgtagcttctgctttgatctcctcactagggtaatcttatgatttatgataactttttttgtcttcctctggtttttagtgatattatctaacatttcgccactgtacatctttgtttttactgcaatggaaatttgaaggccagagagtgtgataaacacatgggataagaccattttcatgaactgggagctgacattgctttgactggaaagatgtgtgaagaaaaatagatgctagatagacaaatacatgatatgatatttggacagacatagatccatagatggataagcatagataaaacatatctatatatatgtgtgtgtctgcatacatagaaaataagaaagagttcagaataaatatttccatattgattttaactataggaaatcttagatacaagaataacacattcattttttaattttagtagttgcctaagtattctctaatatgagattaatggtgagtgggtaagatagtaatgagaaaacaaaagtactgcctttatatgcaacattgggatttcattctaaagaagatacaatcatagtaatgttaataaaagtggaaatgtagcaatatatttttcaaaattgtaaattaaacatgacaagaataaatattgattgatttcattgactatataaaattaggtcaaataattttaaatgatttttttcaaagtatattttctttcttctggatagaaaaacatgacattttcgttgtacaaatttgaaaagtaaagtataaagacataaaaataatccataatctcttaactagggctaaactttgttaaatgcattgtgtatttaaattaaatatcattttaaaaattattattaatttacatctatctgtgtgtataacctggattccacttattatgcattatatttttataattcatttaattcattaaatagtctttgaacgctctctttcaaagctgctcattatttcattatacattcattacttcatttagtgtaacccttactgttaggattttggattgattataatttttcaatattataaaaatattgtagtaaatatatttatacatgttagaggacacctgagattactgtctttgaataaattcctagaaggaaaattatttggcaatataaacgaattcacgtgtttaaggcttttgatagatattacaaaattaccctcaaaaagtttgtacactttatttatttatttgagacggagtctcgctctattgcccaggctggagtgcagtggcacgatcttggctcactgcaagctccgcctcctgggttcacgccattctctgcctcagcctcccgagcagctgggactataggcgcctgccaacatgcctggctaatttttttgtacttttagtagagacagggtttcacagtgttcgccaggttggtctcgatctcctgacctcatgatctgcctgcctgggcctcccaaagttctgggattataggcgtgagccaccgcacccagacagtacacattatttattactttcatccagacaggcaacactgatttcccctataacctctctaatatcactattacttttgttaaaatctttgctaatgattaataggccaaatttggttccccatgtttattttaatatttgtttctttgattactagtgaggtttgacatggttacaagtgtttattaaccatttgtatttttagataattatgttttttactaaattttatgagatatattaatatctttattcattaaaggaaaagcacttcatctgtcatttgtattgtactttttttattttgtggatgccttccacttttaaaaaccttcattgttatgagattaaatctagcattctttatctttttcgattttgcctttggtgtaatgctttacaagtcctctctactctcacattaaataagtattcattttcacttttattagaatgtttgagctttatttttccatttaaatatttactccaccagaaatctcaaatcttaaactaaatgcctgactaatgaaaactcctgtggcctgtttatccagaagactaagggaagaggaaagaagttgtagtcacacataggtcctgccccatcattgcatcttctttgtgtgtgttggtgaagtgtgaggctccatttttacttatgttgccctctgtaaccctgtcagcctatcatcttgccaccccactggcctggtacaataacttccaagcaaactcagatgccaactaaagctgctcttcttcaaagctataaaattagtaaaatgaaaggaagtttcacctctccaaactagaggatgatgatgaaatctgatcaaggtctcttcaacttccatttcacagatcatgatgttaagcaggtgcttagtgtcttcctttaatttagcttgatcagggaaatattgcccatgcatggtaccactagcattgaccaccctttgcctctgcttttttcatatactttagtcattctggagctgtgttgagcatgtgcatgggggttgggggagacagagacagaggagaataggaatattggaagaatcaaactggtaatggacatctgagttcacaacatctttgtacctagatttctgtcaaataattcttgaaagagatggtaccctccagttgaatgtagaatctacaaaaacaccagttattcaagccaacttttcttcaagagccacagtatgtctacactgaaagtctagtgaggcaagttatcccgtcttctcacctttatgatttccaaaagtgttgaggaatctccaaagcacaagtggcaactgctttgatttgattcattgatttgtttcctttttactaaatctcttcctattctgaggacaattttcacatattttaggattcaaaattcttaatgcatattcatagtagttttattaagatataatttacacaccataaaaaatcaccattttaaagtgtatcactcagtggtttttagtatgttcacaaaggtatgcaacaatcatcattatgtagttttagaatatttttatcaccccaaaagaagccccatactctttaaccattaaccacataaccatcaataatcacttcctattacacccagcctctgacaaaaaatactctacattttgtttctggggatttgcctattctggacatttcataagatggaatcatatcgtatgtggccttttggctctgtgttctttcacggggttttcatcacatccatgttgtaacatgtacctatacttcatttgtttttattgctaaatactaattcagtgtttgaatatcccacattcctttatccatttattcattggtgagtaatgaggttgtgtttactttttggctagtatgaataatgctgctgaacattcatgtaaacgttcttgtgtggacatatgttttaaattcccttgagtctgtaccaagtagtggaattgccgagtcataacttactctttacctttcagaatcatcctacttttgaatgtgtatatgaaatatcccttatttttcactacattctttaaaaacctttatcctaactttggtttccatcaaaatacaggcatacttcattttatggggctttactttattgcacttcaagatactgcattctttacaagttgaaggtttgtggcaaccctgcattaagcaagtctgtcagcgtaattttttcaacagcatgtgctcacttcatgcatctgtgtcacactttggcaattctcacaatatttcaactttgtaattgccattatttaattattactgtatgtgttatggtgatctatgatcagtgatctttgttgttactgtggtaattgttttggggtgctatgaaccacatccacataagacagcaaacaatcattaaatgtgacgtgttctgtttcagcatccctatctctctccctttcctcaggcttccctgttccctgacacacaacgatgttaaaattaggccaattagtaacccattcccacccctaatgttcaagtaaaggaagaattgcgcatttctcactttaaatcagaagctagaaatgattaagcttagtgaggaaggcatgttgaaagccaagataggccaaaatctaggcctcttgcactaagtacttagccaagttgtgaatgcaaaggaaacattcttgaaggaaatcaaatgtgctactccagtgaacacatgaatgataagaaaacaaaacagccttattgcaaatatagagaaagttttagtgatctagatagaagatcaaccagccacaacatttccttaagccaaagcctaatccacagcaaggccataactccaattgtatgaaggctgagaggtgaagaagctggaaaaaaaaggtttgaagctggcagacggtaccccatgagattgaaggaaagaagtcactgccataacataaaaatgcaaggtgaaacagcaagtgccaatggagaagatgcagcaagttattcagaagatctagctaagatcattgataagagtggttacattaaacaacagatttgcaatgaaggtctaacagccttctactagaagaatatattatagctagaaaggagaagtcaatgtctggcttcaaagcttcaacgaacaggctgactctcttgttaggggataatgcagctggtgactttaaattgaagcaaatgctaatttatcgttcagaaaatcttagaattatattatttaattattcagaatattaataattatttactattcagaaaattacataataattatattatttactattcagaaaattacataataattatattatttactattcagaaaattaaataattatattctttactattcagaaaattaaataataactatattatttaattattcagaaaattaaataataattatattatttaatcattcagaaaatctcttaagaattatactaaatctactctgcctgtgctctataaatagaacaacaaagcctggatgacagcacgtctgtttacagcatggttcactaaatattttaggcccagtgttgatacttatagctcaggaaaaaaaaaaaagatttctttcaaaatatcactgcctattgacaatgtgcctggtcactcaagagctctaacggagaggtacaagggcattaatgttattttcatgcctgctaacgctatccattctgtagcctatgggccaaagagtaatttcaacttttaagtcttattttttaataaatacattttataagactatagctgccatagatagtgattcctctgatgggtctgggaaaagtaaattgaaaatcttctggaaaggattcaccattctagatgttattagaacattaatgatttgtgggaggagggcaatatacaaacattaataggaaattggaatgagttgattccaactctcatggatgactatgagaggtttaagacttcagtgatggaaagaactgcagatgtggtggaaatagcaagagaattagaattaagagatggagcctaaaattgtgactgaattgctgccatctcgcggtaacttgaatggatgaggagttgcttctgattgataagcaaagaaagtggtttcgtgagatggaatcttctcctggtcaagatgttatgaacattgttgaagtgacagcagaggatttagaatattacataagtttagttggtaaaacagcatcaggctggagagtggtgctaccaaaggcattatcataaagacttttaaaagaggaaagttgagttgaattgcaccaaaggtaaatatagacgaaaagaaggggaatttaggaaaatttactcagaaaattgtcattttttactttaaagctatgaagcgtaaacttcaaatttctgagtataaagatggttagaaggcacgaaagataagtcccgcccattgcctgacacatagtaatcccttaacaagctgataattctagaacatgttaccttttgtagttgaaactaaaaatctgtttatgttgttattattagtttttaatgggcctttcttggcaggcaaatagttaagtctttatttctttgtttccatccaggcctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacagctgcccttcatctatggggacattcctcccggcatggtgtcagagcccctggaggacttggacccctactatgcagacaaaaaggtgagtttattttgacttcagtggtcagtttctgttggcttccttctgtataaaaattattttaaattgagattagtgaaatttagtgaataaccatatcatgaccagaatgttaaattaaatatatatatatatatatatatatatatatatatatatatatatataggatattcagaatctgtactttttcaaatttttcattgaaattggctctggcattggcatactacttttaatttttttttttaattatactttaagttttagggtacatgtgcacattgtgcaggttagttacatatgtatacatgtgccatgctggtgcgctgcacccactaactggtcatctagcattaggtatatctcccaatgctatccctcccccctccccccaccccaccacagtccctagagtgtgatattccccttcctgtgtccatgtgatttcattgttcaattcccacctatgagtgagaatatgcggtgtttggttttttattcttgtgatagtttactgagaatgatgatttccaattgcatccatgtccctacaaaggacgtgaactcatcattttttatggctgcatagtattccatggtgtatatgagccacattttcttaatccagtctatcattgttggacatttgggttggttccaagtgtttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttaccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccttttgtcagatgagtaggttgcgaaaattgtctcccattttgtaggttgcatgttcactctgatggtagtttattttgctgtgcagaagctctttagtttaattagatcccatttgtcaattttgtcttttgttgccattgcttttggtgttttagacatgaagtccttgcccatgcctatgtcctgaatggtaatgcctgggttttcttctagggtttttatggttttaggtctaatgtttaagtctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcgttatttctgagggctctgttctgttccattgatctatatctctgttttggtaccagtaccatgctgtttgggttactgtagccttgtagtgtagtttgaagtcaggtagcgtgatgcctccagctttgttcttttggcttaggattgacttggcgatgcgggctcttttttggttccatatgaactttaaagtagttttttccagttctgtgaagaaagtcattggtagcttgatggggatggcattgaatctgtaaattaccttgggcagtatggccattttcacgatattgattcttcctacacatgagcatggaatgttcttccatttgtttgtatcctcttttatttccttgagcagtggtttgtagttctcctcgaagaggtccttcacatcccttgtaagttggattcctaggtattttattctctttgaagcaattgtgaaatttagtataatgtttagtataacatagtatacattgtttagtataattgtttagcataacatttttggacatgacacagtgatctgccaaattttataatcatacctattttttcctgctaataattaactctcatgtgtatgcagacccaaaaatcacttaaaagtttttaatgagaatgaaaattgctaatttcaattttaaaataccaacaattctttttattaaaatttcaagtataaggtaacttgatcttgccaatactatgtagtatgttgtgatttttcatgttagctcagatgacctccggtttataaagtctccctgataattttgacagtcatgtgaccctgttccctcttcactctcattcttccccctttatatttttctgtatgatatctgtcacatcttgccttatattagttactttcttcttttcatttttctaggaagttccttgaatacaaaactcatgccttatttttgttcaaactccttttcattacctgttatgatatagtttctgactatacatgtattagtcttttttttttttttttttttgagacagagtctccctctgttgcccaggctggagtgccgtggcgcgattttggctcactgcaagctccgcctcccgggttcacgccattctcccacctcagcctccagggtagctgggactacaggtacccgccaccacacctggctaattttgtttttgtatttttagtagagacggggattcaccgtgttagccaggatggtctcgatctcctgacgttgtgttctgcccaccttggcctcccaaagtgctgggaacacaggcgtgagccaccacgcccggccgtattagtccatttttacactgctataaagaactacctgagactgggtaatttataaagaaaagagatttaatttactcactgttctgaatggcaggggaggcctcagaaaacttacaatcatggtcgaaggcaaaggggaagcaaggcacatcttaacatggtgcaggagagggagaaagaggagggaaatgccgcacttttaaacccatcagatctcatgagaactcactcactcactatcatgagaacagcactggggaaaccgctcccatgatccaatcacttaccaccaggtccctcccctgagacgtggggattacaattcaaaatgagatttgggcggggacacagagccaaaccatgtcaatacaattgcagaaagaatggatgaataattttttaaaaatacagtctactgagatttaagacaaaaaggattgtacttgaggactaggtattaattttaaaataattttccatgtaaaagtgaattttacattaaattgtatttagatagaactgatacagtgaaagggagcaggaaaataaaaggacacctgaaaacaatagactctgatttgttttcttgagggaacgctgccgcatacaaataaaaagcctgactcacagacttacctcctgaatacggtgagaaatgcttattgccagaaacccactgataaccctatataaaatttagaaagtcagtgtctttcagctaacacaagtcatcttcctgccaaccggagaaaaataaggctgggatttgaactttgtctttctgatttctaagccaatgctttaggttgctttaatattttgttgttactgctggttgtttttatttcttaactgaatactaaagctatggaaaaggacacttatggaatggctacaataacatttcaagaatgtttgcttctattcatatcgttttttaaattaccgtggttagtaagtgaggaatcctcttaatttaagtcccttttaaaagctaatattagtattataactaaaataaagaaattgaactcagtgattggaaggattcttccaactctgacgttccttcaacttaggaaaatattttttgaaataactcatattttggaacatgtgctgctaaccataacaattgccagcaagtattaaaattctcaaggttttatgataaaaatattagagatagctagtttctatttggctttcttaaaatgcagtgtaatggaagggaaagaagttgtactttaaaataacttaaccacagttattgttactggtgaaagaaaatgaaaaatatgaaatacagtattttgaaagctctaagcaatacatgctaacaaatagctcaatttttaaagttactatgaagaagtggacttggagttcattggccaaggtgacattgatagatgcgttgatgacattggaaccacattgctggagtctgatggcagtgtttcttcaatataacactgccatgtagaaaggtaaactgctgatattgatgtgaaaaattgatattttggattctcaatttcatcctttctttttcctcctgcagactttcatagtattgaacaaagggaaaacaatcttccgtttcaatgccacacctgctttatatatgctttctcctttcagtcctctaagaagaatatctattaagattttagtacactcatatccttttaaaaatgattacatccagtggcactttatggtgtaatttttgctattttattcaaatatagatgttataccttttgcaccttgaaagactctggttttagtttattaatttcagtattattaatataatttgtcatgggtctcagagaagactgggagagtggcaatattaagattttaggatatgttacttttatttattactctcttgttcaaagagacaaaatagtctacaagctcatttagaatttttttcttaggaaaagttgtaagcatttcaacaagtgtcatcctcaaatatttcaaattcccactgtcgtctcttttgttccttgattctaagctaccttattcagcatgctcatcatgtgcactattctgacaaactgcatatttatgaccatgaataacccaccggactggaccaaaaatgtcgagtaagtgggtataagtacattttaatatagttttggtattatcatttcatcctttccttttcctgccaggaagttactgcatttatgaagatggggaatctttaccttcccatgttatatgcttgcttttcttttgttctttacctcctctatgatattaacctgctagattagaaaaattagatgctacagtgttttctcaaagaatgaacttgtcagatgctccatcctgttcttagacatgttacacatattttattcttgggtgtatgttttataattatatgggtgtatttttaaatgattgggtgaatttttgatagaagcaatgtaggaaatttttaggcagatctgagacctatattcttagttatttcaagtacctctgctttctgggagtgtttctgatattgacattttaatattttctggatagacctattgtagtttaatagggtgtgtccataacccaacagccatcctccaatatatgtcttccagtggttaattagagaaaataagttataaagatttacatggtggttgtattcttttcacatctagtatcccaatggaatcttgtgtttaggtacacttttactggaatatatacttttgaatcacttgtaaaaatccttgcaagaggcttctgtgtaggagaattcacttttcttcgtgacccgtggaactggctggattttgtcgtcattgtttttgcgtaagtactttcagctttttgaaacggcaaatttatgaaaatctcaggcagcacagtgttccaataacagcaaacctctggggtctgatttttccagcatggaatgtctgtatttaaaggaaaatggaagctatatgaaagctagtcattgataggcaaatactaaatttttcaaaaagactatctcccactcagaggtatgtgacatcattgagattgatcatcttcctccatgctcagcacttggatggatagtctatgcagtgccaattaggtttacactttttccaagttcttgtttaaaaatgaataaaacctataagaagcacacaaaaaactcaggcctttaaatacaagtacagtgctctttatattaccctgtattattcaattattttatatttttgtattaaaatataaaagtatatatttgtaaaagagctgtcactgcttactaagcctaagattaatgcattgtatacacattatatatacactcagtttattttcaaggaaaatattacattacagtataattttaatttattcataattgttactcttttcccaaatgtatttatcagaaaaatggatttttacaatctcatatctagatattctattttccgttaatgactttgaattatcaaagtaatccaggttcactggagccacctagacaatacagaagggtcttaagattcctaatatccgattccttcatccctgcctaacctcttttccatcaggctccctccttttgaggtcacatatgatggggcagttccatctgctacctgctgctaagaaaacattgtgcaaagaagactgcctcttctcataggtctcctttttttcctattggtacaattcaaatactacaaaattcacaattttaaagtatacaattcagtgtttttcagtatattgacaaacttgcgcaacatcaccactacctaattagagaagtttaacaaccccaaatagaaactctgtactcattagcagtcacttcaatttccttctctccctggccccttggaaaccactcatctatgttttatctctatggatttgtctatttggatttttttatgaatggaaatatcaaacagtatgcagccttttgtgtctgacacttagcatactattttcaatgttttataaaaaattaaaagtctaaattaccataatgttaagggtccaacaattgaaacatttagttgtttacgcatttaagtgtatgaatccaatttaataatatataatatctgtattttgtttgcatcaaatgagtcaaatcaatgctaattaaattaagttagttatgatagcaaaaaagacttgcagaactatacatttaaaatagaagccccaaacgtagaaaataccttgactaaaggctcaggtaagtatcatagactctatctaaattctgaataattctgatttaattctacaggtatttaacagaatttgtaaacctaggcaatgtttcagctcttcgaactttcagagtattgagagctttgaaaactatttctgtaatcccaggtaagaagtaattggtgtgaagcattaggccactcataactccaactatttgggagttgttctttgttcgtttgtgtgtgtgtcgtcactgtgtgtataaactcccctattacagatatgtgacagagtttgtggacctgggcaatgtctcagcattgagaacattcagagttctccgagcattgaaaacaatttcagtcattccaggtgagagtggggttaaacaccagggctgactttgatcttttgaaagaaagacataaaaaaaacctttctttatgcaattttaattaaatttgatttcttctgttttccacaatcattatcaaaagtcaacctttgagtttaatcaattgcatgggtctttaggatgaggatgactacttggctcacatctcaacttgaaatcttccctcctgtctgagggtttgtttttccatttgcttatacaggaaggaaaatttcaatccattttaattgattttaaaatacttaggaaagagatcataaatatcagcatggggatattgcatgacattgttttttattttttctcagcaaaccatttctttattgaaaattattacaaggtgtcactatatgctgtaatttgttttggtgccatttatagagaagtggtttgtttgacaaacattagaacttacaaaaattatttttaaagtggtttgaatagccaaattgttcattttgacaacctaggtattctttgagaatatgttcctatttttaaccatttgctgtaatatataaaaacaaagtatatataaaatagcaaacccagaaggctttttttgaattaggttacttaaggtcattgatttgatataatgcatgactttctaggaaagcttgtgttttttgtttcgattcagaggctttatgtcattacaaacacttttttctcccattttcaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaagtaagaatgtccttgcatttgttattaggttgaaataatgctaaaaacattgctctcttttaataatgaaatgttgctttcattttaatcatttcaaagctattcaaatatatagaaagctgctacagtgtgaatttgggtcatgttatatatgattttcataaatcatcctggttctaagctatctagcagtactggcaaaaggaacacaggatagttccataattcctaatttctatatcataaaaaagaattattttctctagagaaataaatgtagccttgaattaataacattaaccattacatttaacaatataatagattatatattttatataattttattatatagtacatacttatatttattatatataatgtgacatatttattatgatagatttttatacttaatagattgtactcataactataacatcttaaagttctattaatcatatataatgataatattaattatcaaatataaagatagtatctgtatcttgatagtattcctaaagatttgtacaaagcaaaatcatttgctcagctttatcaacatccactttgtaaccaatgacgagtttcatagctgtttttaatggcttccttcaatataggctgatggcaagatatcaaagtttagttcagtagaattatttctgtaggtaccacatgagatcatctgtatgcactctcagaagtctgcttaattcagaagtatcaattagagtttcttacataaagcatgaattgaatgttctctaaacaattatcccctagcatggtgtctctcactggaacggttgatgaatattggatgaagatatgatcaagattgtactttctgtctgacacctggaatgtatctatctgatggtgcccacgtgaatacataaatcttaatagataatttgacccaggtgtggtatggaagtcacgaaacctttcaaatatatgtgctgttgccaaaaggaaatgagggaggaaaggtcaggattctccttagataataaaaagtaatatacatcattttcttattttaccaaatgtgtcctttctcactcactgtgataaataaaatcaaataacacctagcccacatggtaaaagactataaataaaatgacagaaaaaaatagaagccttaacaagaaaactgaaagttttgaagtaaaatgtttagcatatatatttttactaccaccatttgatgaggaatttagcatattttccccttctttttatatttaccctcttttccagtttctgattgttacaaacatgatttgaaacttatttccaatggatggagaattttatttcttaatttatatgctgtaaaattaatatatctgatgagtaacttacatttaatattgtagattattttaccacacttatttaaacttaagttttctcactgggatctgtccttttattctgagtcttgctcctatttctgagtttatactgtgaatggttttcttaacctttgttaaaagaaaaattttcaacaaattaaatttagcagcttatttcagcaatgaaatagtatttattgctgaaataagataataataataatgatttaggcagcactcagaaccaagagaagttcggagagctcaactcagcaacatgagcaggagtatttatagacagaaaaagggagtgacgcacaaaaacagcttgattgcttatagcttgacatttgccttatgtggacattgtctgataaatcagcaggctgtggttggctgaagctcagctgctgtgattggctgagacagctacttgttacaagaatatactaatagattagaatgcaatttgtttacatatgaagttagattgcaattctctatgtacacagacagcctttaatcaaatttaatttaattcatcgctttctggaattgcttcatgtatttttttttttttttgctaaaaaataatacaaaaaaagaagaaaaaaaaagaaaccccgtctctactaaaaatacaaaaaattagccgggcatggtggtgggcgcctgtaattccagctactcaggaggctgaggcaggagaatcgcttgaactcgggaggcagaggttgcggtgagccgagatcgtgccattgcactccagcctgggcaacaagagcgaaactgtctcaaaaataaataaattaataaattaataataataatagagcccttgagttatgtgaattatctttatattatatttaaacatgaatgcatgacaattagctaataatgaatcttataccacaatcctgtcttccaaatctgtacattattctttattttcttctgaaatgtagttttagtgaagaggtgtttaaatcaagtctgaattttgcttctgtttcctatgtcatagaagccatttttgactgcataattgattcaaactttcatttattggtgcgtttattacatggtttccctgagctatagcaataaatgatagcctcagcccttgctttcacagagcttatcatctagtgggaatgaaaaaaaatgtttaagggggaacagacaaataaattaaaaatatctcaagttataataaatgccatgcaaaggaagtgagtctcaggtgctgagatatcaactagatgagaagacatctctgaggtgatggcatttaagctgagatctaaaagatagtaagaagccataaaatagtttaagtgtgggtgtgagtctatgtgtggggggtgctgcttcaattaggagaaatagcatgggcaaaggtcctgaataaagggagggtatgggtttaaagaatggaaaaacagcagcgtggtttggtaagagaaaggaagaatggcaacagagaaagtagcagaaaaaataggggtcatatcatgcaggacatttcagcccatgggaaggagtttgtattttattttaaatgcagtcatttttattgctgtctgtcttgtgcacaactgattgagcaagggtagatggtagatgggaataagaaaggtaagttgaaggttgcttctctcatctaggcaagagaaaataaaggtttcatctagagtgatggcagagaaatgaagagaaaaaagatgagctcaacatacaaagtctgtagagcttgctgatggattaaagaagacaggaagcattgaggatgacttctcagtttctggctgcaataactggatgggtggtgatggttaatgaggaaatggtggacacatttgtagaggaaggtcactattagctagctaaaattaaaatgagatgcctttgagatgtccaggtggatatataatatagagaattggagatttaagtatagaaatcagagggcctgctgagtttggagataaattccagagcaatcagcaaaaagaaaggacacacacacctctacctctgaacatccctgatatttttaagtagatagagaatgggaaacctggtatttaaagcaatctggtaccaagatctacaactctgacatttagaattcaggtagaaaagaggacccagaaaagaacacagagaaagagccgccaataaagtaagaagcaaagatataaataatgaagccaagagaagaaaacatattgtagaaacagatgtgcttgtgtagaatcatgctgcaagatcaaggagtaaggatgatgaagaaagaaatatgcattaggttaagtaacagggaagtcatcagagaatttcttgagaaaatttgggtaagtggtagggttcaaggtaagaataaggtgcatacaggggtgaaaagaagaggtcagaaagaaggtaatatgtgtagacaattctcccaagaaatttggctataaagggaagcagaataatggggcaaatggctggcatttaaaaaaatatatgggtttttgtatggatgttttgctagtgataatgaatgagtagttatatatgaatcaattcaggagagagagggagaagtcaagtcctcgtgaaagtgaaagagtaaaggggagcgacagctccaccgaaacaggaggaaagatagaagagaagactgcagagttatcaaaagatgattgagttcaaacccaatggtttttatttcctcaaagtataagatgggatcattgcctgagagtgcaaatgaggaagagaaaattctacagatgatttgatgagaatgcattatatatatggtcatatcagggcatgagaaatttagtgtattttgagtgcaaatttgatgttggagattacttacttaaaatataaccattcacttggttgtgagagtttctccaccaacattcagccatttggtagccagcatggaaaagacagatgccagattatgtgtagactgtggttctgccaggttaggcactgatgataatgaatgcccatggatttaagctgtacaaagagtgacaagaacttggttgatagatcatgagaaagtgctaaggcaaatgaattggcaatatttaaaagatcaaggaattataatggtaaaggcaatctacacagagaacctgagcataatctaaaagcattttctggtgcctatagcaaagtattttccgaaatgcctttccaaattcacaatcaaataaattaacccactgtctcacctcctgctgaaaaacatacaatttgtagatttcctttggtgttgctgtctactttgatgctcatcaaacacttttttatgctgctacagatgaaagtggggttcatgtgcacagtgtgtagctaaatgtgcagtattatggagaaatatactgtggttatattgggctaaaacaggatattctcttcctcctgtttttctaatatttgacatttaatagagaaagttttgaaaaaaccgcaatattggccttcactactaacaggaattttcctatctccttcatctacagctgttttcttgtgagaactacatttgccagagtgtagagtatcatgtgcaggccctctgcccagtcctgatcccctgcactagttttctcagagttgcattatttgcccttcgttggggatatactcttcacttccataggcccaagccatacacaattgtcataagttgtctttctgagcaagggcagaattaccatttttttttctattttgctacattaatcttgaaaattaatttaaaaacttcacccagaatcttcattagatttaatatcaattctgtatttttgttatatcaattttcattttccccatacgtattttagtgataagttggcatttatttacccccacccacaacctttgccgttatgctgcattcccttttaaaaataggtttattgaggaataatttatatgccacaaaattcctttttttaaactgtataactcattttttaaactatactcagagttgtgcaacgatcgccactatctaatttaaaatattttcatctttcccaccaagaaacccagggcccgttagtagtcattccccatttcccttttctcccagcccctggcaaccactaatctactttctgtccctagggatttacccactctgtagatttaatatacatggaagcatataatatatggctttttgtatctggcttcttacacctagcataatgttttcaaaatttatccatggtatagtatgtatctatgcttcatttctttttattgctaaatgatatttcattgtatgtatatgctatattttgtttatacattcatcagttgatggacatttgggttatttccgtcttttggttataatgcataatgttgctgtaaacattcatgtacaagtttttgtggaaatacattttcaattttcagttctcagtatatacctagtagtgggattactgagtcatggttctttttttttttttttttttttttttttttttgagatggagtctcactctgtcgcctaggctggaatgcagtgtcgctatctcggctcactgtaagctccgcctcccgggttcacaccattctcctgcctcagcctgccaagtagctgggactacaggtgcccgccaccacgcccagctatttttttgtatttttagtagagacggggtttcattgtgttagccaggatggtctcgatctcctgacctcgtgatctgcccgcctcgacctcccaaagtgctggcattacaggcgtgagccactgcgcccggccgtgattcattctttatctttcagaatcatcccacttttgaatatgcacaagcaatatttcatttttctttgcattcaattttttcccatttttaaagatgttaaccttaaatcttcttgaagccaaccatcttaataatttaatgtctagttgtttagaaattattgtaaagttttctacaaacctagagtgagctacctgcattgctttacctttcatcattcttatactgtgttaaatacagtagtatagcagtgtgctaatagacagctccagagcccattcatataattcagctcctcagtggttgataaatgtgaaccagcattagtttaaaggataattctaaagtaatccatccttattaaaatattttggatgtttatgtatgcaaaattgcatcttatcctctcccatactcactctaccaggcccatccttcccgaggttcaggagtgttttcaggaaagcttttcatgcacattttcacctacatttgcacctcaaactgcaaggctttattgttttatctgtgtcttctaagtaagataaaatgatgatgtgtaattcaatcaatagttttatctcaaattgtataatagtttaactaattataataactcctgtttttgagcagctagtacagaatgtgtggatcacagtatcaagtggtttacatgcaatatcctatttatactatttaacaactttataaagtaggtattcttatacgtattttacagatgcagcagctaaggcttaatggcttaaagataattcacttacttaagaagggatagaagcaacattcaaatccaagaatatctgatttcatagtctttcttccatgattactccaaaagtctcccaataatcagattttttaatttgacctgagtaaaataggaagtcaggttcttatagtagaatagatatttaagagagatgacaaaaggttttttagtcatttaaacatttactatacaaggatagatctgcccccagtcttaggaacaagccttaacagcaaatgacagaagagttgatgagaacttttactactaaaaattagcacaaagaataccatgaaaggtgaaacatggaaaatctgcattgattacattgtcatctcctcaacacctagaattagtaggtcctaagtaagtatggactggtgaatgaaaagtaagataattttagaaaacaaattttactcacttatgttactgccttactgagtctgcctcttccggagtattgtaccacataaggatgttttagtcaatagcggaccatatatataatggtgatctcataagattataatactgtatttttttactgtaccttttctgtctttagatacacactttccattgtataacagttgcctacaatattgagtacagtagcccactctacaggtttgcagcccaggagcaataggctataccacatagcctaggtgtatggtagcctataccatctaggtttgtataagtgcaccctaggatgtttgcacaaggacgaaacgtcctaatgatgcatttctcagaatgtatcacagtcattaagtgacacatgaccgtacctttaatcatacttaaaatccaaactcatttctatgatatgcaaattccgacatgatccggcccctgcctacctctgccatcacaatcctccctctcaccacactgtagccacactggccatcttgctggcttttccacacaccaacttcatctctgccttagggctttagttctttctcttcccccagcccaaatatctcttcaccagtattttcatggctgtcttctttgtcacacttaggtcttagtttaaatatcatctccttagaaagaccgtccctgactgcagcctaccacgttgccttaatttattttctttagatcatttatcactatctgaaaatatcttgtatatttatttatttacttaaatttttatccaaccacaacctccaccctcacctaaacataaaggaggtctcataaaactaatgattttatttatcgtgtttattgtcatgtttattgcctagcctctaagagattatcaataaatatttgagggagaatatatgagaaaatagtaaataaatggatgcatattgcctgggaccaggcctgaatttgtagataaatgtctatatcaattaatttacctcctttatcacaatcacagattaaagtctgtgatgttataactgttcaaattcttcttcaacagaatatttttattacttggaaggatccaaagatgctctcctttgtggtttcagcacagattcagggtatgtaatatttgttttctttttagtctaaaggctgaaagagaaggaaaagaatgttcagtcagtttgcaaattagtctttgattctatattgctttttatatatttcatggtattatttgactcattctgtcccacagcaaatccagtctttaaaatgttcacagttaatgcatactcttgaaagcaagactttgagacagtgctcgaattaacacaagacagaagtcatataaatcttaagaaggtagaaaatgttacttctagaaaactccaccaaaagttggttggataatttcaggtcttctttctggaaaacgaagagtcacaaagtctatttttctttctactcccaagttccactcattctccaattaaatgtgactcataggtgactgaatgtcatgttttggccactctaagcaaagggattccttggacttgggtacacatattttaagaatattgtatatataagaatattgtatatattcaactgtccatcttgctgcttctctcttacaccaacttcattttgtagcatcagctgcataagctcttgcttttccccctatgcagacatctattcatcaggctctgtgtacactggcaacataggaataaactggataaggttgctgttcccagaagaatctcagaatattgtatttatttaatggcatcaggaaaaaccagtccaccaattttagaaagaaaaaagtcttaaagctgcacatttttatgaacttagacaattactatattttgactattattgactctaatctattccaagaattatacagacagaaagagctttggtaacagcctacatatcaatatttactgaaccaagaactatcacaaaacgtctgttgaaaatttccatgttttaatgatgatgatgctaatggcagctatgatttattaaacactttctatgtgcaggatgtaagctaagtaatttgtacacattatcttatttaaacttattacaagtcttattttcttgaggtagatgttattatcctattttcacagacagacttatgccttgaagaatttggtaaagtcactaagtagtcagtagccaaatcatgtattcttaatccttattcaatattgtccccctatagaagaaaccttgagtttgtaacttttcagtaaggctatttagcttgtgtcctgaagacactctcacctataatgttctttctcgtgtgtagtcagtgtccagaggggtacacctgtgtgaaaattggcagaaaccctgattatggctacacgagctttgacactttcagctgggccttcttagccttgtttaggctaatgacccaagattactgggaaaacctttaccaacaggtgagtaccaagagaaacatgcattgtatttttgaatggcatatgtacctggtgtatgttaagagcctgtattaggaggttttttatttatttgagaatggaggaaactctattatcttattaccaaaattataagtgttttactcccatcactaataatatgggtagttctcgaatcataaataattttcttatcttttctgggcatatttaatctctagatctctcgccttcctgagtatatcatcccatggggtcctagttaagtaccaggacatactgtaatgttttctcaagctgctcctgcacatggactgttttccatgcgtgcttgggatggcctgaagagaagaggctctctgatgttcacctgctcaccatgttttatttttgaactcctatttaaagttaaagatgcaattcatttctctaagtttttctctcccaaatcaattgctcccaactgtagacttccatgattttttgtattttcttccatttatatcattgatctcttgtattgcaagtggtaattcatgtggctatttcctctaacttgaatgtgaacctcttggggctgtggtctccatttacttgtatagtctcagcagccaagccaaaaggaaggagaccaaaatgattattctatagtacacataacaatgattcacttttctcagaatagctgcagatctgtttttttttcttttttggcctattttatatttactttatttccgagaatattataaatgaattcggaaattatgtaagatgcactttacagcaaaaatgggaatgcaaatattttttaaatatgcaagaagtggtcacctttactcaaaattaaagaaacacaaataaaaaaattaaaataatttttcatcagaggtaagacttatttttcatttaatatcagttgatactatcctaaattcactttaaaatgctttgtatgataaaagtatattacattatacaattattaatagaaatgttaattatcttataaatttgtttaagttacttgtagattcttaatattagacctttgtcagatgggtagattgccaaatttttctcccattctatagtttgcctgttcactctgatgttagtttcttttgctgtgcagaagctctttagtttagttatatcccatttgtcaattttggctttggttgcaattgcttttggtatttttgtcatgaagtctttgcccatgcctatttcctgaatggtgttgcctaggttttcttctagggttttcatggtttggggttttacattaagtctttaatccatcttgagttaatttttgtataaggtgtaaggaaggagcccagtttcagttttctgcatatggctagccagcttccccagcaccatttattatatagggaatcctttccacattgcttgtttttgtcaggtttgtcgaagatcagatgcttgtagaagtgtggtgttatttctgaggtctctattctattccattggcctatatgtctgtttgggtaccactaccatgctgttttggttactgtaacctcatagtatagtttgaagtcaggtaggctgatgcctccagctttgttctttttgcttagaattgtctttgctatatgtgctctttcctggtttcatatgaaatttaaagtagttttctaattctgtgaagatgtcaatggtaatttgatgggactagcattgaatctataaattactttcggcagtatggccatttacatgacattgattcttcctatccatgagtatggaatgtttttccatttgtttgtgtcctctcttgtttccttgagtagtggcttgtagttcttgaagaggtctttcatatcctttgtaagctgtattcctaggtattttattctctttatagcaattgcaaatgggagtttattcatgatttggctctctgcttgtctattgttggtgtataggaatgcctgtgatttttgcacattgattttgtatcctgataccttgctgaagttgcttatcagtttaaagagttttggggctgagatgatcgggttttctaaatatagaatcatgtcatttgcagagacaatttgacttccggtcttcctatttgaataccctttatttctttctcttgtctgattgccctggccagaaattccaacactatattgaatagcagtggtgagagagggcatccttgtcttgtgccagtttttaaagggaatgcttccagctttttcccattcagtatgatattggctatggagttttcataaatagctcttattattttgagatatgttccatcaatacctagtttattgatagtttttaacatgaatggatgttgcattttattgaagaccttctctgcatctattgagataatcatgtggtttttgtcattggttctgtttatgtgatggattacatttattgatttgcatatattgaaccagccttgcatcccatcaaaaagtgggcaaaggatatgaacagagacttctcaaaagaagacatttatgcggccaaaaaacatgaaaaaaagctcaacatcagtgatcattaagaaacgcaaatcaaaaccacaatgagataccatctcaagtcagtcagaatggtgattattaaaaagttgagaaacaatagattctggtgaggctatgaagaaatagtagcacttttacactgttggtgggagtgtaaattagttcaacaattttgaagacagtgaggcaattccttaaggacctagaaccagaaataccatttgacctagcaatcccattactgggtatataccgaaacgaatataaatcattctactacaaagacacatgcacacatatgtttattgcagtactatttacaatagcaaagagatggaatcaactcaaatgcccatcaatgttaaattgtataaagaaaatgtggtacatatacaccatggaatactatgcagccattaaaaaagaatgagatcatgtcctttacagggacatggatgaagctggaagccatcatcctcagcaaactaatacaggaagagaaaaccaaacactgcatgttctcactcataagtgggagttgaacaatttgaacacatggacacagggaggggaacaacacacaccggggcctgttggggggtgggaggcaaggggagggagaacgttaggacaactacctaatgcatgcaggtcttaaaacctagataatgggttgataggtggagcaaaccaccatagcacatgtatacctgtgtaaccaacctgcatgttcttcacatgtatcccataacttaaacatatgaaaaaaagctcatcatcactggccattagagaaatgcaattcaaaaccacaatgagataccatctcatgccagttagaatggtgataattaaaaagtcagaaaataacagatgctggagaaaatgtggagaaataggaatgcttttaaactgttggtaggagtgtaaattagttcaaccagtgtggaagacagtgacccagcaatcccattactgggtatatacccaaaagattacatatcattctatggtaaagacacatgcacacatatgtttattgtggcactattcacaatagcaaagactgggaaccaacccaaatgcccatcaatgatagactggataaagaaaatgtggcacatatacaccatggaatactatgcagccataaaaaagaataagttcatgtcctttgcagggacatggatgaagctagaaaccatcattctcagcaaactaaaacaggaacagaaaaccaaacaacgcatgttctcactcatgagtgagaggtgggcaatgagaacacatgggcaatgagaagatcatcacacactggggcctgtcggtggtggggggcaaagggaggaatagcattaggagacatacctaatgtaggtaacaggttgatgggtgcagcaaaccaccatggcacgtgtctacccatgtaacaaacctgcacgttatgccaaaaaaaagaaaaaaagaaaaaaaaatctctgtaccttcagtttaattttcctctaatcctaaaactattttgaaaaaaaattctattttaaaaagcaaagaaagcgaaaaaaaaagttaattgaaaatacctatgagatgaataaagtaattaaataagaccatctgcctagtgttaacattcaatgatattattaatatttgatgataaagaaagaaaagatagaattttaacagtaaaagggactatggatatcacctgttcctaaaatttgaaagtgagcaaaggatttaattttatgagtaattttcagactgtaggaaaaaatgcatgatttttatactactacacttaataatcaagaatcttacatgactttagtacaagcatattacattgctatattcttcgtactgaaaatgtgtttaatatttgttttccatgaagatataacttttctctttatatttttgataacatgagattataccaaactgtcagatttgctcatgcctgtcaaattgaaataatttactaaaaaaactttttattgttcaaatgacaatttccatttttccctagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggtactgttatttgatttaaaattcttcctagaggtagaaatgcaaacggttacaacagaggctctgcggtatatgcttggccttctccagctagattttctttaatgaatttttgtgtataaactgtatcctcatttctggtgtggaaaaaggaaccaattctgggctgagctagaattgatactttccccataatcatctcactgcatgaaaagtgatctaaggctgttcctcttaaaccttttacctacaatgacttagtgtgtgtgtgtgtatgtctatatatacatacacatatacatataaatgtgtgtgtatatatatatatatatatatatatataaacacatggaactatgtgtttttttaaattattatatcatgaggaaaaatcttttagaataattgattaaataatatagtcagatatataatatatatataatctcaatttatatatatatacaatatatatatgtatatatatacacacatacacacaatggatttccccagagtaccaattgtatacagtggtttcatgaaaattattttaacgttaaaattaacagatactcttctatggggtatgactaaaacagtgcatcatgttttgttaatgtcacaaggatttttaagataaaacatgagatattaagaaaataattttggtgtggctaatttaggttgtcatagattctcgaaagtttcctccttaatcctctttccagagagattcttcagtgtaaatgtttgagaaggcttgtactaagagaaacataatttcaaatgtactgcagttgccttaacatttgtctgaaggtttcacctagttaaatctcttcaaggagtctaatgtattaggggagggcaatcatctgcaatgcagataaattctgatgcacaaatattcagtgcagcattttaataatggtaaaaatcagaaaaaatttaaattttggaaaattagaaaataactaagaaaattatgaaaattgtatatcttaaagtattattttgccatagaactatgtgtttttttaaaattattttatcatgaggaaaaatcttttagaataatgatggattaaataatatagtccgatacaatctcaattttaaaattatacatacatataaaaagaatggaagaaatattagcaccaattatttctgggaggtaagatgactttttttctgtttttcatttatatctttatttcccatgtttttacaagaattttttagtgtttataaacaaaacattttgtaaagggatagtactaggttatcccaggtactacctagggaattcccagaagtttcatttaggccaatagtcattgaccttaccactttcttacaatattatgctttaataattcatttatttttcaaataactcaatctttattaaaccatagagtgcctgattctattgatgatatggagttaattgcctgataatcaaattgtctgtcttattgcatggtttatgcgagttttacattccaaaattaccttgtaaaactttaacatataatatttaatttgtctttactgtaagcaaattaataacatgtaatagtttaattctaaaatacaatagagctttatttcaacctgagacaaaaaccaaatatatactttgtaagcattctgatcattgtgtaaagaaaacgatcatttcatgtttaaaggacatgattatatgcaccatgttgttatgctaataggtgaaagatgtcctgtcctagggtttcctaggatttggaaatgactcatttaagtgttaacgtcttggcccaaccaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcaggtaccacccaaattgctaaatgtgtatcacccgaggcagaatgctagagaaaaatgtcttattttagggtaagagaactcgggagaggatagtgagtgatttcattggtatgattttaggtaaaaacctagtatcgctaggcatttatggaaagatgtacacaggtttccatttgggttcaatcatttttgaaagaccttatagtttcagaattgtcaatatattctctaataaactaattttcagaagcaaaatgttcctgagaaccattgtagaaataaagagaccattcacactatagaataacttttatatttgtatttagtctgtgttttgtaatgcttcattggttaaaaactaatcttagactagtttctcttctttcttaaacagtataggtaatagtatcactcacccatttggaactttggagaagcctttgatatcctccacccccaaccacatcaactactaatatgtagtgccatagtctgttaattctgtttatgtggaagttctctttccctttctcttttcactgaaaccttcatctctcaggcctccctgcttataattctgcacaaatccccaagatgaaccattgcttctgttttccttaggtcttccctgttttccatcacacaaccccacaaatcacttttctaaactaaaaatctagttaaaaatctacaagattctcctgatatacacagtaaaaaaagatagagtccctgccttcaaaatttcacttgaacctaggtgatgatacagaacttggacacatatatcaataaaaataaatatgacaggagcagtccaagctggttttgaggcaaagaccttaccatactttttccattgttcacaatagttgccactttgttctttacatagtaagcactaatgtctattgaactagatccttccaaaggatttacaccctggacatgagtcatataagcatgaattgaatttttcctcctctttggtattgggcaacttctttttaaatatttaatgactttataaattaactggtgctaaaagctctctttaaatacactttaactgagctcttagtatgtaaggtggattttcaatgcaaagaaccatacagcatgatttccaatttttttgtgaagcctggggattgatatataaaaagttgaatgaccagtagcaatactaagttctttttttaagttataagttctgtgcagcaaaatgaatggcattaaaagaatggagcagtaactctaggccagaatattagagagctgtatagcaacaaataatttacctggtcctgaaaggatgaattctacaaattgtttcatcccttaagtggaagaagttttcttctcactgaattgcttcgtttttaagtatgtttcttttaagtcagtacagagccacctgccctcaggccagtgggttcagtggtatttatatgaagtgtacttctatcagtaggtgcttcagcaaccacgttttttttaatttttctgcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagaggtgataatagataaggcaacttctgatgacagcgtaaggacgttttacatagctcaggcatggctgggcccttgttcctgcatcagtcagtctctctgctgaagggccttctctggtcttgtgaatggctctgcattttgcaatactttttctataggaacacacctttgattcattagcctaatcctcattctatgtgttgtaggcatctaactcaaagataaaatcccatttttgtaaaaaggtacttgtctattaattttataattgaagattataaataatctctttagagaacaatttatgacggatacatatatagatagatatcagtacagaaaatgcaaggataatgctgatattagttaataatagatcccatttctatgaagaaatttggattacttgccagctactgctatctttttcaggtcacagcttaatatgtacctattccaaggaatcttatttgagttgttaataacagcaaacacatatttagtatttatgacaaccccatgagatgatacattattatctctgttttacaaatgggaaaattgaggcatggggaaatgaagcaacttgccccaatttactcagctaataaatggtagctcctaagttgaaacggaggctgtctgtttcagatcttgtgctcttaaccactcactctgctatctctccaatgtgcagtaggcttcttatcttgaaaaaatttagaatggctatgtattaggtcctccatataaatgaaacataactgttttcatttttaaaaaatatttcatctggagtctatgaatcaaaacaaaatatctgaaatgcaagcattgacacaaacaaacataaaagcaaaacaatcattttacagcagttccaaaggtctacgagtcactaagtggttagagaaaggtgtctgattaggcttgaaagtgagatctttctcattcctggagtttccaggatatctctttagcccactcactatgctatgctgcattaccaatatcagcaagggctttgactaacccaataagcttcaaacatatgctacatgcttatatatttatatttgcagacaatgtagtatttcaagtgagagtaaagttccatcaaatccatggccacacatatatttcaatttgaataaatgcatgtgcttttaggtaacatgtgacctctatgtgtgcatgatacagcttaagcccttctgcaaggtatttttcattattgaatgagcatgttaaatttctgtggaatcaaactttgcttgcattttgttttgcaattatgtgtgtaatatgtaaaatactatataatttatatcagattaggagattatttcatatttttaatgaagtttcttcatttaagagttttttcaccatagaaaaatcagtatcacaataaatcctaaagtgaaaactacaaaactagaggaattagtggatacttataagatacaatggaaatacagtaaacataaaattgtggcacaatatatggtttatatgaaaacactgcataactaataacgtcatctctatacctgaaacatgtctacatggaaaataatttgtttaatctgacaaattcttgtttgacagactatagcacagaaaacctggttttcgagacttttcaaaaagttgactttttacagagatctctcaaatgggtgtgtctgttcacatacacatagatgcataatacacccatgcacatatctatgcctgtatgtctgtgttttgatacacatacatgcatgactatacctatacaactatacaactttacaaatctagaaatatatatttaaaatatataccacataccacacacaagcagacaaacatgatagatctagagttgtatagttgtttgtgtatatatgtgtgtgtgagtgtgtgtgtgtatttctggcctgcatggaaccaacatagtgttttaaatttgaattagtttccaagttttaaaaataagacattttctcacaaaaataaatacacttgttatgcatgagttcatgtttttgcatggcaacaatttctagagctgaagagaggtcacctctttcagatgtagcttgcattctccatttcactaattgttcctttcaaactgagtcatttatcatcatatgctctgctcagttcatgaggtcttccttggcagtaagagacaaccattacaggagcttcattaatgttgttccctcaataaaaagtaattccagaaatttatcagagaatactgagattctacccctttagatacacagcactacagcactttcactgttttcatgtaggactgtcacatgacaaactatctgaataaattgaacactcagaaaggcagagaggtgatgatagtgatgatataacaaaaaagcagctagctttattttttatctcataaatattaattcctttaatcctcacaagaatatgaagcaagcactatgattatccccattttaccaatataaaactgagacagttaagtagctctcctatgatatacagccagtaagtagcagagccataatttgaacccagcaatctaggctctacttttaattactcactacagctatataagcaagattttatcttatacctacaatttattaggattctgttcttaagacattaattgattttttttttagggcacgaccaatcaaatacacaagaaaaggcgttgtagttcctatctcctttcagaggatatgctgaatgatcccaacctcagacagagagcaatgagtagagcaagcatattaacaaacactgtggaaggtatgtaataatcttcttttactgtacagattcttaaataaaattaacataaatctggtcaaccttaaataggcacatgaaattcttaggaagaattcagagaccataaaatggttttaaatgatggtaaagataaccaatggatactgatggaattgtttttatgtgcttaaaaatggataaaattatttgctattaaacacagacattgataacatggcaaaaatgactttgcaaaatgaaaaaaagaaaacccacaaagacagatgttgggtgatctgacctttcaaagataagtgatttaatagtaattgatgcagaaaacaaggttaacccagagctacgtgattctgtcactatataatcttacaaattacatattcgctcaaaaattgtctcttctaataagcaaagatagtcaaagggtgacaactttacaaactgtgctggcttctaccctctcccctgacaatatgccccaggtcccacctggtccctgggtctaacacttcaccccccacattcccattgtgggggcaaagtgtctactcatctcctaaataaatggtgagaagtaaatgggctaatggtgtgaaatgtctatttcatgagtcctccataaattatttctagttgcttggttctaggattgttttcacctgtgaactattacagcaagagttttttctggacagaatagtctcatcttattgttgtcatgggactaaaaacacaggtgaaaaatatgcatattggtggaaaacatacatttctctgttaaggaaacatagttctcctgtttaccatcacatgttaggtgcatttttctctgaaagatgcccacatatgtgcttgcagtcataaatttcacttccttaccctctcttatgcttcatctaggcaacgaacatgtcataatagacttacataagaggctatgctttcattgaaatagtactgttaaattttcaaaatctaaactataaaccttgtttcaatattagaatgcctgactgatttgtatctggttaggagtgaaacagacaaatggctgactccatgttctctgcttttttctcccagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtaagtctcttattgtgtgttatgtactcatagtttctctttttagttgtcatcattgtcatttcatattttttatgtcagatgaatctgcagcctcagaattatgcatatccagaactttccatatgaatggatgtgtagagtcaagtttctggttatgtcttttaaaataattgtgcagtactgttgaggtctacaaataacaatactatttctataaaaggttaccatcttgggagttgataatgattttttctgccagcatatttcttgggagcaacacttaacatttttggttctttctcacaccttcctaattacattgctgctttcttgtaagtacacacctcacatattttcagaaaacctatggatgtattgctttgacataatagtagtgaagtgtttgggtcctcagagtcccaaagtcctgggtttgaatgctgattctgcattatatgagtgatatgcccttggacaaatattttaactctgtagtatttaattttatcatttataaaataatacttcattataaaataattatttataatataattgtaactgtatttcatttatcatattcttgggaggattaaatgctttctgcttattagcctggcatatagtaaatacacaataaattaaagctatcatcatcatcaacatcattgtcatcaaaacttcaaagacttaatgaaacaagctttaaaaacaactattttgagaaaccaaaatggttgaactggacatagaagactcaaggataggcaagaaggtgatcaacagacttctggaagatataagatccaattagtaaaattgatgccagagtgatctctaaaatgtacagtgctggtcacactaactcagggtaaacaaaatgccagtttttgactatggatgtgaggcaggcaccagttcatttttagggccagagaatctcagcttatgactcttcataaaccatgaataactttgggtatctttgtcaatgtctatataagataattttgcttttgctgtggtcccaaacaaattgacatttgaagaccagaagttcttttctgagtctgtcttttcttctaaattgtctacaaatattcccaatgtttttccccatgtgctcgctgagttagcattcttcttcccttctatttatctttggaaaaaggcaggaatatctagtttctaattgttggtggagatccggatcttgcaaataagtaccttctcactgagacgactgcatccctgtgaactcagaaaggatttacctggtcacagctattaccacaacctcaagtccagctgctccctgccaatcttcttgatcctgcattatttgaaaattgactcctgcagttatagacctaaacatttcccttagaatcttctttggtcagattccttgagtcaaagtgtacccaaaggattcatttcggtgttgcctttttaagtgagtcctttgataccagtatcatgaattaatgatattttgcaatgcacttttgtgtcaaagctttagaagtattactttagctgccacattgtcaattaaatacttttttctcttctgctgataaatctttaaagagtgagtcaacatgttctttattactctaacagtagtcagatcagaaaaaaaaagactggctcaaaatttcagtatcaacttatgttttctttttatcttcttccagaacaactttttgacccacataaattctttgaaaatagtgactgtgtcaattaccaaatgttttactcttctgaaattttaatatgctattctaaaatgctgtctaaaaatgatgagcactgacaggacagttagagcttttcaaccttttgatgctgatatgggagccagggaagagcaatacctaatttacaggactaagttagataagaatatccatttataaagtatttagcaaactgtctggaacacagtaaatgctaagcaaacagtgattattatcattgtgttgatttcctgttttctaatattaacagaaaaacattatttttctcacttaggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactggtaaacataaactaaggttgccattatattctataataaaggggtatttctttggttttgcattatttttaaaaacttttgggaatttgaatcaaaaggcaagattatatcttgatatctagtaaaataaaatccattcattgacaaatgcacttaaagaactaaaaccacatgaatatttttacaatttttgaagacatgctcaattctaatttgaagtacacgctaatataatataaatattttctattaatatagtacaataatttatttcagagtaagaagcttgtggcttacagaatttcaatgattatatgttcataactttatgaatttggtaattaaagatcaaattgttatcccccaaaacaattgttgtctgatcttaacaatataaaaacaaataaagactttttaaagcacattcctctaatatgctagattttatctaagtgtcggcatgagaaaatgtatgaaagtattagaaagtagaattaaggataaattatcaattctaaaagaaaaatatcacaaattatgataagaggtttctatagcaatcctgaactaaaagtacatagtttcttcataatatgtgttgtaattttttgtggcaagtggaacaaaataacagagatattgaaaattgatgaaaatgaaaaataagaatattttagctggataataatgacaatattataggacttaaagtctgctttaccctttgaacaaaaatcaagattggaaacattgaaaagattttcatagtgattaacattaaactttatatttgcttttagctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataattttaatacaagaaagaacaggaaagagaacgaaattttgtattagttttcctagccaaataacccatatttatatttttcaaaatcactgcctattcattttaaggcaaaggtttctatctttttctctaattttgaaagtgatggcatatgctctcttgaagctatactagtaaataaaatataattaagttaataataacaaaaatgaagttaataatggaccaaggcaaatgaaaggactggtcccgcaccttatagccatgtgtaagactagcctctatagcaaggatcagcacctatgccccacagaccaaagccagtccaatgcctgttattgtgtggccctgggagctaagaatgatttttacatttttaagtggttaaaataatcaaaagaagaataaatgacacatgcacattatatgaaatgcaaattttagtgttcataaactttattcaaacataggaatgtcaattcatttacgtatcttctatgactgcttttacattacagtggcagaggtgaatagctgccatagaaatcgtatgcccaataaagtctaaaatatttatcatttggccctttacgaaaaagttttccagccactggcctatagcatcgcgtggacatagcaatctgcctactttttgaattagtgttttcttggcttgtactttttttttattttttttcttccttatactgattagtgaaaactttcaagcttacaagcaggagaaaattgggataaaatgctcttctatgagccactcatctcaattctcaaatctgccacgttgacttgtcacagttggtcagcttgacatcaaatctctcatcaggtatccagaaggtgggatatggtaacagccatatggtaagtgccttcacttcccactgagttgaaaaaaattactaaaatattgttgtccttgtaaccaccataaaaagaggattcagaagtcaggacagaaacttacattcatccagtcacacactaaatgatactgtgccagacatacacaaaggcatttatgcagcacaaattctagatttttactgcacaaaaaatatacatcctggattaccattctataattgttgatcaccctcaagttgtagtaataaataagcttcctagttttatatagccttacaaattccttccaatatggaatgaaatgcacattctctttgtttcttcttctctgttttgtatttataagctcctatagcaggatttgcttgtgtattttttttttttttgagatggaatctcgctttgttgcccaggctggagtgcaatgatgtgatctcggctcaccccaacctccacctcccaggttcaagcaattcttctgcctcagcctcctgagtagctgagattacaggtgcatgctaccgtgccagctaatttttgtatttttagtagagacaggttttcgtcatgttggccaggctggtctcgaactcctgacctcaggtgatccagcctccgtcgcctcccaaagtgctagaattacaggcgtgagctactgcgcccagctgtgcatttcttcttacaaaattttgacataaaatcgtgaaattgggaaaggtataacttgtgaaaacatgccacatcaaagccaataatcacaaataatttaaatgtttattatttattcaggcaaattcaaagggaaaggcattcccttggctctcaccacattttccactcaatattttttagtatcttctctgtgaaaagaaaggtatttaggtattgtttagataggaaggcattgtttaggtattatttagggtggaagaccaaaaccaattacccatggtctaatccttgtttttaagatgcttattagggcacagaaaagtggaacacaaaagttatcagacaaggaagaagtgatgagttctaccaataaggttaaataaaatgcttctgacacttaaagaaagagttctagattgagacttaagggaggtttttgaagtgggcctttgaacaatggataatataatatttgatcatggacactggtgtgagagttatgttttcctttgaaaggcaatatagatttatagtaaaaaacagaggggatatattggtgagtgtttcattcgtgtagaattagtgttaactaactcatattattattctttaattattaattcttggcaaagaaagtatacagaagaaaattcataaagttgataaccaactcttgactaatggaggaactaccaatatcatagaattaaaatttaaggaaaaaaatatattcctgatatagccttccacattagagttatatgctaaactggcttctctttttttatatttctctaatttattcttttgatcattttattgccagttaattgaaatggttaaggaccataggtttaggaaaacatttggaaaaataagttttagtcagctcgggtctatatcaggaaacttgcgaagaccattaatcaaaatgagactttgaatcaagtatacattttattaatatttcttctcttgtttaacatgataatacaaagatgatacaaatggactttattttgatttgtgatacccactaggttatagaaatattagagacttatgatttttgaaggaaagaaagttgtcacagcagctgttctcaacgaagtgagaaccgcatgagccactgcaccctgttaaaatggtttaacgcttgaacagattaaggagactaaagcagtaaaatggaccctcagatcttcaccaatattcctattaaaacaaatatacacaaacatgtatttcatagtgaaatatactttttcattgacaactattaaaccatttcagggatttttagcaattatcaaaattgttcactatgattcccagacctccgacctccagaattttctcctaaatcagacttattgagacacacaattttagcctgctgtctttacttacatctcagagaaattgttttaggtatgaccaaaatgagggatgagtaccttctcttcagttaggtcttacttcgatttttaaaacatgaggtagatgatttgggccatgaaaagacttacatcaaatgccaattcaatttccttttttgtttcctggataaaacaatgtttaaatataatttacaatttacatgtttcctgccctctgtgaacattttttttttttacaatgtggagttgacctgcacttctacttcagtgagaaaaaaaaataattaactcagaaataaaactttgcttcaagagaatagaaattgtcctgaccttttttgtaatctcttctagggcaaacataataggcaatgaagccagccaatcataatgccattattgcatgtgaatcaggttcaaggggcaggtccttttctgtgctttaaaagtcacattaagcagtattctagcacgcttcttggacagaatattttattacaggaactttgtaagtattatgtgttccatttgttagaacaagtgacatttatcttctggtaaagtgaacaaagatctttagcacaatagaaaatagtcacaattgttttgttctacctgtttctcacaggtaataaagagtaatgatagatgaatgctaggagagttttttgggttcataaaagagaacttgattaaggcactactgctacagaaatgaacttagaaatgatgtaatgataatggtgagggatcattctctctgctccccatggtaattcttcctgggtatggctgaccctctgctgctgagtctgcaggggctagtctagggatacagtgatgaggagtctaccctcgcctctgtctctctcatgtggtcttatccgtgtgtgaaaaggtgcagaaatcttcgttgctggtttgtattgtggcctatattcggaaaagtgtacttattttattttattttttatatttcctgtctccctatttctctaccccctctccccaccctgatataggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtggtaagaatgcttcatatactttgtgtttcatattaacaattagtatgaaatgaatgaaaatttcatatttctattgtcataagttcttcttaacattgcatgtagtgatggatagtttttgtgcgtgactttacacaacagcttcctgaagattcatctggtaaagttttcttactagttcttaataattgatttaatcttacttagctgtatgagaaagctcaaaggtatctttgagccttcccatgcttcatcccatgtttcctgtcagttgaaaagttacacagtctccctccacagtgcctgtttgaatccacctctccttttcatcacctttcctttgtactcactactttttgcctaaaccatttcaagcagagtctcaactgatgcctctgcttccattttgcatttactctagtttacttatttgattattttcgctcatgcagattcagtcctaatcatttcactctcatgatgtatccatgatccgcaaagtatcgctctctctctctctctcttcttttttttaaaaaacggagacaggtctcactctgttgcccagtctggagtacagtggtgctatcatagcttactgcaaccttgaactcctgggctcaagtgatcctcctgcctccacctcctgagttgctgggactacacacccatgccacaacacccagctaatttttttaaaaaagtttgtagagacaaggtttcactatgtttcccaggctggtctcaaactactggactcaggcaattcttcaaactttttccccagttgctgagattacaggagtgagccaccacgcctggccatccccaaagtctcgaattatgtactgtgcacaaagccttcacactatggccctaaccagctttgaccagctctatctcctagtgctcacccatagatttttacctgtaccaaaccaatttccttttaggtcataaacactctccacactttgcttgggatttccttctccagtcaaaatccttcaaggcatcacccttgtatttatcatctattaaattgttaatacttaaatcgcagttgggtcagggttaaatgaattaacacgttaatacatgtaaaatgtttagaaccatactcaatgttctcaaaatgttatttatttcatccctcctaatttctccccaaatggatgtagtcccttctcatttttgaaccgcaaacaattttatacttcttcctggattcagtaatcttaaattttaattttttgagaaattatggtatgcatcaaatagtactgtaaattcattgagaacaggaactctttaaaacctttttttgtgccctcctctcccacccttacctgcatatttctagtgagtcaaggtatgtattgagttttatttttattgtgaaatataacaaccgtattacaaattacttttatgagattgctttcaagtcttaaggcatcatttaaaaataatcttttgttttctctagctcatgttagaaagtatttgacagatatttaccaaatatcttctatctccttaacttactaagactccaccctccatgaatttatagtggacttggaaaacgagattatatggaataatcatgactgatatatatatatatatatatcagtaaaatgctcaggaggctgaggcatgagaatcacttgagctccagaggcggaggttgcagtaagccaagatcgcaccgctgcactccagcttggactacagagtgagactctgtctcaaaaaaaatcaatacataagattaaattaaatacataagattaaattaaattaaaacaaaataaaataaaatgctctatatttaattgagtgaataaatgattaaataaataaatcatgatatatgtttctatgtagccaaggacattttttccaagacggtaaagtaaggaatcaaatctagtcatccctcgatatctatgggcgagtagtttgaaggccccccacagagactaaaatctgcagatgctcaattcctttatataaaatggcacaatgtttaccataaaacctacacacatcctctcatatgtacactttaaattatcttcagattacttataatgtaaaagtaaatcactgacacaatgtaaatatttgttttactatattttttatttgtactatttttattgttgtatttttatatttattttttccaattattttccatctgtagttggttgactctacagatgtgggacccagggatacagaaggccagctgtattttatttgtatattttaaaatgttctacatggaagaagtaatactcccaaaattttaaaaccgtgttcatttcagcttaaagttagaaaatcagattccacgtatgccttttaaggagcaggcatctaggtttagtatcatatggaaagggaaactaactcagtcacctatttttttctaactaactctgtcacccatttaaagaagattaaaattataaactccaattgcctggcagacagttgctctcagaataaaacttggattctaggtgttaaagcacttcaggagctggggaaagtcaaccaaagacttctgaaattatttcttaacatttatgaggaattatttcttacctgttcatttttctttcatttaaagtcaatggctgacctttcatggatctccttagctgctgacaaaattcttattcttagtatgttgagttgcaacatttttaagggaaccttatagaactttccatttagcacttcattttctaactgaaaaagcagactcattaaaaggaagtgattttattcacagttataaagctagagttatacagttataaatctagagttatagagttatacagttataaaggcagagccatgtcaagagtcctaggcttgtgacttatagctcaatggaatttctacctctcttgtcctctctttgtccatttgaaacacaaaacaaacattcctattggacttaataatttgtctcccctggggtataaagccatgcagctatagaatttatatatctgtggcatgcagatgaaggtgtgttgtcataatggttagctatcttttataactagtgattttatttgtattttataactgaaatagattattttaaccattcataaaattactctgtcacttattccatgagcccttccgaaagcgtatgaaatctagtgccctataaactgagttgtctaaaaatcatttgatgttaatattctaatattcttgattttcactaatttttttctcattacataatggttatatctatatgataaaagagtgtacattcttactctattacatttccatggtatgcacaattaaatatacaggagtttgtggctaccttagaggttgtagtaacagatacacaagctagtatttttaagtcatgtagcatagtgtttgaattagcaagccattttaaaaaaagtgtttgttgtcatcgatttctgcatcattattattacttaagaactcaggttcttagtgctactgacttctaattatgaactttgaaagtttacccttcttcataaaaaattttccatgacgtatctcaaagtatgtcatattaagtatagacaaacctacctgaaaatataagaattgagaaataatgaaggttcaagatctagaggaaatttgtttgataagatattaagctgtggtcaactataaaaaccttacatctaaggtctttctttccagcctcttcagattaaaatgtttccagtttaaattctgtcatttttgttttgttttgttttcccattcagatcactaaaatagtgtacattttatttatttgtctaaaatgtctttaatcctcctatgctaacttttcctgctctaattctcataatcttcatctcccacttgagttcccagagtcttgaactgtgaattccctcttttgcaacttttatttttttcgtatctgagatgcctttgaaatagtgatggttgtgtttgtgatgagcctggatgagccaaagaggcaaattgaattacccaatagaaagtaactcctaatttatatatttatgtcattaagtcttagccactaccttgggatatagttaagaatgccactttttaagatagaatatttgcctcaaatcttagcttttgataagaccttgagcaatttacaaaaacatttttttcagtttatttatgtgtaaaatagattgtaataaagattatatgattctcataaataattagacaaatgcttattgaaaagtgctcaatgtacaattattataagtatggaattgagtgcttatatacacactgtaagtagctattggttacagattgaatttaaaagagatagcgtgatgaagatcagtgcttcagaattttagtgtgtgaaagacatacttggggactttattacaaatgcctgttctggatcatatcctttgaattgtttgcctaaatttggatgcaacttcagaatcattaacaacgtttgcagcagctactgatcaatagagactactatgaacaatcatactccaacaaattggaaaacctaatggaaattgataaattactcaacacatacaacttgccaagactgtatcatgaagaaatggaaaactcaaacagaccaataatgagtaacaagattgaatcagtaataaaatctctcctagcaaagaaaagtccaggaccacatggcttcactgatgaattctaccaaacatttaaagaagaactaatactaattcttcttaaattattccaaaaaaatcaaaaggaaaggaattcttctaaattcattctacaaggccaatattaccccaataccagaacaagacagggacacacacacacgaaaagaaagctgaaggccactatccctgatgaacacagatgcaaaatgccccaacaaaatactagcaactcaaatccaacagcctatcaaaaagattattcaccatgctcaactggaaatcgtcccagggatgcaaagatgtttcaacatttgcagaacaataaactttctatattatatcaacagaatgaaacataaaaaccatataatcatctcaatagacagagaaaaagcattttataaaatccagtatcctttatttgataaaaattatcaacaaattaagtatagaagaaacataccttaatgtaatgaaggccatatgtaacaaacccacagctaacatgatactaaccagggaagagctgaaagctttctctccaagatctggaacaagataaggatgcccactttcactacttttattcaacatagtaatgaagttctagccagagcaatcaggcaagagaaagaaataaaggacatttaaattggaaagaaggaagtcaaattctctttgtttttatatgatctgatcttagatatagagagttctaatgaccccatgaaaaaaagtagtagatttcataaatgaattcagtaatgttggaggacacaaaatcaacatgcaaaaatcaatattatttctatatgttaacaacaaataatctgaaaataagaaagcaatcccatttacaatagctacaaaaaataaaatacctagaaataaatttaaacaaggaggtgaaatatatttacaatgaaaactataaaatattggtgagagaaattgaagaggacacaaaaagggaaagatattccatgttcatggattagaataattattatttttaaaatgtccatattacccaaagcaatctacaggtttaatgcaatccctatcaaaataccagtgacattctttacagaaaaaaaaaaaaaaagtcctaacatttgtatgaaaccacaaaagaccctaaatagcccaagtaacctggaacaaaaagaacaaagctgatggcttcacactaactgacttcaaaacatactataaagctatagtaaccaaacagaatgatactgacataaaacagacacacagagcaatacataagaatagagagcccagaaataaatctacacatatacagtcaactgagttttgacaaggttccaagtacctataatagagaaaggacagcctctttagtaaatggttctgggcaaactgaatagccacatgcaaaagaatgaaattagacctttatctcttactttatacacaagtcaactcaaaatagactacttaaatgtaagactgaaaactacacaactattagagaagaaaaaaaacagggggaaagcttcatgatgttgttctaggcaaggatttttttggataaaacctaaaaagcacaggcaacaaaagcaaatatagacaaattggattatattaaactaaaaagcttctgcacagcaaggcaaacaatcaatagagtgaagagataacctacagaatgggaaaataaatttgtaaactatgcatctgataatgggttaatatctaaaacatacaaggaactcaaacaactcaacaacgacaaaaaaaacaaataattcaaaaatggacaaaagacctgaatagatatttctcaaaagaagacaaagaaatgccaacagataaatgaaaatatgctcaacatcactaatcaccagggaaatgcaaatcaaacctatcttgaggtatctcctcaccctagttaaaatggctaccatcaaaaaatcaaaagatataagtgtttaaaggatatggagaaaagggaatccttacacactgattgtgagaatgtaaattagtaccaccattatggaaagtaatatgggggttctttaaaaaattaaaaatagaattttcatatgatccagcagtcccaatactaagtaaatatccagatgaaatgaaatcagtatgttgaagagatacagtaaacatagaatactgtactcctatatgtttattgctgcactgttcacaatagccaagttatcatattaacctaaatgatcgtaaataaataaatgcataaagaaaatgtacataagaaaaattgaacgccattcagccataagaaataatgaaatcctgttatttgtggcaacatgaatgaacctggaggacattatgttaagtgaaatcagccaggcacagaaagtcaaatatctcacacatatgtggaatctaaagggttgtcatagaagtagatagtagaatagtggttatcggaggatgggaggcttggaggagcgaggtgtggggaaagattggtcaacaggtacaaagctacagtgagatagaaagaataagttctggtgttctattgaatcgttggatgactagagttaaccataatgtgttgtatatttcaaaatagctagaagtttttaaatggtctcctcacaaagaaatggtaaatgttcaaagctatggatctgctagttaccctatttgataattatataatgtatacatgtatcaaactatcacatgtaccccataaatatgtacaattattatgtgtcaataatttttaaaataaatgatgccaacttaatccctagcttacttggattcaggtttctgagatattattttctttattcaggggctatgggtatatttccccttttgcttgtttaagaacctgcattttgagcaaggggaaaaaacatcactgacctttgatatctctccctctcttctccctacccaaaaaccctctcttttatgacctagcatcctggtttctcaacagagtttatggagaattttcagtgctctcctagtataagttttcaggttgacagatttcctcaacctgatagacagttaaaaatacactccagaatcaaatcaaaatattttacagtaaaacctcttatcagaaaataaccaaagagatgagttaaaacaaacggtttagtcaaatatcttaaacagttctgaggaaacaaatggaaatagaacaatagcacttctctgaagagatagtcagtgtcagaatcaagaaagacatgctgttatctcaaaggtacccatgagaataatactcttttcactgtttctaagaatgcaggcactgaactgatggctcttctcagagtcagccttctcctgaagtgcaatgaagccctccaagcacactccaaacattaacaacacactacacaggcttttttaccactggcagtgaagtgcttcctcattagaagccttaaaggaagtatgaaatgcacccatttgtcaataaatatttattacaccttactatgctctaagcactgtgctaagaattgctgagggaaaaaagatcatgttctcacacagctgcaacaatttaatatcgggattaacttgaaagttaaaatataagggctcagggtctagatatataagattgtgagctgatccaaggatgtattagtttcttacggctgttgtaacaaattagcaaaactcagtggcttacaacaacagaaatttattcttttgccagttctggaggctagaagtctgaaatcaaggtctgagcaaggccatgatttctctaaaggctctagtaagtatcctgccttgctgctttctaactttggaggttgttggcaatccttgcagcttgcagctgcatcatcccaatctctggcccggtactcacgtagttttctccctgtgtgtctcggtcttttcttcttataaggaccccagttatattggatttggacccacacaatgacctcatcttcattgtgtctgcaaagaccatatttccaaataagatcacactcaaacatgccagggttaggacttcaacataacttttggaggattacaattcaacccacaacaaagaattttgacttagaagactagatggttattgatacaattaagaatacactgatggaggagaaaattgaggaggtaggggaaatacagagtttaatttggtggcatcataaatttgaactacttgcagtacaggcagtgaacctgaacaggaggtatatggaaagataaatcttaaggaaagaagaaaagtcagagttgtagataggttgggattttgtatgctaactttcattaatcacgggattgtgtaggggtcagttccctgggaaaccaatcctgagagagaaatctgagatttactgagaagtgttttcaggaacgaaacgtaacatctgtaaaaagtgaggcatgcaaaattattgggcagagagagaagttgaactgttaaaattgcaacagagatttcggctgatcctattggcatctctgatgctgtgacaaccctctggagtagttccaaaacaaagcaagagggtcaggcctttcttctccacaccattcattggatgcaggctctccctttacctttccaggggagaagggtataaccttgggggaagcacctcccttctgccacgataaggcccaaagagggattcagatgtgagccttcagcatccaacacttttggcagctgggggaatgagcagcttgctggaaagcaggatgtggacagtgccttagagcatctacttcatgacagaaccacagacagcagctgagaacagcggatcaaacacatttgagaggtggatgcaaaagaagaaagcacgcacacacacacggataaaatgtatacagtagcccctttacacacattatataattttcgtctttgtgacctccttaggaagtaaatataatgcatctatatttgcagatgactgcgattctaaaagattaagaaaagatttggttagtcatggacgtatctgggggtctttttaaatttaaaccccaagctgtaatcattatactacatgccatagaaaggcaagaaaatgagtagtagtataattgttttctgctatacctctgtaatggtgtaattcagggtgaaattttctgttgtaatggtattgtacatttgctgattcattgggattctgatattgtgcttctaatccaccttaatgctgactgattaggttatagtctaccttggtaataatgtgtgatttttatattttaggtgtttaaatttgtttcttcaaaactatcttattcccttctttattgaaaagtaaaactgattttacttctagaatatatttctttctcaagactacataaccctttcctttccatttattcagtattaaatgcatattttatacattatggtatttcatgtgtatctgtatatttatttttgcatatattaatgtgtctattttttcatgcaaattattgataaatatgacaaactcatctagaccaaattcaagttcttgtagcttctgcctgatacattcattcttctctaggtgaaaaccttgctgaggtaactatgaggttcttagtgctactaagacttatccagctctccctggcttgttgatgaaattggcaagtgactcagaaatatcactaaagtccagatcattgcctttaaagcatctcctttgtcatgacttattatgttattacagaaaagtattaaatcaatttggcataattttttctacacatcactttgctctctttgaacctttgtgttctctcaggacaatgtattaagtagaattgatttattattatattatctttcacattaaggctatattaggggctagggagtacacttactgccacaccaaggtacacatgttaagatcttaactatttgaataaacctattttacttaagggtacatgggtaatccctatttttttgtgtgtgtgttttgttatttttggctatttctgagtcaggactctgtttaactgcatgcaacagagacttaactacattggcataactggatagaacattctgttttcatattttaaaacatccacagatcagcagtccacgtggcctccatgtcctaggctccatctcttctcccttctgccaatcttcacatgtgttttttcttctatattaatgcctatgattagaggtgactgttccacctacagctttatatccaatacccaggtagagaaagaaatagaacgaagcagaagtaatgactatcccacttgcctgaggaagggcaaaactttcccagagatccttatccaactttggcttatgtcttattggcaagaacagtgtgacatggccacccctaacaacaaggtagcctggctgaggcaggacatttatctgggcatattgctaccctgaataaaatctggattctcttggtaagataccttggaaggtattaacaaggtcaggcatgcttctccaatattactactgctactaattattattattcctttatgaaaatgtcaaaagaattgaaggatggtaattttctattttaagagatgcagttactaggcataatttggaataatatgcatcaattgtaatgttatactttgaaacatattgtataaaattaccaaaaaacaaaagttaatttttacttattgaattagaaaatatatatgaaaataagaatattttaagttaaataataaaaaactaaatatccaaccatttttaatctgcaaaaactagaaatttcatgtggctcaacataatacaaaggcataagtaaaatataaacttcattctacctgtataatcttatttcttaattacataaatattatgttactgaacacagatattttattcatttcttttatttgtgcatagtagagaacacattaaaattttctatgactctctgcccagaattataataggcatagagtttttctctcctaaattacactcatgaaatatttttggccccctataaatattgagtcccccaaaaaccacactaaaaacttcatgtacttcaaaggtaaagggtgattgatcattgacaacaaaaagtatacactctaatagcttgcaccttaggtaaatatacaaaaaattataacacagaacaaagcaaagcacaatccgtaacaggacactaaactagtccattgaggatgcattgagtaaggggctgtatctggctgacttcacatgaaaggaggtggcacttagaccagaccttacagtatggagaaaatttcactgggcagatgtggtacagaaggaaatctcaggcagaggaacaagcattcatattgttcacctgattcactcattcattcatctatccacccattcatctattcagtgttcagtttacaaagtcattatctttggagatacttaaatatgcttattattatgaaatgtagtcattttgttgacctgataaaaagttgtttcaatatttgcagttcccaaattaaatatttaatgtccttttactatgtggtggttttaattacactgttatcaagactttctctctttagatttttaatcaaagttttagatttaccttctgcttattactacactttagaaaatataataatcttttaaaaatgcatttgactttgaaagatttagggattagttacagttatgctgtttcgtaaaattggcatttgattctatattttatgcatagattttttttaaaagcactcttctgtagaattgcacttagaccatttgtttttttcaggttgtttccaaagaatttgaaaaatctttccatcttcattggatttgtttacgtgcctaaaaacaatgaaatatttgtctgacatattcaaatcaatgtgtcttattctttatattttgataaatttggaaacttcacttttttgcaatgctgtttaaaatgtcaaaattaattaaataaaaataagtcaatcaagaaatgctaattttagaatatgctttttaaagctgcatactcttactgccacctcaccccctatactgagaatcacttatatttaaatgttgcttgcatttaaggaaaaatagaatgcaaaacattgcattagcacattatagtatttaaattcaatttttaaatagtagagtagaattatgtaactgtttaattgattgtttttaagtctctgttgaatgacatttaatcttagtactgtgattcaaatatattgcttaacgttgagtatatagcatgtactttcaaatatgtaactaatttctacttacaggtatatgactttaaacattttaaaacacagttgactaaactctttcatcatgctgcatttctaaaattcagtacctaaccttcttctcacaggggtaatatcaaactggatcagtcaaggatgcagctctgtgcttttaaccaggcagagacatatgtcaccacttttacacaggttacctaaaaaaatcatacatacgatattttttcaatgtcttgcatgctgttcagctacaaaacctttctgcctgacccactgcaagaaagtagaaacatatacagttgttcaatagataaagtgacatcacagcatgtcaccagggcaatttgattatttttttgtgattctcttgatgacttcttgatgtaaccttcatgtgcttaagtgatttcaagtgcatgatctgtagatttttattgaattgattataaaagtaaaatgcagaatgtaacagtagccattgaagctacatttaatttgaaaacctctatcaacttcccttcctgatttaatctacataaaaatatggagagatgtatatcacattaaattgtcacatttaaattaagtagatcaaaactctaaaaaattgtggaagaagtgtttctggcataaatataaaatctcagagcaggaaaagatcattgtaattctagctttgtatttaataattctggttatgtatttatggataagcaaattgagactcatgctttcttagtacacatctagaaagttggggtcaaagccaaagtaccctgcttctagtataaactttgaatacattttgaaatggttttatgcactgttagttatgggactttatttttttaaatcaactcagtaattaacatttgattttatttgctcctatataaaatgcatcagttaaaagttgataggccttgcctatgaatgaataagtgataagtgttcaaaatgtttaattttattccagaagtaatattactcattgataagaataagtttctgattatatacataatcagatcagtctctagaaactaagaggtttagatagagcatattataaatcctatctatcaataacacatagaacacttttactgaaattagatacagattaatatgtattgccttattgaatatttctaaaatgtattaaaatacatactaagatatattttaattttagcatactttgttgaatgactgaactttaatagttctaggatgggggcaggaatctctgccaataagaatcttgactcctttttataatctagttcatattttgaatttctctgtcattgttgagatgtttgtattattgttatctattgtgcaatgatgaaagcaaaactttatcctgaaattgacacaccttagagataatattgctaacagtttcaaatgaaaaattagttattttagtgttccagtttatttgaagataattttaaaggtggcctaagtaaaagatatatttttctatttcaaatttggtggggatttagaggcaatattctcatagaaaactattttattccagaatatggtgaattttcttcaactagagcctaaataaggatgcatatacacccaatattatctatataggtatagataaaacatataatttttgagaaagctatttctagaaatatatatacatgcatagacatataaacatatgcatatatatgttttgaattcataaattcttattacttttttaccaagctgttagaaaagatgaggtacatgttaatgaatggtcatcctcttaagaaaaaaactgaatattcagttaagaatgacttgaaatatggcactttagcaaaagctgcctacataaaggatatagttattttatccatgtaaaatttctatttatattttcaatattagaaatccacatgtttaaaaagctagtaattattccattcattaaaattcacttttccttgccctccttcattgtgggtagtattagtagttaacagaaatgattcagatatctaggtagcttactttgtgtttgtcattcttgtttgtttcaaaattatagataatatttacgaagcttgagtctgcgtatctacactttgcctttatgtttgctaaggttccaatccttctttacctacttgttgcatttttttaagctggcataaatagcaaaattgtttaaatgtttgcttctaaagactttaagacactctgacttgacccactgtattccagctgctttctctgcaaacagtgtagcagttctgtgacagagcacagagagagcccttgaatatcaatggccactttacactcctagctctttgcttctcttcttttcattagaaagatgcttcaagatgatactataggacctggctgagaaatctgtagccagtctagccttcttacatggccaactgttgttgcttttatatgatttctttatattcatatcttatcatttagtcacgtaagttttcatgttattggatagaaagtgccctaggtagaagattctgagaaaaagaagaggtctccgtgaaatcactggttttattctgaatttctctggtggtggctgagatttgacctcattatttcaccaacagaatactatatatcatgttgaccttgtgatggaactgtgtgtttcacgctgaataagtagctattcctcccagagcctacacaatatttctctgctagcaatagacaaagaaaaataggaaaggaaaaaaaattggttttcttgccctttttttaaaaaaagagctaaagttttagttgcccataattagaatgtgagcccagaatttattgcaactagttaataaactgacaattttctgctaaattagtggaagtaacattaaaacttagacaacagaagaaaatacagttgagttttccactgatcaataatatctggagtattttttaattatttccatttttttcctgaaattcctgagcttcagtgattttttaacttgaggcattaccttttaaaaagaatcttgagaaatttcatatcaaaaaaaaaagattgtagagacctcaaggggcccagaaatctaaatcatgttaagaaatgtgattacactcaagatgaaaagcactaatagtaatatcaataatattaatgacctccaattttaaaaactctataagaggataatgttcacatttctccagaaggaaaaaaataaaggccctgaatgattgcaagagagaagaaaggttatttttgttctacaccagaagagagtatttaaacatctagttgtcctgtaacataatgggaaacttggaaaatattggactcttatgccacatagtaactatgtgtggatttcttctcaaaggatcctttgatcctttaattgaaatttactattttactccttaatgattcaagaacacaattatagatattgaccgtaaaactacacaattaaattaaaagatggataatagtaacttgaaactaattttaaaatgtctttcttgcttattaacagataatggagcttagtttaccactgtctgccataatttttcttctcttttatacccatctcctccttttgatttgcttctctcaactttcttactgtcttttgtgagtattttaaggctcaggtgaaataaccattctaggctctgctccttaaagaatatctttttttttgttgtgtgaagcaaacagtttatagtatgtacttgaaatgtaacatttttcagttcttttcagcatcaatcattctctttgagtaaggtttttgttgagttctgtgttttgtacagtgctgctgtgtttgatagtttcttcttttgagcgttagattatcaagtcattagacactcctacctcacacctcttggaacaataaataactagcattaaccatcatccatgatagcatgaaataggcttacatcgttaatgtttatcttaggaaatgccagtgataaatttgtaagtgaacaacttaggacatgttctaatatgatacatatatttaacacaatttctactcaagcagtatagtagaaaacacagcttcaaggcaatcaaagggaaaaccatgaagaataataaagcttttaatttggacatattttcagtaattgaaaaggagcatcttaaatagctacataagtttacaatcaagataaggattgtttcacagctatagtgttgtatggatgcacactgaaaaatatggaaagatatgtctctctctctctctctctctctctcctctctctctttttctctctctcgattacctcaagggggttgaatcaaggagatagtggagggaacttttattttgcactgtaaatactattatacatttaaaatgtttgagtcaactatatcactttcatatttttaaaacacttttagaaggcacagtcaatatcatattattcaataaaaaggcaggaatgctaattatggtacacttctgattcctaatactagtgagtccaccttcttgatcctatgcttatatttatatttactttatttataactagactgccaatgatgaaaaaaattgatacttcccttttattagaaatcaaatccatgtgaaaattacagaaggtcctatttataatagcaaaagaaatttctttcatactaaagcatttatttcacttctctaatatagtcattctttcatttccaaaattacatggaaaactaaacaacagatgattgagtttaaagaaatgaagataatatagaaattaatcatataaaataatacaaataattgatatgatcttccttgtatagtaaaaaacatatattcaaagtacttaaatatggtgatgcctactgtgagaattcaatatatttcaccgcaggaaaaaaaaactttattatatatatcagcctttctatataaaggtattctcttagaaatctgctaaagaagcttatactgtagcaagtatagatttcaaaggctgaattgactagaactgtctatattgctaaagcatgcttataaacatttaattttatatacagtatggaaatagttactgtttgaatacttaatgcattcccaagaaaacattgaatgtctaagaatctattagccataataatttgtctgtaaatacaaattaattaataatagttcatgttaaatattttgataatttctgtcccattgaacaataatattgaataactttatgatgtaaaattctgtgccaagctgaattcaattgaccattaaaaaaacataaaacctgcatatgaaaaaaagtttcaacaacaagatacactatataaaatcacgtgaatttttacttgctcataatctaatttggcataaatctttgttaatgctctcttaaacagtgagaaaaccaattattgatgtttgaagatgctttcatgaatttagctaaagtcagaattctgcaaataagaatcattttatttaaaagttgttaccagctcagagaaaaaccattataactatttcctattgttaatattgtgtctaatagcaggggggtgctttgtattctttctatcagcaattcctctcactgctttacctcaaaacccaggccaataattcttttttcagaaatgaagggcctggtcttaacttcacagaataatagggccttgtctttcacttctctggtgatagttcacgtgcagccgagaggtcaggaattgaagccattaaaactgtagtcttctaaatatggtactttggattttgtggcaattggcacaaaatacatattagtaattataagtttatccaacatcgtttcctggattaatctgtattttaaaacttatatattttaaaactcattctatagtttatactttaaagcctattctatagttttatagaatattcagttataattaatttctattatcttattttaaattaaactaatttagatgaattcaatcagtttaaataacatgtttttgagtgaaattttgtactgatactttcataactgaaactgttatcaaactcctggacctggtgggaataatgcctctaggccaacatagattggaggagttctcttaataggttgttcataattatttactccagttataagaaagacattgtctgcttacatcattccttatgtacaatactttatccatgccatttttatgatgttgtatactaggtgataataatagcattgagaatttaatgtggtacccatcaagaatacttctagcttccaagtcaatctctaaaagtcaaacctttagattgggctatcatattaatacaaattcatagattgagaatcaatttatctgaaataagtattttattatttttagcacttgcacttgcttgaactactctaaaaaagataaagttgtaacttaataagagaattgtgttgtagtaactagtagctttcaatattcacatgtcatttagcaaatgagaatgaaaaattaactcttccattgatatgctgctttactcctttataaaacaatatttgggaaatttgacagagttttgctacagttgctgtatgtattttttgtaaagatttcttcgtgtgtgtgtgtgtatgtgtaaacatcatggttactcataaagctctgggtgagaaaaacctatttgcgttatgatcacttatatgatcataatgacaatgaattcattattccatgtgtaagtctgccatgtttaattttcttcgatctttgtttcagagtttgcatgtggtgcttactttagtagccactttcttgacattataaataatactgtttgatcttttctactatatactaaaatgttatatacaaaatgggtggtgttggtatggtcattggcattttgatttcaaaaccgtatttgattttgtggtcttgatcaaagaacttctatctatatcatcctgctacatatatttaaattcaagagataataaaaaatacatttggactttatcttgcacttatctttttaaaaaattttaactatcaataagttttttgccaactatttgatctgagctttcaatgatcaggcattagtaatttgacacttgtattatattgcaaatagggtataggttgtcctcaaataatgattgtcagtgtccataaatttatattaaaaatttaaaaaataagatgtggtcaatactttccaaaagtgatagttaacatcaatatattaccttatctaattttggccacgtacttgttagtataataaacataataaagtttattattttacaggatggtgtagatagaaagatcaagtatagatacatttaaggttacttgacctcaatatgtgtttatacattttttatggccatcatactattaatcttttttcataatactttgcatgagtctgattattaaataaggcttaaatatcatatttgaatgaactctaaatgaactacctggtggggtggtgaattcctttctagagattaaaccggtcaagctcctcagagtgcagcacagttgataaccctttgcctggagaaggagaagaagcagaggctgaacctatgaattccgatgagccagaggcctgtttcacagatggtaagacaaaaattgagaccttggttagcattccttaattagtgttctggggtttgtcttaacgcctaatacttaccagaggttgtcggtaagtcagaagactccattccatgctgattcagctatagctgtatgatgattaagggcaagtcactagagctctctaagcttgagtttccacatctatggcacttgactaacagtaatttcctatcactgtatgttagactgtaagcatgctactacttcttattttagagccttaattcgtattcccagatcaatggaaccaccagaatacaagttaatgaaagagtctgtactctggtccttttaatcaaaaatggaatctactcactaactctcagaaaactgtttgatactgttgactacagtctctctcaaaattcttcctttccttagtttcagaggccatagtctacctttggtcttttatttgtcttagagttctgagttcctctctctatttctttaatgagtattttttctgcacatcctgtaaataatgatttctccccacatgttcaatcttcagttatcttttcttattctgaagctctgaggtgtttcatgcatgcctgtggcttgaaaagccatttctgtgctattgactcttaacatcaatgtctttacctctaacctcactcttgagtcccagatctgcttacaattccccattggtcatcaccatctgttgtttgtaaaacattccaagtttaataagtttttttttttttgaaaagcaaaaacaaaaacaaaactttagtatggtttacagcttcctccagtctttattagtaacttcatgatctaccttaccctcaagctaaagactttgagagacccttaaagttttccttgctagtcacaagttcatcaggaactctggagatagggcccaagcccttaagaggatttgcatgcacactaaaatgtgagaatccttggcctctagggtaaagtctgaagtccttaacttgacatgtaaagttctttacatttggccttagtctcttgttttgtaacagtacctccttctactcctgtatgctttctgatatgctgaatttcttactacttctggaatttgtcagggataatgcagtattgtctgaacaagtattgtatcatctaggtaaaaatacaagcccagagtagggctgcaatgtaatacagtaatacaaagttcaaactttggagcctgataaacatatgttctaatttgccgacttatctgcctgtgagaacttgtgcacaatttaaaatcttgttcttcagatatctcatctgtaaaatggggatatcagcatccacatcacagcgatgctaagaggatcaaataagataatgattataaacttactagcacagtgcctatcttccttcttctacttttcttattcttcaaggattctgttaacaatcttatacagaagttatgatagcacagatgctaatgacttatctagtcatgggcttaccctcagcattagtattttttgaaaaatcatcgacttgctttcagtgtccaagattttctcaactggtttcttataacattcatgggttaagcaaaatgattggaaaataaagacatcagcaaactacaaagagtgcatggattttctttaaatacacaccaaatatcattttatgtaagaagcaaaggtgtacgacatccagtcaatataaattttgtgcttgctgaaattagtgctataagcaaatgcacagtttcctttaaaagtgtccatgttacagagatttaagaatttcatcaacatgtatggcctgctcctcaagaaatttattagcagtatatagacttaaatttgtattgatgctaccaagattttccctattcattttatgaatgatcatgacttaaaattctaggataactagaaagaagttgggcttatcaatcaacttaaagtttcaaaccaaaaaatgacttcaaaaaacttaaactcttacagaaagtattaatactatgctatttcagactgtaggtgctgttataataagatataatacaaagtttttttaatcctataaacatcaatgaaaatacttttgtgaatactctgagattattcattgcttccaaactgaggccagtatagaagaaatattatggaaacacattttccaatgaacctgggcttggaccattgaaatttactgagggagcatatatctctgagtcacatcccttttatgtgctccagcagagacttcatacagtctctggatctgtagcctaataaattcagtgaagcagccaatttgcttagcctttcaaccgtgtattcacataatcattctttattccagtaaacaaataattattaaatacctgtgtgccaggtccagttccaggcactggagggagatggagctgtgaacaaaacaataccccttgctgaagaaacatatcaagatgtagcaggtcagataagtgaaaagtgctatggagaaggtatatggaaaagaggaataccaagagtgagggggaagaacttactagcacataaatatgctatcaatgaatgattggtcagagaaagcctgcctataaaggtggcgtttcttccgtgatgtaaagaaaattgaagggggccgtgcaaatatatggagggaaagtattttaggcagagtaatgaaggcacatgccccaaggtgaggatatgcataacatttgggaaaaaccaagaggccaaaatagatggagaataatgaaagatgggaagaggattaaaagttaaggtcagaggctgggtgaagtggctcacacctataattccagtactttgggaggccgaggtgggcgatcacttgaggccaggagttcaagaccagcctggccaacgtagcgaaaccccatttttactgaaaatgaaaaaaaaattaattgatcttggtgatacatgcctataatcccagctacttgtgaggctgaggcacgagaattacttgaatccaggaggcagaggttgcagtgagccaagattgtgccactgcactccagcctggacgacagaggaagactctgtctccaacaaacaaacaaataaaacaaatgacattatttttaaaaagtgtagatcagagatgtagtagaggccagattataagacatttgaagaacattataaggatgtgattttaaaatctcacaatgtgcaatcttaagagtggaagggcgaatagcaatggcagaagctggaagatttcttggagtttctgcataaatccaggtgagaggtgatgggagcttagactagtatggtagagttttgtatagtgagggtgtgacatgctgagtatattttgaagttagagctgaagggatttgttgatggattgaacattgggtgcttaaaaactggaaatgcatagtttccacatgaagactgagaagcatgggcttgtcagaatgaagaatcatgaacatgtttacttacaagttggtaattggtctacaagagctgggctagaatcaatgccagttcagagcaatgtttcacctccagagatctctgctacctgaaaggtaacagaaaaaattaaatgaagtatgaaaaagaattaaatccaagtagcatgtttttactgaagataaatgttaaaacgattttgttgttcatagtctcacatttgttgattcatttcagcttcataattatcactttactaatgtatttcattgattgcatctggttcctcttattcaccttttctctccctcttatgcaaggttgttccttagctctgtgtctattactttgtatttgaagacttcagactgcttccgtatatcttgccctgttctttactatccttagttctacatgacttggcaacctatataattatgaacatgacatgactctttgggtctatgtggttttatattgtgctgcttttagattatcaaattagtaaattacataatcaggattagagttagcgaaaaataacctttttcacaaggtcaagagatcgagaccatcctggctaacatggtgaaatcccgtttctactaaaaatacaaaaattagctgagcctggtggtgagcgcctgtagtcccagctactcaagaggctgaggcaggagaatcgcttgaacccaggaggcagaggttgcagtgagctgagatcctgctactgcactccagcctggcaacaaagtgagactctgtctcaaaaaataataatggtaataatagtaatgtatttttctgttaacttggtaggagaagccaaatcatcttcctttcaaaatgttttgtattcacccccttcctataaaataactaataattaattctaactttagtaacacaataaccaactcctttgtgacttttattttttctttcttttggaaagataatgttaacaaatatttgttttagttatatttgatgttaagaaatggtgaaaaaagcttgttttcataatcaatttttaaattaattatattgatcatgctgttatggtttttaatgaatagtctgtcttttgaagtggtcagtggtttcttttttctttcctttccttttttttttttttttttttttgagagctttggtttaacatgatgaaactcagcatagactttatgtaatgcaccatgagagcacattagtgaaaccacccaaaagaaatagcatttactcactgggacccattaaaatgtttgagagattctctgttatgtttacattcaattaatagtccttttaaagagaaggtatgataacattgctaaccagcttagttggaaatctcttgggatatacctttgcacaaaaaccagacaggcgctccatcactcttgcctcaaaataagagaaagaaactctctgaggtgtaataaaccctgagggcaatatttatgaaacttcatttcagattgaaagtttactaacttttctaattaggatttttagtgtttttatttcctcaatcataagaataatgtttcccttcaattttaagattgacaaaagtaaatcccagagagcaaaatcttcttaaccaaagggataattttcttatccaataatttgcccctgagaaagataaattctttcttatatgtgatcattgtttttaagtttaagacaaattctaaagcactaagttaatattaaaaaattcatctcatttttttcgctctctctggtatttttattttccctgaaaaagattaacttagagttaatttttgaccctacccttttactctgtttttatatcattttatcgaatgttctctcttaactaaatgcatgtagataataattatttaagtataggatgatacataatttcagatctgagatcatgttcactgtaattaacattgtataaatgaagctatgtgtagattttccattcacctttttttttctttttcatccaatgtttatgtaaagtatagaattcacagagatgtaacctttcaaattatgactaactgcttagaagattatataactctttttggggaatcaagtcttttaaaaatcaactataaatgacctattaagccaagtagaggactatgatgagtactataagcacaaagagcaagcattacagactcagtttgagtcttctgggaacttagaaacttccagagagaaaaaacaggaacacataaaatatacatgataacaaaaacaccagagacatagggggagagggaaacaccttgtttgctgtatttctatagagctggaaattaaagtgctagaaaataaccttatatcaactggatcaatgcactaattagacttcagaaacatgaaaagattcattacaaaacattttctaccaggtgcatcttgtcaagaggattctagttttgttgttttagaacatacaacttatgattatctgaagttgttacttgaaaactcaatacttgttaatgaattatattgttttacagaaaaggagatcaatcttttagaaatatctaaaattcaaacttctgaaacaggtatcaaaaaagtgctgcccattcttactttcccacctcctgccttcatctaaaatgaggtttttcatctaaaattttatgaggaagaattcactgtagttactttttaaagagtctctcttttcttcagagtaattctagttgctttaataaactttaaattgattaaaatttttcaatgtttcaatcattctctttctgggcctcttatgttcatagctctgtttatcacttcttataaaactttttactctttggtttctcttttactgcaccctcttggtccttcttgttcatctctcatttcatctacttcaaagttttctcctctacctgtcctagtgatgtgtaggtaaatatttttataaactggttctccaaggaaaataaaaaatgtgtacttatatcatttactataaattttactgatattaggatatatgacacacaatttacaaataataaaatattacaactttttattgaacattctgtatatcaaattgtttctcaaagaatgctttttttgaactttgccaaacttttgcatgtataggcaacctatttttgcagctaataaacaagtatagttttagcatgaagactgcttgatatttatgttagtcagtgaaataaaaaagaaatgaagaagctatatgtcagaactttactcattcatcagtgatgtaagcaattatttgcaaatcaaaaaacagaatttcaataatgaaaggatattttttaatttttgtgctattcagagtaatggctacaaacacaatacaccttgactgtttatctgttttattggcatttcctccatcaccttcttaattctactctagaaaatcaagaagctctcatttgtagtgcttggagatttttgtaatgtaaagattcccaccatcactgatttcaaactactgatgtgaaattgctaaatgcagagttaagaagagattcacagtagctcaacagtgtgacatacttccaccatccagatagaataggccagatagaatagaccagcatccagaaagaagagttgcacagtagcccaatagtatagcatattactactgtccagagagaataatccagagagaatagaccaccgtccagaaagaagagatgcacaatagcccgacagtatgccatacttctgctattcaaacggaatagacaaataaaatacagtaaaataattaggaagtgatatgtcttagtatttattacctttccttaaggtaagttatagaattctaagtttatatagtcaaatatttaataatggctgcttttaacaacagacaagcaggaatttctgacagtttaacaacaagaattggtatggtctgctttcagcacaccattgaattctctcccttaatattgttgtttcagaatgtttcggagttggccctttttctgctcaccctaaatactctttttgtgtgacctcaaaaactgttctgacttcagcagatacatgtatgctaattattactaagaattcttttctagacaggtttttcccgtttcaggttcccacccccatttttaaaatctataggatatctgtatttaaacaattcacaggcatctcaaaatcattacctgccgagtcagctcctcctcctgtggttttcaattcactgctaacatccacctggtagtcctgggatccttcctttctcttacatttgatatccaatcaatcaccaaatcctgctgattttatctgccaaatatgtcttgaatctgttacaactctagttcctaactaatctttccctccagacaggatactggaccagaatccaaatggttttctgggtatgaaactttcttcacccctactcctctctattcacccttccaacttatcctccatgtaccgtggagacatctatttacattgcaatttgcgtatctcgttccctgcttataaccctttacttactcctcaacctcaataggatataagccaaactccttaaggtaaaggccaatgctttccataatctgaccaatttttctaagctcacctctcacccttgcctcttgtgtacattctgcttgcatcacaattctaaactggtttaaatttctatgcataacaatttttgctgcctggaattccacccaaactcttttttactgatattttgattcaacccaggctccatctcttctaggaagcctctactgatctctctttctcaagaaataagccaggtgagattgatttcttccatgctatcaaaatgaaccctgactatctgtcactttagttgccatatctagttatagtcatttatttctgtttttatctacctaaccaaaacctaacataaattcactgaggaaaggaaatcatgtacagaggtgaatacataaaagatacgtaacaagggtttgatggacaaaagaatgcgttaatgaatgaataaacctaaccatttttaagtacaattttcaattttttgtagcagtatattttgtacataaaaatttaaagtcacatttgtttttaacttagaatacttgaaacagtttcatctggatcttctaatcaagatgagtttcttttgaacttaatttcaggagtttccactaattttctcaatattgtttagaaaggtgtatttcagagggtttttaccatagaggagtggaagtatctaaaattatagactagaaaaatttatctgtcagaaaagaagaccctaaaattcatgtcgtcttcagattttagttcattcattcattcacacataaaatgaaagtggtttaaagactgtggaggagactgaagagaaattggggattacagaagacaagaatacattgtaagctaaaactaactaacaactatttagaaaacatcatgcaaagttagaagatgaaggaaggcagcatccaaattaaatctatctgaaattgcaagtataggtgttgaaattatttggttgagggagtatcacagaaagcagtttgcattaaataatgtattaaaaattttatttattctgaatatcaagatttaacatgcatgtctttcttgtcaggttgtgtatggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggtaaatgatctgacacctaagtcaatatattgattaagtcaatattctttaaaatgagctaaaagataaaaatatcatggcaagttgttttacctagaattaatccctatgattagtgccaatgacaaaattttacttgagctcagtaaatagttactgagcactcctacatgccaggcattatccttgctgccctgaatgctgttgtccaaaggaccacccagatggctataatagaaaagagaattttactggcaatatcagtttgcaaaacagggagagagtctgtggcataaactgaaagcactttccctgtagaacaaagagagaaggttagaggttttattaaaatgggaaaatgttatatattgctctttgagaaagttcattggccctagtaaggatctggggaactggtaagctccaactggcgagcaacagtcgttggcacaattagtcctagagtgtaacaggtttcctcagaagctatagataaaactaatttcaagttacaacaagcagcttcaacagtcagtcttgcagagaattataattcttggagtaatgttttgtaccctgagagcttttccccctgccttcttgactcttagttgactgttagttgagtaggacaagaactacccaatttgtatgatcaactttcacaatgcaaagataaataagatccaggtactgtttattcttaaggagctcagagcaatggagaagagaagaatacaaatgagtaactgtagagcttggatgtgtttgtaagcaaagtgtaaatgtgacaaagttctgtagcaaggagaacaactgcttgcaatttcagaaacgtaaatggtgcttttcagggtctagaaagacgaacaggaattttctagttaggcaaggcaggctgaggggaacaagtatacaatcgtaaggaggcataaaacagcatcagatattcaggaaattaaaaactgctgaactgcaagtgtggtgggaagaagaacaagtacaggtggccagagatactatgagaaagcaaggtcagcttgtgaagcatcttgtgtgttataaaaagggaaaacagatggtagttttaggataaaagtaggacaagtttctcattcttgtacacatacaagcagcttccatgagagttgaaagagatctagtagaattacaagctacctgaacctttttcttaattgtcatttttcctgctgacgctgacagagatgagccattagaagccattaggagcccagatctagctagatataccactggaagtttcattatactaaaaatagaatactcaagaactttgtaacttgcctcatagacagtcttcatgagtttggactttgattttactgtacttatatgctaataggttgatctgatactgtttcatggatgctggcagaagatatgaggtgcttgggtcagagataaaggactttgttacttatgtgtggaaagtagcatgagtttcaacatgtttctgttggttccccctttacccaggtctcatgggggcattatatgagcctgaatgagtgtgtacacatatagtggattgatgtcacagctgaggaacactgagcttagggaatgcatccttttataccaagcaacataagcaaccctgctctttgtcccagagaccctacctcatgtctcaaggttgctcactgcaaacacaaccctgaggaatgtcctaggtaaggagcaggcagagcctggcattcttggcacactccccaacaacctgcagggacccactgtggctttcctttcctatcaagtctcaactctcagaaacagaaaatgtgatcagaaaagctctattttccttacctggagtcatccaagtagaaatcatgatagtgtctaccatgcaatgtattcctagtaactaaggaggtttatcccatgctgactcacatatgtgactgagaatttcagagaggagattacaaaaaaattaaagtttggagtaattccttgttcaaaatgtctaaaacagaggaagacatttggggagggcattctcaaaagtgtattttaaataaatcatatgaggaagaaaagggaaagatatttcaagaagctggtgtttgtacttagacaggttgccaattaaactagattttttaaaagtatagcaaacccccatgacacgtgtttacctatgtaacaaaccttcacatgtaccctcaaacctaaaataaaagttaaaaagaagtaatagctctcatttagcttatacttattgtgtttcagaatcttcttttagattttctcatttaattttcaaacaaccctgtgagattatgatattttgcttattttaccaatgatgaagctgggtacagttttaaaagttgcttaatgtcccaaagctagtaaatgacagagctatcactgaattgacatctaaaatcaaagtcaccatatcttttcactgtgttgtggctcctcagaaagaagagtatacacaaaacagaaataaatgagtggtaactgaatttagtaacagtaaagcgttaagtcctaaatcagatagagctcacataaggtcattcttgcctccttgctcctacatccacaaaattggttctggaagctagaacccctgtgggctgaattctaattcctgctctgggaccagtcagagagaggttctcatcatcaagacttcctgcggctctgctctgaccctgtacaccagttctagaaacaggcttcgttttccttgtgactaagccccttccttgtctttgtatttcaaggactgagtcattgccatagtttcggtttagatggcttgcctgattcctccagaatttgggggtggagtggaggggaggaaaatcctgagggctagaagcctccctctgcacttcaattccattgaatttcagaacctctgccaactgctgggaccttctttttgcatcttagtaggtccattcagtctttctgccccaacttgtctcttttcttcaatattgataccaacagtttcccaaaactgctaaggataattttagagtattgaaagcagaacgtagaataagaagaatctgaatggcacaagttcatgactgtagacaggtaataaatataatattaaccacgaaggatacaggtctttgactttcattttatccaacagggttaatagtgtttcgatctgaaagagaaagttctaacactttagacctgttgagatcagcaatcattttcagtgtctcaatgagccttttttttttttttttttttgagacagagtcttgctctgttgcccaggctggagtgcagtggcgtgatcttggctcactgcaacaatgagcccaatttttcagtcctttcaaattctttgtcaagggacatgtggctgaagtctaaagtcaaagtcaccctgtcctttcactgtgttgtggctcctcagacagaagagcatacacaaaataggagtaaatgagtgataaccaaaattagtaacagtaaagcgtaagccctacattagatagagctcacctaatgttgtcacataatgttgtgtgtcacttactaaaatttcttggaaagcataggaagcaccgcattaatggagagaatagaacagtgatttttagagctgaagctttgaaggataatatatggatgaatagtcaaaggaaaaagcaccctctgtgttctataggcctattaagctactgcagtcattcatttagcaaatctttcctttcctgctgctgttattaacatggtactaggcactgggatgcacaagcatttgagagctgaaagacaggctccacatcctactggtggggaaaaaggggagtgtaggatgtgaaaagtttataacagtggctggccatgggatcatgtcttaaattgctaggacttatccaattttaatggagaaagaggaggaatcagatggaggtggaaatgatcaggtgtcagagatcatgagtctttttgtggattataagtaatttcattcttttgcactttctcttgacctctgaagaccagcagcagcactggtgagaaggctagaactaactgttatatgataactgtaaaccagaaaaaatgtcagctggcccatgtcaatattatgtttcagcagtcttagcattagaattgtatttttcctgttttttttaaatgaatcatgaagcttaagttgtgcatgattgaaacttgaatattatttccacaggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtaggtacttttgagtacattttaaaagaggatttattcttactgtgtgttgtgaaaaaaccttcaccactattgcatattatcatattttaattttgttaagcttcatatattttcaggctataggtttattcttttagaaatattaacacagccagtggaaatatatctgtgaggaatattagaacagaaatcgttcaacaaatgtaaattatttctgtgacattgtaacatttataattgagttttttatgttttctgcaaaggagatgtgattttttaaaaaatatgatttgaatgtcattcttgttaagaataaaacaaaatttagaagtaggagatgataaaagggcagagacacagattaaagagaggaaatgatgattattcataatgtaaaattggaagataagagaggatgaggggcacatcaagttggctgatatgtgagctaaaatttttctaaaaatcattatacaaatacaaagttaactttgtatttggggagagagaagtcatgaaattttaaaatatctatctcagacccaattataggaaaaaccaaaatgagacacaattgtctctatctcaaatatgcgacttgcccttcatctccagaatggcagtggggcagaggagtaggcattattattaatgtaataattttagataataaattcaaagaactgttgaatacttggatgatggaaaatacataataattctttagtttacatattattttaacgaagtagaaatatttttacaggcttctgattgagatagagaagaaatcttaaaatagtcggtgagatcaaggactctcaaatagaaactaacggtacaatacccattattatcatttcattgaatgtactctaattattttatattttaataatataacttaataatatatatgacatattttgtattaattaaaatggctttcttacattattttataacctcaatctcccagtcttatttttctcagaatgatatgttctttatcttttactaattcttctagattttcagaaacctaacctttgtgtttagggaagaaacatcctataatcagtcatagtttttagagatttgttttccatatgatgcctgacataattagaggtcaacacgcaaatttgtatatgccaataagtgctttaaaatttaaccaagggtttgcattatcgagcttttaagaaaagttgaattcatacagcatcatatgtggattagaaaatcacaagtaagcatgatcatacatagtaaaatctgactgcaaaatgttaccaaattagtcatatttactcaaaagttcaatttctcaactgttattcaaagcttcataaacttttggcttctggccaggcgcggtagctcacgcctgtaatcccagcactttgagagtccgaggcaggtggatcacctgaggtcaggagtttgagaccagcctggccaacatggtgaaaccccgtctctactaaaaaatacaaaaaattagccagacatggtggcaggtgcctgtaatcccagctactcaggaggctgaggcagaagaatcgcttgaacccggtaggcagaggtttcagtgagtcgagatcgtgccactgcactccagcttgggcgacagggtgagactccatctcaaaaaaaataataataattttcgttttcttaatcacacaacatattaaatgttaaaaacaataacttttttctataatatgtaatgtgaaaaaatttttaacatagctatatattacaccttatatgtgttatcttaggtttcctctatgagaattctaacttcggatatagtaatgatttcttgctatttttcaattaatcattcatatatcaagttatctagttactgcctaaaaaatgaaaaatgataaaatgggtatttttgtaatatagtagttttgaagaaaggctgccccaaataagaagaaattatagaaggaatgtagattttcttttctcttaaactgtaaatatgacggggtctctctcttaaaaaattatacaatattttagatattttaaaatctttaaaatattatcacaaatacactcattttcatcattcagtgtaagaaatgaaggtttacaagtaaaattgaacttattttaaattaagagatatggctgtttaataatggaaattgttttatttgaaaatttaaagtgatgattctcagtgagtataacctcctgttcaggggtatgtaatgtgcagaaatcagggagataaacaactccaatttgaaatattatttaatattttggaaacgaacaaatataatgcaaagcacagagagtaaagctccacacaatattcttgctgacagagatgcaaattttgggacacagatttgggggagtggctgattttttttttttctgaaaagtatagaaacttatctacagcagttgttcttgaaggatggtctcaaaactgaaaacgttggcacatgtaggtgagaactcataagagatgcaaattctgcccccaaccccaagacatactgaatcagaaactctggggttggatgtggcaaatcattgtaacaagccctacagatgattctgttgtatattcagatttcagaactacttatattatttgctactcagagaatggacttgtctgatttctgcaggcttctgggttatttgaaacttacttgattaaacagtgttcttcagtacaggcgtatatttgtatatatacgtgtgtgtttatagaaagatgtgaatatatatgcatatatattctcagttacaaactataccatagtcttaataatatgcatatattccgtgtcataaaactcacttaacagtggcttggagaacagacctattagtattttaggggctgtatcaattataacagacatgtcttagtctaccttttattgctgtaactgaatacctgagactggttaaagtattcaataaagaaatttatttcttaaagttctggaagctgggaagtctaaggtgaagggtccacatctggtgggaactttcttgctggtgggcacaccagagagtcccaaggcagctcatggcatcacatggcgaggggtgttcactgagagccaaactgggttttataataaacccactcttgtgatatctaactcactcccatgataacccattaagcccttactctatattccattcatgaaggcagaaccttcatgacctcatcaccttttaaaggctctgcctcttaatactgttacattgggaattaagttccaacatgagtttcaaaagggacaaacattcaaaccacagcaaaacattaaaaaaaaaattttctgattaaagagggagcatacatattttcaagtgttcttaagtggaaaataatggatgtgaatgactgggcaaatttaagagtggcatgaggagtaatttattctgctaaatacgtagctttaggaatttaaaaaaaaaagccatgttacatttagtgagacatctggaaatactacatgaggatgagcactttaaaacacttcccgcttcatcagtcagtttacctgtctctgatggtaacagcaatgaactttttgtgaacaatgactttttctacgcctgaaatagataaatatataaagttggctctcatctgttcctattcttccctcgaaaaattgaatctctcagtcactaacttattcgtaatgaagaactgcattccagacatttttcttagacatcgtctcctgctacacaggatgtgaggcaaatgaatattttccatggaactaattcagagagtaaacatatttatagatccagatctaaggtcatggaggagctcattgctttgtaactaaaatgtgtattgattgtattgctgttcatgttctttcttaagataatttacgataagaactcaaatttcttttggatactggttatggtaattgtggctgatctatctaacatgatgaagctcttattatatctatattgattgtgaagccaatgagatcagctactctcattctctcttcagtacaattgtgatttttctcccatgaaaaactatttggtagatctttggtgctaatctttagaaattgtagggcagaagcaatcttgttgagaatttgccccaactcaaaatcatgagtcttcaaaatgttttttaataagatttatactaagacatagatttagttgagtgaataccacacttttagggcttagcttcagaatcacacacttcattttgacctgagttttataattaaaatgttcaccattgttctaattaaatttttagatttaataaggaattacaaagcaattgattacaaaagtgtgaaaagcatatgcatgatttctattcaaatagaataaacaacttactttgcttacattatttcttcttattttggttaaccttcttttaaatctatttccttacagaaacatccatcttaccctatttttaggcattgactacacaactccgtatataccatcttattgttcctgttgagttgcttttagtgagtttcagaattgactttttccttttatgcttcatcattttattgacacaattaatgaaaatgttatttttataggtttctttggttactttagtggcaaacactcttggctactcagatcttggccccattaaatcccttcggacactgagagctttaagacctctaagagccttatctagatttgaaggaatgagggtaagaaaatactaaactttataatgttcttattttttaatggggtttaaaatataaaaacaatgggtatgtagaaattatgagttgtttctgtttacataaatacataggctgtttatgtatgtgtgtgtacatatacatatatacatatgcatatatgtatatatgcatatgtatactatatagtatgcatttacatactatatacagtatgcatatatactatatatagtatgcatatatggtatatatatgcatattatatacactaatagtatatatatgcatattacatatactaatagtatatatgcatattatatatactaatggtatatatgcatactaatatataaatactaattatagcattaattaaatagtatattactaaaaatagtataatactcattagtatatactagtatattactaaaaaagtataatactaattagtatatactattatatattaatatatacagaatatgaaagactatatataaaatatgcatatatagtatagtatatatattatttcatttactgtacatattagtatatatatgcatactctctctctctctatatatatatatatatacacacacagtatttcagtgcatattgtttaacaagggaataagttaatcacagtaatcctgcctttatctaatattgtcaaacaatagaatgatccaaatgagtgacttttttcatattaaatggaaatcttccctgtgctaggaagtccaagtgaaaggggaaactattgttcctaacatcatctctcatacataagtaatcaaggacctacttatatcaggtgttcaaataatatttgtttaagaaactacctgggtaaggagcattagaaaagataggtaagtgagacagcatcagccatcacatttaatttcacctttaaaataacattgcaaagtaagtggaattataactaaattatatttgagaaaactaaagctcagagagtttacttaatttgcacttaggctgcagagtgcctgaaaagatactcaattagcagagacaaacaagttataatgaataacaactaccataacctagctttaaggattgtattaaaccagcaactttgtaacacacatggaggacaacaactctattttctgtaattagtccatatcctcatgtgttggtactcctctaaaatttcttctccagatttatacctgctattttatgcctctgttctggaatgcttcccctgccctgtcccgaccctaacccgtttgtatagcagacaaacacctatctgtcctttaaggctcaatttaaagttgccttgtccgtccaccaggagacataactggatattctctctctgttcagacacctaaaatcctcattatattgtattttacttatttgtttacttaactgcctccctaccttaccttctctgagcaatttaacacggagattagtccagcttactgatactttaagtgtggtttactgaccagctattagcattatctacaaacttattaaaaagacggacggatcatgaggtcaggagttcgagaccagcctggccaatatggtgaaaccccatctctactaaaaatgcaaaaaattacccgggcatagtggtgctcacctgtagtctcagctactagggaggctgaggcagaagaatcgcttgaacccgggaggcagaggttgcagtgagccgagatcatgcaactgcactccagcctggggaacagagcaagactctgtatcaaaaaaaaaaaaaaaaaaaaagcaaattcttggatctcaccccagacctactgagtcagaaactccaggatggggataagaaacttgggttttaaccagcctcaagtgaacattagagatctttcagcctaccaaatcttcactgttatccctacaaacctaattatgactgcaatctctgctattttaattatccagtgtataacggtttccaagtataaaagaaagatcatgattatacaaaaaagttcataagcacaattcaaaaatattctatctacaagttgaaaattacaagtttcattttgtgcagaaaggtggtattagaattcattgacattaacttaattttttgagcattaatagaatgttacaatctatcacaactttcccctacaaaaccacttccttcagtgattaagccagcccactatttaactctgtttgctctttgttctttatctgtattacaggtgaattggatgcaggagaatagtttagtatattttgagaggcaaatgtctatttagttacatttgttaaccatgcaaaaagagacatttattcatgccgcagggctattttgaaggataaatgaaataatgaaataatgcatttgaggcatattgtagtcagcttgtttgagtccttaggctctttagctttcccaactggcttctcatcagaccaataggtgcctgtctttctcagagacccatgattccatcattactcacattttttagaaaaacattttaaacaccaactatgtgtcaggtgttgtgatataaaaaacacagagtacagtggtacatagaccccggtccccaaagagtgagtagggtcaatggttacaagagagacagacaagggcacataatgatacaggaatatacagtagggagtggctatccggggaagtctgggaagacatcacaaggaggtgacatttcagacatttcatgactgaagagtaagccccaaatcataggcagataggcattcaaggcagtgataccacatggtagggaggcacagaatagattgtgcaaggtgtgcttggtcagtgactagatgtatcagagtgcctacgtgataaacatagtagggagggcagcaggaaatgagcatgaaaaggtaggctctattaagagctggctactttgaacttcattctctattcctattcctcctaatcttttttgaggtcacatagactgtaagaatctgatgaaagttagaattgtctttccggaaagacagcacaaccataatgtttgttatataatttcatgcccccaggaaacctctacaggtccatgaactccaaataatcattgctctggaccaaaggtcaacaaaccccagcctgtttttgtaaaaatgttcttggaacacagccataccagtttgtttatgtatgacccatgactaccatggcagagttgaatagttgcaacggagatataacccacaaagcctaaaaatatttataaaaatgtttgcaaaccttctccctagatgatctgattagtagtcagagatccttagtatttctctattttaaagcatcttgagaacctgcttaatacattgcagaaaagaaggatcccagtgctccttccctaacaggttaatctttaacacatttgtacttgaatgggtgctcaagctgaagtgtaagatgacaggtaggttttgaaagattaagtaaataagaaaatctggagagtgttaaatgccacaggaattgccctggatgaaaactggagtggcaaagacaaactggtgatcaatagcagtacaaatgctgaaaagcagaaataaagaaaggattaaagaaaaactgttcctaatttttgtcttaactgaggccagcactatatatatttagtcaaaggcttacatataaagtatttagagtaataataataaatttaaaacgattgctcttatttcgtagaaccagccaaatctaaaggatttaaaccatttaaagattctcaatccttttgtggagaatgtctcaaaaaaagagaataagaaaagaaaataattaaattaaattaaaatgatgtccagtcataattccacctacctgatatacaccaatagtttctctatgggggaatctttaatgctggtaataataggatcatgaacatttaaatgtatataaatatatatttttcatttatgtttatacatttcttttttttccagagtgtacagattttacaagtttaccttatcaataacaggttttggtttattatttttatttattttacatttatttaagctattatattatcttagttattttgtcttatattttgctaacaattttattgtgtgataatcatgtaatttgtaagcctggtgatcacagagttcatgtcttattttgtcttgcttggcacactgctgagtgtagagtaggcatttaataaacatgagtcggctggttggtttgatgtcttagatatttaagggcggcttttctaatttatttatgtctgcatggcatttctttcatgttgcctatttaacatcttactaatcctaatcatgcttttctttcttttgaatactaggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgtaagtgtcccatttcatgagtgcttggtattttaatagatattggacgaaggatataagttattctttaaatagtatattaattataaattgaagataaaatactgtgtggtttttaaaacagtgccagtcttggccgggcgcagtggctcatgcctgtagtctcttcactttgggaggccaaggtgggcagatcatgaggtcaggagttcgagaccagtctggccaacatagtgaaaccccatctctactaaaaatacaaaaaaattagctgggtgtggtggcaggcgcctgtaatcctagctgcttgggaggctgaggcaggagaatcacgtgaacctgggaggcggaggttgcagtgggccaagatcgtgccactgcactccagcctgggctacagagcgagactcttgtctcaaaaaaaaaaaaaaaaaaaaaaaaaagtgttggtctttcctagaacatgttcctacatgaataagaagcatgggttctgttgcatttgagttattaatttataattgactctttggtgtcatgtggactcccatcttgcaccattcaaatattgcttcaaaaatgaacgtttttgaacttcctgcttcacactatgaagggatgagaggaacttcccacaggcatggagaaccctttaaaaaatggagaaaagatgtttcctgtcttattcataaaattttccttcacctttaaaaaataaaaggttatgtgcgaaattcacaggcaactgtaacaatttagaaataattaactgggactaagatttagaatgttacttgggaatatgtcctttttaaaaaaatctttacattaaatggacatgttgaatacagcaaaacttactagtattacttaataattgtggtaacattaaacagacaaaactctgtttatggctattttagaatatgagcttaacattcaaattctattaatgttattcttaaaggcaacttttaagggatggacgattattatgtatgcagcagtggattctgttaatgtaagtattgattatcttagcactaaactttatttttaaaagcttcttagtttatttcagtgatttccaaactataacttcatgaagcccttgggactcacatagacaatgaagaacatccacctgatagtagcctagtggttgtgagtacagcagttggagatagagcctgattcaaattctagctgtaccatatcatccaagctctacaactgacttcgggcaaattaccttaccttcttgagacttagtttatttgtctaatctataatttaatgaatctatcatttgtctaataaatgtctacaatcatccaatgcctactccatagtgttgtgaggacccaacaagaaaatagaagcagggcacttagtgcaggctggcattactaaatgctcagtaaatatgcgcttatcaaaataaaaataaaataattttaatgtatagcttttactgtttttacagtttaaaacaccttggatgagtttatgtgaaataagttccatgctaagaaactttaatgattactccctaggtaatatttttacaaaatataataaagatgtattcggaatcaaaagaaaatacatggcaaaatgtgtataaatatgataatgtctcatttacagtacttttggaaataacatatacatagtatgtcacttagttattgaattttcctaccaatatgagcacaaatatgcatatgattaagccctttgtagttatttgaagattatattatttattacataagtatgtaataaattaaataataagtatgtaatgaatacatgttgaataaattgttaagagtgattatgttaaacctcaacaatgctatggcttcttaaatcctatgtttacctaggatagcactgtttgaattacctggtcaaaccatgtgaaaaagaaaataatgaatgttactgtccatataatgctaacttttgtaaattttataggtagacaagcagcccaaatatgaatatagcctctacatgtatatttattttgtcgtctttatcatctttgggtcattcttcactttgaacttgttcattggtgtcatcatagataatttcaaccaacagaaaaagaagataagtatttcaaatatttttcattgtaatgaaagggatgaacaattattttccaaaaaagataatgtaaagtttaatttgatatcaattcatgattaattttattagaacttcatttatttttcaaataattgactagtatacaattacaaatatgcttaatcttattcatttttgcacagaaaacaattttctaaataataggttctggctaacttatgatttaggttaaacccataggttttgagcaatatatcaactattctgttttttccaatgtttcctatagaggattgaataattaagaaaaatcaatacactatttattcaaaacacattttataagtagttatttattttattttgtgtaatatatattgggttggagcttggggagaccaacgtaagatatggttcctgagctcaaggagtttatgtcatagcagaataaataacacaggtaatgaaaattaagacttgttgaatactgtaatttgagcaatcttctgaaatttttaattaattaatcttcacatcaactgtattagtttctttgacctacgagaacaggataatacaaacctgagggcttaaaacaagagaaatatattctctcacacttttggaggttagaagtccaaattcaaagtgtcagcaggtccatgttctctttaaagcctctaagaaaatatattttattgcctcttccagcttctggtagcccaggtgtttcttggtttatggcaacagaactccaatctctcccattatagtgacatgccattttccctctgtgtgtctttctcctctactagtaaggatgccagtcacactggattaagagcccactccactccagtatgacttcatcttaattacatctgcaatgacattattttcaaataaggtcacattctgaagtgctaagggttaggacttatatgtaccttcttagggcacacaatccaacccataacatcaatcacaaaagtattattacagagtctctttcacaaatgaggaaaggcacacagaggttaagtgacttacccaaggtcatatatcgagtatgtgatgaaggttagatagagtcagtagtaaattcgatgtatcttgtactctattaaactctctactatgctctatccccaaatactataatcatgataaatacaataagaaaaattaacaagcacaaaaaatatacatgacagtcagagtaaaaatagatgctgctatagaatggtttatgaaatacgtgacaattgagaaggctttggaaggtgggaaagaagacatgtagcaacggagaggcaaaagaatggctaacccacatggagtgaaacagaaatgaatgagcaaatgaattgtgttgataaaagaggcagcaattcaggggggatagcaatgctttcggttttgaagaaatttaagatttggagaaatagtaaaagatgaggttttaacctgcctgagagtagatataaaaagccgtattagaccttttttaatagcagctggtgtttcattcatatatgttgagtagggaagaatatggaagcaggagattgatgtttattaagactccatgatatgtcagatcctgtgtaaaatacttctaacataattgtagtcaaattttacaacaaatctaaaagacatagtatcctcatttaacctctcagaaaaattatcttatttgcacatggcctgacagctaaaaagtagtttcattatggatctagctccagaattgctttttctagagactgagctttacaaaaaattaatctagcagtgatgcacaaaatgactagggaaggaccaaagactatttcagaccctgcttgacctgccacctggaccacactaagtctccaaattagtcctgtgtgtcaatggagaataggaaatatgttccattaaaacattttagagggtagaatctacagtattgcttgtgatttgcaagagataaaggagtctaattctggagtttcttgtcaactaactgagatactctggttgtggtaccacctatacaaaaagagatctttggagactaaatggtagaattacaaaagagaataataattttgggtactggcttagcatctaagaagacagatgtacatgtaccaaaatgtcattagtgtgcatgattgactatttgcaagtagacaaaaatttagtaaatattgcattatttatcctgacatttacaaatacagatgtttatttttaaagatttttaaatttcatgttccattttacatttataaagtgtacactgattttcaatttatttttctcaacttaagcattatatatacatacatgtaatatataagcacacacaagtaattcctcagtcttccctgcataggataaattaagcgtgtctagaaagagcagtatgagcataaataaaacagccaacatccaattgactttaatcttcctgcttgttaatgttattcttacaacatttctactgcaggaagtaaaataggatgggttgatactatcaccaccaaagtcaggaaacagttactgatttagaagcatcaaaaactcatatcccctatcattcttccagtatttcatcttgcaatctaagtatagcttttattttctgaccttttctgaatgatttagaatttctttccactcttccctgaaaaaacatgaccaacacttcaattagttaacacatgctatgtagaagtacgtagtagatgctttgtgatgaactcatttattccaaagaaaaaaaacaaatgaaagtggtatccttttctttgcctttcctaattttaattattgtggtaaggaaacttaatatgagatctacctgcttaacaaaatttttaagtatactatatatattgttaactatagttacgaagtactacaggaagtccctagaacttattcatcttgcataattgaaactttattcccattgaatagcaattctccattctcccatcctttcatgccctggcaatcaccattcttctctctgtttccatgagtttgaccattttagttacttcaccgaagtggaattatgcaatattttttctgttacttcactcagcataaatttatccaggttcattcaagttgctgcatatggcaggatttccttctttataaggctgaatagtgtgtgtttgtgtgtgtgtgtgtacgtgcacacgcacatgcaggtatacaaataccacattttctatcccatcattcatcaatagacatttaggttgttttcatatttggatacagtaaatagtgctgaagtgaacatggaagtaaggactctgagatcctgagttcaaatttttaaaatatgctcagatgtggcattgctagatcaaatggtagttatatttttaattttttcaggaactttcatactgttttctatggcagctacatcattttacattccaacaatgtacaaaggttctaatttctccatatccttgccaacacctattatcttttgatttgggtggtttttgtttttgttttggtaatagccatcctagcaggtatgaaatgatatctctttacggttttttgttgctgtttttttttttttttttttttttttttgttgtttttttttttgagacggagtttcgctctgtcgcccaggctggagtgcagtggcgcgatctcgactcactgcaagctccgcctcccgggttcacgccattctcctgcctcagcctcccgtgtagctgggactacaggcgtgcgccaccatgcccggctaatttttgtatttttagtagagacggggtttcaccctgttagccaggatggtctcgatctcctgacctcgtgatccgcccgtctcggcctcccaaagtgctgggattacaggcgtgagccaccacgcccggccttgttgctgtttgtttgtttgtttttgaaggagtctcactctgtcaccaggctggagtgcagtggcgcgatctcagctcactgcaacctccgactccctggttcaagtgattctcctgcctcagcttcccaagtagctgggattacaggcatgtgccaccatgcccagctaatttttgtattttcagtagagatggagtttcaccattttggccaggatggtcttgatctcctgacctcatgatccacccaccttggcctcccaaagtgctgggataacaggcatgagccactgcacctggccctcattacagtttttatttgaattttctgatgattagtgatactgagcatcttttaatatacatgttggtcatttgcatgccttcttaagttgcaggagttccctatatattttggatattaaccatttattagatatatagttggaaatattttctcccattctataggttgctttttcaccctcttgaatgcttcctttttttcccaaagctttttagtttgatatggtctcaattgtctatttttgctcttgtttgaattttggagtcattgccaagaaatcattgtcaagaacagtatcatgaagctttcctgctatgttttcttctacaagttttacagttttcaggtcttaggtttaaatgtttaatctattttgagtttatttttgtgtatggtataatataagaattcaattttatttttttatatgtgaatatccagttttcccaacattatttgttgagtggcctcttttctattgtgtattcttggcacccctgttgaatatgagttaactatttatgcatgggtttatttctgggctctctatcctgtttcattggcctatatatttgttttatgccaggaccatactattttaattgttgtagctttgttatacattttgaaatgaggacctgtggggactgggtgcaatggctcatgcttataatcccagcaactcgggaggctaaggctggaggatcacttgtggccaagagtttgagaccagcctgggcaagatagactccttctttacgaagatatttgaaaagtagccaagcatgatggcacacacctatagtcctagctacttaggagcctgaggtgggaggatcactgaagcccaagagtatgaggctgcagtgagctatgatcatgccactgcactctggcctgggcaacagggtgagatcttctctctcaataaataaataaataagaaatgagaaaatgtgattcttccattttgttcttttttcttaagattgctttggctattcagagtcttttgtggttccatatgaattttaggatctttttttattttagtaaataatgctattgggattttgatatgtactgtattgaattcacagatcacttagggtagtatgggcattttaacaatattaagtcatttaattcgtgaatactgggtctttccatttatttgtgtcttctttaatttccttcatgaacattttgtagttttcagtgcatacattttcaatgccttggttaagcatatcctaagtattttatttcttttgatgttatcataaatgggatttctttcctaattttctcttcagattgtttattgttagtgtatagaaacgcaggtgatttttgtatgttgattttatatccttcaacatctagtaaatttgtttattagttctaacagattttcctgatgtgtggagtctttagggtactctccatataaaataatgtcatctgtaaacacttttttctttcagattgggatgtcttttacttgtttttcttgcctaatttctctggctaggacttctagtgctgtgttaaatacaagtggcaagagtagccatatttgtcttattcctgatcttacaggaaagtttttcagtttttcaccattgaatacgatgttagctgtgggattttcaagtagtctttgttatcatgaagtatatttcctctgttctcatccatttgtgctactataacagaataccacagactgggtaatttataatgaacataaaccttatgggatcacagtactggaggatggaaagttcatgactgaggggctgtctggtgaggtcttatttgttgtgtcataacatgctgtaaggtatcatgttatgatacacatggcacaaagagagaataagtgagaaaaggaggcagaacctgcctgtttataatgaactcaatcctgagataacagcattaatgcatttaaaagggtaaaattctcataacttaaacacctcttaaaggtctcacctcccaattctgtcacaattgcaattaaattgcaacatgagctttggaggggacaaaccttcaagttatagcaacttctatacctagcttttgttttctttttttagtttttaccatgaaaggttgttgaaatttgtcaaatgcttcttctgaatctcttctgatgatcatgtgatttttatccttctcagatcatgtggtgtatcacattattggtctgcatatgttgaaccatccttgcatcctagggacaactcccacttggtcgtagtacatgatcatttaatgggctgttgcattcagtttgctaatattttgatgaagttatttgcatctatgttcatcagggatcttgttctgtagtatgtttttttctgtttaaatatttgttcatttttaattgacaaaaattgtgcttatttatggggtacaaaacaatgttttgatctacataaacattgtagaaattttcagtcacgctaattaacataaccatcacttcacccacttatcatttttttgtggtaagaaagttaaaaagctattcttttagcaattttgaaatatacatttatttttttcatttcctattgtgtgacttttttgacttttattttaagttcaggggtacatgtacaggatgtgcagtcttgttacataggtaaacatgtcataggggtttgttgtacagattatttcatccctgaggtattaatcccagtatgcattggttatttttcctgaccctctccttcctcccacccttcaccctcccataggccccagtgtgtgttgttaccctttatgtgtccatgtgttctcatcatttagctcccacttataagtgagaacatgtggtatttggttttctgttcctgccttagtttactaatgaaaatggcctccagctccattcatgtccctgcaaaggatatgatctcgtttttttttgaatggctgcatagtattatatggtatatatttaccacattatctttatccagtctatcactgatggtcatttgagttgattctatgtctttgccattgtgaatagtgctccaataaacatatgtgtgcatgtgtctttataatagaaaaatgtatttccctttaggtatatacccagtaatgggattgctgggttgaatggcatttctgtctttaggtctttgaggaattgccacacagtcttccattatggttgaattaatttacactcccatcaacagtgtgtaggcattctttttttctccacaccctcgccagcatctgttattttttgactttttcataatagccattctgactggtgtgagatggtatctcattgtggttttgatttgcatttctctaatggtcagtgacattgagctttttttcatatgcttgtttgttgcatgtgtgtcttcttttcagaagtgtctgttcatatcctttgcccactttttaatggggttgtttatttcttgtaaactcatttaagttccttatagattctggatattagacctttgtcagatgcatagtctgcaaaaattttctcccattctgtagactgtctgcttactctgttgatagtttcttttgctgtgcagaagctctttagtttaattagatcccatttgttaatttttgtttttgttgcagttgcttttggtgtcttcatcatgaaatctttgcccatgcctatgtcctgaatggtattgcctaggctgtcttccagggtttttatagttttagattttacatttaagtctttaatccatcttaagatttattcctctactctaaatgaaaaatgtacatcctttgatcaagatttatactttctccacatcgtcttcccccagtcctatggcaaccacctttatatgctgtttctgtaatgttgacttctcacttttttattttttatttatttatttttttattttactttaagttctagggtacatgtgcacaacgtgcaggtttgttacatatgtatacatgtgccatgttggtgtgcggcacccattaactcgtcatttacattaggtatatctcctaatgctatccctcccccctccccccaccccattttacatgtaagtgagatcatgtggtatttgtctttctgtacctggctaattttgcttagcataacgtcctttagtttcattcatgttgggatgaatgacaaaatttgttcttttaaagttttgtatagtagtgcactgtgcatacctatcacattttctttattcattcacctgttgatgggtacaggttgcatgtatgggttagtgcaaaagtaattgcggttttggccattacttttaattgcagcaaaagtaatggtaaaaactgcaattacatttgcaccaacctaatatgtcttggttcttgtaaataatgctgaaatgaacatgggagtgcaggtatacctttgacagaacgattttaattcctctaaaggaattaaatatataccactatatacctagaagtggaattgctgaattatatggtaattgtatttgttttgggaacttccatgctatttttctcaaacagctgtactaatttacattttcactaacaatgtataagggttcctatttctccacatcctcatcaacacttgttatcattcatctttttgataacagccattctaggaggtgtgaggtaatatttcattgggattttaatttgcatttttctgatgattagagatgttgagcattttttaatatatctattggccattcatatctcttcttttgagaaatgtctgttcagattatttgcccattctacaattggtttattgattttctaggtgttgagttgcttgagctttttatgtataatgttggatattagccctttatcagatgtatggtttgcagatattttatttcaatccatgatctctctctccactctgttattgcttcgtttgctgtaaagaacatttttagtttgatctaatccaacttgtctcttattgtcttttgttacctgtgcttttagagtcctagccaagaaatccttgcccagataaatgtcatacagcttttcttttatgttttcttctagtagctttatagtttcatttcttatatttaagtcttttacttgtttggttttataaacatatggtatgagaaagggcccaatttcattcttttgcataaggaatattcagttttcccaacaccatttattgaagagatcgtcctttcccccattgtttattctttgcacctttgctgaaaatcaattgactataaataattgggtttatttctgggctttttatccttttccattagccaatatatctgtgtttatgccaatagcatagctttatattttgaaatgacagagtattgcacctctagctttgttctttttgctcagattgctttggccatttagcatcttttttattttattcaaatgttaggattttttactatttctgtgaaaactgacattagaattttgatagggattgcattgaatctgtagattattttgggtagtatggacattttaacaatattaattcttccaacacatgaacatgaaatatattacaatttatttgtgtcttcctcagtttttttaaatcaacttatagttttcagtgtacagatcttcaactttcctggttaaatttacttcaaagtattttatttatttattttgatgctgttttaaataggattaatttcttaatttctttgttggatacctcattgttaatgtatagaaatgctactgatttttctatgttgattttgcaaactgcaactttactgaatttatgtatcagttttaacagttctcagtagagtgttcagggttttctacatataaagatcatgtcattagcaaacagagataattttatttcttgctttcttacatggatgtattttatttctttttcctgcctaattgctatggatgggatttctagtactatgtcaaaaagaagtggtaatagtcgatatccttgtcttgttcctgatcttagaagaaaagctcccaacttttcagtttttgcataatgttagccgtgggcttgtcatatatggctttattttgttaaggtacattccttccatatctgctttgttgagattttattatgaacatatgctggattttatcaaatgctttgtctgcatctagtaagatgatcatatgatttttgttcttattttgttaatgtagcatatcacatttattgatttatgtatgtttaaccatttttgcatccctcagataaatcccaagtaatcatggtgaatgatgttttaaatgtgctagggaattcagtttgctaatatattgttgtgaatttttggatctatgttcatcaagaatattggcctgcagttttcttttctggtagcatactcttagggttttcatatcagtataatactggcctcataaaatgaatttgacctccttttcaattttttggaagaatttgagaagaattcatattacttctttaaatagaattcaccagtgaccttttccttttttttttttttggttaggagacttaatttattactgatctattttctttatccagtattggtttgttcagatgtaatatttcttgatttagtcttggtaggttgcatgtttctaaagattagttcattccttctaggttattcaatttgatggtgtatggttgttcacattaatagtttatgattccttgtatttatgtgttatcagtgttagtctcccttctttcatttcagatattgtttgagttgtcttttttcccttggttagtctagttaaaggtttttcgattttatcttttcaaaaaaacaactttttagtatttgctttgtttatttctatcattatctttgttattttcttccttctgcaaagtttggggatattctgttcttctttttctaatctctaagatgtaatattaggttgtttatttgagattttccttctttctttaatgtaggcatttattactataaatttttctctcagggcttctttttctacattccatactatttgttatcttgtgtttccattgtcattgatcccaaaatattttctgtttttccgtataatttcttctttgacccattgcctgttcaggagcatgttgtttaatttccacgtaattatgagttgttcaaggttattcttattgacttctagtttcatgtcatcatgaacagaaaacatactcgatatgattttaatcttcttaaatttgttaaaacttgtttggtggcctaacatgtgatctatcctggagagtgtttcatgtgatttgagaagaatatgtattttgttgctgttggatgaactgttctataaatatctgttagatctattggattaaagtgtagttcaagccttcctctaataagaaactgcataaattatgtcaggagcaagccagggaagaagccaccttcctgttcttggtggtagagaccttccacatcttttaaaagaaagattgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcatgaacccgggaggcggagcttgcagtgagccgagattgcgccactgcactccagcctgggcgacagagcgagacagcgagactccatctcaaaaaaaaaaaaaaaaaaaaagaaagattgtagagttgggattgtctctggaggaagccagggaagaaggcgtggggaatgttattcctcttgtttaggctgaagaaggtttattcttcatttgctatgtagatttccaagtactggaagaggccagaaccacagggagcggctggaaaacgtgtagcctaatggtttccatggggaagttggaagatggtctgatcccaggaattaaagcttctgagagtgctcaggcagttcaaaaccccccatcgttttttgtacttgagagaaaactccaatggcttatctctgccattcctcaagcatggtgatctaaaagccaagctctgtgtcagggcctataaaagttgggttctacaaaatggaaaaccaaggcaattatgaagatgattttataatatagttcatctcttctctctttacactctagaaaaagcattttctagaaataaatacatttccttaaattaaaaaaaagttgggttctatatgtgtgctatagtttctcaacccttgggaagtagctgcaaatttggttttcttcccaaatgtaaggcactgtgctcagggtggggttagtgcatgagtgtctttccactttttctacccattttgatatgggtattttctgtcctctggtgtgcatgagtttttctactggattctgggtttctctggagagaactgatccatgtgtatgtagatgtttacttggtacgtccatgagagaaaaaatagtcataaacctcctattccacaatgttgctgaagtcacttccttcaaaagctgtaattttcttttcttacagtgtctttgtctggctttgatatgagaataattctggccccataaaatgactttcgaagtgttctttcctcttcaaagttttaagagagtttgagaagaattaatgttgtttcttctttaaatgtttggttggacttctccagagaagccgtctggtcctgtacatttcttttttgggagttactatcattatcattattattattattattattattattattattattggttcaatttgtctattcagttattctatttcctcatgattcagtcttggtaggttgtatatttttggaatttacctattccttctaagttatccaatttgttggtgtataattgttcatggtagtctctttgatccttcttattcccataaaatcagttgtaaattctcctctttcatttctggttttacatatttgagtcctctatcttttttcttagttatgcttgctaaggatttgtctattttatctttcgaaaaaaccaattcttagttttgttgactttttctattgcttttttattctctatttcacttacttagctctaatacttattatttccttccttttgctgatgttgggcttagtttgttctttttctagttcctagacatgtaaatctatattgtttatatgagatatttctttttataatgtagacatgtatctcaataagatttgcttttattactgcttttgctgcatctcataaattttggaaattgtgctttcatttttgtttgtttcaagatacttttaaattttcctattgattttttttctttgacccattgctttttcaagagagtgttgtttaatttccacatatttgtgaatttttcagttttccttctattactgacttccagtttccttccattgtggtcataaaagatatctggtatgatttcaacttcttaacagttgtcaaaacaaacttcatgacctgatatgtgatctatcctgagaatattctgtgcgcacttgaaaagatggtatattaagatgctgttgggtagcatattctgtgtgtttgtgatccatttggtctatagcgttgttcaaatccacagtttgtttatagattccatatctggctgttctgttcattattgcaagtcgggtattgatgtatcctactgttatggtgttgctgcatgtttatcccttcagatctgtcaatgattgctttacgtatttacatgctttgatgatggattcacatatatttataattgttatatcttcttgatgaattaactcttttatcttattttatgacctactttgtctcttgtgacagttttttatttaaaatctattttggctgatataattacagggtgtcctctgtgtctgtgggttttacatctgtagattcagccaatgctgattgaaaacactgtattcatggaatgtgaaatccacagatacagagggtcaaatttttttatccacaggtcctgcaagactgactgtgggacttaagcatcctcaattttggtatcccttggggttctgaaaccatgaccctgtagatactgaaggacgactgtatagccccattgctctcttttggttaccatttctacaaaatgtatcttttttatcaattaactttcaaactatgttttcttaaatctgaaacgagtatctggagacagcatataactggatcttgttttcataaatctatgcagccattgtaggtcttttgattgggaagtttaatccatttgtatttgaaataatcattggtaggtaatgacttactattgcctttttgttaaatttttctgttttgtaattctttttttctgtctttttctctcttaactgtcttcttttgtgattggatgatattttattgtgatatgctatgatttctcttttttatttctgtatttttacgtggattttccttgtggttatcatgaggcaatcacaaatatcttataatagtctactttaagctgataacaacttaacttcaatcatatatcaaaaatcttcacttttaatacctccctcacactttttgttatgtcacaatttacatctttttataatgtgtttctacaaacacatttttgtaattttagttattcttaattattttgacatttaacttttatattagaattataaatgatttatataatactattagagtattacagtattctctatttgtccatgtatttacctttactagtgagatttgtgctttcatatgctcttgtgttgctctttaccatgctttcgtttcaacttgaagaactcactttagcatttcctataagataaatctagtggtgatgaactccctcagcatttgcttgtatgagaaagtttttatccttccttaattttaaaggacagtttttccaggtatattattcttggtcagcagtttttttctttaagtattttgaatatatactttcactttatttgctcttttaaagtttccactgagaaatctgctgttcatcttaagagagctcttttggacatgacaattcagtttttttcttgctgctttcaaacttccctttcacttttggcaatttgatgatattatgtctctagtggagactttctttcttttttttccgagatagagtttcaccgtgttgcccaggctggagtgcagtagcatgatcttggctcactgcaacttccacctcgtgggttcaagcaattctctctgcctcagcctcccgagtagctgggattataggcacccaccaccacacccagctgatttttgtaatttttggtagagatgtggttttgccatgttggccaggctggtcttgaactcctgacctcaggtgatccactcccgctcagcccctcaaagtgctgggattacaggtgtgagccaccatgcccagccgagacttctttagatttgtcctatttgggattctttgagtttcctgaatttagatgttcatatctctccccaaatttgaacatattttagtcatttaaaaaatatttttacacccctttctgtcttctctgtgatttcataatgcatatattgttccacttaatgatgtcccatgaaccttcactcatttttttttttatttcttcttgctccactgactggataattttaaatgatctacctttttttttttttttggtgtccatcttttgagggttttttaattttattttttatttttttatttttattttttattatactttaagttttagggtacatgtgcacaacgtgcaggttagttacatatgtatacatgtgccatgttggtgtgctacacccattaactcatcatttaacattaggtatatctcctaatgttaggtatatccccctcctccccccaccccacaacaggccctggtgtgtgatggtccccttcctgtgtccatgtgttctcattgttcaattcccacctatgagtgagaaagtgcagtgtttggtttttttccttgcgatagtttgctgagaatgatggtttccagcttcatgcatgtccctgcaaaggacttgagctcatccttttttatggctgcatagtattccatggtgtatatgtgccatattttcttaatccagtctatcattgttggacatttggcttggttccaagtctttgctattgtgaatagtgccgcaataaacatacgtgtgcatgcgtctttatagcagcatgatttataatcctttgggtatatacccagtcatgggatggctgggtcaaatggtatttctagttctagatccttgaggaatcgccacacggacttccacagtggttgaactagtttacagtcccaccaacagtgtaaaagtgttcctatttctccacatcctctccagcacctgttgtttcctgactttttaatgatcaccattctaactggtatgagatggtatctcattgcggttttgatttgcatttctctgatggccagtgatgatgagcattttttcatgtgttttttggctgcataaatgtcttcttttgagaagtgtctgttcatatcctttacccagtttttgatggggttgtttttttcttggtttgttgattctttctccagtttgatcaagtctgctattgaatcctctagggagttttttagttcaattattgtattcttcaattccagagtttttactgatatttgactttttgtgtgtgtgtgtatagtttctttcccttcattgatatcctcattgtgttcatgtatcatcttcctgattttgtttagttgtctatctctgttctctggtactttgctaaacttcattaggataattattttgaattcttttttaggcaatttataaatctctatttctttagggtcagtaactgcggatttcttttatccctttttgttgtttccctaattctttgtgttccttgtgctttgcattggtgtctgtgcattggaagaatagccacctgtcagccatccgacacaatgtcacaaaggacacaaaacagccaccaagatttatggactgactttgacagggcaagacctttgccagtcagcctggctagagatactgagagtctctcaaacagctaatctaccgtccccttttcctatgtttgtagctgtatcaattgttctaatcatactggttctttcagtgctccatatgaggcaagagtgaaactggaccctagtgcagcacactgaatggcaaggacatttgatgtgctccactcctctccctcccttgaaagtggtatcttgatgaaaatgaataaattagcccctagaaaggatggataaattgtttcaaaccaagtaacaggataccagcacagttatgattgaaatgcctgtttgatttgaaaacccatatcttttccacaatgcaatgttgccacttactgctttttaacttcaataatttgatcaaagcttatggctctatcaactacccatgcctctttctaataaccaaccctattttactagtttttccaactattcatcatcctcataagtacttttttcacctctaatgatttcatgtgaaattagtttttaataatcataaaacatactactattagaacaaaagtcattaatgagttcaagttataaaaaggaagattacatgatatacaaatatataattacaaatttgagcaactatggagtaaatgttaacaataacctcatttcattaactctcatcttatcaggaagtttaatagcaccaacagtaatagtaactaaaatttaatgaagacttaccatgtgccagatattatgctaagtattcttcatgcattacctcaatttatcttctcagcaaacacaaatgcagtgactactcttataatgatgaggtggttttacttaaagaattaagaaacttacccaaggacaaaagaaaggacttgaacaaagatgatctgacaccagaagtgaagaagtctttattactatgtaatacagcctcaatgtagattgtaacacagaaaaaaactagcctgacttacagaattccttccacctaggttttaaagggatacattttgcacaaggcctaaataagctataggaaaacaaaacacccacgcaagtttctctattgaattaattcataatctcctattagttttatcccattcttcatcatattgacaaccaggatatcattaggggaaaacaaaatctattactttgattttctcttcaaagttggagttttctcctcagtttttctccagcttcttctgtcaagttcttggcatgctgtaattttcagtccccattaatgaacagtaaaggatctgggtttctcttgacattgacatgaagtctgtctctctcatgccttgccagtaggtgagatgaatatgaaaattacataaagactgcatattaaatagaggaaagctgaattaaaacactctaaggtggccggatatggtggctcacgcctgtaatcccagcactttgggaggccaaggctggcagatcacttgaggccaggagttcaaaaccagaccagccaacatggtgaaaccctgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagcaagactccatcaaaaacaacaacaacaacaacaacaacaacaaaaacactctaaggcagaaagggaagtctggttaccattaggtgtttgatgaataagaaaattcaatataatgggaagcttcccattcaatagcaaacaattaaaaaaataagtaaataagaggaagctgaatattaccaaatccaagagaataaagggaaaccataaccaggtcatctttaattccagcaccctacaagttaagtaatgatctcagaactataaatccttgaaaataaattcttaattatatggattatactaatttatgctgtgacttaaaaaggtgaaattatagactaatgtagaatatacataaatctgtaaaacttacagctaacttaagaaattagcagagaacaaagggagcaactgaagcttctagcccccctttgtaagatttaggcttttccagtcaaaaacctcatttagatgttatgttatttactgttgaattttaaaagttatattttcttttatgtaatcaattggaaagtccttcagtttgggtatgataattgataacttcctcagtacctagaaatctatcaaggataatgttgacatccaataaagtgtttatgttgaaatcctttatttagaattaaaaaggtagtcaaagagtttcttgaaatagagatatagaaatgtatattatcattttagtttatattcattttttatgtaaaggaataatggtatattaaaatgaatataaaattaatacaattttggttattgtatgtagcccctattctttttttattattatactttaagttctagggtacatgtgcaaaacatgcaggtttgttacataggtatacatgtaccatgttggtttgctgcaccaatcaactcatcatttacattaggtatttctcctaagtaatccctcccaaagctcccaaccccctaactgcccctggtgtgtgatgttcccctccctgtgtccatgtgttctcattgttcaactcccacttatgagtgagaacatgcagagtttggttttccgtccttgtgatattttgctgagaatgatggtttccagcttcatgcatgtccctacaaaggacatgaactcatccttttttatggctgcatagtattccatggtgtatatatgccacattttctttatccagtctattattgatggacatttgggttggttccaagtctttgctattgtgaatagtgctgcaataaatatacatatgcatgtgtctttatagtagcatgatttacaatcccttgagtatatacccagtaatgagattgctgggtcaaatggtatttctagttttagattcttgaggaatcatcacactgtcttccacaatggttgaactattttacactctcaccaacagtgtaaaagcgttgctatttctccacatcctctccaacatctgttgtttcctgactttttagtgattgccattctaattggcatgaggtggtatctcattgtggttttgatttgtgtttctctgatgaccagtgatgatgagcattttttcatatgtctgttggctgcataaatgtcttcttttgagaagtacctgttcatatcctttgcccactttttgatggagttgtttgtttttttcttgtaaatttgtttaagttctttgtagattctggatattagcccttttgtcagatggataaattgcaaaaattttctcccattctgtaggttgcctgttcactctgatgatagtttcttttgctttgcagaagctctttagtttaattagatcccatttgtctgttttggcttttgttgccattgcttttggtgttttagtcatgaagtctttgcccatgcctatgtcctgaatgatattgcctagagtttcttctagggtttttatggttttaggtcttacatttaagtctttaatccatcttgagttaatttttgtacaaggtgtaaggaagggatccagtttcaactttctacatatggctagccagttttcccagcatcatttattaaatagggaagcctttccccgttgcttgtttttgtgaggtttgtcaaggatcagatggttgtagatgtgtagtgttatttctgaggcctctgttctgttctgttggtgtatgtatctgttttggtaccagtaccatgctgttttggttactgtagccttgtagtatagtttgaagtcaggtagtgtgacgcctccagctttgttctttttgcttaggattatcttggctatgcaggctcttttttggttccatatgaactttaaagtagtttttttccaattttgtgaagaaagtcagtggtagcttgatggggatagcattgaatttataaattaccttgggcagtaatgccattttcatgatattgagtcttcctatccatgagcatggaatattcttccatttgtttgtgtcctcttttatttcgctgagcagtggtttgtagttctccttgaagaggtccttcacatcccttgtaagttggattcctaggtattttattctctttgtagtaattgtgaatgggagttcactcatgatttggctccctattctttataaaagttctaaatatttgccaaatcatcaaagaagatattcattacttttaattcttacaaattttcttagcaataaaagtcacagtaagacagctagcagataaaaaagataaaagtacatagtttaaaacaacactgattagcacaccaaaagaatattgagccaatccttattatatgtaatacaaatatttatatatgcacatttaactgtgtttggagacccatgtttctacacatatgtaattatttaagatatattttatgtatagctatcatgaacataataaaatacattttatttctatattaacacattttaacctattttagtaatctatagaaagatgtagacaatgattctggttttaactacatttattttttgtttgtttctttaccttggaggtcaagacatctttatgacagaagaacagaagaaatactataatgcaatgaaaaagctggggtccaagaagccacaaaagccaattcctcgaccaggggtaaaaaaatatatatatctttagcatatagattttcaaattatttctaattcatttttaatgcacatctttaatttctggataatacttgaaaagtttactctgcattcgatattattcttatttctttgcagaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtaagaatatttatttttcagattttattttttgagtaaagctaaacttcacttatgctcaaggaagtatatgctgaattcttgaacacaaatttactcttgagtaagtcagtacaatgaaagaatgaaaaaatcctaaaaagcaaaacaaatatctgtctctcatactacagtgtttctgggtttacactacaggccccaaagccaaatatttctatctattagaaggaaattatacttgttgatatttagtttccaatattacctttgcaaaactagttaccatgtttatatatagctgtgtcttggaaaaccaatgttgaatctgaaataacttctggttttagcacatgtgagacttgtcatttgattaatgataatattaatagccagaatatctgtgaatttgtgaaaattcttccagaatttaaagtgaagttaagatctctagaaatgccagttttattttttacagcttaatacttcacaagtgtataaaatgccaatcattcctcaaccagccatggtgttcatgtctgtgaataacagcacatgattttatacttcctatacattcattgccatggttgtttttctatcttcttgtttttgttgttgttgttattttcacatatcttgcaaagtattttaggattgtatttctttttagaattataaacttttaagagagagagattatagagattactacaagtttaatcaacaggttatcaatctgaaaaggttcaaggttgcatgacttagaatcataaaattgagtgccacataacagagtaagcatttaaaatcaataattttggaaaagcatattatcaccagaagtcataccaaaattgatataagaaaatgtattaaaatttaggtgagaatttcacactaacaaaaatgattctgaaagcattcctattaagtcaggaaaaaaaaaagagtgtgcctgtatcatccctgtttttagtgttgttggccaatgcaattagataagaaaacagagaggtacatatataaaaacaatggagtaaatgatccttaatataatgaccttcttcatataatgaaagaacttgttcatatattgaaagagaatcaactaaaaataaattcaattagagttcaaaaggtacaaattttaaattacatgtgccaacactaataattatcttatacatgaaaaaaattagaaaatctgattcacaattgcaataaaaataaagtaaattatctaataataactttatcatatgagacttctgaagaaaactttaggatataaaagaaagctaaaataattgaaaggattgtcatgtacttagataagcttctctcattgtaattaagactttcaaatttattaatctataaattcaaggaaaatatcaatgagtctttttatgtagtgtgggtaataaatagacaaaaacaatataagtctaaatgattctaaattcatctggaagaaaattagggtgacaagaggtggcttattctgcaaaatattaagacatatagatgttaaataaaactgttcaaatataaaagctcagtgggtttgaagagagtccaaattaaactttaatgtataattaccaatttactgtgtgaaaagatcacatgaatcaaaatctaaagttaaaaaaaaagattctagtaggaaatatgtggaaatagacatataaccatatactcttatagtcctttctatgcaaaacacaaatttgtaaagccaaaaaaaaaaatgaagaagaaatgactgcacaaaaaaacaaaatattctttggggaaaaaatcatcataaataaaaggttgaaagacaaaaaataggtgaaatgtttacataacagttaaggccgagaaaggatcaatactttaaatagaaaattgttcttataaattaataagaatatagtaaaaatcccaatagacacatgggcaaataccaaactaagccaaaaacagaagttaaaaacaaccaataaggatacaaaataacaaaacacaaggaaaattgtggattattttcacaaaaaatgcaaataaattacaatagtagatgttttcaaatgtcatgaaaattttttggtaaaaaactataaagaagaatggtagcactcaatactgttgaatgtgtaaagtatgagcactatcatatactgccattagaaatgttaattagtacaggctttctggagataggttcagctatatattgtgtgtatatatatacacatacacacacatactatgtatatagtatagagtatgtatatatgtatactatatatatacatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatatagtatacgcatactctatactatatatagtatatgcatactatatgctatatagcgtatatgcatactatatgctatatagagtatacgcatactatatgctatatatacatactatatagtatacatatactatgtactgtatatacgtatacttagtatatgtatatgtatatgtatagtatatgtatatgtatagtatatgtatactatatactgtatatagtatatatagtatgtgtatatatatagtatgtgtgtatatatagtgtgtgtatatatataaacatatatatactgttgacccaagttctattaacatattattaaaaagtactcatgcaattaggagaacatagctatttagatattcatttcagtaacaaaaatggaaacagtataaatgctagtcttcaatttgtggttattttgagagaacattataccactataataaattatttcgttgtcatttttatgaaactatctccatgacatataaagtaaataaaataggttacaggctgggcactgtggctcacgcctataatcccagcacattgggaggccgaggtgggcgaaatcacttgaagtcagaagtttgagaccagcctggccaacaaggtgaaaaccgtccctaccaaaaacacaaaaattaaccaggtgtggtggcgcatgcctgtagtcccagctactctggaggctgaggctggagaatcatttgatcccgggatgcagagattgcagtaggccaagatcacaccaccgcactccagctttggcgacagagcaagactctgtcttgaaaaataaataaataggttacaaaaaaagcttatataacatgaatacatttgtttgtgtgtgtacatgtgcttgcacagaaaaatgtctgaagtgatactcaaaaaaatattgataatagttattgttgacatttcaggtgatttatattttctttttagcatttaacggtattgcttgaattttctatgtgagtaggtatcattcttaaaatgtaaaacactattatggagggaaaaaatggcccatgaacttagtaaaaaggagaaaatgtcacaatggtaatgttagtcatttctctttggaatttcttaatccttttttaagtaattgcattcagtataaaataactgtcttggccgggcacggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaaaaactgtcttgaattcataagaaatgagttgacagataaaactgtttagagtcatcatttcaggtagcatacatctttaaatattttatttctattattttcctccacatacaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattcagttttttggtttttaataaatcagaagaccatgtagaaaacttttacatctgccttgtcatcttttcacaggattgtaattagtcttgtttcccatgtaaataaacaacacacgcatacagaaaaatctattatttatctattatttggaaatcaacaaaagtatttgccttggctttgcaatgaaatgcttgatagaagtaatggacattagttatgaatgtttagttaaaatgcattattagggagcttgactttttatcaatgtacagaggttattctatattttgaggtgcttaaatttattctacattgcatcagaaccaatttatatgtgcctataaaatgccatgggattaaaaatatatgtaggctattcatttctacaaatgtttttcattcatcttgactcacatgccaacaaggataagacttacctttagagtattgtgtttcatagcctttcttctttcatatccctttttgttcatagaataaccacagaacttgaaaaattattctaagtacatattacactcctcaaaaaaaacaaagataactgagaaaaaagttattgacagaagttctatttgctattatttacatagcctaacatttgactgtgctgcccaaaatactgataatagtctcttaaactcttttgtcaaattttcctgctttcttatgcagtattgtttagtcatcctttcgctgtaagcaaagttgatgaaatccttcctgatatgcagttagttgtttgaccacggtacatacttgagcagataataacttgggcacagtatttattgcatcacttgtatacaatcccgtgtttggcaagctttcaaatcatgtaatatgacagactttacacagatatgtgtttagtatgaataaaaaagcattgaaatagggattcttgccaacttgctctcttgccaccaacttactttcctaaattatggaagtaatcttttttggatatacttcaatgtatacaatgaggaagatgtcaccttctccttaaaattctatgatgtgaaatatattttgcctcaatcaacacagtaccatgggcttctaatttatcaagcacatattcattttgcattagctgtagacatctagttttttgaaaacacctattaatagtaatttgaaaagaaataaccataatgctttttttcgtgagtttatttcaggaatatgagatctttcttctataaagttattcatgcacaggcaaaaattgagctacacaggtagaatgtagttttacttagaagatttttgtgggaggttttgaagcaaatatataaaacaactttcactaatttgctttccatatttaaaaaataataaattacatttatataataaatgtttaaagcacatattttttgttgttctggcaatttaaaaagaaagaggatttaaacgtacctatagaaacaaagatttatggttaaagaatgagatcagaagtctagaatgtttttaaattgtgatatattttacaacatccgttattactttgagacatttgtcctaatctacgtataaaactcaatctagggctaaagattctttataccatcttaggttcattcatcttaggctatttgaaccactttttaatttaatatgaaagacaccatgcagtgttttccgagactacatagatcattttatcacatacctaccaagcctgttggaaataggttttgataatttaagtagggacctatacaaaatatattacatttatcagatttttaaatacattcaattaagaatttaacatcaccttaaatttgaattcaatctaccgttatttcaaactcacaaatataactgcattatgaatacttacataatgtagtaagacaagatgtttgacaggttcgtgtgtaattttctattaatgtttttacattgccttgtttttatgtaaaataaaaaatatgggcaactggtttgttaacaacacaatttcttcttagcatttcaaaaatatatataaagttgttctttttcctatttcatgaactatgtttttttttaaaataacatggttaagttttatatatatttacgtttgtttcaggaatgtctacttgtgactttttatcaattaaaaataatatttggaagaaagagcttattaagtataagcttgaagtaaaattagacctctctttccatgtagattactgtttgtactgatggtttcacccttcagaaggcactgtcatattaatatttaaattttataatcgctgaacttattacacccaacaatacagaaaggcagttacactgaagaacttaacttagaataaaatggaagcaaacaggttttctaaaaacttttttaagtgaccaggtctcgctctgtcacccaggctagagtgcaatggcatgatcatagctctctgcagcctcaactctgggctcaagcaaccctcctgcctcagcctcccaagtagctaagactacaggtacatgccaccatgcctggctaatatttaaatttttgtagataaggggtcttgctatgttgcccaggctagtctcaaactcctggcttcaagtgttcctactgtcatgacctgccaacatgctggggttacaggcatgagccaccatgccccaaacaggtttgaacacaaatctttcggatgaaaattagagaacctaattttagctttttgatagttacctagtttgcaaaagatttgggtgacttgtgagctgtttttaaatgctgattgttgaacatcacaacccaaaatacttagcatgattttatagagttttgatagctttattaaaaagagtgaaaataaaatgcatatgtaaataaagcagttctaaatagctatttcagagaaatgttaatagaagtgctgaaagaagggccaactaaattaggatggccagggaattggcctgggtttaggacctatgtatgaaggccaccaattttttaaaaatatctgtggtttattatgttattatcttcttgaggaaaacaatcaagaattgcttcatgaaaataaataaatagccatgaatatcataaagctgtttacataggattctttacaaatttcatagatctatgaatgctcaaaatgtttgagtttgccataaattatattgtagttatattgtagttatacttgagactgacacattgtaatataatctaagaataaaagttatacaaaataaaa

SEQ ID NO: 42 - DNA, 46524 bp, Homo sapiens
  source 1..46524: mol_type = genomic DNA
tcccttccccgcgaccctccgcccgccctcggaagaccgagacagcggagaggttgcgggtgagctgcgctgagcccaggagccgaggagtcgggagcgcagtagcgctgagcccgagcccgagcggccccgcgtcccgagcgcatcggagcggccgagccgcccggatgcagcgcctgtcccgggcagcgcagccccggccgcaggtaggaaagggcggccggcgtcggggcgcggggcgcagagcctgggataacggcgcaggaacggccagagccccgagccgctgccgcgagccgggccgggtggggggcggacacctcgagattcaagcccccgcgccgcaccttccctgagccacatgaaggagcagaggcgccgctcggaccccgacgtgcgcccaggccatccgtcccctgggacactcgggaggcaggagggctggaacagaggcgagagttgcatgccccttccctcccgcggtgccccactggccccgcaagttggcactggattctgctggagccgtcgaagctccctattcattccccagggcatggaggggacgcggagtgaatgacacgagcagcgttggggggccgtgcgccactttcccaatcctggggtcagctgagccgagttagagctatgcccctcatttgttctctgcgggctacggcggggtcgggtgcgacttgaggatgggacgtctctgggacagcccgagctctcagaaacgttggcttaaaagcacaccggggcttgggctgagtgcaccggagctaagcctagtgcaccagagctcgcgccgcgctctcccagccccgactttctccaagagatgtggggtgcgggcggtcccttagagggctggaggacggtgcctccttgctgcttcgggaactgcgctccccttcttgcttttggtctctgcgtgtactccccggcgcgacaccgctcaccacggtagcctcgggcagtgcccattgggttctgagcacacgtccccacgggtggcacccacagatgtcctgttctaggcttggctcggtcttcagacaagaaactcagaccgggcagtcccctattgaggctctgagctaatatcctcccaaaatagacatgaaccacaaggagaattttttaaaagccaaatgataacaccacgttctttccggatgtggggctggagcgctcattccctttcccaggaagctcagccttatccccatgaagagctgggggggcggggagggcgggaataaaatggctcctgagatttgtgacaccccaaaaatcagagacggtatcagactgagtggcattgggggtctacctttgtttttctatgacacacaaggtgggtgtttggcaagagagtagggatgttgggtgctggatagtgcctagattctgtgtctttgggaactttgggggaagtgtcctcctaagggagccaaaaaggctgctaccccagtcccccaaattccaaaacaaaagaggtcagtgaaagctactcgcattttgcatgttatctctttatctttggagcacattgggaaggactgacccagctccagatcagggtctgattggggcaggacagaccctctccaaggcagagaaggggaaaaagaacttgcccttagaagtgggagtccctgggggagtgggacagaccttttcccagagcagccctggcaaaatggctgagcctcccttgagcctcagaaataaatcgtcaggcaggcagcaaacaaagaaagagctctgtctccagccaagcactggctcagtggccagtccttggaggacaaacagtgagtcccaagcagagagacgcagcccggcctgtctggcagagcatctggaaagtggggttcccctaggaacacacaggagagaggcagccactctggaggtaaaatcagggaccctctgtcctgatgtgggacactttatttcaggtctggaggcttgatgagaagtgggtctccaggaacttagatggggctgggaaggatgtctggagaccaaggagtaggtagcttagagggtaaagatgaggcaaaatcaagtccatcgaagccaaaagatgcacagtggccacgtctctcctgcctgccacggattttacatgcctggtgaccccggagcagcagaggctataaatttttttacacgtggcccagcacacagcaggacctcaataaacctcttagaataaagcctgcatggatggaaggtgatgctatcactggcatggacctacctgcaatctgtacctgtctcactgagccaggaaggctataaaatgtggccccttagtccatagccgggaatgaacgagccccagatgagggtttgctttgagctggggcattgccatttctggccaggtgaccttgggtacgttcttgttcctgttggaaggaaggaatggagtacccaaagcttccaatgtgccagggattattcctacaagaaccgtgtggagcaggcactattctaatccccacttcagaggcgatgaaactggatgcagagaggggaagtgacttgtcaaaggtcacatagccaggaggaggaagggcagggatcttaaccctactgttctaatttccaggccaactctgtcctattgtgggtctctgggcctcggtttttccatctgtaaagtgaagtgatggggtggtagttcccgtgggcctgccatgggagcagtggctggtcctctaccttggtggcatatgacatgtggagagcaccatgaaataaataaagcaccaatatcaggccacttcttgccatcacacaaagactccattccttggcttggctgtgagctcagcagctgagatagagttccatgctacttggaatttggagatgtcttttccaccctcttgcttgtctatgggtctcaggcagagtgttaatgaccgttgattcagccttgccaccacctttagccacctgcatcctgaagtccatctcctttgtccttagaagcccatccctgttgcctagcccaaaatgtgcccaccttccccttgactaccacccccgccccagcagcccctctcctcagccacagccccaatgccaaacccagttagagccacttcatcccctctctgcccaaatgaaaactaaaatgcaagcgtcagcaggcctgtctatgcctgtgtcgggactaccccttcaattcacccatgcaacgtcgcctgagcttctctgtgcctggagaatggtgggcagggtatagccccgctgaatgacagcaacctcgaattgacttcagttgccaagagcattgggcacttcccccacaaggtgaaaagatcatcctgtgtccactgctctgtggcttggcatgcctcgatgctggcttctcagacaggccctgcacgggtggctcttcttgccaactttaccccattctctgaagggcactgggagatggaggggaagaggttggtgcttgaaaaagaaaagattgggaggccagatgtgcaccccaaaataggacttcccaggaaatgggtctcagtgagcatattaacatccagcatcttcatctactccatgctcacctaagacctctggggtcaggggaaggggctatggagtcagtgggaagtgggccagtagcagacaggagagttgcctggcataggcagtaggtgtgaatgcaagctgtgatatttcagcagagacctggaattcagtcataaacagaaaagaaagaaaacactaaatattgttccaatgcaattgtatcaaaaacagtaataactgtcagttactgcatgttggcaatatgccagggactgtgctgtgtgctttatatcgttgcagttaattttcacaaaaccctgtgagatacgtagcataatgatccctgtcagggtgaggaaactgaggaggagaggggctaaagcacttgctgcaggatcactgggctggtaaatagccttaaagcccaaactcagtcacagcatgcttaaatctctgccactaaaagcccctgacactgcttacttggcaatgaccatgagcgccccccgctgcctccaccccagttaaggagctgcacagtttacaaagcacttcttcatccattccatctgtggagctttgccacagctctgggaggctgggtggcatgatagcttctgcgtgataactggggaagctgacttgcagagagatgaatttgtgcccaaggtccctcagctgctaggttgcagaactggggttcaaattgagatgtccagcctgttacaacatatttgggacctagattttaaattcatttgcagctagtgctgatgtcatgcactcagccacctttccctaactctcgggtatcccccaattttgtccccaccatcttactgctcaggaagctattgagagtgccctgacaaagccatcagctgcatttaccgtgatctgacatgacacagaagtggcatccgattctatgcaagctgcctgcagcgaatggtcttctatttttacatttctcacaaattggaaattacaaggaggccaggtcttgcagcgagattggctgtggtgctctgaaagcaggggatgtacaactaggtggaacaggccactttaggatgccaggggcactgttggctgtgaaaggggccccctggctgctggggctggatgggatcctggcacacaggccaggcttggggatgcaggagttagtgactgccttggacggtgacctgcagctctgcccacctgtcagctgcctggtgtctgcaagttctgtgtctcacgccagctcctgagataactgagccctggccagagggacattcaaggtcaaagatgccctgaaacatcgacagcaggttgctttcatggctgtgtagtttgataaggagattctgtgcagggagagggcagcagccacagggaggtgagcaaagacatttggtatcagtgttgcggtttgctgcaacttagcgctgatcacgatactcccggtcatcagaaccgcactttatactttgctaaaaatgctcttgcagctgctttttcttttgatcatgtatgaagtattccaggggaagaaaatatggtccttgagatcctggagaagaatcctctctccaataaagagtgatttttttaaagctagttttcttataaagcccaaatcagaatgaccttgacccaaatgaggctcctttgcacacatgtgcgtacatgcacacgttaacacttatgtagaatttcagttttcaaagtgttttctcagtcgaagcttgtgacagccctgggaacttcaagtgaaggtaattttattgttattattggtaccattattatccccatccaaaagatgaacctgaggctcagtgagccctgactcctcatctctgtcccctagtttcccagctgatgaaaatcacctttgctaggctgaaatccaagttcaccaggtagccccttgagaaggagcccagatgaggccagatctggtaggaggcagagcacagagcactcaaagatcgagacttacaagagagcgtgggaaggcacggctgtgaggctggggagaaaagggccgtagcatcttgtaaccttacctgagctctggccagagattaacatctccttggttatgcgcagagtttggggtccaaagtgtgatcatttggccggggggtcccagcagtaaccaggcctggagggagaggaagggatggttgctctcacacacctatgtgcacacaagaatgcttttctcggtgaattgggggagaaatgaacaccagggaccccatgagatttcatagaaggatctaaaggtcttggtagccaggaaggttgtggggagtgtttgtatgtgagcctcagctcagacccactggaggagcaggctgtgtgcttctgagccatgcccaggcaagagggcagggatcactcacctctgcctttggactgttgccatgctggagattgtgaaatatcatgagttctaggagcttccctctggggtgcagggggaggcaagagacctgagggtttgacagttccctggctggatggtggggagagaacttgtccagctgggccctgacagtgagttcagagggcctgctgggcactggtccctgagccaaggctgatactggatgataggtgctactctctccttctgccagagaggaccctgagcccaagggtggtggagtcacttgccacagggtgcacagaccaagtttggtcccaggtcttggtgatgccaacctcatgctgcttctgaaaagcacctgagacaagataactgttggggagccaggggctttttctctgtattcgccatttctggctgtgccatgcaagggctgagaaaaagtgaaagcaatacaaaataaaagtggccaaaagcaaaagctaccagcttcctgggcaccgtctgagctgccagcctgcaatccaggcttcactgccgcctgagctgaccaagcccctttccgcccaagtcagatgtttccagagcttaagatccaggacccacctatgattaaaaaaataataataaaaagtaggcctggggagagagaagaagtcatcttactgaagagtatttttgaaagatggaatttaaatgcacgcatgtattacatatgcatttttagcaggttggttcagcataatgacacagaatgatctgatatgtacatctctcagtcttgggctctgcctgtgacctaggcactgagccagtacttcacaagcattgtcccaggatcctcaataaggaaactgaggctcagggagctcaagaagttgcccaaggtcataccactgacacagggcagagctgggaatcagatccaaagctgcagggctccgaggcttgggcttgcagacctgagaaagaagtgggagagccgccttctgctgggcctcaagcctgtgggggaccgtgggcaggttctttcccctcttggctttgcatgctcagttcatacagccaagaggtttggaccattggataggatgatcggctgctccccgcaccaggcgccagttctccaggcaaggggagggaagttgcacgccccacttcctcctctcctcctccatttcccccataatagcctccccgagactaatgactgaggaagataagagccctttctccaaatggcagtgaatgccactaatgacagagcagatgcagcactgttaattattccacgggtattaaatgaaaacgccagccctggaggagttaaatagcaccactgatctggcaacgtctgtgcttaaaagtgatgccatcaaaccgggccggggcagagcagccccctccccaaacttggagctagacaggagtcacaaagtaagggtcccctcattggtcacagacccctcttcagctcagggtccgaagcagctccttggagacatggatcggtggctgctttgggagattttcttaaaggcccctggggggcctagactagttatccttaggggcagatgtggacaaacaattggaccgaataaaactctgagcacctactgtgtgccaggtcctattttggattgtagaaagaaactggatgctgttcctgccctttgaagatccacttgcattgaaaaccgtagattccttaagagcaggaatgctgtgttgtttggagtctctggtcccatagtcaagaacacagagtgggtacctctgtattactttgattatctgctggttccttgaatgagagccagaggccacacagattgtggccagagtgagatcggtgggcagagggactgggccagggtcaggctgtcttcttcaggtacaagcaacatgaccttcctggacagcttagccccaggttctgaaacaagccatgacctggatgaagagccgggttttccacttgctgaggcaccacaggcgactcctttgccctctctgagcctcagtttgcacatctgcaaaatggggaggataagggccatgatggctgcaggcaaaacaactgtctcctaaccaatcctggccctgaatctggaggatcacagagacctcatgaatgtttgaagagtgacattctggaggaaattcagcagagagagagagtgtagtcaccaaaggcagcatctggttcttcctgtgggtctcactcaaatctcactccaacccccaattcatctccagcagctcaggtcacttgttcccagcttcctggacctggaaagctgtttctcaggtctttgtaggctagagaacatcacaaaacccacccatttcagacacacctgtgttatagatgggtaaactgaggcctagagaggaagagtcctaggtcttgcagaggctaggacccagagcttctaacccctaacccagtgctctttcccttccaccaagccagcccagctcctccgttaagaaattattaaatagagttggtggaaggactctggttgccgtgacaacggagcctgtgtcctcgggagataatggcgttgcacaaggcagagcgatgtgtgttgaatgctgattcaggacctgctagagtgagagtgagtacaagaggagagtggaggggaccgtgtctagaactcgagcttccccaagaaggaggtgcgggactggtaggggtggggcaaattgccttctctacttccatccttcctacagccttgtcagaatgggatacttccctgcacttcgtggaggtgcagagtcaggtgaggagaggtgaagtgactcatcccaggtcacacaaccaggaaagagccagagctgggattatacctccaaccaacacgggggcctaggctatagggagggcctggaaggaggctcacctgcaggggcaggggatggttgatggagacctctctaaagtcttaagtgcttgtggaggtcctgatggtccaggaatgacaattccagcccaagaggaagagaaaacagaatgtcagcatagctaaaagcatcagctttggagccaaagtcacatctctccctgccacttactaaactgtgtaatcctggatgagtcactttctctctgagcctcagtgtcctcatctgcaaaatggggataatgccggcacctacctcataggattgtggtgagactgcatatcatgaggaagataaagcatcgagccccaatcctggccatagctcaatcaccagcagctgttgttatgaaccaaaggggagaggctgggaaaaggatccactcccaaccatgtatcagcttgtaatttgtggtgttggaagagcgaaactggctaacacagtacaagcatgatacataacagggctcttcattccaggctagtaaatatcactagaacaaatgaacagctccatcaccaaaaatatacataaatattttgcatttgaagagtgtgaatgttgtacctcactgcaaatgtactgtccttaaaaacctccatgcacacctcactgagggaatgtgtgttttctctgtgccagctatctaaatgaccccatgctgcaaacgcttttggaaaataaacactctcacccacccacctagtttctcttctagaagcacagctggttcagtgtacttacctccctaatcagggattggagaacatggggttaataccctgtgaaaccccaaagtgcatcatttgcatgctggcaaagatgcaggctggcagacaaccccattccattttggaagcggaaagagggtgctggactcaggcatttggctgtttgaaaagcgctggtaagagctgggatcctgatgattgagatgcaagcaaccattttgtttgtttccgcaaacctgtttgagcaaatccacccccagagatagcaacctgtttctgggtcccctgagagagagggtcatttgtttgctgctgtttctggggctggatgccaagctatgaggcaatgagctgacgaccttggatcctgacacccctattctatgcaggcaggagaagggtcagggagactgattcagtgaacaaataaagacggttgacatttaaccaggattttaatgggtgtgccaaattgcaagatacatacacatgtccactttgggaatcatgtttaataaacaatttgccctaagaatttgattcaatcagcatctcccagtgactcccaccattcctttatattgattgcctataggttaagataacactgggcctggcgcagtggctcacgcttgtaatcctagcattttgggaggctgaggcaggcggatcatgaggtcaggagatcgagaccatcctggctaacacggtgaaaccccgtctctactaaaaatacaaaaaaattagccaggtatggtggcaggcacctgtagtcccagctactcgggaggctgagggaggagaatggcatgaacccgggaggcagagcttgcagtgagctgagattgcgccactgcactccagcctgggcgacagagcaagactccgcctcaacaacaacaacaaaaaaagataacactggcctgccttccacccaggactttttcccatcactaactaaaaatataaatgaaagccctgatcaggtggtttattataatatctgccaggtatcaagcatttactatgtcctagatgctgtactaactacatatttccccatttaatcctcatagcagccctagaagtaggtgttatcacttctgttttagacagagagagtagatgactaacctacagtcacacagcattgaaccagagctgaaactcaaaactgggtgtccttgcccctagggaaggacaaattttctttaagtcccacgaacaatgggcatacttatgaagagctgctgcttgggatatcatagagtgatcagaagtttgtttgtcaggagccatgataggggcaggcagaagagggcattgctcattgttcatgggacttaaagaaaatttgttcaataaaaatctgatttttagccagacatggtggcacatgcctgtagtcccagctacgtagggggctgaggtgggaggattgcttgagcctgagagacagaggttacaatgagccgagatcatgccactgcactgcagcctaggtgacagagtgagaccctgtctcagaaaaaaaaaaagaatctgatgttaccaaatgggtagactgttcttgctacataggagtttccactttacaaaaacaaggggctctataccataaaattcctttccacagctaagtgagtgagtcaagaacagatgcactggtgaacgtgagcattcaagtcttttaaaaataaaattagcctttatattgtgggaaaatattttagaccctggaatctgacccttaattgactctgaaaatacacgcctccctcattcttgcagactattctaaagcagagtctctctgcggttttttaaatccaactgagcttttattaagagaccaataggatttgttgtttcccaaatataaaactataacaccaaacatgctttttcaaacttcaccacccccaagagtttgacatatcccccaggaaaggggcaatattaaccctcatccatcttccactgcttagagaaagagttctactgagtgactaagattgtaccgtgtatacaaggattgcaaattcaggggccattgagggccagacaggtcacagaaatgagtaaagaggtcagcgataggatgacagtaatggtgggacttgtagtaaactagaaaacacatcaccacttcccttctccaaagcatgcaagttcaatttctaaaattcaaatctgataccactcaatcaagcatagctgtgggacccattcggctcaaaaccaccacgttgagatccctggtggttcttattgtgaccttgtgtgatcttgatccagacagtttctctttggggctcagtctgattgtctctagaaggggctgatagagcctgcagagctgctgagagagaaatgcagtcccaggtgtggacacttaataaggagccatggcgctgtctgcagccactgtcacggatatgccttctgcgaccctaagccagctctctgtttgggctgtgctcctgcacgtcacttatttagttcatcgtttagttcagccagcccttgcagtgttattttttcttttccccaaatctgaatgcttaaagggcctttatcttaatgcccgtcggagccttccaagcacatcttgaacaggaatgaacagctattttaaccccacgggcttcttacaagtgtgttttaaaaggcaaagagcgatgtaaaagaatggcaaaaggtcatcgtgccgctcttatttcctggtctaagtcagtcctttctggccggttgagcacagggcttttacagaggcgtcccctggaactgaagtcctccagaaagccccacacccctcagaggcaggaggaagaaaggagcctggaacaggtggtgagggtgcagagggtgggcacccggacctgttccacaggggctcgccctcgtgcccagcacagggttgggtgctcaagctggcaatgggagacagctgccctgagtggaaggttgagactaatgggctggcccccagcaaatacagtcagaaccaactgaaggaagtcagtggaacaggccctgcagcctgggttcaaaaatcccggctcctcagccgcttttgaccttggcctccgccaacctcaggcttctcttggctgaaaggtaggctccttccctccctccttgggttcagtgagcgacacagtggagccttgcccagctcacaagcagtgaatggcgcatctgttttctcttctgtccttccttccttctgcccttatttttcctctttcccctttctgatcccttcctgcgctcctcctttcttcctcctgttttcctcctcatcactctgctcctttaccccagcctcctccttgtctgtttctctcctcctctccttccatacccttttctctcctttcccctccttcccaccctcctctctctccatccctctccactctttcaaatccacccagggagatgcctctgagttcctgtgtctgatcccagggttcgatgttcctcatcctgcagcagacgtctctgcgggcacccaccagccccagcatgcgctccagggccagcccaggggttgacatccagggctttccttacaggaagcaatcaagagagtttccagcattaaaccactcaggaagcaaggccagtttctgcccgagagcatgcctcactggccccacaagaagaaacaggcctaaggctcagtggtgtgctggagcctgctcacagatggcacatacccaatcctatgacctcatattagtaccttgcacaggccacagtgggagtgtttacaccacagaaatcagcagatgctgcaaattgagtcttctgttttgtttcctgagagcccattgttaaagcttaccagcacaccattgctctgtagacctgccaccttctcccaagcaaacgtttctgtgctgaggccttgtaagaacaatgtcctctgccatagagggcagaacccagaagagcgcatgcatatctagcactgttcaagctgcctgctgtcggggaagcagagcgggtggaagacctgggccccgttcttgcataggtgacagtgcagctgggaagctaagagagaagaatccgtaattagtcacgagagaagccatgttgtatagggcgaccaggccttcctcctcgcccccaccatggtcctggttcaggcgctgtcccttatccttgcaccatccctgttacagcaacctccacccatgctccctctcctctcctcctccccacacagctgctgggcggtcttgccaagtcaccatcacatcaaatctccccatcttccacggttcaggtggcagccctggtgaccaccccatgcccacagtggagagggatagttaagaacatgggctttggaatcaaactgcagtgtctgggagctgggaagttgttttactgtctgaacttcgccttcctcatctgtacagtgtgcagtacagaaatgcagtaaatatattaagcacttcctcagccttcggtgtgatcatcattcttattacagggtaagatgcgccctcttttcctgcatcagagctctttactactactggcggcttcctggccacgttcccctaaatcaccccagattctagcccccaacaagcctcctcactgtctccaaatgtgttctgtattttggctttgttctatctgcctggaatggaccaggagtggttagggttgcagttaaaagcaaggagtccggtcctgctcctctagctgtgattatttgaaaaatatccccacttctgctcccttttccaccaaccgcaatgctacccctcccagttgcctgcctgaacccagaccccggggcagggtgccacctctccttctctgcgtgctgtggaagaacttaccccgtggatgtggattgtccatggcccatctcccagctgtcccgagagctcagtggcagcaggactcagactccaacttgcatctttgtccctcagcacccagcatgaggcccggctccccggaggtgcacagtcgatgcggatcagattgaaaattgccttgacaaaatgaagttctcagttgggcactacagataattaggggccagaacagacgttagtaaaccactgatcgtgtgagcgagacaagcaggactggatcagagtgaagtggagctggaaattggagtctgactgtcctgcttgcacacagaagaaagctgaggcacagagaggggaagggactggcataaggtcacacagctagtaagtttagagagagatttcaaacctgtgtctactggacttcagggcgtcaagctaactgcccttcctcctcaggtcagctcctcgcagcagctgcaaggcacgagccatgtctgcagttggaggagagctggggtctccaagaggggagtgctgcccctagaggctggctgcctcctggggactctgattagagcctgcagccccacagctcagccagaatcccacgtgacctcccggggtctccctggatacctgtaggctttgtccagcgcaaccgtagaagccattttggagccagaactcagaggctctcatgctagcagcctctcttgggtttcttaaaaagaacagcaggccttgtccttgtggaggtttgtcctggagggaggtggctgctggggacgggccatacttgtacaccccaaatggagggtttggggggttccacaggtaccccattagagacagcagagtggttaagagtttggacacaggagcccagctgcctgggtcaaggcttggcatccttagctcctaactgggagacctttggcacgtcactttaacctctctgtgcctcagtttacccatcaataaaatgggggctaaaagcaattgaatagacagaaagcatttagagtggccccggcacattagtaagtgtgtccagctcacttcctccctgtactgagctcttctttttctttcaccccttgttaatgaaaagttggggaatttttcttttctgtaggcggctgcagaaggagaaccatcctcctggaatctgtttcaccattggatgggtctgtcatattccagtagtcgcaaagttgaatttgttctcgcctgggttgtcggggtggggatgccctctggccttcttccacattgtggtttcagaggtgtcctagaaaacctgacttctaggctctcagaggctgagagcagaggggaagggctagagcttccatttattcatctgtcctaggacagtgaggctaggcaaactcatctccatgcagtcacatttctctccctctggcatccagcagccatgcttgggcagatcagatcatgaggcctgataggtctaatggtttcagggaatttcacacaggccagcgcctgggaggcactttctggacaagcaaatagcaccagactataactcagagggcctgggtcaagtcctgtgtgaccttgggtaggccatttgacgtctctgggccttagtgccatcatctgcaaaatgggaccaatgatcagtttagcgtcaatgtatttagctcttgctgaactgggcacggtgctagaaaattcaaatccagtcatcacagagtgggaagtgcttactattgacctcctttattgatgaagaaacaaaaacttttttttttttgagacgaagtctcgctctgtcatccaggctggagtgcagtggcgcgatctcagctcactgcaagctctgcctcccgggttcatgccattctcctgcctcagcctcccgagtggctgggactacagacacccaccaccatgcccagctaatttttcgtattttttagtagagacgggttttcaccgtgttagccaggatggtctcgatctcctgacctagtgatccgcccgcctcggcctcccaaagtgctgggattacaggcgtgagccaccgcgcccggccaaaacaaaaactttgagaaaataagtagcttacttgaaaatcacagtgggatgttgtgaacagtaggcacgcgataaatactactgacaaagacacctgcttctgcaaattccctctcaggtacgttgaggcagctgaggggtttataccaaggcatgaaactgctttcctccatctcttgagtaagagtatgcggctggctgggagttgggagtccataaggttcaggccactctcaggctgtgtgaccttgggccagccaccagtccttgctgggtttttttcttcatctatagaatgccatggtagaccaggtgcaccagtttggcatgcagcaagtctggaccaggaaggagaccagctgggtcgtggccctaagcaccactgtgcatggggctgaggtccaagaagggaggcctcccatttagaccccaagctgtcccaaccagctcatttctcctgtagcctgcatcccaccacaggcctggctggcctctgaggtcttgttaaaatgctgggccttggagaccctctctggcggctccctttccattagagcaccttctccagggagctttccctgacctccaggacagcgcgtggcaagcactgcccacagcaccggctgtcccacacaattccaacctccctctaaccttctgtacctgatcatccactattaattggtcttcacatttgtataacatttttcaattacaaagcacttttgcggccattcatctctttgagtggcagcctaagctgctatttattgacacttcctgtgtgccaggcccttggctggcctctttccatgcattatcatgcaattctcagagcaattctgtgaaatccacatttacagatgagaaaattgggactcaagcaagccagatatgtagccctattacacagagatttgaacgaagtcccatgaaataatctgggtcattcctaacaacagcttctgaagctttcctatgtgcctaaatcacgggacctgtttaaaaatcagcttctcgttccacaggtcttgagtggggcccaagattctgcatttctgacaggctcccaggtgatgctgatgctgtctcttgaagaaccgcactttgagaagcaaggccctgaatcactgggcaatttgagaccccaggctggcaaggctgtttccttatctgtcagatgggtgaggtagccctggcttacatagatggaatgactcccggatgatatagtgcctgtgaaatgcctggcacacaataggcgctcaataaatgctagctcttctccttcgataggagctggcatgagtctgggtacacaacggatgctcaataaagccttgtccaatggattgagcctagcatttttcccgaaggcagagaataaactgtattatgtttccccttggaatgaagccaaactcaatattaatttctttcttaaaccacagagtttcaaaaagaaataaaggcaaactagagtgattgcagtctgaagcgagcctctgtaatttctgtaattacagaacgagagcaaagcaaagcaggcatgagcacagtctcatggagggagtggggtggggatagggggaggggaagagcaggccctactcccagacccactactccccgtcctcgattccctggcttttcagggctccccactcactccatggcggggccatggcctgggacaatggcagccctgagactccagccctggcctctcggtctctgcctaggtccccaccccacgcagccgcctgtccctctgatgcagtgggacagagggagattgtccaaggcggtttccacacacttccctcccccttgcctgccatctggtccagggctgggctgctcacagccaatcatccagcaaggcccatggcccacgggccccacccccagaatagatcctgggtgtcggtgacacttcccccaacttctgcccatccagccacccccatgcaagccaccatcatctctctggactggcagcctctgatcatgtatccctgcttcccccttgcccctatgcagccttttctgggcagccagagggagactcttaaactaaccgtaagtcagatctcccaccacttcaacccccacttcctcccatcccacttagaatgaaacctgaatccttgctgtgacctctgagacctgtgtgacctggcccctgcccaccacctctgcctgaatccatttcctctcacactggactccaaccaccttgggcaccttggtgtctttcaaaagtgccaggctccttcctgcctcagggcctttgcacttgctgctccctctgtttgaaatactgtatcccagagagtcccatttctggctcctaattcagactgaattttttttttttttttttttttttttttgctcaggccaaataaaacaagcccaagggccagttttgacccattttgccacttctgatgtagagcttccaaactgtacatgttttctttccctacaaagcatcttgtcattcagagattggcagaggaattctttgtgcttggtttggccccatttttatcaatggctttaacacttggtcatagagcatccactgaggaaggatgggatatcctgggaatgttttaccatcttcctgcctggagtgtctttcactaactccgtccttcccagaggccccatgagcgagtcatcttctggtttacgaatctgatcccattatcagccctgccccatccctgcagctagtccccaggttccttagtccggtgtccaagacccttcatatactgaccttcctagcttcacactgtatactttagtacatgtgtttccctccacttggaacgccttttctctctttttaaacctgatgaacacctattcaaccttcaaagccttgctcaaaggacgcctcgcctaggatactttctctggctgtattaatgcgtttcttctaggcctcccgtgtcttgttcttacacctcttgcagcacttatcacagggtattatgatcagctataggcagaaatatttctccttctaggccatgaccttgacaagggcaagggtcttgtcttatgaaattctcacaccctgagtgtccaccccagctccacccacataggaggcctcagtaaggatttacagaaatgaatctttctgctggaacctgttagttcactgattcggattctggtgaccagggtgtagttcagaatacaaaatgcttgaagagacggctccattgtcgtttcagcacatagcatgtgctcagtaaatacttgcagaatgaatgtgttagtgagtgagtacagaggacctgacatgtcatcactggtggtctcacgttaatagtgccctttgaacgtggctttggtggaattaagttaatcgtggtatagtatgcacctgaaggaatgtggagccgcatgctgggtctgcagaatgttgtcacctgatgaagaagaactggaagacgctggaagaaggctttggaaaaatgcccagatcatgagaaggtgagaggtgtttcttccgcctgctccaccagcaggtaaaggaggctgatcacaggctggcactcagggcgaggtggaagaaatgcgtggtcttgccactacagacccgcagagctgtcctccaacatgatccaagagagccacaaaacacaggggtgtgtcttgggaaaggaaaagtaacaacttgcaaaaaggttggttctgcttcagagaaatgttctagaaagacagccaagttaccctgccgtgaactcacacacacctgtgctttctgcatgttatgtttcataggagagggaagtgccgggaattaaaattgcggatgcactgttccccaggtgtgtgggtgaggcacgcttcctgggaccactccatttaagcattgggtcccaggcatgttcactactagcaggaggctctttatcaatttcctcccgtggaccagatgattgggatttttttttctaccagactttattacagaataactatttttgtattaactaagcaaacaaatgtaccgctcccagcttctgactggcccaaggtgctgagctagacctctttgctttggtacaaagagagcccaaagccaagagacttggcatttctgttagctggtattccccagggtgactaaaaggatgatttccattggattttttaaaatgctgaagacactgaaagacctgaatagtaagcccgtaataaacgttattcggtattattattgttgttgttgtagccttctgggaagttgcgaatgccaaattaagaacaatggacccatacccagatggtggcgattgcagtgataacaatggctgagatttcctaagccctaactatatgccaggcatagttgtacatgctttacacacatgatctcatttaatcatcaccataaccctcggaaggagttattattatcttcccattttatagatgagggtcagagaggtgaagtaactcacccagcattagtaggtgttggagggagccgaggtctgtctgactcagcaccagggtggctttgctgctgtgtaagtcaaagagccttctccgttctaaatcctcaaagaagtatgagttatatcaattcatggctttactttgtttatcttcatatgtgccacatcttctaaaaggaaaactccaaatatagtcatgtggctcctcctagggaattataggcatttggctgaatctgaatacatatccccgtattccagaaattggaaatcacatgtatgtctgctttatggtgaggtcttcagagcagccaccgtctctgatcgttcagggcttggcatgaggaggtgctcaatatagtcatggagaagaactcatggactgaacttcctggtgaaccagagggatggtgcagagatttaagattgcaacaggaacccccaagccaatgtaagcaaaacatctatttcatgactatgggaatgttttgtaaaatccaagcaccagcctgaagaaagcctggaactgcaaactaggagctttgagacactctatcttttgatgtctagttttctccttcctcagcagaccaaatctcactctgagtacaagatgggcagaggatggctgccccagagtccccaagtcactagcaaaactgcccttcttcctgggtcccatgccaaattccagagaaggaatttgattggctagcctgggtcaggtggtcagtcctgattcaaggtgattggatcattttgaacaaatatggcagctggagcccacaagggtagatcatgggaccgttaagggcatcattgttaccagagttaatggctgaggctgctctctcctgcgtatcccaagagtccctggtagaccacagaatcggccgcctcctactatcctgccattctccagaaggggaggcaggcaccctactgagtccagagctctctctaacattgccatgcccaggccaggatctagatgggcatccaagaccagcctgtgtgccgtgaaggagttcaaagtgagcaggccatccctgagaacgaggagcaggggtgttaggaaagtttggattatctgaagatggcctggttctccgtgaactctgggaggagatgatggtgtttggtaatggggactgcatgcgaggggctggagggcgagtgcacagcagactgggcccccgccgggcaaagctgcggggaggaggccgcgtggggagggccagggccacgccgcaccttgctttggcgcagctcccagctctgagggaatgcagaccgcttcacatgttctggtttgttctgagggttccataagtttattttttgttatattattaatttaaatcagttttgtagagcattatagaaattaaaaaagcacaaagaagaaaacgaaagtcactcaaaaactaagcattgtaaccatctttgggtatatccttttttaaaatagatgtggggggtgggggcaaaatgggataattcgaaataaactgtctagaaacctgcctttctcaccccaaaacaaggtgctctttctcgtgttcttacgtggtctttttgttacatttccacaagtttggatggaggacagagaaaagtctcagcagcccctctgttggtttctcttttcttctgataaaattatggaatgtcttctccacgctgccctcatcccacgcccacagctgtcccgagggcagcgggccccactcctgcatgttcccagcaccccaagggccagtgccatgctgcatggtctcgctgcggccaccctggctggggacgctctgcgggacacgcgcacagcccagacgccctggcaggcttcctgcacccctgctgccctctgtaggagctgcctgcctgccccatcgctgcttcaccatccctcctctcctccccttctctgctttgcaggatctcacccagggtggcagaaggaggccttctggagctgacccacccccgacgaccatcaggtaacgtcaacagccccggtaacaacatccatgagtggagttctctctcttaaccaggttggcgaaaagcactcttgcagcgattacagctgagttttgatgcaactctacaagccagaggggattgcccccattttatacatggggaaactaagcacacacaacagcagtacttggtagtagtattgagtagtagtactgagcagtagtactcagctggtagaaggcagaccggagatttgaactcaggactagtctcagcccaatttcctccactgtactgtaccccacgctgcccctggaaataaaaaggtaagaaggctgcagagtgtcagtagaatatcttagggtgattgaaggctgaaagaggtcatctaaaccagtggcccttagctgagggccagggctgggctaccagtataagaatctcctttggcagagcttgttaaaagtatagactcaggacttcctgcaacccagtgagagatgtaccagtgtcatcctcattttaaaagataggggcacacagaggttgagtgtacttaaggtcacacagctcaaaagtggtaaagtcggggcagggtgcagtggctggctcacgcctgtaatcccagcactttgggaggcggaggcggaggcgggtggatcacgaggtcaggagatcgagaccatggtgaaaccccgtctctactaaaaatacaaaaaaaaaattagctgggcgtggtggtgggcacctgtagtcccagctactcgggaggctgaggcaggagaatggcatgaacccgggaggcagagcttgcagtgagctgagatggcaccactgcactccagcctgggcaacagagcaagactccatctcaaaaaaaaaaaaatgtggtaaagtggactgtgatcagaggtcgtaactcctaggctctgtcgtcttcacccagacacctccgtagtggggacacctttctccccattcagccacaggtggagcttctttcttgctcaccctggcgatggctagtatggccgcagagtgtgacaaggctcccaattgcatccttggaggcaaagttaaagattttatgattaagtacttaacatttcctgttggaagtttggtggcctcagatttctcctctgagcaggacatacaacagagggttggacacagatggccagagttgaagctaggccaggaaacatcgctgtgtctttggaaacaaaagtcaccttccttcctccaggagcaagggcgggtgagaggaagagggcttatagagagccttttcaagcccctagcttgtttatgggttattttgtttttgtcattttagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggtaggtgctggcccggggacctcctggctgggtctggaccctgcaaaaaggatcctgcttaggcatttttctggggcaactgtaggagaaaagcccccctaaagactccagagggagcaccaggccccatttcttgtttcttgtccctttatcaaaagattcctgaaggacaattgtcctctgttaatgataccaagaaattcatctattcacctgcaaaaaatgggatgtatttcacatatggctttccttgggcctgtggttggctgtgggtcctgcttttgaggcaggtataaagaaatactggatggggacccagacccacgacactccctctaccagggcgggtcttgaaagtcttggggccacgagctctgtcttctttacctgcaggagccttcctgatcccctatttcctgacactcatctttgcgggggtcccactcttcctgctggagtgctccctgggccagtacacctccatcggggggctaggggtatggaagctggctcctatgttcaagggtaagtctgcagatcagggacctgggtggtggtgcccctgcccacacacacctcttgccctctggagagagcgagctgtctacccagaccagggctgacatcacatatccatccaccaggtgcatatctgagcagagtgagggctgttgcaaggggccaggtggcagatgacagtgctggtcagaagctagggaggtggaggtggagaggcccaatccagagtcccccgcacatcagcctgctctgtcctgttagcccatctatttcctctgcaagggctgggtgtgactttctttgcctcgtgctcagtgcctgacaggcacccaggtagatacatggtgagtcatgctcactgaccgagggcctgggcctcacctcgtccggcaagctgagaccccagccctgcctgccaccagtctgcactgggccccagacatgagtcctggccccctggcttgtcagatgtacatgaccttcagcaagtcactgcctctctcttagcctcagtgtcctcagtaatgcctgtctccgagatcaataagattgtagaggtcatggaacatgccacgacagttcatgttaattccgtattaaatggacgcgtgtctgtgttccgctcccaggcgtgggccttgcggctgctgtgctatcattctggctgaacatctactacatcgtcatcatctcctgggccatttactacctgtacaactccttcaccacggtgagtggtccctttgaccaccccatccagcagaagccacacccagagcccacccttggcccaccacggccaccactctgctgacaaggccattcctccaggagtggggaacttggtttgtcttttgtgggccttggtctccccacaacagccatagcctcacaaatttagcatctcctgtgagacaggcactccttgcaggctcacatccaatcctcatgacacccctctaaagtgcgtattgttagcacattttatatggacacagacagcctgggttcaaatcctgactctactatataccagctgtgcaacttcagaaaagagacttaacctctctgagtctcagtgccctcatttataaaatggaaataaaattagaacctgccccagttcctcaaaaaattaaacatagaattaccatatgatccagcaattctgcttctgagtagatacctgaagaattacaagcagctctcaaagagatatttgtacactcctgttcacagcagcactattcacagtaggcaaaaggtggaagcaagccaagcgttcactgataaatgaattggtaagcaaaatgtggtctatacatacaatggaatgtaattcagccttaaaaggaaggaaattctgacgcatgcatcaacatggatggaccttgaggatattatgtcaagtgaaataagccggtcacaaaaatacaaatagtgtttgatcttgcttatatgagttccctagagtaatcaaatttatagagacagaaagtagaatgatggttgccaggggttgtgggtagggggatgaggagttgttgtttagtgggtggagttgcagttttgcaaaatgaaaaaagttctggagctggatgctgacaatgttaggcaatacatttctcacaatgtactcccattgttaagtgacacatgactgtatttgcagaggtgtggcagggttcagggagctacattatgggtatacttaatgcttctaaattgtacaggcaccaatagttaagatggtaaatgttgtgtgtattttatcaaaattaaaaaatgaaagaaaacaaaaagtgaaacccacctcatagggttcttgtgaggattaaggagcagatatgtgtaaggaacttagaactgcgcctggcagagaacaagccctgtaagtgtttgctggtgtcgttgcagtgagagttagatgggcaaggtctcttgcccaaggtcacatggtggggaagtagccccggctgcagcttggaaggctgttctcacagtgaacaggttgaggttcaaatctcagctctggcacttagtagctgtgcattctcaagcaagtcactgtccctctctgatctgtcaaatggggatcataatgctacttgcctcccagagctgctgcgaaggggaggtgtgaggaggcttggggaccatgagggtgggcagggtgcactgggaccactcatgccagcccctgggagcccagcaggatgcgtcctcatgactgtgtccttgcagacactgccgtggaaacagtgcgacaacccctggaacacagaccgctgcttctccaactacagcatggtcaacactaccaacatgaccagcgctgtggtggagttctgggagtgagtatggggccatcaggggatggcagggacggggcatgtcagccagagcccggcaggagacagaggcccctcggaggggtaacagaagaggtggataaaggggctacagtcatgtgtcacatcatgacattttggtcatcagtggaccacatatgcaacgatggtcccataagattataataccatatttttactttaccttttctacgtctagacatgtctagtaccgaaatgcattgtgttacagttgcgtacaatattcagtacagtcatgtgctgtacaggtttgtagtctaggagcaataggccacaccgtatggcataggagtgtagcaggctagaccatctaggtttgtgcaagtacacgctatgatatgcacacaacaacaaaattgcttaagaacgcatttctcagaacatatccctgttgttaagtgacacatgactatacttgcagagttgtggcagggctaaggcagccacaagggatgctgaagaccttttctccccaaaaagagttggaccacagatagagccatgagacacacaaactctgacctttgatagcaaaacccagctactcacaaagccaaggtccagcaggaagaatacattccccaacatctctgcctctaatctcctgccagctcctcccaatggtcaaacccagctagaagccagagggcaggggaccagataatgtggccatagtcgtcagcatcctggggcctggcacagagtggtcaaggggaagagtggatcagagaggcaaacggaggggaataaccagcatagccaattagaatcacctggagaggttgaccacatcctgattcatcctgaaaaccagcctgatctacttacgaacctagagtcactcggaataaacatgcacacacactctggccatagtgaaggccgtgctgattgtatcttcaggggagtaccttgtagagatgtgtgtcgggggtcactgatgtgacacaatgaggtgctggggcccaaatctctctggcatgaaggaagcatccatgctggacagctcagaaggatccgggagcagtctagaaggtctcagagcaccttggataagctcccaggaggagctgttctcaggcactgtcagaatcagagttgcctgatctcttcatggccaatgtccatggttacactgtttctttacaaataaaaatcaaattctgctctggtgggttctgctttctggcatctcccgcatgctgctctcaggcacgttcggacttttcattcaaccatttattcagtaaacacttcttgatctcctactatgtgccaactgatgacaggcacggacatgcagacaggcaatggcaccaccaggcggccaatgcggagaggagggaagcccaggcagctgggctgcggggacctcagggagtcccctggaccaccccaggtcgggagtggcatctagaagagaaaactgcagggcaggcaggtgctggagagaaacagtgtgaaggctgggaggcagatgaggtcaggccaggcaccggcaaacagctgcagtgagtgctgagaggagagagagatgcaagggccttgaaaggctggccagggagtttgggcttcattctgagaacaagcgggtgctattcatcgcagtaagcagaggagtgacatgatcagacttgcaatttagaaggctctctggggctggagaggggatagagcaaaactgaaggcagggtcccactaggaggccactgggccatccagatgagcagtagtggtggctgactaaggccctggcaggtcctgttctctttgatctcttgaccaaacagcactttctactgattagtataatgggcctcacagtccccagctacctcttgaatcacggtgatgacggtgtcagcacagttctagggcggggatatcatctgtggccatgccctgggcacccctgggtcactccggctcccaccagctctgtgtaactttctcctccctccactgtttgaccaggcgcaacatgcatcagatgacggacgggctggataagccaggtcagatccgctggccactggccatcacgctggccatcgcctggatccttgtgtatttctgtatctggaagggtgttggctggactggaaaggtaagggatatatgtgcacagtggggacaggagggcactggatagaggaacaggtctacaaaggaagctctgcccacaactcccaagagtcccatccaaccttgaattaagcaggtcccttcaacactcggtgtgtccgtttcttttactgtgaaatgggaataataacattaccttaccttctggggcagttgtgaggataaaaggaaatagtgcaagtcaagtacgcagcacagtgcgaagctcacagtgagtcccatgggattccactgggcctaacagagtcatctcaaaacagagggcaaatgttgctcctggactgttgaacaaacttttccagagcatctgctctgcaccaaaccttgttctaggtgcagaaactccagagatgacagcttcacatcctgacccttgaggaacaacagagatgaataggttaatggttagattcaggctctgtattaagcagtccatgagttaagatcccaacctcaccatttactagctgtgagctcaggcaagtcactttgcctccctggaactcagtttccttctctgtaaaacggggctaataattatacttatctgttggtttattatgataatcagatgagatggtgcttttgtcaagcgctcagcacccagcaaggagagttgttattactcttgtttttattctcagcaagtgcagagcaaatgccaagctgggatgtctagcccagggacacccgggaggtggaaaactggccttactccaccttttctccctttcaagccctaccccaggagcctgggggcagaagatggcagtctctcactggccctgacctgaagggaacccggaggacaagtgtgttgtctcagatcttatggcaagtcaagggcagagaagggatttgtactgaataagatgggaggcaggaaggtcagaactacccaagaagtgaatgcaaggttctagaagcagtagtagaaatgaaccaagcagaaccttaacaaattccacacttgggcagggcagagctgatgaaaagctaccctagtttcatctagtgggaacttctggacccactgggttctcaaatccaaggctggtgtaaaagtatctctgatccattcctaggactagggacgccggaggagggcacaagtatctcccagtctaaatttcaggagcagaaaagtatagggcttatgggctttggaagggtttgagtctcagtccctgagcttctagctgtgtgcacttgagcaagccatttcatctctctgagcctcagtcccctcatctgttcaatggtcacaataacagtaccttacagggttgtcccaaagactgagggagatgagtagaatgcttagcatatgccttacacatagtaagcactcaatacatagtatcaattataatcattttggagtggtaattagagttcgtgctacattaggagactggccacttcttggggacagagagtagggccccctcactgcatatattgaggatgtcaaccaatccatccacaagcatttattgaatacctactatgtgcctggcttcatgctgaacacggaaggcacagggaagtacgagaccaaggtgacatataataagcctgcggcatgtcctgatgtgactgacctttctgagcagtaggtgtgactgtgcctgattccagacaagagaaagtgaagctaagagaaaatacaacattgaccctaagttacgcagcttgtgggtgacacagatgagtttgaattcccttttcctagctccaagtacaatgggttttctcttggattgtggctgccttccttaatcctgcagaatctcggggtcaagtcagggaggtgaagctaagccagtgaactgtccatgctgaccgggaaacaggctcacattagactctgagatacaaaggtcatcaaacttgaacattgctcttccatactagtgagcaaagaaatgcaattttagacaatgatcatcagtttggcaaaaaataattgtttaaatgatgatacctagtgctggccttgtgacagaaaggcactctctgtaatgccaggtgaagttccatttctcgaaagcaacaaggtaatatggatcaaaagcctgtgatgaatttattccttttaattcagtagttccacctctaaaaatttttcccaagagtggtataataattttgtagctgaagatttatatacaggggtgtttaatttggtgttatttagagtcacataaaattggaggtaacctgaatgcatagcagtggggaagcttaaaagagaatggtaggaccttctgagggactgttttgtgcaattaaaacgtcaaattgttcatgaggcaataaaacaacgtttagtgaacaaaatgggaaacaaacctgtatgtactgcgttttttttaactctaaacatgttacatggaaaggcaagtacctaatttgaacctcattttgtaagaaaatgtgattgcatctgcaaaggagagtttcagaggagcattaaagtaggaacatccctgcatttatgtgttcgtcagacaattcttgagtgtctactatatacggtggactgttctagacatggggatgtgaacaacacaagccctgccccccacataacttacattctaggtgctggttaaaggaactttcattttatgtgtgtgtgtgcatatgtaatttaaaagttttcctgtcaccacatgcaatacttggataatttagaagtcaaaaaataggaggggacaggggaagggaaaaaccaaatgtgagctggttggctcagactccaaggaggagcttcagataagtggccaaggagagcaaggatctgggaaggcttcctggaggcggaagaactggaatcaagcccagagccacaacagatacggatgtaggggaaatgggggaggaggaagcaagggtgtacaggaggaggggtcaccagtcacccactttcctcccaggtggtctacttttcagccacatacccctacatcatgctgatcatcctgttcttccgtggagtgacgctgcccggggccaaggagggcatcctcttctacatcacacccaacttccgcaagctgtctgactccgaggtgagtgcccctcccagcccggattctgagccaccacttagcagctttgagataagcttttgcatctttctgaccctcactgtagaccaggtttgttgccagggagagctggtgggcacatggaaaagttcctggatagctgcggctatggtgattacttttgacagtctttgataattctgcctataggtgtggctggatgcggcaacccagatcttcttctcatacgggctgggcctggggtccctgatcgctctcgggagctacaactctttccacaacaatgtctacaggtttgagaggacagctgcgggagccccttccttcctggccgagccctttgagtccacatcccacactcatgtgttagggccctctttggccactttgcactctcagcttaacctctccctgagccagtcgtttgtttaactccttctggagacacagacattcctgttgtccccctttcctgaccctgatcttctggctctgccctcctctagcttgctcttagggcctgtgcatctgggacctaccgtgtagccccattcccagccccctcctccgggccacccctccataaccacagccagcagctacaccttctgccagctgcaccctcctcaccccacccctccctctcttcagggactccatcatcgtctgctgcatcaattcgtgcaccagcatgttcgcaggattcgtcatcttctccatcgtgggcttcatggcccatgtcaccaagaggtccattgctgatgtggcggcctcaggtcagtgcaacactgtgtggggccgggctcctggcatgggggcactaaccatgctggcctttgccatcatcaccattaccaccaccactgtggctcactggccttgagcactccctatgtgccaggcaatgcactgagcattttacatggactgtacccatgattcttctcaacactttgcaatacacgctattgttagcccatttcatagatgagaaaactgagactcacctcctaagggtatggagctagaaagatggcagatctggagttggagcccaggtctggctgactcccaagcctgggctcttagtctcttggctatactagcatgtccagcacaatcctggacaatttggggagaagatccactcttgccttgggagtataaactttggtattgggggaaattcacccccgatatttcacgtaggttcttttctattttacctaagtgtcagctggtctgagaaataaagggaaagagtacaaaagagagaaattttaaagctggatgtctgggggagacatcacatgatgcccccgaagctgtaaaaccagcaagtttttattcatgattttcaaaaggggagggagtgtatgaatagggtgtgggtcacagagatcacatgctcacaaggtaataaaatatcacaaggcaaatggaggcagggcgagatcacaggaccagggcagaattaaaattgctaatgaagtttcgggcacacattgtcattgaaaacatcttatcaggagacagggtttgagagcagacaaccggtctgactaaaatttattaggcaggaatttcctcatcctaataagcctgggagcgctacgggagaccggggcttatttcatcccttatctacaactgtaaaagacagacgtccccaaagcggccatttcagaggcctccccttagggacgcattctctttctcagggaagttccttgctgagaaaaagaattcagcgatatttctcctatttgcttttgaaagaagagaaatatggctctgttccacctggcccacaggcagccagacgttaaggttatctcccttgttccctggacatcactgttatcctgttttttttccaaggtgcccagatttcatattgtttaaacaatttgtgcagttaatgcaatcatcacaaggtcctgtggcaacattcatcctcagcttacaaagatgatgggattaagatattaaagtaaagacgggcataggaaatcacaagagtattgattggggaagtgataagtgtccatgaaatcttcacaatttatgttcagagattgcagtaaaggcaggtgtaagaaattataaaagtattaatttggggaactagtgtcaatgaaatcttcacaatctatgttcttctgccatggcttcagccggtccctctgtttggggtccctgacctcccgcaacactttggctcaattcagacatgttcatcaccatactacaaagaccactaaatccatgcttttgtctcagctccaaaaatgttctcgccaagtgggccatgcccactctgctcaccacacagtcatcaatgccacagaacccaaggaaaaccccagacagcccttcgctgcacagccaggcaagcagccaacaggtggaacccactgtatgcagggcagaggcccctgaggctcatggaggccacacggctggtcccttgaagaagtgggctggttccgtgaaaggagcattctctgctccggttctaatctccccttcaagggcagccaccatctcgtttctctgcaattccccaaccattcccccacccccatccggagccagacccagggaggttacaatctctttccttctcattccgagatttcctgatctcttagacacccccaccaactactcaaacacaatacatgccaaacaaggctccaaagccttctcctccaccatgctccccatcacagaagggtcccatggtccagtgcccagggtggagacctcagcattgtcctggactcttccctcaccctcatcctgcaaaccagccaataccagcacctgcccctccatcccctacatatctctctatctggttgcctctctgcacctgcactatcctcactactggccaagccatgccatcccccatcgagatgatggccacagctcctcactggtcctcttgcctctgggcacaattactatggccccacatcccccaccctctttctgcacctggaaaaaggggctgaaaacactcactcaaaaggttactctgaagatgaaatgaaataaggcttagaaaatgggcagtgtgctggaaaggctgtaggtgatgagtaccttttatttttcttcttttttgcacttctctgttcaggccccgggctggcgttcctggcatacccagaggcggtgacccagctgcctatctccccactctgggccatcctcttcttctccatgctgttgatgctgggcattgacagccaggtgagggcgccccccccgcaccccaggagctctccatccccagactcctcagtccccgagtaaacagggagaggaggcaactcttaggctgccaagaagatgaccaaaaattccaggtccctagaatgttccactgcatgaaatttcaggaaacagctcagccaccttctccattttccagaaggggaaactgatgcccagaggggagggactctcctgaggtcacaaagtgagtcacaggcagaatcaggctggaccctgggctctcctggctcggtgctgctgggcctcccgtccttccttagagggccaggctttgggtgggttggggctggggctgctgcaggtggctgacctctgttcccacctgaagttctgcactgtggagggcttcatcacagccctggtggatgagtaccccaggctcctccgcaaccgcagagagctcttcattgctgctgtctgcatcatctcctacctgatcggtctctctaacatcactcaggtaagctcagtaagcacctggcactcccccagcactgcccagggccatgcccagggcctcctctcccctcctctgttgtatcccacctttcctgccttcattgagcatcatctctgtgccaagctctgggcacataacagtgagtcagatggggtccctgccctccagaggctcccaggctggtggagacacaaacattgagctaagacatataggacagagctagagaatgcagcacctaactggactcggagcaccagggactgcttcttggaggaggggatgtagaaattgagctttgaaaggcccacagaaggcctggcatggtggctcatgtctataatcccagcactttgggaggcagaggccggcggatcacctgaagtcaggagtttgagaccagcttggccaatgtggtgaaaacccgtctctacttaaaaaaataaaataaagtaaataaataatacaaaaattagtcaggcattggggcaggtgcctgtaatcccagctacttgggaggctgaggtaggagaattgcttgaacccgggaggcagaggttgcagtgagctgagatcgcgccattgcactccagcctgggcaacaagagcgaaaaactctgtctcaaaaaaaaaaaaaaaaaagaaagaaagaaagaaagacagaaaaagaaaagaaaggcccacagaaattagccagaaagtcaaattggagttgagcctttgaagttgacactgcccaaagctttctttcattcccatttttcttttgtattgacatgaatgagaaatgctcacatagctggtgaattgtgcaataaatataaacgactctagcaacatgagttcagcactgcgggtctgatttttataatccacaaatcacccccaccccccccccaccagatccaaatgtagttctgctccagagttagtattcattcatcccttcattcatagttgtcaaatacctactatgggcctggcatgaccccagaaatttggcaattaatgtggcagatactaccatgtctgctgtcttggagcttacattttggtggacaagactgacagacaaattagatgattttggagagtgtcaagtgccctggagaaaagaggacagcagcacagagaatggccagtagcacaggaggggcgctccctcagacaaggtagtcaagggaggtctctctctccaagaaagcgacagttgagctgagacttaaatgatgagaaagagccagccagagaaagatctggggaaagagagcagagtaggtgcaaaagccctgaggcatttgagggacgagggaagccagagtggtggaggcagagggagtgaggcagtgggtgggagacgaagaaccagcccatgcggaccttgcaggccaagacatttgggtgggatgggatgggatgggatgggatgggatgggattggatggcatgggattggattagatctctctctgcttatttatgtgttatattattgtctcatttaagtcctgaaaggttttaagcaggggagagacctgactgatttacactgtaaaaagatggccctggtgaccaactccgctttctgccctccaaccttaccagaaattggcattttcctctaccacctggacatttccttcccaatgcccggactgtcaatgtccacatcctctcgtggtcacaaagccctcagtgcttcatctaatctaccctgaagcctaatcccagccccatcagcctccagagtccatgtggtctgtgaactggatgcagtgggcgccggggacaatgcacctgttctcacctcttttcatcttgcaggggggtatttatgtcttcaaactctttgactactactctgccagtggcatgagcctgctgttcctcgtgttctttgaatgtgtctctatttcctggttttacggtgagtatcagcccctcatcccttattcattcactcattcatccattcattcctttcttgagtcatcattcaacaagtgcaatttgaaccccaggtcttctccttacatttatttatttatttattcttcacattacaattcaatgaggttagtccaggagtcccccatgtttagaagatataagagcagttaaatgaattcatttaaaataagtggagattttatccagaaaagggaaaccaaaactactttttaaagttttaaagttatatatttaacacagtctaggctgtaattaaaagtgtgcactatcttaaaacaaataacaaaagaaacattgattttgtttattttgtggcctaagtttcttgagccaactgcatgatagtaaaaaatgacaacatcctttcctgcacctttgattgtcccatcagagcaaatgtttttaaagaagcatgatattttgtgtccccctttgcaatatctgccacctcatcctccttgtcattgtcccttcttttttgtttgttttatatgtataaatttaagggacatgagtgcaattttgttacctggatatcttgtgtagtggtgaagtctgggcttttagtgtacccatcaccacataatgtacattctttttttatttttatttttatttattttattttattcatttttttgatggagtcttgctctgtcaccaggctggagtgcagcggtgcaaactcagctcactgcaacctctgcctgcctggttcaagcaattcccctacctcagcctcccaagtagctgggattacaggcatgtgccaccacgcccagctaattttttgtattttagtagaggcagggtttcaccatgttggccaagatggtctcgacctcctgacctcatgatccgcccacctcggcctcccaaagtgctgggattacaggcataagccaccaagcccagcagtacattctacccactaagtaatttctcatcatccaccccagctcccattcccccacccttctgagtctccagtgtctattattccacctgtgcccagtgtttagctcctacctttaagtgagaacatgcagtatttgacttcctgtttctgagttgttttgcttaagatgatggcctccagttccatccacgttgctgcaataggcatgacttcattctattttatggctgaatagtattccatcgtgtatgtataccatatttcctttatccagccatccacggatggacacttaggttgattccctatctttgctattgtgaataaacacgagtgcaaatatctttttgatataataatttcttttcctttggatagatagccagtagtgggattgctggatcaaatggtggttctatttctgattctttgagaaatctctgtactggtttccatagaggttgcactaatttacactcccaataacaccttctctctctaactgttccaacacggtcagatcctcactggtcagtgactctgcttataatttgagcagtgcccgaagccgctctggtgaacttcaagacaccagtttggggtttggggtttttctttttcatgagatttgcagttctttgcaattgattgtcaatttctttttctttcattcattcatttatttatttatttatttatttatttatttatttttgagacgaagtctcgctcttgttccccaggctggagtacaatggcacgatctcggctcactgcaacctccacctcccaggttcaagcagttctcctgcctcagcctcccaagtagctgggattacaggcgcccgccaccacacctggctaatgtttatatttttagtagagacggagtttcaccgtgttggccaggctggtctcgaactcctgacctcaggtgatcctcccacctcggcctcccaaagtgctgggattacaggcatgggccaccgtgtccggcagattgccagtttcttatagcatctgaccatcagggagaaacagcccctgcccaggaaagcctttgaaggaatggctgggatagatgtcgagtgggagggacattgagagtggcaggggtggaggggatcatcatgtcagtctccttttgttggtagatatcttcacattaaagtgacttgctcacctacacaacccacttgctgtgagaattgggctattgaaaaatacttggtaacgaggacccccagagcataacccccatggtacagacaaggaaactgagactcagagaggttaggtgacttgcccatggtcacactgtgagaaagtggtagaaccaggctttgaccctgaagcacccacagctcatccatccctcctgctcccaatgtcacaggtgtcaaccgattctatgacaatatccaagagatggttggatccaggccctgcatctggtggaaactctgctggtctttcttcacaccaatcattgtggcggtaagaacaaggcctgactagccctgttaggatgaggctagaccaagccctggggggactcaggtccagggagaaacttctagaggcagaggcaggtgggagaggcccccagaaaccctgttccttaataatacttctctctaccatttgttgggcatctattctgcaccctgcatggtacaagacacattatatcatcctccacaaacctcagaaaggaggcattattgtcccactttaccgctgcaggatctggggctcacctagccagcatcacccagctagtcagcactgggattcgaaccaagcccagtctcttggcacttggagactctccttctcagggtccctcatccccacaagcaggagctgaagcaggggcgggcctgggaggggccacccaaggttcttgaggtgggggcagagccactgcatatgttgtgtccacataaggggaccctgccaatggcacattgggagctgatatctcacccttgctctgcttttgaagctggggaacttggaggaaggggttcccttttctaattagtctccctagaggagttgccttttcctactgatcttccctgagagggtgtctttttctattatgcacaaaggcaccttatgtgctagcagcggtgctgagtgcaggactcccaagaccttgggcctctgtaagggtcagcctcggggtgagggtggagggcagtcagcctgctggcttcagggtggttcatcctgggtgactgactcctccccctccctcccctcccctccaccctctccagggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcaggtaagcccttccccacccttcaaattgccagtgcccttctcccactgtgtcaggcacagccccaccccttgtgaagctcacagtctagctggggaaacagacaagtcaatagccaatgacagtagagtattagagacactgagattagggaaagccaagggggtgggagcaaacagcctgccttagccctacttgggttaaggaggattaaagaagcttcccagaagaggggataacaaaggagaggcctggggataaaccaaacttaaaagtagaagcagaaagtatgtttctagaagagggaggggaggagaggttggaaagcatgtgcaaaggtccaggggtataaactgcattgggtcaactgaacggagatcagtgtggctggaaggtaaagtggaaaggggtgcgaggaggggacatgacaagagatgaggttgggatgtaagaaggtccagccagatcatgaagggctttgaaaaccaggacaagaactttgaactttatcctggcagcaatggggtgtcatgaagggcttggaacagacggagggtgggatcacatttgcccagggctcactctagatctcatttgtagggttgatatagagaaaatgtggtcttacccacaaagaaagacaaagcacaaaagacctgctgcctgcagcaggggcctcaccatcacatagggttctctgtccatgcccacactttgttaaattgcactaaattcttgagggaagcaaagaagtgctggaggtgccaggcaggtgcctcattgatgaggtgtgtgcaggctgaaaagatgccacggggagaagtggagagtcggagtgtgagggctgccccggaaggccctggatgagttgctgtccactatagtgccctgggaaatgcacctgccagacccaggggaagcgctctcaggtctgagatacagggaagcctggctgcaggttatgtgctgccgtggagttactggcccatcttcctccaacctcagatgaagaaactggggaaccacaggggttgagtaagcaggttcccagctcaggaagctgtgagcagagctagggcttgcagccctttcttcccaatgcaagtccaaagctttcattttccatgatccactggagagcctcaaacagcagctgggtcttagcgtggcaagaggttaggggggtgcccttgcagaaaacagcacagcttgtgcaaaggcccagcggtaggaagggccaagacatacctgaggccagggtgtgagctgacggggcaggatggcgaaggcagtagggggtccatccattcagcacacatggacggaaccctgatgatgtgccagacactactgtcagtgctggggacacagccatgaacaagataagcagaaattgcaccctcctggagctcccattcagggagaggaagataagcaactaacaaaataaaagcacgtgaggtggcgaggagcactatagagaaaaatcaagtagacagggtgtttagggagtgccggatgaggcctcactgagaaggcgaaacatttgagccaagacctggggaagtggaaagcgagctgtcgctatctgagaggaaggctctgccagacagagggcacagcctgtgcaaacgccctggagcggaagcgtgcctgctgtgtttgcggggcgtcgaggagtcctatgcagatgaggtggatgtgcgaggaagaggggaggacactgaggactgggaggtggcaggggccaggtcgtgtagggccttgaagaactttggctctgcctcttggtgaaatgggagccttcattgggtcctgaagagtacaggggcatgatctgagtctggttttcatacaactctcctgctgctgtgttgacgacagaatgaaggggtgagaggacagcatgaaagtgggagtggaagctgagggctgattgggagttgttgcaataacccaagtgagaggggctgtggcgtggcccatgtggggcagtggcaggggtgcaggaggtggggatgtggctggagtctgggtgtagtttggaggcagagcagacaggatgcacttgaatagagagcaggagagggaagcggccagttcctcaccatcccaggctgggattttccccagagagcctcacaccttcctccccggtacccacagcgcatccaagtcatggtccagcccagcgaagacatcgttcgcccagagaatggtcctgagcagccccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactaaaatccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaa

SEQ ID NO: 43 - DNA, 8017 bp, Homo sapiens
  source 1..8017: mol_type = genomic DNA
attctccaatcacatgatccctagaaatggggtgtggggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggtaggagagcggccgcgcagacctctcgcctgctcctgcccaggggcccgccagggccatgtgagcttgaggttcccctggagtctcagccggagacaacagaagaaccgcttactgaaactccttgggggttctgatacactagggggagttttatgggaaagaggaagcagtaattgcagtgacgccccgttagaaggggctttctacctccccagcattcccccaaagcagggaccacaccattcttgacccagctccacccctgtcggtaggtgctggcttcttcccctctcctggtggtggtgggtggttcccgcggcggcctggagccggaggggcgcgcgaccctgggctgggagctccgagggcctgggaacgagacctgagaccttggcttctcgaaggtagtagggacttgggagtggtgactgaacctggtctggctcctccttacttcctcttgttgcgggtgggacgagctagcttccgcctctcccagccactttttcctgctcatttgcagctaggttggctccccttttgggaatttcctctccccttggcactcggagttggggggtgccacctagtggaagataacggagctagggtcttgaagaggctgctgtcccctctggctgttttggcggtgtagggtggcatgagagactgcgactcgcctcctcatccctgtttctgtatgcgagtgcttgtattcagtagaagcatacactatactccctcaatttagggtaaacaggaggggccacatgcacaggtaattcaccagggagccgaacactcctgtgcagacagactccccttcccagcaagccatggcagcggacagcctgctgagaacacccaggaagcaggcggtgccagctgcaggtgctttgcctgggagctgtggggctgaggagagggtccactgtccaggaccagtgaacttcatccttatctgtccaggaggtggcctcttggggatgctgagttaggggaggggcacttgaggaaagccaggtggagcagagaggatgtgagtgactgggtgggtgagatttcctgcccctccccccgcagtggtatccacacctagactcgtggggtaactgaggcacagacagagagcaacttctcaggccctcacagttggcaattctaggattaggacccaagtgcgattttcaggcagtccctgtaccctgtttctgttgtacctgttgcaccattcccaggcactgcccatcgtgccactagtgatatgaacccaggtccaatacgctctggggccatcaaagcctgacgtcaccatgacctgatgtgtgacgtgttataggtgtcccttggtatcttcacggaactggttccaggaccccaaaatctgtgggtgctcaagcccctgagataaaatggtgtaatatttgcatataacctatacatactttaaatcatttctagattacttatacctaatacaatggaaatgacatgtcggctgggcgtggtggctcatgcctgtaatcccaccactttgggaggccgtggcaggtggatcacctgaggtctggagtttgagaccagcctgaccaacatggtgaaacccccatctctactaaaaatacaaaaattagccaggtgtggtagcgcacacctataatcccacctacttgggaggctgaggcaggagaattgcttgaacctgggaggcggagttcgcagtaagctgagatcgcgccactgtactacagcctgggtgacagagcaggactccatctcaaaaaaaaaagagaaaaagaaaaagaaatgccatgtaaatagttgtgatcctgaattgtttagggaataataagaaagaactatctgtagatgttcagtatagatgcacccatcgtaagcctaactacattgtataactcagcaacgatgtaacattttcaggggtttttttgttttgttttttgagacagaatctcagtctcactctgtcacccaggctggagtatgttggcgtgatctctgctcactgcaacctccacctcctgggctcaagcgattctcctgcctcagcctcttgagtagctgggattgcaggtgtgcgctaccacgcatggctaatttttgtatttttaatagagatggggttttaccacgttggtcaggctggtcttgaactcctgaccttgggatccgcccacctgggcctcccaaagtgctgggattacaggcgttagccaccgcgcccaatatattttgatccctggttggatatggagggctgactgtacttaacatctctaagcttcagtttcctcctttaaaataaaggtgtggctgggtgtggtggttcaagcctgtaatcccagcacttagggaggctgaggtgggtggatcagctgaggtcaggagttcaagaccagcctgaccaatatggtgaaaccccctctctgctaaaaatacaaaaattagccaggcgtggtggcgagcgcctgtagtcccagctacttgcttgaacttgggaggcagaggttgcagtgagctgagatcgtgccactgaactcgagcatgggcaacagagcaagactgtctcaaaaaaaaaaaaaaaaagggggtgagcagacgtggtggcacgctcccacagtcccagctacttagtaggaggccaaggttggaggattgcttgatcccaggagtctgagtccagcctgggcaacatggcaatacctcatctctaaaaataaaataaaagtaaaggtattaattactactttggatggttgttgcaaagaaatatatataaaataatggagagtcttgtaactggctcccaagaggctcaacagacattactgtttttgcttcttcattatgagttacctctctggccaccccactgaactagctgggctagctgagcctgggagaagagttgtttaggaagtgagaggctgctctccacagagactcaaggctcagttcctcctggtgactcagatgggcagcccagtgggcacacgtggtctctctccacatgtggctgagtttcacttccagaatagatggagaggcaagggcagggtttagcatgcttgaggaatctcagagggccctggtggtgtgggggaccctcagaacacaggtgtctcaagggctgacccagcttctgtgtccttttctctgggtgaggaggggacattcatgggcagatggtgacctctggggaaggcagcccagactccactggccaccatatttcctttttcacaactttctcacccctgtggtttcccatgtcatcatgtggccgcttcccgcaaggccttagcggggtgcaggtatgaacatagtgtcaggcaaggaggcatctggaggggaaccctggcttttcctggggggactccctccctgcaccctagccctgtcctctcccatggctactgatgccttcccctcaccccagaggtggcccacatctgcacagatcagacccacaaaaatcacgtcttcctgactctcataagcctgcccagtgaggcccaggcattaggccatgtgctggggactcagacccacacatatacgcatgtcagcattcatgcttacaggtccgcacatgctggggcaagtgtcacacacggggcgctgtaggaagctgactctcagcccctgcagatttctgcctgcctggacagggaggtgttgagaaggctcaggcagtcctgggccaggaccttggcctggggctagggtactgagtgaccctagaatcaagggtggcgtgggcttaagcagttgccagacgttccttggtactttgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggtgagtgcccctcagcctaggcaagagctggcagcctgggttttcccaaagggtcatcttggattggccagaggaggacgccaggcacaagtctgtggtttatcattttccctgtctttctaggacaaatggcccacaacactgagcaggcatctgggtggcccctgccaggttgatgcccactgctctgccggccactcctgcatctttaccgtctcagggacttccagttgctgccccttcccagaggtgagcgtgccatcagcccagtggaggggcttaggtctgcatttatgcttttcctgcactctaccacctgcagataaaagggccctgccaatgcaggtttctctgtgttccacaggccgtggcatgcggggatggccatcactgctgcccacggggcttccactgcagtgcagacgggcgatcctgcttccaaagatcaggtgcagctggggtgtgggtgcagggcaggcagacgggcagcatgtggagtctggaacccaggagcccagctggcgggggcagccctgattcctgcccttgtgccctcattcatgtggcatctgtactaagcaacagccctgctgtggacagaggggcagcactggggataggagggtgcgggagaaagtgcaagactccaggtccaggcgttgtgggggtggggagaggtcgagctgggccggtctaataccaacccatggtcagtgggtgccccttccccatgccatcttgctgagggagggactggattgtgaggagggtgagttaggcctgcctaggagatcactgagccttagtgtcaccctcaaaccccagtagctgggcttgcaggccctggtgccaccagctccttgtgtgatgggggagtcaccttccctgagtgggctggtagtatcctgggtcatcttgtccacaggtaacaactccgtgggtgccatccagtgccctgatagtcagttcgaatgcccggacttctccacgtgctgtgttatggtcgatggctcctgggggtgctgccccatgccccaggtacaaatctgggggagatgggggtatgtggagggaagtgggggcagagttgggggccaggggcagggggtgaagacggagtcaggaccattttttctcaggcttcctgctgtgaagacagggtgcactgctgtccgcacggtgccttctgcgacctggttcacacccgctgcatcacacccacgggcacccaccccctggcaaagaagctccctgcccagaggactaacagggcaggtgaggaggtgggagagcatcaggccaggggctggggcggggcctcattgactccaagtgtaggaaaaagtttcctccatcctggctgcccctcacgtttgctcctcttccagtggccttgtccagctcggtcatgtgtccggacgcacggtcccggtgccctgatggttctacctgctgtgagctgcccagtgggaagtatggctgctgcccaatgcccaacgtgagtgaggggctggagccagcttggctgtgtgcccccagccacctggccctgacacgcaccttacaggggctctgtggcatggggctggctggctgcttgctgggagcctggctgatgcagggttcatgctaccccctagtgggggattggggcagtgccagccatcagcctggctgctccctgtgtgctactgagcctggaagtgacaaagacccacccctgtccccactcaggccacctgctgctccgatcacctgcactgctgcccccaagacactgtgtgtgacctgatccagagtaagtgcctctccaaggagaacgctaccacggacctcctcactaagctgcctgcgcacacaggtaccagaggcagggtgcagatacaggggtggggccccctttcctcccttttaggcctggccttaggatcactgcaaggtggtgtaagcggtaccctccatcttcaacacctggttccagctgtggagccggcaaagggttgatacccctgagggtccccagtgccacttctgacctgtcctctctgcttccctcacagtgggggatgtgaaatgtgacatggaggtgagctgcccagatggctatacctgctgccgtctacagtcgggggcctggggctgctgcccttttacccaggtacccaggggtggcgggtgggtgggctgagcacagtgtggcaggcagccgggccccagtgcccacctgcccttcttcatctgccctaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggtatatgggaggggacagcatcttggcctgggcaggtgggtggccaagctcctattgctttctgccctccgcatagcccataggtgatacccagctctgacagattcgtccccagctggaggtgctgtaagcaggagaggcgggctggagtaggtaggggctcggcactgcgccccacatagtggctacctacaacgccctttcctgcccaccccccaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgtgagtgcctccctgcctgcccctggataggggagctaagcccagtgaggggacaggaacataatgccattctgtgctcccttccccgccaggctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccaggtcagtgccaacccccatcctggggctgggtatggccagggaccaggtcccacctcgtccaaccctctcgcccccctctgaccatccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctccccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttc

SEQ ID NO: 44 - DNA, 21465 bp, Homo sapiens
  source 1..21465: mol_type = genomic DNA
ctgttcccagcttctcagcctctcttctctgttcacttcctgctcatgggactcctgcctctcctgggcttggccgctcctgtcttggcaagccccagaccctgccttggatttctttctggcctccaagtgggcgcttggctcctggcacctggcagccttggctgtctccccagccccactgtcctgcctctctgcttgggacccatgggagctgccatctccccagccccaggtctgttctacagctgagctccccacttcatgtcttctgtcatctccaggccctctcagccttccagccccctcgttttggctgcctctaaggccctccaggtcctcctgggcttcctcctctacaatcttccctgtctttcccaccgccaccacccccagttcctcagccgcctgcgcctcccgctctacagtggggactgcatctcccaggaggtaggagacaaaggtgccgagggaatcctaggaaaaaagagagagagaggggagagtcattgaggagagtcccagccctttccctgggggccctggctggaggagcccaggttaaggaagagggtactgggatctgaaaggagaagaagaggatttgcagaaggagccagaaggggcatcgattaggggtacgaggacgcatggttggaggtggggactgaaattcagaaaatattaggccaggagtctgcctgaacctgagaaagcaatctccagtttgaggagatcagaaggaggaggggaaaggtgaggccccaggggaggtgcccggaagtgaggccccagggaatggggtgcaagtatctggcagctgtctgcccttctcaccagtgcccccctcaaggcctggtgcagcccagggaggtatagccggaggaagtccatcctgtctgtctctgtctgtgtgtccagaaagctgataatgaccgtccccacccaccaagacaagccaaccttccccaggaccaaaggcacttcctcttcccctgtctccctgatgcgtccccaccccaggccctgcccacggcccctgatgcccacagtagcccccactgcagcccgggaaatgggtgtacatcacacaggggactcaggtgcacatttggaaataaaggacaagcaagaggccagaaaggacaaagtgggagcaggagaccttagaactggggagggggagagggaggggacatgtggcaacagcagctcaagtgactcaggtctcgtatccgcacctcagccatttctgcctcccctacaagccacagccactctgcaagaggaagctggggtttgtggttcctgttttgcctgggaagaaagagtagcagtgaagagggggctggtgggagctctgacacatttcggcgtcattaatgcttcccccaggggcggaaggggccggattggtggctctggggtgcatcccctcacctatgattaggcttgcaaaaaagaacttggctaaactttatattgtggatatctgtgtctgcctcccaccttcctgtgacttccttgatggcagatgccatgtatgaaacgctgctgaatttctagagccctgcacgttagtaggattccattttccatcagctgagtgacctgggaggcacactagagagggcacatttcttttcttttcttttctttttttttttgagacagtctcactctgtcacccaggctggagtgtagtggcgcagtctcagctcactgcaacctctgcctcctgggttcaagtgattctcctgcctcagcctcccgagtagctgggattacaggtgcgtgccaccacacctggttaatttttgtatctttagtagagacagggtttcaccatgttagccaggctggtttcgaactcctgacctcaggtgatctgcccaccttggcctcccaaagtgctgggatgacaggcatgagccaccacacccagacgagagggcacatttccaactgcattctgaaggcctggtggtgagaaagagcatatagaggtggcacagcccatagcagagatgaggccaaggacaagaagagaatgcaggatgccgctttccacctagaagaaggtaagggtatgattccttatttggaactacataaagtgaccttgctctacttctcttccccataccctccttctcccctccccagccccactttcctattccaattagggcaattctatgaaatcacagcatcagaatcttaggccttaaaatcatttagtctggccaggtgcagtggctcacgcctgtagtcctagcactttgggaagccaaggcaggtggattgcttgagctcaggagtttgaggccaccctgggcaacgtggcaaaatccagtctctacaaaaaacacaaaaattagctgggcacagtggtgcgcacctgctgtcccagctactcgggaggctgaggtgggaggatcacctgagcctgggaggtcaaggttgcagcaaaccaagatcctgccactgcactccagcctgggcaacagagcaaaaccctgtcaaaaaaaaaaaaaaaatctggtctaagcaccacctttgatggaggcaggaatcctgcagcagcctggagccaacccaatggctccctgcctctggtgctctatttcttatcaccatacaggtctctaaggtcacctttaggtctaacattgtatgaatgattgtcagcaactttccaatttttttcatatacatatattttttttattttattttttactttttctttttttgagacaggatctcactctgtcacccaggctggagtgcagtggcgtgatcatagctcactgtagcttcaacctcctgggcacaagtgatcctcccacctcagcttccaaggtacctgtgactacaggaatgcgccaccatgcccggctaattttgttatatatatatatatatatatttgtaccttggttttctcatctgtaacaccaggggttgaagtgctgtgatattttttggttctaggataatttggaaatagggatctcttaacatcttggatactgccaatagatcattcacgaaatccctttagatgagtgttatgtttacttaggtctctaaaacaatttgtaaggtcaacagatggggataagaatgacctgaagctggtcgtctttgttcgcaaccagaaacagtcctgcctcaaaaaaaaaaaaaaaaaaaagggagtaggcaggtggccatatttgtttctggcaagtgagtgctgaaggaaaggagctgaagcctcccacagtcataactggtgctggcaggctactgtctcggtcttgggcgccactgatctaaggtcacggctctgcttgctgctcccacccgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggtgagtattcccgcccaccctcatggaacgaccacctctggctcgcagcccacctgaggggaatgagagctgactcggccccgggaggacacgcaaggagcggtcgtgcacctgagagtaggtgggggtcatgccctcttctcgctctcccaggggaggagaccgtcccggagccccggctccctctgttggaccatcagggcgcgcattggaagaacgcggtgggcttctggtgagtggcctgagacttcagcgagtgacaatggcatgagaagagggaagtgaccggaggaaagggggaagaaagagttaagctgcgcaaaggagctgaacccacaaatatttactgaatccactggtttgccccaggggcagcatgtaaaatttccaaacttcactccttatcaccttccggatttagcaagatcctcatacctaccacctgtaggattatttacttttttcttccagccaattcagccttaacgttttttagtgcacatatttttaaaaagaaaactttaaatcacgactccacttggaaaaccagcgttttcctagtgaacgtttaaataaatgcatcactactaaaacttttttatttttttaatttattttattttatcttatttttttttctttttgagacagggtcttgctctgtttcccaggttggaatgcagtagtgcaatcacagctccctgcagcctggaactcctgggctcaagtgattctcccacctcagcctccaagtaggtgtggctacaggtgtgcaccaccgcatctgcctaatttttatatttttttatagagatgggggtctcactatgggacctgggctggtctcaaactcgtggcctcaagtgatcctcctacctcaaccttccaaagtgctgagattacaagcatgagccaccatgccgggcctgaacctttttttttttttttttttttgagacggagtctctctctgtcctccaggctggagtgcagtggcgcaatctcggctcactgcaaactccgcctcccaggttcacaccattcttttgcctcagcctccggagtagctgagactacaggcgcctgccaccacgcccggctatttttttgtatttttagtagagatggggtttcaccgcgttatccaggatggtctcgatctcctgacctcgtgatccgcccgcctcggcctcccaaagtgctgggattacaggtgtgagccaccgcgcccagctttttttttttttttttttaattttattttatttttgagacagagtctcactctatcacccaggctggagagcagtggcacaatctcggctcactgaaacctccacctccaaggttcaagctattctcctgtctcagctccccgagtagctgggattacaggtgcgtgccaccagacacagctaattttttgtatttttagtaaagacaggatttcaccatgttggtcaggctggtctagaactcctgaccttaggtgatccgcttgcctccacttcccaaagtgctgggattacaggcgtgagccaccgtgccccgccctgacataggggctttgggatcacagacttggattcacttccagcctccaaggcctctcccagaaactctctgtgaccactctccttttttttttttttttttgagatagagtctcgctcttgtagcccaggctggagtgcaatggcacaatctcggcttactgcaacctccgcctttcgggttcaagtggttctcctgcctcagcctcctgagtagctaggattacaggcatgtgcaacttcgcccagctaattttgtattttttagtagagacggggtttctccatattgctcaggctggtctcgaactcctgacctcaggcgatccgcccgcctcggcccctcaaagtgctggaattacaggtgtgagccactgcactcggcctcttcctttttattttttatttttgtgacagggtcttgctctgtcacccaggctagagtgcagtggcatgatcacagttcactgcagcctctgactcctggactcaagcaatcctcccacctcagcctcccaagtagctgggactacagtgcaagccaccacacctggctaatttttaaattttttgtagagatgggggtctcactatcttgcccaagcaccaaagcctgtatttttgaccccaacattgaatgaggatgggatctggtgatagagggaaaaaaaagagggggctgattgaagggcacaggtaagggaaggtttggcacaaaggctacagatggctgcaggatgaggagggagttgagacctgtcctgctccttccaggctgctgggcctttgcaacaacttctcttatgtggtgatgctgagtgccgcccacgacatccttagccacaagaggacatcgggaaaccagagccatgtaagtgactctctaccaccaccaccatggttagtccctgtgggaagatgagggggtgggacaaggtggggtaaagtttccagtctctggctgggcacagtggctcacacctgtaatcccagcagtttgggaggctgaggcgggcggatcacttgaagtcaggagttcgagaccagcctggccaacatggtgaaactccgactctactaaaaatacaaaaactacctgggtgtggtggcacacacctgtagtctgagctattcaggaggctgaggcaggagaattgcttgaagccaggaggtggaagttgcaatgagccaagatcacaccactgcactctagcttgggcaacagagtgagacaccatctcaaaaaaaagaaagctcttgaatgtgttatctaaacaaagtccatttacagggccatctgtggcctgtggtctagtagtgtgagactcatatggaaaccccctcttcattgtgcatgcagagacgctgaggtcctgagaagtcagtcactgctgacccaaagccatccttcaagtgaaggcagagctgggacgggagccaggctctgtgtgtctatccctctgcctccagggtgaaagacatgcttttctcccattaggtggacccaggcccaacgccgatcccccacaacagctcatcacgatttgactgcaactctgtctctacggctgtgcgtactcatctcacctggtccttgcctgacccagggcccctgggtctatagaccccactcccagcccttcactacccagctgggactgtcatgattaaaacagttgagacctgggctgggcgcactggctcacacttgtaatcccagcactttgggagaccaaggtgggaggatcacttgagcctaggagtttgagaccagcctgggcagtatagtgagacccccatcttaaagaaaaaaattaaaaaatatatatatataaaataattgagaccttaatataatttctgaggctgaggcggatggatcacttgagaccaggagttcaagaccagcctggccaacatggtgaaaccccatctgtactaaaaatacaaaaattagccaggcatggtggtgcacgcctgtaatcccagctactcaggaggctgaggcaggagaatcacttgaacccaggaggtggaggttgtagtgagccaagatcgagccactacactccagcctgggtggcagaatgagactcactctcaaaatatatatatatatagtttctgagtcctttctgtctgcaccatatattagctcatttaagccacacagcagtcctgtgagctaggtgctatgatattcccattttccagatgaggaaactgaagctcagagagtataaactcttgacacacaactaaggagtgggagagctgagacttgaacccaggcgtgcctgactccagagcctgtgtttgtagcaggcctgtttggccagctcctgcctctccttggccacgtggttgggagggttgtcccctggaagctctgcggtctcactctattctcctgtcccaggctgtgctcctggcggacatcctccccacactcgtcatcaaattgttggctcctcttggccttcacctgctgccctacaggtctgggtgagggtagtgggaggcagggtgggcaggagctgagaaaggggaggctgggatggctgagatgctgagagtagagaccgaccttccccctcccttcccttctcaccccctcagcccccgggttctcgtcagtgggatttgtgctgctggaagcttcgtcctggttgccttttctcattctgtggggaccagcctgtgtggtgagtgtgtggttctgtgtcagatggggagccccgaggaaccacatcagagcatttgtgggaagagtctccccagcctcccagaggaaagggattcattctgtcacccttagaagcctgctagggctatcagcagtaggcgatgggagactgggacaatttggaggggtaggcagtggaggagatgggagaaaatggatgaattagatggagattgaggtgaacaaagtcaagactctgtgatggaccaggcacagtgactcatgcctataatcccagcactttggaaagccaaggcaggcagatcacctgaggtcaggagttcgaaaccagcctggccaacatggagaaaccccgtctctaccaaaaatacaaaaattagctgggtgtggtggcaggagcctgtaatcccagctactcgggaggctgaggcaggagaatctcttgaacctgggaggcagaggttgcagtgagccgagatcacgccactgtactccagcctgggtgacagggcgagactccgtctccaaaaagaaaagaaaagaaaaagactgatgaaggggcagagacatcaagggtgcatgtctgcccctggtctgataactgggtggatggaggtgccactctccatgaagggacacgcaggggagtggggctctgcttcagacctggaacctggcctatgcatgggatctattggagcctctatgagctgatactgaggaggccatggccagacacattagaggcctgggcagtgtggcaaggtgtggtgtgaccatcccagtgcttgtcctccccccaggtgtggtcttcgctagcatctcatcaggccttggggaggtcaccttcctctccctcactgccttctaccccaggtaagcaggtggagcagggagtgtggggagaggctgtcccatggtcagcctaggtcctcctgaatgttcctgtgttctccttcccagggccgtgatctcctggtggtcctcagggactgggggagctgggctgctgggggccctgtcctacctgggcctcacccaggccggcctctcccctcagcagaccctgctgtccatgctgggtatccctgccctgctgctggccaggtgagctgccctgagccgggagggagaggggtccaaggagagaaaacttggccatggctgggtgtggtggctcacgcctgtaatcccagcactttgggaggccaaggagggcagatcgcctaaggtcaggaaaccagcctggccaacatggtgaaaccccgtctctactaaaaatacaacaattagccaggtgtggtggcgggtgcctgtagtcccaactactcaggaggctaaggcaggagaatcgcttgaaccccggaggcagtggtggcagtgagccgagatcgtgccattgcactccagcccgggcgacagagttagactctgtctcaggaagaaaaaaaaaaaaagaaagaaaagaaaacttgattatgattgcaatcttcaagtccctaccttgctgtgaagggaggcggaatctggactctgatagccccaggtgtgagtcctggagctgccactttttagctttgtagcgttgaacaagttactccacctctctgaaccctcagtttccccatatctcaaatggcagttgttcttgctttccttggaggtgatgagggtaatgcattcagcacagtgtggttcccaaggtgattagaagtaggatgagggtggactttatttgattagttccttttttttttttttttttttttaatcagtgttgaccaggttggcctcgaatgtgtagccttgcctgcctgagtgccagggcaacaggcctgaaccatggcgactcccttttttttttttttttttttttttttttgagacggagtctcatggtgtcactcaggctggagtgcagtgactggtgtgatctcagctcactgcagcctcggcctcccgggctctagtgattctcctgcctcagcctcccgagtagctgggactacaggcccatgccaccatgcctggctaattttttatatttttagtagagacggggtttcactgtattggccaggctggtctcaaactcctgacctcaagtgatccacctgccttggcctcccataatgctaggaatacaggcgtgagccaccgcgcccggcctgattagttctgtgtattttcatgcatattacaaaacactttggccgggcatggtggctcacatctgtaatcccagcactttgggaggccgaggcgggcgcaccacgaggtcaggagtttgagaccagcctggccaatatggtgaaaccccgtctctactaaaaatacaaaaattagccaggcttggtggcgcttgcctgtagtcccagctacttgggaggctgaggagaagaatcgcttgaacccaggaggcagaggttgcagtgagccgtgattgtgccactgcactccaggctgggcaacagagcgagactccgtctaaaaaaaaaaaaaacacacactttgaactagccagacacacctggcccttcacaagattagtgcttaggacaagtctaagtagaaaaagtgagtccatttaaagaaaaatattaagtaaaaatatatatatacaggaggaatatggatatggcaaataacatgaagccagaacctaagtgactaaaatcgaggaagttctggcctagcacagagtgaacgtataattaatgggagctagagcgaccattagaataataatggccagaaaacagaactgactcgctaggtatgagccagcagtccgaacaagggcctgctgagcacagtggctcacagctgtaatcccagtgctttaggaggctgaggctggaggaccactagaggctagaaatttgagaccagcctgggcaacatagcgagactccatttatacaaaaaatggaaaatatgaggcgggcttggtggcacgtgcctgtagtccccgctacttgggaggctgaggcgggaggattgcttgagcctgggaggtcgcggctgcagtgagctatgattgcaccactgcattccagcctggatgctggagaaagaccctgtctctgaaaaaaatcaaaacaaaatgaaggcccatgaataggaataaggagataaattcaggtccaaagaaagaagcctttgtccacaattggagctctcccgcacagcgtaggagccttagaggcagtgagctacccatctttgaaagtgttcaaaggtagaggtgttccctgggaaaagtggcctagatggtccctggggaccttcccagccagtagggttttctgaccctgccttcatcctactcctagctatttcttgttgctcacatctcctgaggcccaggaccctggaggggaagaagaagcagagagcgcagcccggcagcccctcataagaaccgaggccccggagtcgaagccaggtaggagacacagaccctcagagaggtcactttctttctctctgggtttggccttttcctctctgcaataggcaaagttaagaggggaaagagagtgagtgtactggttatgggaaaagcctttgtctatttgagaaatacttgttgaggacgagcacagtggctcacgcctgtaatatcccagcactttgggaggctgaggcaggaggaccacttgagctcagaagtctgagtccagcctgggcaacagagcaagaccttgtcgcaaaaaaaaaaaaaaaaaaaaaaaaaagaaaagaaaggaaggaagggagggagagaagaagggatattaattgagtacttaccatgtgccaggcattccaatcacaagtgctgaggccctgcggtggggataagctgggatgttctagaaccagagaatggccagtgagactgggcagggtgggccaatggccatctgtggagctgtacaagagacattggccgggcgtggtggttcatacctgtaatcccagcactttgggaggctgaggcagatggatcatttgagatcaagagtttgagaccagtctggccaacatggtaaaaccccgtctctactaaaaataaaaaaattagccaggtgtggtggtgcatgcctgtagtcccagctacttgggaagctgaggcacgagaatcacttgaacccaggaggcagaggctgcagtgagctgagattgcaccactgcactgcagcctgggcaactgagtgagactctgtctcaaaaaataaaaaaaattaaaaatcaaagagacgtgaagaggtctcacctggttagcttttattttcatcatgataaagtatgtatattacttgaagtttaccattttattattttttatcttactttatttttttgaggtggagtttcgctcttgttgcccaggctggagtgcaatggcgcaatctcagctcactacaacctctgcctcctgggttcaagtgattctcctgcctcagccacccgagtagctgggactacagacacctgccaccacacatggctaatttttgtatttttagtagagatggggtttctccatgttggccagggtggtcttgaactcctgacctcaggtgatccgcccacctcagtctcccaaggtgctgggattacaagcatgagccactgcgcccagccattttaaccatttttaagtgtccaatccagtggcatggaagtgagttcccactgttgcgtggtctggttaattctgtcataccggtgcctctttgccgagtcttcagtgtgaaaacttcatctgcccttctctctctgttcccctgcaggctccagctccagcctctcccttcgggaaaggtggacagtgttcaaggttcggatgatggctggggtatgtccctgtggggcttgctcacctccaggccccccgcttatatcttctgccttttccagggtctgctgtggtacattgttcccttggtcgtagtttactttgccgagtatttcattaaccagggacttgtaagtgaggggtgctaggaggggtgtggaggtggcgattggggctgggacccacacagccccgtccatctcccctgtctggtatttgttgcagtttgaactcctctttttctggaacacttccctgagtcacgctcagcaataccgctggtaagaggagcgagggcagtgggctgggagggcgccgtggtgatgcagctgccctgcccagtaggcaccggggggagcgggatggtccctggaggagcctcctctcctccccccaaccctaacctcaggtaccagatgctgtaccaggctggcgtctttgcctcccgctcttctctccgctgctgtcgcatccgtttcacctgggccctggccctgctgcaggtaccaaacccctgcccctcacttcactcccaccttggctcccagcttggctcccagcttccccaaaccccctgcttcccactatcagtgggaagtgtaaatttttttttttttttttgagacagagtctcgctctgtcgtccaggctggagtgcagtagcgcaatcttggcttactgcaacctctgcctcccgggttcaagtgactctcctgcctcagtctcctgagtagctgggattacaggcgcccgccaccatacctggctaatttttgtatttttagtagagatgggattttgccatattggctggtcttgaactcttgacctcaggtgatctgccggcctcagcctcccaaagtgctgggattacagggaagtgtaaattgtacactatcatttcttagcacagggaaccaaagtccagcagagctccatgtaaaatgtatagcctcaggagccaagcaaaactgagcttcagtactcagccactgtgtgacttagggcaggtctcagaacctctctgagcctcaatttcctcatgtataaattgggtgtggccaatacctatttttcagggtagttgtaagaaatagagatgagagaaagaatcgaagaacaagattttgtagtgtgtgtgtgtgtgtgtgtgcgtgtgtgtgtgtgtgtgtgtgtgtgtgtgtgtgtgttttaagcattgggattgggccgggccaggtggctcatgcctgtaatcccagcactatgggaggctgaggcaggtggatcatttgagcttggtagttcaagtccagcctgggcaacatggcacaatcacatctctacaaaaattagccaggtgcagtggcgcacacctgtagtcttagctactgggaagctgaggtgggaggatcacttgaacccatgaggtcaaggctgcagtaaccaaggtcatgccactgcactccagcctaggcaatagagcgagaccctgtctcccagaaaaagaaaaaagaaaggaaaagtcggaaccttcctctgtcgcctaggctggagtacagtggcatgatcataggtcatttacctcaggcaaagagacaggctttcaaataatgtttctaactataagaaaatgtacagttcttttattctagatagttaattataatagaattggtgactttgaagtcagtgggttatttatcttgagggtggtgagcaaattcaactgcccttggcaaacagtagtttacagctttaagggcgcaaacacccttccttacaacagtctaataaaaggagtttcatataaccagcattcattgtttcaaggttacaaatccacagcccctgcaggtaactgttacaataaactgtcaactgtgacaggaaagtcttctgcctttgaaatttaggaacttggccagtcctggtggctcacacctgtaatcccagcactttgggaggccaaggcaggtgaatcacctgaggtcaggatcaggagtttgagaccagtctggccaacacagtgaaaccccgtctctattaaaaatgcaaaaattagttgggcgtggtggcacctgcctgtcatctcagctactcgctaggctgaggcaggagaattgcttgaactccggatatggaggttgcagtgagccgagattgcagtactgtactccagcctgggccacagagcgagactccatctccaaaaaaaaagacttaggaactcaattctgtgatagcaaaatacagaaatagagattatactttaggctaggtgttgtggctcacacctgtaatcccaatgcttttggaggctagggtgggaggatcactcgaagccaggagcttgagaccagactggacaacatagtgagaccccccacctctacaaaaaattaaaaaaaaaaataagccaggtgggagaattgcttgagcccagaagtttgagagagcagcctgggtaacatcacgagacctcatctctacaaaaaacaacaacagggtgtggtgacattcacctgtaatcccagctactcgggaggctgaggcaggaggatcgctttagcccaggagttccaggctgcagtgagccataatcatgccactgtaccccagcctgggtgagaccctatctcaaaaaaaaagattacactttcatattatggcaaaagcatgtaaatatcctccagcctccttccttatttatctgagcagtgctgcaagcccagggtttgtacccacaaaaccccaaatttataactcagggtgcttgtagataccactgaaacatgtagcttatggttttaagctacatgtttttagctataatgttttttgttttgttttgttttttgagatggagtctcgctctgttgcccaggctggaatgtagcggtgcaatcttggctcactgcaacccctgcctcccagattcaagcgattctcaagcctcagccttccgagtagctgggattacaggtgcgccaccacgcccagcaaattttttgttttgttttgttttgttttgttttttagagacagagttttgctcttgtagctcaggctagagtacaatggcgtgatcttggctcactgcaacctccgcctcccaggttcaggcgattcttctgcctcagcctcctgcgtagctgggattacaggcacgtgccaccacacctggctaatttttgtattttttagtagagatggggtttcgccatgttggccaggctggtcttgaactcctgacctcaggtgatccacccgccttggccttccaaagtgctgggattacaggtgtgagccaccacacctggctagaggtgtgtcctttttaatgctcatctttaagtctacctcagatttaatgaattaggacctctagggtaagccccgcttggggcatttgtacctagatccccaggcaattcttacatatacgaaaagtatgaaccgccacgaggaggcctacacactgcacaagaggcaatgtggcgtggtcagtgctgggaggatggcacctccttgagagactggggcacagaggtgggacctacaccctggggtggggatcgaagaggcttcctggccaggtgcggtggctcctgcctataatcccagcactttgggaggctgaggcaggggggcagcgactgcttgagaccaggagttcgagcccagctgaataggatgcccggctactcccaccttgttttaccatagtgaaccaacggtttttccaataggggcaattttgctgcccagcggatgtttggcaacgtctgcaggcatgctttggttgtcacaactgagggatgctatgggcatctagcgggcagaggccagggatcctgctaaatgcgctgccatatacaggacagccctcaccatgcagaacaaccagcaccaaacgccaagagtgctgcaattgagaaatcctggtttcgatggtcccacttcctttaagaagcctccatttttttttttttttttttttttttttttatgagacaggatcttgctctgtcacccaggctggagtgcagtggcacaatcatagcttactgcagcctccacctcctaggttcaagcaatcctcctgtctcagactcccgagtagctgggactgcaggtgcgtgccaccatgctcaactaatttttaaattttttgtagagacggagttttgttatgttgcccaggctggtctcgaactcctggcctcaagtgatcatcccaccttggtctcccaatgtgctggtattacctgcatgagccactgcaccaggctgaggttgagaattttttttttttttttttgggatggagtctctctctgttgcccaggctggagtgcagtgctgcgatcttggctcactgcagcctctgcctcccaggttcaagtgattctcctgcctcagccttccaagtagctgggactacagaaccactacacccagataatttttgtatttttagttgagatggggttttaccatgtttagtagagaccaggccaggctggtctcgaaatcctgacctcaggtgatctgcccacctcagcctcccaaagtgctgggattacaggtgtgagccaccacaccgggctggtgttgagattttatctagacctggcagccctctccttcaccagtaactcctaaaaccagggacccctggaggggaggccacctctccttccctgccccgccctggtcccaggcttagcctctccccctgttcacagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggaggtcagcattggccgggcaagggctgggggtggcctgtccagggacacccagggcagggatgtctgggactgaagcctcacccctgctctctgccctcccagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatggacttcttatatcgtttttgtctctaaaaagaaacttttattatgaaagtaatacatgcccactttcctatatatagacagcataaagaaggtatgtcagcagatttctcccttttttgtttgtttgtttgtttgtttgtttgttttgacagagtctcactctgtcacctaggctggagtgcaatggcgtgatcttggctcactgcaacctccacttcccggttcaagcaattctcctgcctcagcctcccgagtagctgggattacaggtggtcactaccatgtctggctaatttttatatttttagtacagacgacattttgccatgttggccaggctggtctcaaactcatgacctcaggtgatccgcccaccttggcctcccaaagtgctgagattacaggtgtgagccactgtacctggcctctgccatctttgaggccttacgtattcattcattcatgcattcattgtttgggacaatctgtaaacaatcatgttggacattctttccagcatgaaagttttcagagaagtggaaagaattgtgcagtgaatcatcctgagtatgcgccaccctgttctatgttaacattttgttacagttgttttatcatgtagtccagcccccatcaaatctatgtattcactgttccatcagtgagtagatagagctaatgaatggcagggttggcacctgaggcattttattttattatttttttttatttttagagacagggttgcactctgtcacccaggctgaagtacagtggcacagtcatggctcactgtagccttgacctcctagactcaaacaatcctcacaccttggcctcccaagcagctgggactgcaagtgcatgccaccaagcccagctaatttttttttttttttttgtagagacgcgatcttcctatgttacccaggctggtcttgaactcttgagctcaagcagtcctgccttggcctcccaaagtactgagattacaagcatgagccactgctcctggcatcctgttatttaggtacagtttttatacacagtaaaatgtataaattgttacatatttttacagtaaactgagtctgggccaggcactgtggctcacacctgtaatcccagcactttgggaggctgaggcgggcagatcacctgaggtcaggagtttgagaccagcctgcacaacgtgacaaaaccccgtctctacgaaaaatataaaaaattagccaggtgtggtggcttgcacctgtagtcccagctacttggaaggctgaggcgcaagaattgcttgaacccaggaggcggaggttgtggtgagctgaaattgcaccactgcactccagcctgggcaacagagcaagactctgtctcaaaaaaaaaaacaaaaaaactgagtctgacttagtgtttctcatacttcattgttaccctttctactatatttgccatatctgaacctaacagtacttttatttacttaatatttttcattaaagcaactaacctttaatatacattcagttattttaaagggaaacattattaaaatcatgagtttgaggtgatatatatgtattttctactttactttaaatagttatgtaactattggagtttaaaatgaacatgcaagttccccctgagactactccattacgaccagtgatgtttgtggacccagatctaggaaatgctgacccactggttaatagcatgggctttgggggcagaaggaactgactttcaggtgccaaccctgccattcactagctctattaccttgggcaagtcacttcacctctctgcacctcagtttcctgatctgtccaatgggataatagtagcaccagcatttcataagttgcttttggaaactacatgagatcatgtcaacactcaataaacatcagctctgatcatgctatgatatgactcctgcctctcacctttgcattgcattatacccgtgtttctcaaaccttagtgtgtactggaggccttgttttttgtttttgttttcttggagaccaagagtcttgccctgtcacccaggctggagtacagtggcatgatcatagctcactgcagtctcaacctcctgggctcaaggggtcctcctgcctcagcctcctgagtatctaagactgcaggcacgcaccaccatacctggctaatttttatatttttggtagagatggggtttcaccatgttgtccaagatagtcttgtactccagagctcaagtgatccacccaccttggcctcccaaagtgccaggatcacaagtgtgagccactgcacctggccctgcctggctaatttttattttttttctgtagagacgaggtcttgctttgttgctcaggctggactggaactcctggcctcaagtgatccacctgcttcagcctcccaaaggtctgggattattacccatgagccaccacacccagccacaatattttatttatccatttgttagttgatggatattggggtttcaattttttgacttaactatgaatcatgctgctataaatgtttgggtaaagtttttgtgtggacacatgttttccatttctcttggataatatcaaggagtggaattgctgggttgatggtaattttgtttgatcctttgaggaactacccgactgtttcccaaagtggctgcaattttacattccactggcagtgtacgaggactccacgtccccaccaatacttgctcttttccattctttttccaccgcaacctccgtctccccggttcaagtgattctcctgcctcagcctccctcttttttttttatttttgagacagtctcgctctgttgcgcaggatggagtgcagtggtgctatctcggctcactgcaatctcagtctcctgagttcaagtgattctcccacctcagcctcccaagtagctgggattacaggcatgcgccactacacctggctaattcttttttgttgttgttttttgtttttgttttgttttgttttttcagatggagtcctgctctgtcaccaggctggagtgcagtgacgcagtctctgctcactgcagcctccgcttctgggttcaagctattcttctgcctcagcctcccaagtagctgggattacaggcacccaccaccacacctggctaatttttgta

SEQ ID NO: 45 - DNA, 9402 bp, Homo sapiens
  source 1..9402: mol_type = genomic DNA
acgccctggccgcttcgccatcgaggggagggtgaggacagtctccgaggcggcgctgccgaacctcccggtgacctggaggccgcggagcccgcagggacccatggcccccgaacctggggcaagaagggcgggcgcgcgcggggcgggtcacgtgacagctccaggcccacgcggggccggggcaagggcggggcctggcgcgcgcggccctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcaggtgagggggcgttccgggggagggggtgccctcaggggagggggcttcgcgggagaggaggaggaggcgccgagcgctttccgggacgtggagacgcggagcgtcccgaggaggcaggagactcgggatgatcgggagcgtcccagggagggggcccctgagtgctttctgggggagggggcgctgcctacgtcctcaggggagcaggcttggaggctttgagtccacccttctgtaatgatgggaggggcatccgagtgcatgtgggggcccgcggggaccctagtgacacggggcgaggcccagaggatgagtactctcggggaggcgacatccttagtgaagaggcagtggagggcccgttttgggggaaagggtgtcttggattccccctgtgaggcagtgccagggagcctgggggagaagagccgagatcagggtggggcagggctttggccccaccaccccaggggcccagagagagatgaggcggccaggagtgccacctgcatgttttgggaggggtctgtgagtgcccccggccccaccgtgtgctctgggcctctatccctctgggacagccccgctgcccggatccctcaccctgggaccctcccctgccctgtccattctctcctgcccctcccctggctgccaccttcccagtatttgccccatggtgtgtccccagcatctgcacccccggacctgtcttgggttaaggagcctttcctgggaatgggggcgaagggttcagggccagtagaatggaaggggattgaggagaggggaagtcagtgagcggtcagtctcttcctctgtttgtaaagtcaccgaagggccgcctggctggtccccagctttctctctggagatcccaggcctccacagcaggaaggaaccagcattgtttatgatttgaccagagccagctcctgctctctcccctccctgccaaggcctgggtggggccaccaggcccggactccccctttgtaaggccacagcagcagcctctctccggtcccctcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtgtatccttcaccttggccagtcggctggtcaggcacggcctcgcagctgggctggggacccgttgcttggtttctgtttccatcttacccaccaccctccaaaacaaacccagtaaaataaactttcctgcagaggggaagccacagtgtaacaggacttggagacctctgatgaacccaggcctgcagcggcccaggcagtatggcctcgagcaagtgggttctctgctctgtgccccagggggaagggctaggcaggatggtctctatgggagtggtgtcttctgacgtcggcagttctgagacatgacctggcctctgcccacagtcacttcttgctaaggaatggatgattctttcctctctttcctccttgcccagaccggaagggagacagggagaaagaaaactgtcagctgggcgtggtggctcacgcctgtaatcccagcactttgggaggctgaggtgggagattacctgaggtcagtagttggagaccagcctggccaacatggttaaaccccatctctactaaaaatacaaaaaaattagcggggcatggtggtgcaagcctgtaatcccagctacttgggaggcagaggtaggagaatcgcttgaacccaggagctggaggttgcagtgagccaagatcgtgccactgcactccagcctgggtgacagagcgagactctgtctcaaaactaaacaaaaacaaaaaactgcctttcttgagggcctgctgtgtgtcaggtactatacatgcccaatgcttttttttttctattacacctcccaactaccctatgagatgggcttttcagcttcatttcaaagatgaggggtggagtgcaatggctcacatctgtagtcccaacactttgggaggctaagaccagaggatcactggaggccaggagttcaagaccagcctgggcagcatagtgagaccccacctctacaaaaaatttaaaaattatccaggtttggtggtacacgactatagtcccagctacttgggaggctgaggcaggaggatggcttgagcttaggagttcgaggctgcagtgagctatgattgtgctactgcactctagcctgggggacagagcgtgaccctgtcaaaaaaaaaaaaaaaaaaaaagatgaggaagctaaggctcagaaaacctaaaatcaagtgtttctgttgctgtctcctcctctcctcccccagatgggaacttgtccttcttcttaggacttctcactcagagccacaccctaatcacctgtggacttgcaccttgcccagggagggacagcctagccttggctgtcctcccccaatactgctttcctagtttgctgtccacttcctgtctggctctccttagcaacttatgacacctgtcacttcttccctgccccacccacccactctcagtcccagccctccacccaagagtggggatttgtactgaggtgtctgcaacccccaccacaaactgtggacaggaaatctccgtgctcacccccagctcgctgtgtgatctgaagcaagtcactgcgtctcgctgggcctccccagccctaaaacagcagggctggtccacatattctctgaagaccctttcaaggctgattcttgttttctttgttttttgtttgtttgtttttagatggagtctccctctgttgcccaggctagagtgcagtggctcaatctcagctcacggcaacctccacctcccaggttcaagctattctcctgcctcagccttccaagtagctgggactacaggcgcctgccaccacgcccggctaatttttgtattttcagtagatgcggggtttcgccctgttcaccaggctggcgtcaaactcctgacctcaggtcatcaacccaccttggcctcctgaagagctgggattacaggcatgagccaccatgcctggtctcaaggcagattctaaaagacagccctgacttatttttctagagacaagccaaacagcatttgtggatttatttatttatttacgcataagcttttttgtatcttcaaatagaaaaagacattttactcctccatcttctgaggtatggccaagcactctcctttgagtgggagtgtgctgttgggagtgtctcctcatttttcttgcacaaaccattcccataaggcaggcatttatttttaagcaaacatttattgcatgccagatggtgttcatacattatctcatttaactccctcaacagccatgtgactcaggcattcatattagtaataatagttcatgtttgcctagcactcacaacttgccaagcactgggctgacagctttacatgcgccatctcatctagtcttcacaaccaccctcaaaagaaccattatttcatggcttgcacctgtaatttccagcactttgggaggccgaggtggaaggaacacttgaacccatgagttcaagacctgcctgggcaacagagcaagagcccatctccacaaaaagaaaacaaacaaacaaacaaaaaaacattatttcccctacataccagatgagaaagttgaggcacagacaggttgagatcctaaagccagtgagtagtagagaggagatttcagacatccatgggttaactccagagttgctgctctttttgtaggtttttttttttttttaatttatttatttttgagacagagtctcactctgtcatccgggctgcagtgcagtgacacaatcttggctcactgcaacatctgcctcctgggttcaagtgattctcgtgctgcagcctcctgagtagctgggattacaggcacatgccgccgtgcccagttaattttgctatttttagtagagacagggttttgccatgttgcccaggctggtggtctcaaactcctggcctcaagcagtcctcccgcctcagcctcccaaagtgctgggattacaggtgtgagccaccactcctggcccaagttgctgctcttaactgtgaagttctcctgcctcccacagtttattattatccccgtttccccggtagggaaactgaggcctcagaaatgaagccccttgctcaggatcagcaactgtgatgcaacagaggctcagagccctgccgctgggtaatggcagcagcttccccagctggtggtgcaggttggcagatctattgagtcccaggggccctggctggaggaggtgtgcagcctcgccttcagagcctgttttccttaaccaagtgcctcccactgccccctgcctgggggggtctgcggaaccatcctcagctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaaggtcagagggttgggcacctgtcccctcctcccccagggtctggggcttccagtgaccagtagaagaagccttgggcaggagaacattgcaagcaaagggaacagtggaggcaaagacaagggggcgtgactgcttaggctgcagaggccttgagcgccgagcttagcagctaggtctgattccagatttgtgatttcggcctggcccggattgccgatcctgagcatgaccacaccggcttcctgacggagtatgtggctacgcgctggtaccgggccccagagatcatgctgaactccaaggtaggaggggctgcccactcctgaaaggaacggaccagttcccaggaagccctggagctacctctgagccagacactgacccccatgacacaggaattctaccctctgggccttgggctctgcaaggaagctgagcattgagccctccaggcctctgccttctgcctggtgttggatctaacttggaggtggtggcctggcgcagacaacaggaccctgttgaggctggcccaggagctcaccacttcctcctctcccccagggctataccaagtccatcgacatctggtctgtgggctgcattctggctgagatgctctctaaccggcccatcttccctggcaagcactacctggatcagctcaaccacattctgggtgagggaggcccggctggctgagttggggatgattagcttttccgaggtgagatttctcgagagtccaagtcagggataccaccacgtgtggggtgcctccagcatctcatggtatctcaatgaggtatagatattatccccattggatagatgggaaaagcaaggctaagtcccacacctgaggaggcaccagacctaggatttgagcctcggtctgcctgaacccagcccccttgctctgcaccaccatgctaatgactaggaggtgactgagggattggcatgggttgctgggctggggggtcttgttcttgccttgttgcctattctgttcccagaaagaaagaggtgatcatttaccaagtcacctccttatccacaggcatcctgggctccccatcccaggaggacctgaattgtatcatcaacatgaaggcccgaaactacctacagtctctgccctccaagaccaaggtggcttgggccaagcttttccccaagtcagactccaaaggttcgagagacatgagggtgggtgtgggataaaccttgggtgtcgtggagggtgtgtgagcccagcagccgctggaggagacaggcaaagcaatgcttctcggagctcctccagtcttccctgtgacccctgactcctgcccttccatagcccttgacctgctggaccggatgttaacctttaaccccaataaacggatcacagtggaggaagcgctggctcacccctacctggagcagtactatgacccgacggatgaggtgggccagtccccagcagcagtggggctgggggcaggggagcaggggggcacgtaggcatcccccatgccaggcctgagccttgctgtctctaccaccccagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggtgagtgtctccatggcccacacatggacaccctgatactaaatatctatatctgtatatctatatctatatctatctgtacatgcctccatacagcagcaagcttaccccacacccatggtcaatgtgtctggtgacaacagaagtgcccagggggctgggtgtggtggctcatgcctggaatcccagcactttgggagactgagactgagaggagtggatcacctgagggtcaggagtttgagaccagcctggcctgcatggtgaaatcccatctatactaaaaatacaaaaattagccgggcacagtgggtcactctggtaatcccagcactttgggaggctgaggcaagtggatcacctgaggtcaggagtccgagaccagcctgcctggccaacgtggtgaaaccctgtctctactaaaaatacaaaaattagccgggcacgtaggcatgcgcttctagtcccagctactcaggaggctgtggtgggaggactgcttgaacctgggaggcggaggttgcaccactgtactccagcctgggcaacagtgagactctctcaaaaaaaaaaaaaaaagggctgggcacagtggctcatgcctgtaatcccagcactttgggaggccgaggtgggtggatcacaaggtcaagagttgagaccagcctggccaacatggtgaaacccggtctctactgtaaagaatacaaaaatgagctgggtgtggtggcacatgcctataatcccagctactcaggaggctgaggcaggagaattgcttgaacccaggaggcagaggttgcagtgagccgagatcgcaccactgcactccagcctggactacagagcaagactccatctcaaaaaaaaaaaaaaaaatgcccaaggctgcccagactggtggcccaccgagtcctccagccccaaatgtctctgcctgtcaacaccttgcatcctccagccccacaagccattctaatctccttctaggaacagaactggcaaagaggcaagaggtcactgagggcctctgtcacccaggtgaggacctgagccaagcttcagctctgggtgtggcagaagcaggtggggccatgattgctttgggaggggcccagcagcgcccagcctgacccagattgccaggcctcctcacacctgctgccagatcagcagttcacatagctgtggggaccccactggcctgcccccacccacgctgcctccttgcctcctccggtctcttcctgtcttcagccaggtgtggcctgatagaaagaaggcatgcgcacctgggctcaaactccagctgtgccacttagtaagtgctgtgtgatattgggcaaggcacctcacctctcggcgcctcagtttccggagtcaatctatttatctttttttttggttttgtttttttgagacagtgtctcgctctgtcacccaggctggaatgcagtggtgcaatcatagctcactgcagcctcaaaactcctgggtgcaagggatcctcccagctagctggacgagccattgcaaccggctaattttttttttttttttttgtggagctggggtcttgctatgttgcccaggccagtctcaaactcctgggctcaagcgatccaccacctcagcttctcaaagtgctgggattataggcgtgagccactgtgcccggccgagacagttctaataatgaaagcataaagccctaagcattgttctaagaggtttacatgtattaattcctttaatcttacagcagtacctcaagctaggtactattattatctccatttacagataaggaaactgagacccagcctatccagctgtgagggtgaaatgagagatgttgaggtcagggctccagtgggtctgcccggggggtgctaacgactcctcttctgcctgcttctctctttaggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctga

SEQ ID NO: 46 - DNA, 64920 bp, Homo sapiens
  source 1..64920: mol_type = genomic DNA
tttacagggcttaactcattttatccttaccacaatcctatgaagtaggaacttttataaaacgcattttataaacaaggcacagagaggttaattaacttgccctctggtcacacagctaggaagtgggcagagtacagatttacacaaggcatccgtctcctggccccacatacccaactgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcagtaagtatccgcgccgggaacagccgcgggccgcacgccgcgggccgcacgccgcacgcctgcgcagggaggcgccgcgcacgccggggtcgctccgggtacgcgcgctggactagctcaccccgctccttctcagggcggcccggcggaagcggccttgcaactcccttctctggttctcccggttgcatttacactggcttctgctttccgaaggaaaaggggacattttgtcctgcggtgcgactgcgggtcaaggcacgggcgaaggcagggcaggctggtggaggggaccggttccgaggggtgtgcggctgtctccatgcttgtcacttctctgcgataacttgtttcagtaatattaatagatggtatctgctagtatatacatacacataatgtgtgtgtctgtgtgtatctgtatatagcgtgtgtgttgtgtgtgtgtgtttgcgcgcacgggcgcgcgcacacctaatattttcaaggctggatttttttgaacgaaatgctttcctggaacgaggtgaaactttcagagctgcagaatagctagagcagcaggggccctggcttttggaaactgacccgacctttattccagattctgccccactccgcagagctgtgtgaccttgggggattcccctaacctctctgagacgtggctttgttttctgtagggagaagataaaggtgacgcccattttgcggacctggtgtgaggattaaatgggaataacatagataaagtcttcagaacttcaaattagttcccctttcttcctttggggggtacaaagaaatatctgacccagttacgccacggcttgaaaggaggaaacccaaagaatggctgtggggatgaggaagattcctcaaggggaggacatggtatttaatgagggtcttgaagatgccaaggaagtggtagagggtgtttcacgaggagggaaccgtctgggcaaaggccaggaaggcggaaggggatcccttcagagtggctggtacgccgcatgtattaggggagatgaaagaggcaggccacgtccaagccatatttgtgttgctctccggagtttgtactttaggcttgaacttcccacacgtgttatttggcccacattgtgtttgaagaaactttgggattggttgccagtgcttaaaagttaggacttagaaaatggatttcctggcaggacgcggtggctcatgcccataatctcagcactttgggaggcctaggaaggtggatcacctgaggtccggagttcaagactaacctggccaacatggtgaaacccagtatctactaaaaaatacaaaaaaaaaaaaaaaagaagaagaagaagaagaaaataaagaaaagttagccgggcgtggtgtcgcgcgcctgtaatcccagctactccagaggctgcggcaggagaatcgcttgagcccgggaggcagaggttgcattaagccaagatcgcccaatgcactccggcctgggcgacagagcaagactccgtctcaaaaaataataataataaataaaaataaaaaataaaatggatttcccagcatctctggaaaaataggcaagtgtggccatgatggtccttagatctcctctaggaaagcagacatttattacttggcttctgtgcactatctgagctgccacgtattgggcttccacccctgcctgtgtggacagcatgggttgtcagcagagttgtgttttgttttgtttttttgagacagagtttccctcttgttgcccaggctggagtgcagtggctcagtctcagctcactgcaacctctgcctcctgggttcaagtgattctcctgcctcagcctcccgagtagctgggattatcggctaattttgtatttttagtagagacagatttctccatgttggtcaggctggtctcgaactcccaacctcaggtgatccgcccacctcgccctcccaaagtgctggaattacaggcgtgagccaccgcgtctggccatcagcagagtttttaatttaggagaatgacaagaggtggtacagttttttagatggtacctggtggctgttaagggctattgactgacaaacacacccaacttggcgctgccgcccaggaggtggacactgggtttctggatagatggttagcaacctctgtcaccagctgggcctctttttttctatactgaattaatcacatttgtttaacctgtctgttccatagttcccttgcacatcttgggtatttgaggagttgggtgggtggcagtggcaactggggccaccatcctgtttaattattttaaagccctgactgtcctggattgaccctaagctccccctggtctccaaaattcatcagaaactgagttcacttgaaggcctcttccccacccttttctccaccccttgcatctacttctaaagcagctgttcaacagaaacagaatgggagccacacacataattctacattttctagttaaaaagaaaaaaaaatcattttcaacaatatatttattcaacctagtacatacaaaatattatcattccaacatgtaatcagtattttaaaaatcagtaatgagaccaggcacggtggctcacgactgtaatcccaggactttgggaggccgaggcgagtggatcatctgagatcaggagttcaagaccagcctggccaacatggtgaaaccccatctctactaaaaactagctcagcatggtggtgggtgcctgtagtcccagctactcgggaggctgaggcatgagaatcacttgagcccaggaggcagaggttgcagtgagccaagattttgggggattctgtgacatacaaaaaaaatcagtaataagatatcttgcatactcttttcgtactcatatacttccagcatatctcaattcacaatttctaagtaaatgctctatctgtatttacttttataaaattcacaattaaaaatgaaggttcacatagtcaagttgttccaaacacacttaaatgtctcctaggctgggtgtggttgctcacacctgtaatcccagcactttgggaggctgagatgggcggatcacctgaggtcaggagtttgagaccagcctggccaacatggtgaaaccccgtctctactaaaaatacaaaaattagctggatgtggtggcactcacctgtaatcccagctactcaggaggctgaggcaggataattgcttgaacccgggaggtggtggaggttgcagtgagccgagatcgcaccactgccttccaacctgggcgacagagcgagactccgtctcaaaaaaaaaaaaaaggctcctaataactttattactttattatcacctcaaataattaaaattaaatgaagttgaaaatccaggtcctcagtcccattagccacatttctagtgctcagtagccacgggggctggtgaccaccacatgggacagcatatttagtacctgatcattggttctcagatctggctactcagcagaaccaagaatccacagaaacggcttttaaaagcacagccccacagcccccagccccagccttacctacctggaggctgggaaggactctgattccacgaggcagcctatgttttttgatggagggatgtgacaggggctgcatctttaacgtttcctcttaaatactggagacagcttcgaggaggagataactggatgtgtcttagtccatttgatggagggatgtgacggggctgcgtctttaacgtttcctcttaaataccggagacagcttcgagaaggagataactggatgtttcttagtccattttctgttgcttgtgacagaatacctgaaactgggcaatttatatggtaaaaaattttcttcttactgctctggaggctgagaagtccaaagtcaagtcccttcttgctggtggggactttgcagagtattgaggcggcaccgggcgtcatatggtaaggggctgagtgtgctacctcaggtgtctttttcttttcttataaagcctaactagtttcactcccatgataacccattaatctatgaatggattaatccattattgagggaagaaccttcatgacccagtcaccgcttaaaggccccacctctcaatactgccacatcgggaattaagtttcaacatgagtttcggaggtgacaaacattcaaaccatagcatgctgtctcttaaatgactcaataagctcctgtggcatccacttctgcatgccttgggcagcttttagacatctgtccattttcctagagggacaagaccaccacctgtgatcctatgaccttttggctttaggcctaacaagcaggttataccctcactcactttcaaatcatttttattgtcttgcagacaatttacacaagtttacacatagaaaaggatatgtaaatatttatacgctgccgggcgcggtggctcacgcctgtaatcccagcactttgggaggccgaggcaggtggatcacgagttcaggagatggagaccatcctggctaatacgatgaaaccccatctctactaaaaatacaaaaaattagccgggcgtggtgacgggtgcctgtagtccccactactcgggacgctgaggcaggagaatggcgtgaacccgggaggcagagcttgcagtgatccgagatcgtgccactgcactccagcctgggtgacagagcgagactgcatctcaaagaaaaaaataaataaataaataaatatttatactgcttataaactaataataaatgctatggtctgcatgtttgtgtcaccccaccattcatatgttaaaacctaatcaccaaagtgatattaggaggtggggcccttgggaggtgatgaggtatgagggtggagcccatatgattgggattagtgcccttctaaaatagcccaacggagcccagtgacaaggcatcatctatgaaccaggaaactggccctcaccagacaccaaagctgttggtgcattgatcttggatttcccaccctccaggactctaagaaacacatttctattgtttataagccacccagtggctggtattttgttataacatcccagactaagacaaataacaaatacttgtatccctgacaccaggttaagagatagaatttgtttgttcctctggaggcccttgtcttcaccccatcactgccctgtcctccctggaggaatctgccagcccgaattctgttcatcgtaccctccttttcttagagtttgacctcctctgtatctcccccaatccatgtattgcttatatacaaggtattctgctgtatctgttctgctatggcttgccccttttgttcaacactgtttttgtgcgtcatctgcattgatgcatgcagttgtcctttatttgttctcactgctggatagtatctggttgggtaaatatatcacactgtaaatcacactatccaggttcctttaggtgacatttggttgattgcagtgttctgttgttacgatggtgctgctgtgactgttcttgtgcatggacagaagttcctttcaggtgaatttctcagaatggaattgctgggcaaaggggcagccaataatcaactcatttgatgccaaaagtggtggtgccagttcatcctcccctgcgaggtatgggtcctgattcactcttcaagtgctgtggtttgacagggccgggggtgacaaggggacacctgggaaggaaagctgggctccctgctggccatccaggccagtccttaccagggggtaggcaatgattgggtcaagtggttcctgaccactgggcctgagacttcaggcccagaaactatctaatatttcctcaaatgcatcccatgagcaggcactgtgtgagtgagcacacacatctgaagcctcaagctaggcaagcctaccatgacttgtggtccaagggctcacgggtgacctggagttagagggagacatggctgccaggtggctttagaaagaacactcatcatggccaggtgcggtggcttacgcctgtaatcccagcactttgggaggccaaggtgggtggatcatgaggtcaggagtgagaccagcctgaccaacatgctgaaacctgtctctcctaaaaacacaaaaattagctgggcatggaggtgcacgcctgtaatcccagctactcaggaggctgaggcaggagaatcacttgaacccgggaggcggaggttgcaataagcctagattgtgccactgcattccagcctgggcaacagagcaagactccgtctcagaaaaaaaaaaaaaaaggaagaacactcatcctatgaccttgacctccaagctttgcctccctcaagcagaacagaatggagcctcccttaggcagaggcggaagtttgcctctcacctagttctccattcttttgttcagagcctgaataccctcaggctctgtacttggggtatttctgttctcttgttttatgctcacggttgtgaggtttgttgtgagtaccacgatcccttccttcagaggagtaaactgaggttccaaaaggtttagcagttgcccgaggaatattaaattggcaaaagcaggtagaatataaagcaaggagtatttggcaacggttcttttttatgattaaaaacagccgaagaaagacttctacttgtgcctttgaaggagtaactgcatttgaccttcccaccagtaacaaccatcaaatctctattaaattaaacacacacacacacaaacaaaaacagctattgtgaaggtatcagcgactaagacaactaaggtttgaggggccaggatcctggagagatggaaacttccctgaggtgagccccacattctcagacacttttccttggatgttttgagcactgctttaattcctgggaaaacaattccttccactgtgcacagactctggggccagacagcttgggttcaatcccagctctgccacttaatgtctgtgtatctgtgtaggcaagttaccctttggtgcgtcagtttcctcatctgtaaaacacaactatagttgatcctcattcgttaagagtctgtacttgttaatttgctcacttgctaaaatttgttaccccaaaatcagtacccctagccttttggggtcgtttcaaagatgtgtgcagagcggcaaaaaaatgtgagctcctccaggctcatgttcccagccaaggtccaacaaagtgctgccctgccttcttatttcagctgtcatagtgtaaactgtgtccttttcacagtctgattagtgccatgtttttcagatttttatgcttttttcttggttatttctctgttaaaattgtctccaagtgtagtgcaaagtttagcacgaggaggctgtgatgttccttacagagaaaatgcatgtgttagagaagctttgtcaggcatgagttaaggtgctgttgtcctgagatcaattaatttgttgttgttgttgtttgagacagggtctccctctgttgcccaggctgctggagtgcaatggtgtaatcatagctcactgcagcctctacctctctggctcaagcaatcctcccacctcggcctcctgagtagctgggactacaggtacaccccaccacacccagataatgtttttgatatttttttaggtggaattttgctcatcacccaggctggagtgcaatggtgcgatcctggctcactgcaacctccacctcccggattcaagcaattcttctgcctcagcctcctgagtagcacagattacaggcacatgtcatcacgccttgctaatttttgtgtttttagtagaggcggggtttcaccatgttggccaggctagtcttgaactcctgacctcaggtgatccacccgcctccgcctcccaaactgcagagattataggcacgaaccacaatgcccggcctcatgttttttatttttcaagttgaaatgaggtctctctatgttgcccaggttggtctcaaactcttgagctcaagtaatcctcccaccttggcctcccaaagtgcggggattacaggtgtgagctaccatgcccagccaagatcagtgttaatgaatcaactatatatattacataaggtgtctttaaacagaaataaggttatatattgatcgattggtaacaatgttgtgaccagcagcttacagggtacctagccttgtatttctcctataaataatttgctcgttgagtgtttgtggcaactttgtagcacataactaccaagaataaggactgtaataagagtacgtccctcacaggattgtaatgaagactgagtccatttacataaaggctgagagcagtgtcaagcagatggagaacactgtagaatgtgcgatagctctaacagtggttatcatggctgccctctcacttcttcagagacatgtgtttctaaggtctgcactctgccccaccctccccatccactgtcccccagcccgtttcctcctccacttacttcccagccctgtgccttctgccttctcttttctgagtttgctaagggcactgctggctcaagagcagtaactaacagtctctcgcctcttctctccatggcaaccagtgacctttggagaatgtaaaccttatcaccaatctcttaaagcccttcggtgccttcccaggatgacgtccagctgaggtccttggcaagacccagggcgccccctcctcgctccatcacctcccctgtcacctcccctgcatctccctactccagctgcaccactcttgtgccccagtggctcttgtctgattatttccttcatctccccagctggtcagcagagctggtggtaatcaactcagaccctgtcacctggatgtccagcagttagggactaaaaaaaatcaacaggtcacattctgtcctgcagatcatgataataagatctgtcagacagcagtcagcagtcagagccaaatcttctggacttcagcaggattctgcctcttgctatttcctgttgcctctcttagtgaccttttaagagcattgtggatgcctcccagcctcctgctaaccaccctgtaacctgaacagcctgcagcagccctgcccagtagaacttcctgatgtgatggaaatgctgtgtctgcaccactagccacatgtggccacaggattctcgaaactggtggtgcagttgaggagctgactttatattttatctcattaaatttaaatgtaaatagctacgtgtggcttgttggctagcctattggaaaacacgggcttagagagacacagggagaatcactgtaatgcactaaaagaaggtaaaaaaaaaaaaatcctaagaaatattcctaaaatactttaatatagggctgggtgcggtggctcacatccagcattttgggaagctgaggagggcagatcacttgaggccaggagttcaagaccagcctggccaacatggtgaaaccccgtctctactaaaaatacaaaaaatcgggtgcggtggcgggtgcctgtaatcccagctacgcgggaggctgaggcacgagaatcactcgaacccgggaggcgggggttgcagtgagccgagatcgtgccactgcactccagcctgggcgacagagcgagacttcatctcaaaaacaaaaaacaaaaaccaaaaaaaaaaacttcagcatgattatttaaccaaaatgcaggttagttgttcaccggatgcagagtccaattaacaagagcaaggcctggtaccaaaaaaagtgaatttactccgaaactagcttgggtgaggggtacaaagcatcctgcctttctttaaaagtgctgcttccccttggaagtagaaagtggacacttttataaggtaaggggggaagtgtgcaagggcaagtgggggggtccctctgctagttccgtgcatactctacaggacagttgacttggcaccttcctggttagtaataagctgtagcagtggccaagtgggcatgctttcagtatgccctcccagtgaatgaaagtcctgaggcaacccccaagggtggaagtgccaggccaccacccactggaggtgaaagttccgtgatgggtttgctttggtctgcgaatctactgtcatgtggagagatctgtgctctggaagagcatacagttagaaaagcttgccctgaagggaatgtatggtgaaggggaggtgaaaggttatatttgcatttctgaagggctaagtaggaaaccgggaaccaggggagaggagaagagaagagaggataattttttttaagaaaagcaacatattccctttttcttagaaaaaatggagcactcggttacaggcactcgaatgtagaagtagcaatatataaattatgcattaatgggttataattcactgaaaaatagtaacgtacttcttaactttggctttcagagttcgaaccaacgtggcctcaaccagatttggaatgtcaaaaagcagagtgtctatttgatgaatttgaggaaatctggaactttgggccacccagggtaagataaaacaccttccacgtcataggtatcttcctctctccttccctgcctctcccattagaacctggttttcttcctgagcagcaacaatcttaggcatctttccatgtgactgagtatccaccacattatttttaatgaaatagtattagattgcatggatgtgacataatccatttaacccatcccctactgttggacattcaggttgtttccagagtttcaatattattttatttaataccctaatagttagagcaggccatgctgctatcacaaatagacccaaatatttaatagctcaaaccaataacgtttgtgtcctcctctctgggcagtacagggttggcatacctcctgaagtgaattaggaactacactcattccagcttccagtttggtctttatctgtcagtgccttactgtcctctgcattgttgagtctcagtcaccttgtccaagttccattggccagaaagggctagaagcacagaagggctggaagtggcatttgttcctcactcacattctggtgggaagaacttagtggtgtggccttagctgactgtaagggaggctgggaaatatagtctagcgagtgccctggaaaaagccggcacggcattccccatggaaagctgtcaggcacggctacagtctaccccctgccaaccagtatctgcatggaccctccttccacactcagatgcatttacccccagccccaagagagccaaccgatgcccatgtggtcaccacagccacctccgagtccaagatttccaggtgacatgcagtctcctctctcccagctttaggaatggcttcttctgatctacacacagacacagacacacacacacagacacacacacacacacacacacacacacacgatggagaggggcaggataactgcaactgtaactccattcagaaaagaggcacagcactagctgcccgcagcactggagccctgctgggcagcactggatcaacctctgccctggcagaggagcatgttcctccacaaatccctgcttcagcctctcgagaggctcctccttgtctgttattttccttggccacaaggcaggcaggcagtgggaagtgtgccctcctccggggcaaggagccttcacagcccacttcctgctaataacagtttggggttccacagggtgttttaagactccagtcagctattttaggccagactcatttctctctctctctctctttttttttcttttatgaaatcacaccctgagacccaggctggagtgcagtggtgcgatctcggctcactgcagcctccgcctcccgggttcaagcaatcctcctgcctcagcctcctgagtagctgggactataggcgtgcagtgccacacctagctaatttttgtatttttagtaaagacggggtttcaccatgttggccaggctggtcttgaactcctgacctcagatgatccgcccgcctcggcctcccaaagtgctgggattactggcatgagccactgcgcccagcccagactcatttttctttgagagtaggcttttcccaaaagtaggcttctgagctattcactttcaggcagtcccatgtgccaggaaccacatccaaatttcctccgtggatgggagtctcaggctgccttatctccttgcatgtccccatgcccagctgtctcagcctaagggcaggtaccttgaagtcaagttaaacaataagattggagaccagcaatgccctcagcctggtttttgcagcaggactgagtcccttgttttggctcaatgggaagtctttgctgttcaaagccttagcttctctggctgagtgcggtggctcacgcctgtcatcctagctctttgggaggccgaggtgagcagatcactgaggccaggagttcaagaccagcctggccaacatggtgaaaccctgtctctactaaaaatacaaaaagttagccaggcgtggtggcaggcacctgtaatcccagctactcgggagcctgaggcaggagaatcgcttaaacccaggagatggaggctgcagtgagctgagatcatgccattgcactccagcctgggtaacgagcgaaattccatctctaaaaaaaagaaaaaaaaaaggccttagattctccctttgactttccacgtttgtgcagccttttatctccaatgctccatttcattccatctcctggcttattcttttcttgtcacatctactaaaagcaacaagaagccaccggtattcaggaacattctacctgtccccagagctatatgctcagtaggcatacagttggccctccaggttatctgagactcagatttccagagggctttgcatggctcacaaggtctgaagaacctctgagcctcccgcctgcggtgtctgttcattgactttgccacagtctcaaagaggcactgcatgctgcatgtttgaggtttttgctttggtggcatccatttccagcctcggcttccggcattcctcccccagcagactctctgctgctttccccttactccttctggcagttctgggaggttgcatagggcccttgcaggatgccccaagtccagctgcctctggcctctgggaagcacacccttgacctgccatgtgtaggaagacagcccgcttctgccagggcccaactctgccggcaggtagcaccttccaacctcttcactttggactttataactgtcaggtataaagtcggttgtgtccttacgtttctcaaattcttcaagacacgtcaaccagcctctcctacgcattctctccagctcagtctcaaaacacaccctttctctccagctcactctcaaaacacaccctatcaggccaaccactctttttaaaggacagctcctcaccaatccagtcaggtagccttccccacattgtatcctggaagtgggtgatggactgggtggggaagagggtcatatggcaaatctgtatgtcttacagtaattgtctagcagcccctggtgtcttactttaggccccctggaaactttcagatagtggagttgtctgatacatatcttataacctacagatattaatatatcctcacaggggcacaaaagctcttacaaggatgtttattataataatatttttattgttataatttacatgccataaaactaaccattttaaaatgtataatgcaagggtttttagtatattcacaagattgtgcagctgtcactactaattccagaacattttcattattccagaaggaaaccctattcatattagcaatcactcccccattccgcctttccctaaaacccagcaatcactaatctactttctgtctctgtggatttaaagtaattttaaatttgaaaaatagtatctataaggaaatgtatctagtcacaagcatacagcttgatgaatttgtaaaaattgaacagtcctatgaacataccctgtaagctcaagacatagaatgttaccagcccctgcaagcaagctgcctgctcacttctagtcattaacccctccctcttttccttctagtcattaacccttcagagtaactattctgattaccaatagcatagattagttctgcctgttgttttactttatataaactgtctcattaagtataaacatgtttgtgtatacttgtgtatttctttctatcacaatgatgtttgtgagattcatccatgctgttcctatagacaattctattttgcagcgtagtattccattgcatgactataccacaatttatctgtgatattacaaaggaatacttgggcagtttccagtttggggctataggatagttgtgatacaaatattttagtatagtacatgtcttttggtgaacctgggtacacatttctgttgtgtataccccttaagagtggagctgatgatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcttgcagtgagccgagatcgcgccactgcactccagcctgggcgacagagcgagactccgtctcaaaaaaaaaaaaaaaaaaagagtggagctgatgggtcatagcatgtaaatgcattcaactttagtagatactgtccaacagttttccaaagtgattgtccaacttacttgcctatcagcagtatctgaaaagtctagttgcttcttttcttggccaactctttttttttttttgagatggagttttgctcttgttgcccaggctggagcgcaatggcacgtcctctgctcactgcaacctccgcctcctgggttcaagcaattctcctgcctcagcctcccgagtagctgggattacaggcatgcgccactatgcccggctaattttgtatttttagtagagacagggtttctccatgttggtcaagctggtctcgaactcctaacctcaggtgatccgcccgcctcggcctcccgaagtgctgggattacaggcatgagccaccgcgccaggccggccaactcttttttattttattttattttactttaaagacagggtttcactttgtcacccaggatggaatgcaatggcacgatcacagctcactgcagccttgacctccctggctcgggtgatccctcccacctcaggctcctgaggagctagaactacaggcatgggccatgcccagctaattttttaatttttggtagagacggggtctctgttgtctcagattcctgggttcaagtgatccttctcccttggcctcccaaagttctggtattacaggcatgagccactgcacccagcccatggccagctcttgatacgatctgtctctttcttttctttttttttttttaatttgagaagtgttaaataatctttctttgatattatacataaaccacaccaaaatgtctttcagtaagtaaaatgaaccattttagatacagaaaattctaattagattggcatagttaaggccaaaaatataaagttgacattgctaccttatcttcagcccttgcctttaagaggcaaatgaacacaaaatacaggtgaatcttgcttggttctgagacagtgaaggactttcccccagtatttaaatatatttacataaccagttacataaatctaaatattaaaaaaatctccaatagattttagatggcattcaccatctttgtgaaaagttgaacattactaatgaaatctgatcatatctttagaaggataaacagtgatagcatttactgaatcagaataactgttttttggggttttctttgagacggagttttgctcttgttgcccaggctggagtgcagtggtgccacctcagctcactgcaacctccgccccctggattcaagagattatcctgcctcagcctcccgagtagctgggattacaggctcgccccaccatgcccagctaatttttgtatttttagtagaggcgaggtttcaccatgtcagccaggctggtcttgaactcctgacctcaggtgatccacccgcctcagcctcccaaaatgctaggattacaggcgtgagccaccaggcccagcctattttttttttttttctttttttgagacggagtctcactctgtcacccaggctggagtgcagtggcacaatgtcagctcattgcaacctccacctccggggtttcagtgattctcctgtctcagcctcccaagtagctgggaactacaggcgtgcaccacaagcccagctaatttttgtatttttagtagagacagggttttgccatattggcctggctagtttcaaactcctgacctcaggtgagccacctacctcggcctccgaaagtcctgggattacagacgtgagccactgcactgcctggcccagaaaggactattaattgtagttgcctctgggaatgggggctgcctgcttctttctgtaaccccttctgtgctgtttaaatttttttttttttttttttttttgagacagagtctcgctctgtcgcccaggctggagtgcagtggcgcaatctcggctcactgcaagctccgcctcccaggttcacgccattctcctgcctcagcctcctgagtagctgggactacaggcacccgtcaccacgcccggctaattttttgtattttcagtagagacggggtttcaccatgttagccaggatggtctcgatctcctgaccgtgttatctgcctgcctcggcctcccagagtgctgggattacaggcatgagctaccacgcccggcctttaaatttttactttgggccgggcacggtgccttacgcctgtaatcctaacatttcgagaagctgaggcacgtggtggatcacttgatgtcacgagttcagaccagccactgcactccagcctgggtgacagagtgagactctgtctcaaaaaaaaaaaaaaaagaaagaaaaacttttactttttacatgttattttcatcaatttaatgaatttaaataacaaatgtataaatttgatattaataaaatggaagcatttggtaatcatgttttgggttttgtgcttcctctgcagctctctagatgagaccacctatgaaagactagcagaggaaacgctggactctttagcagagttttttgaagaccttgcagacaagccatacacgtttgaggactatgatgtctcctttggggtacctcttgacttcttttatttttctgtttccccctctaagaattttagttcactaaaatgaagaatttccctccagcagagctaagcatcaagtagcatgtagttgtaggtaggattaaaagactagggttccgggaggtgaaggttgcagtgagccaaaatcacgccactgcactccagcctgggtgacagagcgagactctgtcatagatggatggatggatggatggatggatggatggatggatagatagatagatagatagatagatagctggatagatagataagatagataagacaagactaggcttcaagctgcagtccagctctaccaggcttgttgtgactctgggcaagtcactcagcctctctgagcctcattttccagcttcagtggatacccatgaaggcaaatcagagaggggcctgagtgtgtatttgtccagcaggcagatggagggaacaacaaactagacccgtagttcttcagtagggataagataactgcccaaaagttatttagattacaaagacttgagccctgctcctgtgagacagtgatggggtaggtcgggtgcattcctgggaagcatatttttgaaaagctcacctgggattctaatgtgtatccctaggtcttattcctagagattttgattacttggtctggggtgtggcatgacctgggcagggcactgggatttttaagctccacagatgattccaatatgcagctagtatgagaacttgtttttttttgaaggagtctcactctgtcacccaggctggagtgcagtggcgcaatctcggctcactgctccgcttcctgggttcaagcagttctcctgcctcagcctcccgagtagctgggattataggcatctgccaccatgcccagctaatttttgcattttagtaaagacggggtttcaccatgttggttaggctggtctcgatctcctgacctcaaatggtccacccccatcagccttccaaagttttgggataacaggcgtgagccaccaggtccggcctggtgtgagaacttctgagttggatgaaacattagccccagatcctagaagccagggaagtgctggtctttatcgactggccaccaggtggcagatttgggcaagggtctgcctttgggtttagaattattgcttaggccttaaagtagttcttttttgccagtgggagaaaatccctcaaagatggttttctgggttggttggtttgtttgtctgtttgtttgttttttgagacagagtctccctctgttattcagcctggagtgcagtggcatgatctcactgcaacctctgcctctcgggttcaagcagttctcctgcctcaacctcccaagtagctggaattataggcacacgcccccacacccagctaatttttgtatttttagtagagacagtgtttcaccacgttggccaggctggttttgaactcctgaactcaagtaatcctcccacctcagcctcccaaagtgctaggattacaggtgtgagccaccgcgcctggctcctcaaagatgttaatcctcttgatggcaattgactaataccagaaaatgtcacgaagcgtgcattttggattcaatcatggaattgttgaggacaatcagccatcagactaaagcgatagaaatagtattggaaattgcagcgggagcactgaatggagaaggcactccacataatggaggaggcaaccaagtcttagagaaggtatcaagcctgactataaggacagtgagggaattgaaaaaacaaaaaaggagcaatggagcagggaaggattgaatgcctttcaagtagattcagtaattgctgttagcagcaaaaaatgcagtagtgcctgggcagggctttaaagtgcttgcacaggcagccctagagggccgggctgcttgggaactcttacaaactgacctaccaacttgagcatccacagcctgatcagaggtgggggagttaagggccttctctcccctagcctctactagagcctgtaactgcagggaaaccaagttgcaggctaaactctgcccacacatgcagacattgattagcaagctacaaaaacagtcatgaaacctgtttttataggattagtgaagccccagtttgaccagagtactttgcatgaatgttttgttagaagcaaatgtgccaatattctagcagctgcgtttggtttacttcttcttcttctttttttttttttttgagttgaagcctagctctgtcacccaggctggagtgcagttgtgtgatctcagctcactgcaacctctgcctcccaggttcaagcgattctcccgcctcaacctcctgagtagctgggattacagacatgtaccacaatacagggctaagttttgtatttttagtagaaatggggtttcaccatgttggccaggctggtctcaaactcctgatctcaagtgatccacccgcctcagcctcctaaagtgctgggttaacaggcatgagccacggcacctggcaaaagtcatcttttggtttacttctattgaactgaaaaagtcacaaatatatttatatttaattaaatatatttatataaaaatatggtatttagtattattatttttagagacagggcctcgctctgtcacccaggctggagtgcagtggcacaatcatagctcactgcagcctcaagcttctgggctcaagtgatcgttccacctcagcctccctagtagctgggactacaggcacatgccaccatactcggctaattattttattttatttatgggtctcgctatgtttcccaggctggtctcaaactcctggcctcaagcgattctctcacctcggcctcccaaagcaccgggattacaggtgtgtgccagcacacccagccacaaatctataaatttagaaaggaggactatttctaaagagggtcccactacctgtaggcaggaagcagagcctctggccataactgaaaaacaagcacttccaagaaggggcaaagggaacatgaatttatgctgagaggcgtagctaagcatacatattcaacagattatgggaggatctatgaatattcacaaagggaggatctatgaatatgcacacatgtggagtaagctaacgtgtgcagcatgtctcccatgttcaccttaggcagaaacttaacactaacatgtattacagggcaacaaaatgagactgcatatctacataacctagctatttggtaggctgaagcaggagcatcacttaagactgggagttcgaggcagctgtgagccatgatcgcaccactgttctccagccaggatgacagggcaagaccctgtcttagaccactctgtggtcagtggttatcaggaaggaatgctagtcagttgtgctgaaaccactaaaaaggaagggcagaattaggtgatgagttgataccagtggtgaagtgagtcttttttttttttttctttttgagatggagtcttgctctgttgcccaggctggagtgtagtggtgtgatctcagctcatcgcaacctccacctcctgggttcaagtgattctcttgcctcagcctcccgagtagctgggattacaggcgcctgccaccacgcctggctaatttttttatatttttagtagagactgggttttgccatgttgtcaggctagtcttgaactcctgacctcaggtaatccaactgctttggcctcccaaagtgctgggattacaggcagctccaaagtgctgggattacaggcatgagccaccatgcatggcctgaaataatttttttgaaagggctagtttctatttagcccttaggggaaaaaaaactaatggcagttagggagggaatagaacgagtcctgtttgaactcctttcccatcatggccaaaacttaaaattttttttagatatctctgggctccccttggccaaaagatagtttgttgagtcagttgggagcttagaattttgtttttatttctcacatcattgaatcaatttgaaccaggcgacaaaaccttctgctcccagtagtgggtcagagaaccttcctgattcctgccctgagattgtctctctgaagacaacattaggctagtaggctttccagattctgtaacccattctttcaaaggaagagatgcctatatttttctagccaattcatataccttgagtatcactcaagggcaaaattatttctaacaaatcatttactaattagcaaatgcttaagtgtagatttagaaagctaaagctatacagtggctgccatctatagtttggacttgtgattaactacattgaaatgctaactctgtaccctagagtatgaattcctgattagagtccttcaggtgctaactaatttatgtatttcatgtttgataatattattacttgagctttgtgggagagcagtcttttcctcccctgagatatagctagaagttacctcctttgtgaagccttcctagatactccaagcagacacggtccttcctttctcccttgcccagcactctgaggttgactctgtggagcactgatccctctgtgttataattgtctatttacacgtcagctaccacctataacacactgagttcctcaacagcagggacactgtccattctttgatcccagtgtctggaacagtgccaagtacatagtagggacttaataaatattgattcatatgtaaatgagacttttccaaaacatgctttcgttgatgcctctcagcatttatacaccttttaccaactcgctactggccacatagacaaatgaaagcagtaatccagatacacccaagaggacatctgttcttttttctctctgtggagtgggagacttaagtggcttcttaactggtgtgtcgtctgatcaagtggtccaggtaacaggtggatgccaatgtctggcccaggcatcaccccttactggcactggtcattacagaagacactctaccagagctgaaaggacctcttgtcactaggcagctgtggagtccgctctacttgacctagtaaaatctgcctggagactgttagagtcaccccactacctgaagttacctccaggctgacctcttttttttcccaggtggagtcctggcatcttagatattttaataaggatttgcttgttgacatgttctttattcactaaggtgtcagcatattactgtcttagaactgagggttcttcatcttttttggatcaggacctccctctaagaatctgatgactgctctggtccctctcccaataaaaacttccatactcacctgttaaaaaaaaaaaaaactttaaacaaattaacagagttttattcagcaaagaatgattcataaatcgggaaggctgcaaccagaataggttcagagagactccacggtgtgccacgtggttggagaggatttaggatttatgcacagaaaaaggaaagtgacatgcagaaaatgaaagtgagggcctggtgctggtgcggtgcctcacgcctgtaatcccagcactttgggaggccgaggcgggcagatcatgaggtcaggagatcgagaccatcctggctaacacggtgaaaccctgtctctactaaaaatgcaaaaacttagccgggcgtggtggcaggcacctgtagtcccagctacttgggaggctgaggcaggagaatggtgtgaacctgggaggcggagcttgcagtgagccaggatcccgccactgcactccagcctgggcgacagagcgagacttcatcttaaaaaaaaagaaaagaaaaaggaaaatgaaagtgaggtacagaaacagccaggttggttacagcttggtgtttgccttaaacttggtttgaacagttggccgcctttgattagccaaaactcggtgattggtacaagagtagattgcagttcactatgtacagagaagcccttagatccgaactcaaaataggtaaggaggcagttttagctacacttaagttaacatactcaggagtaccattccagcttcaagctggaagtgtctgcagccccctgagaccacttaatcccaagttaaaaacccctgctcagaggcagcatctttttttttttttttttttttttttttgagagagatctcactctgtcacccaggctggagtgcagtggcacgatctcagctcactgcaaccaccacctcctgggctcaagggattctcttgcctcagtctcccgagtaactgggattacaggcgcgtgccactatgtccagctaatttttttttttgtatttttagtagagatggggtttcaccatgttggcctggctggtcttgaactcttgacctcaagtgatccactggcctcagcctcccaaagtgctggcattagaggtgtgagtcactgttcctggcccagtgaggcaccatctcattggatatggagacaaaggatctggcttagcatcctggatttgtattttctttccaagagtccttaagtgatatctaacttttgcgagctgcagtttcctcagctatgagatgagtgacattaacctcctctcttcagatttataagaggatcaattaaaatggcataggtaaaagtgcatcctagcaagttggtatctactttagaaatgaaggaggtcatatgtatgtgaagtctccagacccaacatgccatcttatatgtgtctatttctacaagtgagctagtgacaacagtaattgctatttttgctcctacatgggtagggctgatcttgactaggaggagtcaataagactcaccagccgggcgtggtggctcacgcctgtaatcccagcactttgggaggccaaggcgggcggatcacgaggtcaggagatcgagaccattctggctaacacggtgaaaccccgtctctactaaaaaaatacaaaaaaattagctgggcgtggtggtgggcgcctgtagtcccagctactcgggaagctgaggcaggagaatggcgtgaacccgggaggcagagcttgcagtgaaccaagatcgagccactgcactctagcctgggtgacagagcgagactccatctcaaaaaaaaaaaaaagactcaccagctgtggccactgtctgtgctaattggctagtgcctgcatctcagaaactgctacatattttgactattccccctgcacttaagggcatgcacactcccaaaatagactcagattgtctaaggaataatgatgatgatgaagagaaagccctctttatctggtctatttgtagtcagttccaaaagcattaagaatttctgctgaactaatgcagctagtttctttcctgtcaccactttccttccaaaatagtttcaagatctgtgggggaaaaaatctatttacagtgaacagactggtgggaggaagttgagcattggggttttctgccctgtgtaaccttgccctaagttgggcagatggtatcacactacctggacatcatctgctcattcactatttgaccagttggtcattcattcacaaatgtcctttttgcaggagggatggaggtgctagacctgcagatgctagcatgaaaagacagatctcctgctgctaaggtgcttaaagtagtggaggtcaggggacaagcaagcagtcaggcagctctgaatgcagaggcaggaagcaccacgaggcaatgggacccacagaggggtagcagggtagaggtgagtgggtctcatgtggggagggaggaagttgactgcagagaaggtgccagggggtgaaaatagcttgagagctgtggagctagaagggctctcacatttgcttattaatatgccctttgaaaaagagtggcctgatacctggagtcactcaaaagatttccaattccgataggaaaaagtcaattttggcttcagtggttgcatgtgcaccccctgatttgctgtatgctgaggcattgtggtgatggacgcaagtgcggagaccttgagcacgcatctgcccctagttcttgccctgagtcctcgaaggaggcaggagagacatcaaggcagacaggcgccgctcatcagtgatgagaccagacctggaactcgcgtcttatactcagtcctctgccctttctgctggattgtggccccccagtatagggtgcaacacacaactggagcatttaagggccacaaagagaacaaattaccaatgattgtgtgttgattctttgagctctttttttttattattatactttaagtgttagggtacatgtgcacaatgtgcaggttagttacatatgtatacatgtgccatgctggtgtgctgcacccattaactcgtcatttagcattaggtatagctcctaaagctatccctccccccttccccctccctccaccccacaacagtccccagagtgtgatgttccccttcctgtgaccatgtgttctcattgttcagttcccacctatgagtgagaatatgcagtgtttgattttttgttcttgcgatagtttactgagaatgatgatttccagtttcatccatgtccctacaaaggacatgaactcatcattttttattgctgcatagtattccatggtgtatatgtgccacattttcttaatccagtctatcattgttggatgagctctttatctcatggaaaaataatttataaaactctgtatgagaggagtgggaaatagtattaacgggtgcggggtttctttttgggacaatggaaatagctggaattagatagtggtgatgtttgcacactttgtgaaatactaaaaactcctgaattatacagttttaagaaacttttatttatttgtttttgagagaagttctctgtgtcacccaggctgaagtgtggtggcgtgatcaccggttattgcagcctcaatctctgaggctcaagcgattctcccacctcagcctaccaagtagatgtgactataggtgcgcaccaccacacccagtgaatttgtaattttttgtaaaaacaaggttttaccatgttgcccagtctggtcttgaactcctgggcccaagcgatcctccctccttgggctcccgaagtgccaggatacaagcatgagtcaccacatgcagcctcagttttaagaaacttttaaataaatgaaatatagtcataccaaaacagtaaaaatgggtttcaggaaaaaaaatgtttttttaaacaaacttacgtattgtataatcccagcccttttaaaaaatgctttcaaaaactggcagtcaactcataaaaggacaaatacttatgattccactgatgaagtagtcaaaagtagtcaaaaatcacagaaacaccaccataaatgtataatttttattttcaattaaaaaaacatcttttttttagtcaaaatcatagaaatagaaagtagacaggtggttactaagggctatgggatggggaaattagtgtctaatgggcatagagtttcagtgttacaaggtgaaaagttctagagttatgctgcccagcagtgtgaatatactttattgttctgtacacttaacatggttaatatggtaaatttagcgttatgtgctttttactatagtaaaattaaaaaaaaaaaaaatggggccgagtgcagtagctcacacctgtaacataatcccagcactttgggaggccgaggtaggaggatcacttgaggccagaagtttgaaaccagcctggtcaatatagcgagacctcatctctacaaaagaaaaatgttaaaattagacaggtgtggtgtctgtagtcccagctctctggaggcagggactgagtcagaggatcacttgagcataggggtttgaggctgcagtgagccatgatcctgccactgctgcagcctgagcaacagagcaagaccctgttgtaaaaacaaacaaacaaaaactggcagctgatacctgagagtgaatatcttttatcgctggttaatgggattgagagaatgcttcatcttatagaaagaacagtgtctttggacccacagagacctggatttaagattagctctgccaattactgagtactctttactatgaacctctgttttcctcatctgtgaaactggaataatgaatcctaccgccaacaattgtagtcaagttggaaacaatttacacaaagtgccaaacaccaagcctggcacagtaggaaccgagtaaatagtggttaatatttttatcagtgtctgcattgctgacgtctccatcatttctatacatttgtttttgaatcagaaaaagatgttattttaaaaaaataacccagtagtgccccttgtcccattcctatcagttatattattattgttactaccctctggaatttcaataactctttgttttttgggttttttgttttgttttgctttgcttttgagacaggatctctgtcgcccagtctggtgtgtagtggtgtgatctcagctcactgcagcctcaacctcctgggctcaggtgatcctcccacttcagcctcccaagtagctgggaccacaggcgcatgccaccacacttggctaatttttgcatttttagtagagacagggttttgccatattgcctaggccggtctggaacttctgggctcaagccatctgcctgcctcggcctcccaaagtgctggaatttcaggcatgagccatgcctggcctaaatagctctctgtgtttgcaaaagtgtgttataagaatcattcagagcctctcgattggatggaggctctagaatgcacagaaaaaggctgccaccgtgtatctctgcaagtcatgcacaagatggggaacagcaggcttccccctgcttaccagttcaaatacagagaactagccctgtagctgtttctttcatatctcacccattctaaagagaccacaggccttagaagtaaaggactcttttgttgaaagagtgttttcaaatttaaatgagcatttattggtcaaagatgcaccaactagtcttttgaagaattcaaggctctttagagaaaaataaagccttggaggagtatctgagaagcttgttagatgcgtgggaagagtctggaaataaaaaacttcatctggagtttctgccttctaccaacagagctgaagctaatgctctcctaagacaagcaaagcagatggtttgcatacttccttaccttccttttacttcctctgtaatagacttgtcatgtctgatgtttgagttgacgtggtactctaatagagttagagtctgcattttttttatgtcctctagtatgttctggttgatggttgagggcaacaaaccagcagtcccagatgccagcaccaagacctgagacaggtcacttaactctccgagcttcaccaccattctcaccttgcagacctcacagggaacagggaaagctctatgagatacaacatcattatgattaatcctattctgattctgaaagcaaagctcttcctacacaaactcctatttctaaatactaaaagacatttctttatggtgtattttgtgtacttgtagaaatggaaagtgttgagataaaacatgaagcaatgatgacaaagtgctaactttttcttgttttaatttctttatgctttttttccacctaatcccctagagtggtgtcttaactgtcaaactgggtggagatctaggaacctatgtgatcaacaagcagacgccaaacaagcaaatctggctatcttctccatccaggtatgtaggtatgttcagaagtcaacatatgtaattcttaaagacttccgaaatgtgacattgtggaccatttaagaaatgtcggctgagcacagtggctgacacctgtaatcccaacactttgagaggctgaggtaggaggatcacttgaggacaggagttcagaaccatcctgggcaacatagtgagtccctgtctctgtaaagaaaataaaaataaagtcacagctgggtgcaggcttacacctgtaatcccagcactttgggaggccaaggcctgtggatcacttgagctcaggagtttgagaccagcctgggcaatgtcacaaagccccacctctactaaaaatataaaaattagccaggtgtggtggcacacgcctatagtcccaactacttggaaggctgaggttgagcctcagcctgagcccaggaggtggaggttgcagtgagccaagatcgcgccactgcactccagcctgggcaacagggccagaccctgtcccaaaaaaaaaaaaaaagtcatcgtcttatgttagcatccttgtaagtgagcctttcctgatattttgcagcctgtctcattctcagtagaaaagtttactctagttacataacttctccctgctgacaatttggatactgtaagcaggcatcaggatattaagatctgaagtgagtagcttataacttttccaaatccagcctagacagttttcctctattaaattattgccctgactttaaaagaagctacttttgaccttgtagcgtttgaacaagttgcactttgtcttcaaagcaagttaaagtttgacctctacttgttttgagcctctcaggtaaagggttatttgaattccctttgcaggttggggttgtgtaccctgtggaggtggtagagtgttatatattgctgctccagggcatttaatccctcctgccttttccattgatgtgctttcaatctagaggaataaaagattgtgttggagacacaatgtggcctgcatagcatctgaaagcctgagaacatgcagggagagacatccctcatccctcagcagcctggctgctgttgaagtggttgtaagaaagtaaaagagaaatgcccacaaaacgttctcagatccagtcattcattagcacttccaaagagagcatgttgactgtgaattgggaaagggccagataaaactagcatagaattctttgaaagactaacggtatttgcattttttaaaaattataaccttactctaccccctaacattgacatcatttttaggtaattaatattttcccatttattattctgtgatctctaatgctttgttcagaataaatagtgtgtttcctttccccacactttcatccaagaagtgtgctagagttcaacaaaaacagcactagaaatcactgtcattctaggaaggccctaattcacagattgtattggtttttagacccagttagtgtgctggaggttggaggattttaacctctgtgggccaactagcctctgtggcctcagtcattcttcctgaccctggctgtgcttgagcctgtgtgttcttatccttcatctccgggggaacgaagtggatcagctcggtccagcgatcacttttggggatcagtggctttgtagatatcgggcaggcacttaccccaaaagaactttccccatatctgaagactgaaaacgtccatatcgtatttggacacactgcccagcaatacgctctagctgtgttcagaagcatgggaatttggaaagatctgctgagcatgccgtttactgtcacagatactatcttcctcaaaaaaaaaaaatatatatatatatatgggggacggggcaggttgagactgggtgagactgaagaggtgccttggccagagcaggccacacccagagaccacaggctccccggtccacctcaggcccctccccttcctgcgccgtttccggcagatccagagtggccaccgccggatgggagtcgggggaagggaggcagagaagcgggccctgaggacaagctctcagtgcttctgtgggaagtggcggcaagacggcagctcccagcgggggatggaggccgagtcagtctgctggtcactggaggccaggatgctgcctaacacagccgtcccgctccgggcctcaccaccagggcggctctccccactcccggcctgctgcccacacagactgcggggttccgggggagcaggacccaggccgttctgcgcctgtcttcttggaaggagcaggccggagcgcgggagcgccgtgtagctgtacctgcgaaggcacaggattccgcgggaagatcccgcagtttcgggccgtcgtcattgtttttatacctgtggcaaatggcatgaccagacacacggttatgtctggagaaacccctgtagaggagcaggaggttgtggacatgctgtggcccggacagtggctgccgagcagttggagcctgcacccgcccaacttggctaaagaagtccccatactctctgtggaaaagatttccagaagctgttgtgtcaatatcaaagcctcaaaacaacaacaacaacaacaaaaacatgaaattatcaacaataaagatcatccttgagtctgctttgaaaagtagggtgaaattctgcagaggcattcaactggcaagataccaccctcatagccagatctgcaggtctcagccatcatgccagggaaaatgctccattcaccactcctcagcttctgcttctggtttcagaggtctctgtattggaggggctttaaagcaagaagggtctttacccacttactcttattcacagatgtgaatatgcaggtccagtggggaaagtgacatgtcctaagtcagaatagagtcaacaagaaaacagggcccaaaatgacttagcctctagtgtataatgggcattgatgagctactggaaatacagagatgaagaaaacacagtcccatcttcaaggagctcaatctagcaagggagacagactctttgtaggtgggaccgggcttccctgcagcagaaggaagcttgaaattggtaacgagcctcagaagggacagaggcaggccaccatgctaccctgagaggatcgcatgtggacacggggctatgacctggccctgctttgacccactagctgtgctgtagggccaggtggagcctggagtggcctgtgctaaggggctactatgagctctttccactcccccaaggcattgcataaataatgtcactttctgtttgcacagcaaaatcagggacacaattttctagaacatggggtgcctcccctccccccagcccaacagaagttctacaatgactgatgggcccttgtttttgtttgagacggaacaccccacagggttccgagtggtgatttgtggcccacaggccactggcaagtggaggcagagctgcagagccctcgggagccacagagggcctgctggccgccacgacatgccaactcagctgctgctggccctcctgtgggcggcagtgctagtgatgtgcagaatcttaggactagtgccaaggaacctataaataccctgggtgacccaggcgtgcactgctgtggtggccttcacagtcagaagatgacaagctgagaaggggagaatcggcccaaggtgagatccacagaaaggccagggccaagatgcggccagcacctcaggctggtggtggtcttacgttgaccatgccagaggccagtccttgattgctccaaaccctctgttcgagggttccaaatgaaatgagcaggtcctcgtgtcaggacctaggttagtttctgaaaaagcatgaaaagcaggcctcctgaacttccccgagtgactgatgcaaagtgcgtcctgcatgcttcacagcaccatggagaggatcttcaggggcaaactgcagactatctgaatgacggcactgaccatcagcaaaccgcagagctgcctgaccaagaaattgcgagacagaagcaatgcttgcaggcgaagaagaaggggccagacacagtggctcacgcctgtaatcccagcactttgggaggccaaggcaggcggatcacttgaggtcaggagtttgagaccagcctgggcaacatagtgaaaccctgtctctactaaaaatacaaaaaattcgccaggcatggtggcaggcacctgtaatcccagctgcttgggagactgagacaggagaattgcttgaacccaggaggcgaaggttgtaacgaactgaaatcgtgccacagcactccatcctgggcgacagagtgagactgtctcaaaaaaaggaggagaagaaggaaaggccaaggcaggaatgaaacaggccatgaatgttggagtgaagcaactggcctcctcgtgctaagcggctactgtgagttctttccactcccccaagacattgcataaataatgtcactttctgacactcaccccgctgaatgtcctgcctctgctcaagggtggtatgatggggacttggcagtggaggggaacagggaaaccagacatggtggtctccccgcttcctggctacaagtccctctgaagaaatccaaaggagtaaagagcttggagagtaggcctctgtagggtgcaagggcacagctggagacggagctcctgaggctgcagctgatgctgcccgctctgcctgaactgcaccaaaaacgtgatgaggccatagcgggagtccacggaggaggatgcctactgcccgacctctagcagagactaagcaaggtgcatgaaaacttgaaccacatgtgtcacacccatgaccactacatgaagatggcccaaaacctggcccaggaattgaagaaagactcttccaatttgctgtaagaaaatggcccagggggcaagcacggtagctcacacctgtaatcctagcactttgggaagctgacgcaggcagatggcttgagctcaggagttccagaccagcctgggcaacatggtgaaaccccgtctctaccaaaaatacaaaaattagccgggtgtggtgatgcatgcctgtggtcccagctactcaggaggctgaggtggaaggattgcctgagtctgtggggcagaggttgcagtgagctgagatcacaccactgcactccagcctgggtgacacagtgagaccccatctcaaaaaaaaaaaaaagaaagaaaacggcccaggaaggctggagggccgccgtgtccattgagagagtgctccaggcactccaaaaagaaaatgaccacaatgggaagaaaccagctgaccatgagaccaagttccaaccttttacaagtggcctgtggctcctggcgccccgcccacagctgacaggggctcagaagtgctagggggaccatgggccaccagggccaccaggagggaggcaggtaacgatgcgagggcttggatgcagaacaccagctggtttgattctgttttccctgtacctgggtcctgaatgcccagaggctcagggaaacaccagccagtgctgctgcctttaaagcacttttgactgatctcttgttaatttagcaactgttattggttgatgctgcagttgctcttattgaagtttgattgatagcattaggatggtaaggcactatttttcaaataaaggttgtttaatataaaaaaaattttgtttttttttctctcagcctttcacattggttcaaaatatctttcatctggctgcatttctgatttttgttttgttttttttttcttaattttatttatttttaattaaaaataattttttttgtcaacatggggtctcactttgttgcctaggttggtctgaaactcgtggcttcaagcaatcctcccacatcagcctcccaaagtgctggggttatgggtgtgagccactgcagcagcctgttttttttgtttgtttgttttttttaatttgacaagttttcaggtcctgtgaaatcagcagtcttacctcccaccttgcgcaccctgaggaggttgcagaataaaggagaattctagggacacgtgggcatcagtgcctgtgctcagagcacctcaggcagtgtggaggggtctagaggttactcaggctctgcctggcaacccgatagcagtatcagagtatagggccaaggggacggtccttgggcttggtgtggtttattagtccttttcctgtgaccctgatggtttggttcactcatttttatctccatactgggaacaggttcaagccccagcatttggttgataatgcaggaatccttgatacttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataagaagacatggcagaagccagcctccgatctgtccacacgaatacagcattcccaaagcaacgtgcatgtgccattattcactggatgagcttgaggtggatgaactagcccaccaggctctcaatgtcatgaatttaacactgaattaagaaaaatatgttttaaaaataatagtttaggtgattgctggggtgctaggagaggaaggaatggggaataactgtttaatgggtatagttggccttgtgtatctgtgggttccacatctgattcaaccaaccgtggatcaaaatatttgaaaataaaaaacaaaacaaaaatgatacaaataaaaaccaatataacaactattaacagcatttacattgtactaggcattataagtaatctggagatgacttaaagcatacagaaggatgtgcctaggttagatgcatgtatcgtaccatttcatatcagggacttgagtacccacggattttggtatctgcagatcctggaaccccttccctatggataccaaggaacaacagcactgggtctccttttggggtgatgcagatgttttgaagctaggcagaggtagtggttgcacaacattgtaaatgtactaaatgccaccaaattattcatttttaaatggttaatgtgttatgtgaatttcaccttaacaactaataatattataggtaaggcacaagttacatctgtagcacaaaaatggccctaatttttaaaacactgctccagcatagcaggtatcacatgtgaggtagcaaaagctggagatcaaagtgtgatacctggagacttatcagtaagggtcaaatgttttttcaggttttgagaatcattcttggaattgttccagaagatatatcgtataactcttcttagatgctaagataagaaggcagatatacactagctcattttgtgttattttctagagctttactccagtcaatttcttgggggcagcatttgtggaatcagtggttcatctgaagggctgtgctgtggaattactatgcatttgttttgtcttccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaattagccgggcatgatggcaggtgcctgtaatcccagctacttgggaggctgaagcggaagaatcgcttgaacccagaggtggaggttgcagtgagccgagatcgtgccattgcactgtaacctgggtgactgagcaaaactctgtctcaaaataataataacaatataataataataatagccatcctttattgtacccttactgggttaatcgtattataccacattacctcattttaatttttactgacctgcactttatacaaagcaacaagcctccaggacattaaaattcatgcaaagttatgctcatgttatattattttcttacttaaagaaggatttattagtggctgggcatggtggcgtgcacctgtaatcccaggtactcaggaggctgagacgggagaattgcttgaccccaggcggaggaggttacagtgagtcgagatcgtacctgagcgacagagcgagactccgtctcaaaaaaaaaaaaaaggagggtttattaatgagaagtttgtattaatatgtagcaaaggcttttccaatgggtgaataaaaacacattccattaagtcaagctgggagcagtggcatatacctatagtcccagctgcacaggaggctgagacaggaggattgcttgaagccaggaattggagatcagcctgggcaacacagcaagatcctatctcttaaaaaaagaaaaaaaaacctattaataataaaacagtataaacaaaagctaaataggtaaaatattttttctgaaataaaattattttttgagtctgatggaaatgtttaagtgcagtaggccagtgccagtgagaaaataaataacatcatacatgtttgtatgtgtttgcatcttgcttctactgaaagtttcagtgcaccccacttacttagaactcggtgacatgatgtactcctttatctgggacacagcacaaaagaggtatgcagtggggctgctctgacatgaaagtggaagttaaggaatctgggctcttatggggtccttgtgggccagcccttcaggcctattttactttcattttacatatagctctaattggtttgattatctcgttcccaaggcagtgggagatccccatttaaggaaagaaaaggggcctggcacagtggctcatgcctgtaatcccagcactttgggaggctgaggcaagtgtatcacctgaggtcaggagttcaagaccagcctggccaacatggcaaaatcccgtctctactaaaaatattaaaaaattggctgggcgtggtggttcgtgcctataatttcagctactcaggaggctgaggcaggagaatcgctgtaacctggggggtggaggttgcagtgagacgagatcatgccacttcactccagcctggccaacagagccatactccgtctcaaataaataaataaataaataaagggacttcaaacacatgaacagcagccaggggaagaatcaaaatcatattctgtcaagcaaactggaaaagtaccactgtgtgtaccaatagcctccccaccacagaccctgggagcatcgcctcatttatggtgtggtccagtcatccatgtgaaggatgagtttccaggaaaaggttattaaatattcactgtaacatactggaggaggtgaggaattgcataatacaatcttagaaaacttttttttcccctttctattttttgagacaggatctcactttggcactcaggctggaggacagtggtacaatcaaagctcatggcagcctcgacctccctgggcttgggcaatcctcccacaggtgtgcacctccatagctggctaatttgtgtattttttgtagagatggggtttcaccatgttgcccaggctggtctctaacacttaggctcaagtgatccacctgcctcgtcctcccaagatgctgggattacaggtgtgtgccacaggtgttcatcagaaagctttttctattatttttaccttcttgagtgggtagaacctcagccacatagaaaataaaatgttctggcatgacttatttagctctctggaattacaaagaaggaatgaggtgtgtaaaagagaacctgggtttttgaatcacaaatttagaatttaatcgaaactctgcctcttacttgtttgtagacactgacagtggcctcatgttttttttttttttaatctataaaatggagatatctaacatgttgagcctgggcccacaggcaaagcacaatcctgatgtgagaagtactcagttcatgacaactgttgttctcacatgcatagcataatttcatattcacattggaggacttctcccaaaatatggatgacgttccctactcaaccttgaacttaatcaaaatactcagtttacttaacttcgtattagattctgattccctggaaccatttatcgtgtgccttaccatgcttatattttacttgatcttttgcataccttctaaaactattttagccaatttaaaatttgacagtttgcattaaattataggtttacaatatgctttatccagctatacctgccccaaattctgacagatgcttttgccacctctaaaggaagacccatgttcatagtgatggagtttgtgtggactaaccatgcaaggttgccaaggaaaaatcgctttacgcttccaaggtacacactaagatgaaagtaattttagtccgtgtccagttggattcttggcacatagttatcttctgctagaacaaactaaaacagctacatgccagcaagggagaaaggggaaggaggggcaaagttttgaaatttcatgtaaatttatgctgttcaaaacgacgagttcatgactttgtgtatagagtaagaaatgccttttcttttttgagacagagtcttgctctgtcacccaggctggagtgcagtggcacgatctgggctcactacaacctccgcctcctgggttcaagcaattctctgcctcagcctcccgagtagctgggattacaggtgcctgccaccacacccggctaatttttgtatttttagtagagacggggtttcaccatcatggccaggctggtcttgaactcctgacctagtaatccacctgcctccgcctcccaaagtgctgggattacaggcgtgagccactgcacccagccagaaatgccttctaatctttggtttatcttaattagccaggacacttggagtgcatcccgaagtacctgatcagtggcccctttggaatgtgtaaaactcagctcacttatatccctgcatccgctacagagacagaatccaagctcatatgttccatcttctctggctgtatagtttaaggaatggaaggcaccagaacagatttattgaaatgtttattagctgaagatttatttagacagttgaggaaaacatcagcacccagcagtaaaattggctctcaaagattttcttctcctgtggaaagtcagacctctgaggccccatccaggtagaagtactagtgcaagaagggcctctgctgtccacttgtgtttctgtgatctgtgggaacattgttaacgccacatcttgacctcaaattgtttagctcctggccagacacggtggctcacacctgtaatcccagcactttgagaggctgaggcaggtggatcacctgaggttaggagttcgaggccagcctggtcaacatggtaaaaccccgcctctactaaaaatacaaaaattagctggccgtagtggcgcacgcctgttatcccagctactcgggaggctgaggcaggagaattgcttgaacctgggtggtggaggttgcagtgagccgagattacaccactgcactccagcctgggtgacaagagggaaactccattaaaaaaatgtaattcccgtgtctgccatcttaagtgtaaaggtggctaaattatatagaaaaataagacaatatcatttcccaattacattcctttcctaccgcactctatgatgctagctgagatttttccaaaagaaaatggcttaaataaaaccctaagagaaagaaaaactttaaatccctccaaagctcaaaagtaatagaaacagatgagtttggagtcaggatttctctgtaagattgcctaggctgtgtactgcacatctccaggtgccactgttgacagagattataactacaatgtgaagtgaatggtgccactgacagttatgcaaaccgtccagagcatagccacctgatcctgctgggattcctcttgccagtccatcagcagttccccttgaaagtttcaccaaacatcccttaaatctgccctctcctgcccgtccccagtggaggtcctcatcatttttcacctgcatttttgcaggagctttcttatatccaccttcctccttttctctcagcccatcatctagctacacagtctccagggtaagctttcagaaaggcaatctcttgtctgtaaaacctaagcaggaccaaggccaagtttcttagcctgaaaaatgtgcttttctgactgaactgttcaggcactgactctacatataattatgcttttctaccccctcacactcaacactttgactccagcaatcccaaatccccagatccctaagtgtgctgtgctattttcacgtggctctcagacttggccagtgctgtttccattttggtctttattccccacatctctgcctggggggtagattctaccctgaaaaatgttcttggcacagccttgcaaactcctcctccactcagcctctgcctggatgcccttgattgttccatgtcctcagcataccatgtttgtctttcccagcactgacctaccatgtgtcacccctgcttggctgtaccttccatgaggctaggactatgtgtctcctttgttgactgctgttgccctagcatcttgcacagttccttgcacacaattagagctctataaatgtcaaataaatgtgttataattatatgtttaagatagttgttcaaataaactctaaataaccccaactccaagagtgttagcaagaaatataaattttacagaagaatggttggaggtggggagggtgtccacggagtgagttacctcacacaggcacggaaaaacttgaacctcctaaggacatttttaagctctctttcccattttctctcctggattcccattgcctggtctcatttctctcttctccaccacaccacttcctcaaaaattcctttagggtttgttcttaagcttagataggtttcccattctgaaatacaaaggcctgataattagccaacttaccttgttggggatgtggaaggcaagactctcagactccatgactcaggtatattgcaacaattaggctgaaagttccttgagagtaagtgtccaaatcttttcatgtttggttcccagggctcactacagttgttggtatatcataggcactctaatatcttcttaaagaatcaatatcattaaaatggccataactgcccatagcaatttacagattcaatgctatttctatcaaactatcaaggtcatttttgttttattttttttctttgagatagaatctcgctattgtcacccaggctggagtgcagtggcgcgatctcgactcactgcaacctccgcctcccgggttcaagtaattctcctgcctcagcctcccgagtagctgggattacacgtgcctgccaccacacctggctaatttttgtatttttagtagagacaaggcttcaacatgttggccaggctggtcttgaactcctgacctcaggtgatccacctgccttggcctcccaaagtgcagggattacagcatgagccactgtgcccggcccatggtaatttttcacagaatcagaagaaactattctaaaattcatatagcggccaggcgaggtggctcacgcctgtaatcccagcactttgggagacagaggcaggaggatcatctgaggtcaggagttcgagaccagcctgtccaacatggtgaaaccctgtctctactaaaaatacaaaaatttgccagtcgtgatggcgggcacctgtagtcccagctactcgagaggctgaggcaggagaattgcttgaacccgggaggtggaggttgcagtgagccgagatcacgccactgcactccagcctgggcaacagagtgagactccatctcaaaaaaataaataaaataaaataaaataaaattcatatagaaccaaaaaagagcccaaatagccaaagtaatcctgagcaaaaagaacaaagctggaagcatcacattacccaacttcaaactctactacaaggctatagcaactaaaacagcatggcactgctacaaaaacagacaggtagactaacggaacagaatagacaactcagaaataaagccacacacctacagccatctgaacttggacaaactcaacaatattaagtaatggggaaaggactccctattcaaaaagtagtgctgggataactggctatccatatacagaagaatgaaactagactgctacctatccccatatacaaaaattaaatcaagatggattaaagacttaaatgtaagatctcaaactaaaaaatcctagaagagccaggcgcggtggctcatgcctgtaatcccagcactctgggaggctgaggcggatggatcacctgaggataggagttcgaggccaggctggccaacatggtgaaaccctgtctctactaaaaatacaaaaattagctgggcatggtagtgtgtgcctgtaatctcagctactcgggaggctgagacaggagaatcgcttgagcctgggaggcagagtgagcccagatcgcaccattacactccagcctgggtgacaggagcaagattccatctcaaaaaaagaaaaagaaaaaaaaaatcctagaagaaaacctagtaaatgcccttcttatatcagccttgacaaagaagttatgactaaatcctagaaagcaattgcaacaaaaacaaaaatttacaagtgggatctaattaaactaaagagattctgcacagcaagagaagctatcaagggagtaaacagacagcctacagaatgggagaaaatattcacaaattatgcatctgacaaaggtctaatatccagaatctataaggaacttaaatcaacaagcaaaaaccaaataaccccattaaaaagtaggcaaaggacacgaacagacatgtctcaaaagaagaaatacaagtgaccaacgaacatgaaaaaatcctcatcatcactaatcatgagagaaatgcaaatcaaaagcacagtgagatatcatttcataccagcaagaatgactattaaaaaagtcaaaaaataacagatgttgcaagactgcagagaaaagagaacgtttatacactgttggtaggaatgtaaatacattcaaccactgtggagaacagtttggagatttctcaaagaactgaattgaactaccagtcgacccagcaatgccattattgagtatatgcccaaaggaaaataaattgttctatcaaaaagacaaatacacccatgtgttcatcacagcactattcacaatggcaaagacatgaaaccaaaccaggtgctcatcaatggtggattagattgtgtacatatataccaccatatggtacatatacactgtggaatactatgctgccataaaaaagaatgtaatcatgtattttgcagcaatatggatgtagctagaggccattattctaaacaaactaacacagaaacagaaaccaaataatgcatgttctgacttaaaagtgggagctaaacactgaatacacatgggcataaagatgggaacaatagacagtgggggctattagagaggcaagggctgaaaaactacctattcggtgccctgctcactatctgggtgacagagtcattagcactccaaagctcagcatcacacagtatacctttgtaacaaacctgcacatgtaccccctgattctaaaataaaagtcgaaggaaaacaacaaaaacaaaaagaaataactcctgagttggggtctccatctcttagttcagcctattggcagtcccctttttcaagttctaaggagcctgtactagactactcttcatttagtcccataataatccctctttcaattattttgccttcaaacctatagggaagggattggaaatgaagtttcagtcattccctaagtaaaatgtatatacatattttaattgaaacaggatttcactctgttgcccaggctggagtgcagtggtgtggtcatggctcactgcagcctcaacctcctgggctcaagcaatgcttccatctcatcctcccaagtagctgggactacaggctcgtaaattttttagagaacaaaaacacagtctttagatttaaacatgtgaaagcagaaattttaaaaatacaatgaaagagttggaagacagagttgaaattgttcagaaattacagtaaaaatactaagagataggaaatagtcaacttccaaatgagaagaatcacgaaagagagaacagaaaagatagaaaaaaaattatcaaagaaataattcaagaacatttccttaaagtgaagggcatgagattccaggtatattccacatatagaaaaatatcccatacaaaatcacattgttatgaattttcataacatgagggacaaaaaaagataatataagtaaccagagagggaaaaaataaataaacaaaacaagacaaataggtcatatacaaagtaatattcatcacaatagcttcatagttctcaataataacaaaaagcctttaaaattctggttgaagcagttcagacaatgccatcacccaaaaatatgccattttggcatactgattattattagctgaaagcacttgagaaacagcagactgtacaggaagggctttccaacctcctcttttctacctaaaaacaggctagaaaatttcccatgataaaggtgccctccctctactagaaagagaaaaacatccttatcaccagagatagggaatcaatgccaaaatggatctgaacaaacttattggaataacccttgtcttccactacttatccccaatatagctcttagtaatttccccaagcccctttgtcttgtcatttcttcacaaatttatcatttctttgtctaaaacatatataaacttgtctgctatggtgacttcttcgggtctacatttgcttgtgaggactcccaggtacatgtaaaattgtaataagacttgcgtgcttttctactgttaatctttcctgtgtcagtttaattcttaggcctagctggaaacttaagagggtagaacagaaatttttcctttcctacatggtgaagggacattctgtaataaaactagcctcaacattaaaaaaatgtgatgtaataaaaaacaaaggaaaaagaaaacaaaacagaaaagcaattaataacactaggaaacacgaggcattgtacaggataggaaacgtcctgttatgttacacaatgcaacagtgggtattgttttcatcattattataatgaaaatgctaaatagtgatttgaccaacaatccagtttaaaacatttggaggaatgtgaatgtttatggccagaaaatggggagaaaaatggttaaggaaacaaaatctcatcatctagagtgggaaggagactgataattcctaatatgaaccaaaaactcaaacttttttttttttttttgagatggggtctcgctctgtcgcccaggctggagtacagtggcacgatctcagctcactgcaacctctgcctcccaggttcaagagattctcctgcctcagcctcttcagtatttgggactacagttgcacactatgatgtctggctaatttttgtatttttagtagagatggggtttcgccatgttggccaggctggtctcgaactcctgacctcagatgatcagtccgccttggccccccaaagtgctgggattacagacatgagccattgcacctggcctgaaaactcattttatttagatatgttaagggaaatctcaaaataatcagctagaaaaattgaaaatggttgcccatgaggaggggagaactgttattatttatgtcaaataaaatttgtaggaagccattgatttggactgtgctcctgcactaggccccaatagaccaaaccacatggagtcactcttgctaaagttccacgtcaccaaaccaaagctaagtagtttatcttaccttctgggaaattaggggagagaaataatagacaaatccccaaacaggccagttttagctggcatataaggaagtcctctctgttttaaccgtattaggagagtaactttgaaaagaccgtccactttttggtccctgtttctgttttcttctgccttttctgcctataaagctaacttcctctgcccagctcactggagtaccttctctgaatttttagaagacaggctgccctgatccatgaattgcaaatgaaagccaattagatcatttaactaaattcattgtaattttgtcttttgacatttgtaaacaagccttgtagtacttgctaaacaatgggctgggcgcagtagctcacacctgtaatcctagcactttgggaggctgaggtgggtggatcacctgaggtcaggagttcgagaccagcctggtcaacatggtgaaactccgtctctactaaaaattcaaaagttagatgggcatggtagcatgtgcctgtagtcccagctactcaggaagctgaggcaggagaattgcttgaatctgggaggcagaggttgcagtgagctgagatagtgccactgtactccagcctgggcagcagagcaacactctgtctcaaaaaaaaaaacaaaaacaaaaacaaaaaaacaacttgctaaacaacatatgtttattatttggtaaattataaacaataaattcaaaactttaaaaagaaaacattttattgatagctcactgaatacaaatttataaaatattatttatgcattaagtttcagttacacattttcacccatcattacagatgtcatatggagttgctagagtatgagaagagcttcttcatcccaacagctttcaaagtgaagaggcgactcatgcctgtaatcccagcactttgggaggctgaggcgggtggttcacttgaggtcaggagtttgagaccagcctggccaacatggtgaaacctcgtctctactaaaaatacaaaaattagctgggcgtggtggcgcacacctgtaatcccagctactcaggaggctgaggcaggagaatcacttgagcccgtgaggtggaggttgaagtgagccaagatcatgccactgcactccagcctgggtaacaaagcaagattctgtctcaaaaaaaaaaaaaaaaaaaaagtgaacatctgggtcccccagatctcttcagagatatgtaatgttctcctttttccaactacataactctttaagctgggttttcttcatatactccaatgaaaacaacatattgcaacagatggaatgaagaggcaagtagaagaatccagctgttttctattaagccaaacattacaattgtcagctgaagaattctgagattcataaatttggaaagaaaagcttcatttctcataaaagattgcagcctgcagggtggccattctgacaggctaagaaatgtagtctctggccagaagccaaaaacagacactgagggtcagaagaataagatgggcatttatgctgaataggatggccaaatatacatattcaataaactacagtcatgaatattcatgaaaggagaaacatgcacatgctcaattgagcttcatgcctctccatgggacgcgtgtgcaaaaaatggcagcattagcatgatcagagggtggagttttctgtcctctgatatcaaaaggtgaaacagaggacacagaaaccctcactgcacatcctctgtaaactggccagaaccactccattgtgggcagtctgttatcaggaaggaatgctggttagttgtgcagaaactgcaaaaggaaggggcagtgtcagaccattggttgatatcagcggtgcagctcgtctttccaaagggctggtttctgtttaacctgtaggaaggaaatcctaatggcgtttagcaatggagagggtataacaacacatcatggcaagaactcagttttcaaggtttctctggggtccccttggccaagaggtggtgcatccgtttagtcagctgggggacttaggatttcatttttatttctcagagttttataaaactctaaaataattatttgacagccaggtgggagggggtccctggagaaactccaaccagcctgcctactagggtggagccttgggagtttgcagcagggaggagcctggcgcctcctcttcctatgtgaacctgggattctagcagcctggtgggaagcactgtagcaggagactctggccttgcagaggatccctgttcccctcatccctttatttccccttttcacttaataaaaccctgctttactcaccctttaaaccatctgcaagcctaaatttttgtggctgtgggatagacaagaaccttctctttagctgaactaaggaaaagtcctgcaatgatcccattcttcacaccaaatatgttttgtttcaaaagtatagttatttatcataaatatgtcattaatattgttaaatcaaatttagcctaaagctgcctccttatatagtttaagcttgacctaaaggtttctctgtacttagtgaattgtagcctacccagatgtgtaaacaagactgtgaactactcttgtgacaaacattggattttggccaatcaaaggaggtcaactcttgacactgctttcaaataaggcaaatattgagctgtaaacaatctggctgtttctatacctcacttctgttttctgtacgccacttttctgtctctgtccataaatgttcttccaccacgtggctgtgctggagtctctgaacctactctggctgaggaggctgcccaattctcaaactgttcaattaaactcggttaaatttaatttgtctaaggttttcttttaaccatataaacaagtgagtttatgattgttatgtcttttttcttttcttttttgagacaaggtcccactctgtcccccaggctggaatacagtggcatgatcacggctcactgtagtctcgcactcccaggctcaagcgatcctccatctcagcctcctgagtagttgggagtacaagtgcatgcaaccatgcctggctaattttttttttttttgtattttttgtagagatagggttttgctacattgcccaggttgatctcgaactcctgagctcaagtgatcctcttgcctcagccttccaaagtgctgggaccacaggcatgagtcaccacacccagctattatttctaaattaatgaacagatgaacattttcaaaatttctcagttttaattttaaatatgattaaaaggatagatataacacacaaacaaaagctctatggagtcctctataactcaagaatataaagggtcctgagatttttctttaaagagaaccactgcactctcctggcctactagctctccgcaatccatcctgcttctccccttggcaggagagacctgttctagaccctcaaggacccctcataacatcacctagctattatctaaggaatctttctccatttggacttcccatttttttcttccccctttaaggtccccttattcttttcatctaattttgtgtgccacctgcagagtccttcttcttcttcttctccttctccttctccttcttcttctcagagtcttgttctgttgcccaggctggattgcagtggcacgatctcggctcacttcagcctctgccttctgggttccagtgattctcctgcctcaggctcctgggtagctgggactacaggtacccaccatcatgactggctaatttttttgtatttttagtagagacggggtttcacaatgttagccaggatggtctctatctcctgacctcgtgatccggccgcctcggccttccaaagtgctgggattacaggcatgagccaccgcacccggcgactaatttttttttttttttttttttttgagacggagtctcactctgtcgcccaggccggactgcggactgcagtggcacaatctcggctcactgcaagctccgcttcccgggttcacgccattctcctgcctcagcctcccgagtagctgggactacaggcacccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcccggccggcgactaatttttatatttttagtagagacggggtttcgccatgttggctgggctggtcttgaactcctgacctcaggtgatccgcccgccttggcctcccaaagtgttgggattacaggcatgagccaacgcacccggcctgagtcctgcttcttccagatctggtgcccagtcctgacgccagaaagggggtcttgttccagaccccaagagtgttcttggatcttgcctgggaaagaattcagggtaagtcgcagagtataatgaagttaagatagttaattagaggctactcaattacagagtagggcatcctcagaaaacaagaggaggaaggcgctaccttaaatgtagtgcttgcttatgtaggttgtataagaattgtgtactttattacaaaggcttgtgatcagcttgtgacaggctattggtactgttattttcctgttactattgatttcagcaagaatttatgagtacactattatatttaaggcaaaacctattccttaagaatgctttttgttcttaaaatactgggacatttccataagttctgagtctttagttagcaacattaactcattccctcaatcataaacatctcatgaccaagagtgcccagttcctggggaatgtaacccagcaggtttggctttattcggcctttattcaagatggagtcactctggttaggacacctctgacagtccctggaaatccaaaggaacccttctgtgtggcacagggaatggaagaaagaaagagatgaggcaggaaaatagggtctggaggcagaaaacataagccgattcacacttcagctatgacaggaaatatcctctccatagggcgtatgcctgtaactttacttcatcctcttcatttacataggacgtatcctaagtaaccaatggaatcgtctagagggtatttaaactcccaaaaattctgtaacagggcctttgagcccctatgctcgggcccgctcccacactgtggagtgtactttcattttcaataaatcccttcattccttccttgctttctttgtgctttgtgcattttatctaattctttgttcaagacgccaggaacctggacgccctcccctggtaatagagagatgagcctttcaaatgacctgactcctttatcccagccaggtgtgtgcccgaccctgaaaggaggaatagggagggggacgttcaacccggcctcccgctctgtgttagcagcgtctggatgggtcagggtggaggtgggggtgttctaccctgctatttgctcctagagaagcttctctgcttcactagtctcacagttctaaaggcaagaacagccctagtgggatcttccaaggattttagaaaagaatgaataagggaaaaattaaaatattgcagggtgccataaaaacatcccagtaaaacaaacacctttctagatgctcattggaacgtaaatggagctcagcccccatcccttcacaccagatccagtcttcatctttgtggttcactgccccctcaccactcaggaggaaaaccccagcttctgttctggctccccttctctcacttagaatttttcaccagagtttcagaaagatttgtcaggaccactccatgcccaaggtaaaaagtgtaagtggtacaaaaaggtagaaactcatcagacccccaaagagtgtcatttaaccatacaaagccctgataaactccagggcagaagaaaaagctgcatccttgactccactggggcattcttatgtaaactaagatccaagaactgcatcaggagagaaatcaagagccctggggatgttaggatgagccctagaggtgctaagacaggttatttgaaaaaccaaaaagtagactgagattcccttccttttcagggaagaattgagacctttcctttcttactgttcagagtgggggctgataagggtaattatttcctggagccactggctactgccctgggaaggaaatccgctgggttgggggagggaggaaggcagaaccaggcattaactctccctccactacatccctttcccgtacccctcccctcctctccttccccccactccctgcccccgccctccgaaaatgacacttggcctgagaaaggaggaaggtagaataggtggacacttcccttgtcctgctccaggggtgtctcagtgacaaggagatgtgaaaaaagaaggaatcccaaggctccccttggaaagaagggagatctccaggggctttgggaagtcaggttagtactgggaaggctgaagactcccagtagatagcgttcagggctgcatttggctgcaatcctataaaatacattcttctctaaggttggatacaagcatttagaagactggccattaaaaaaataaacagtattaataatattaataatcatgagtgtcagtagtgttgaattttttctggaatcctttcccaagttgcctaatgcccagagaaggaaaataacagtgtttagtagacataaattataggattagtgcaagtagctattgagatgatgagccaaggcttgtaaattggttttgttttggttttcctaattagatgtttgcgcctatctgtgtatgtgtgtgtgtgtttgtgcgtgtgcatgctcgcatgtggttaatttcatgacttttgcctctggctcttcctgattaaaaaaaatacttaaaatggtaggaagtggcacacacccttgatggacctgtgtttatattaaagaattggcttagtaaatttaactgggacaaggaaactgtgaaggactgtatttttgccattatttaataattcatatattcaaccgttactgattgcctattttgaaccaggccacgtgctaggatacaatggttaacaaacacattccctcccctcaaggaattcatggtctagtgaaatacagagatagaaaagaaatagaaaagtatatcaataaaatgcattgtggaaagagttatggtcatagtgtgtactatatgcttatagaggctgcctttgtataaacatacataagactgctttttaaattataaaaggcagtacataggccaggcgtggtggctcacacctgtaatcccagcactttgggaggccgaggcgggtggatcatctgaggccacgagttcgagaccagcctggccaacatggtgaaaccccatttctactaaaaatacaaaaaaaaaaaaaaaattagccaggtgtggtggtgggcgcctcatcccagctatcaggaggctgaggcgggagaatcacttaaacccagacggaggttacagtgagctgaggtggagccattgcactccagcctaggcaacaagagcaaaactccatctcaaaaaaaaaaaaaaaaaaaaaaaggcagtacatagtacaaactgcttgggttttgttgttgttgttttactgtaccatataggttggagatcattccacctagtagctgaacattttaagcagatcatctggctacaggcagtgagtaggatgaactgggagagtgatgagtgagttagagagttagggagggagggtgctgtcggagtgttaccggaaaggggtcccgatccacaccctaagagagggttcttggatctcgcacaagaaagaattcagggcgagtccatacagtaaagtgaaagcaagtttattaagaaagtagagaaataaaagaatggctactccatagacagagcagccccgagggctgctgttgcccatttttatggttattccttgatgatatgctaaacaaggggtggattattcatgcctccctttttagaccatatagggtaacttcctgacgttgccatggcatttgtaaactgtcatggcgctggtgggggcgtagtagtgaggatgaccagaggtcactctcgtggccatcttagtgttggtaggttttggccggctccaacaccggcttgttgttttatcagcaaggtctttatgacccatattctatgcccacctcctgtctcatcctgtgacttagaatgccttaactgtctgggaatgcagcccagtaggtttcagccttattttacccagctcctatttaagataaagttgctctggttcacacgcctctgacaagaacatcttcatgcctgtgcctggttgagagagggaggcctctgcgctgctgctggatctagtgaagattcactcagtctctcaaattcctctacagtttctctaatggaagagaaaagtggtgttattgctgctagggagcaacctagaagttattttatttatgccatagatatggtgggctaagcactgtgccaacgttcaataagtcactgcagattctccataaattattgtgacaagtacaattgtttgtaaggcttagatctaggtgtgtaagtccaaagaagggtgtgaagcatctgtatttctgttatgtagttattaggaaaaaggatgttggggccttaaaatggccatttttaacatttccaaacttgtgttgaattctaagattttataattgtatgtttccagttgagaagagctttgatattggtagctctaaataaataaataccgttgacctggaagagaaggtaaagtttagggagaggcctttttttagctttatatttaaacattttttataaatgtgattcatgggccaggcctggtggctcacacctgtaatcccagcacttttggaggccaatgcaggtggatcacttgaggctaggagttcgagagcagcctggccaacatggtaaaaccccatctctactaaaaattagccaggtgtggtagcacacacctgtaatcccagctactcaggaggctgaggcaggggaatcacttgaacccaggaggcgaaggttgcagtgagccgagattgtgccactgcactccagcctgggtgacagagtcagactccgtctcaaaagcaaaacaaaacaaaatgttattcataatgctcgggttgtaactatagtacttatctagcaaaagcttgcttttttttttttggctttgactaattgaaactgcaagagcttactggcagagtggtgtactggtcaatatttaaccaattctccaaaggggaaaaaccctgatttgtatgtaggatttgtcagtttccatggtataaatagtcttcccacagctggtagggtgaccaacttgttctggtttgccaggggctttcccatttttaggcctgaaagtcctgaatcccagaaaattcctcattccccaggaaatagcttgattggtcaccctaatggctggttgcaagctcccgatatgacagaactggacgagaagttgggcagagatgtgcacatggtaccagcctatgccaggagcagcggcctccagcaccccactgtcagggagtccttggcccagtagaggatggttagcagggcccggctgttgttcatattagctctcaaatttaccaccaaccctgtattagtttcctggagctgctgtaacaaagttccacaaacgggggtcttaaacacagaaatctattatctcacagttctggagggcagaaatagaaaattaaggtatgagcaggactctgctcttttgatggctctagataatccgttgtatgtcttttcctcagcttctggtttcacaggtaatctttggcgatccttgacttgcatctgtgtaactccagtctctacctccatcatcctgtggcattcttctttatttttctttctttttttcttttcgagacagagtttcgctctgttacccaggctggagtgcagtggcgtgatctcggctcactgcaacctctgcctcccaggttcaagcgattctcttgcctctggctcccgagtagctgagattacaggtgtgcgccaccacacccagctaatttttgcatttttagtagaggcggggtttcaccatgctggccaggctggtctcgggctcccgacctcaggtcatctccctgccttggccttctaaagtgctgggattacaagcgtgagccactgcactcggcccatggcattcttcttttggtgcctttgtcttcactgacttcttgtaaggaaatcagtcgtattggattagaggcctaccttattccagtatgatctcattgtcttaatttaactaaaacatctgcaacaaccttatttctaaatgaggtcacattctgaggtattagggtttagtacttcaacatatcttttttttttttttgagacagggtctcattctgtcactcaggctggagtgcagtggtgcaatcacacagctcactgtaactttgaactcctgggctcgagcagtcctcctatctcagcctcccagataggtaagattacaggtacatatcaccatgcctagctaatttttcaaattttttataggggctgggcccagtggctcacaccttgtaatccctgtaatcccaacactttggtaggctgaggcgggcggatcacttgaggtcaagagtttgagaccagcctggccaacatggtaaaatcccatctctactaaaaaaaatacaaaaattagccggatgtggtggtgggtacctatcataccagctactcacaaggctgaggccggaaaatccctggaacccgaggggcggagatcgcagtgaaccgagatcacgccatgcactccagcctgggtgacagagcaagacataaccttaaaaaagaaaaaaaaaaatgtagagatgaagtcttgctgtgttgcccaggctagtctcaaatgcctgggctcaagcaatccttctgcctcagtatcccaaagtgctaggattacaggcatgaggcactgcaccaggcctacatcctcttttttttttttttttttttttttttttgagatagagtcttgctctgtctcccaggctggagtgcagtggcacgacctcggctcactgcaacttccacctcctgggttcaagtgattcttctgcctcagcctccagagtagctaagactacaggcataatatctctcttagatatgacaaataatatcacagagtgtacacccactgtgatgttaggagtaatacctccctatgatattacaagtaatactgcctttagatactacaaataatatcacagggtgtacatctactgtgatattaggagtaatacctcccttagatattacaaataatatcacagggtatacacccacggtgatattaggagtaatatctctcttaagcgatcctcccatctcagcctcacagaattaaaggaattacaggaagagctgctatacctggctggatctatgttttaaaaatataacccagataaccctgtggtcagtgtctaagatgaattggattagaccaagggagaaaaactaaagatgggaatactagtttgggactttgcttgcttgcttgctctcatttagaaaacatttagtagttctacaatgctcaggcactgttctgggagtcacaaatataggattgaataaagtaaataaagcacttgctctcctggagctcacttttcactgggggaatgcagatagtagacacatacatctatagtatcagtaagtgctaatagaaaaatgaagcaggtgagatggatcatgctgagtagaatgtatcttcttttccttccttccttccttccctccctccttccttctttccttccttctttctttccttcctttcttcttttctctttcttcctttctctctctttctttgctttttattgtcttaaaatgtacataacataaaatttaccctcttaaccatttttaagaatacaattcaaggccgggcatggtggctcacacctataatcccagcattttgggaggctgaggcaggcggatcatgaggtcaggagtttgaggccagtctggccaatatgatgaaaccccatctctactaaaaaatacaaaaattagccaggcttggtggcacatgcctgtagtcccagctacccgggaggctgaggcaggagaatagctggaacctgggaggcagaggttgcagtgagctgagatcgcaccactgcactcctgcctggacaagagagcaagactctgtctcaaaaataaataaataaataaataataataataataataatacaattcagtagccttaagtacatttgcattgttatgcagccatcaccaccatccatctccagaatttttttgagtggagctctttttaatagagtagttgaaggcctctgtgacacagtagcatctgagcagaagcttgaatgaagtgagaaaagaatccttttgcatagtttaggggaagtatgttccattcctggtcctggaaatagttaagactatcacaatagtgcaggagaaagatgatacaatacagtttgtgtagctgaaaccccgtcttcagaatgtaaaggagaacagatgggaagtcatgttcctcccagaagtaattcatgtagcagagaagccaatgcagatccacgagacagacaattcagtgctctgcacaagaactgtgctttaagcatggagaggatttttgtatctgtcctgggatcctacatcaaacagcatgtggtgattgtgaacacaaacgtacaagactgtgaaccctaccaagtttccttcttccattagatatgaataaggagtcatgagtttcctttggaatgtcctttagcctgttggtacatgttttgcctgtgacgaatgcagttactcataaatcattgagcacattgggtacagagggcaaaagataaattcctgtatttcctctattcggtcaacagaaatacctctaggccataatccattcatccaatctaataattttgccatccataaaaccttcaggtgttctgaattcaacatctttttttttttttttttttttttttgagacagagtcttgctctgtcacccaggctggagtgcaatggcaggatctcggcttactgcaacctccgcctcccagattcaagcgattctcctgcctcagcctcccgagtagctgggattacaggtgcccgccaccacgcccagctaattttttgtattttcagtagagacggggtgtcaccatgttggccaggctggtctcgaactcttgacctcaggcaatccacccgcctcagcctcccaaagtgctgggattacaggcgtgagccaccatgcctggctgaattcgacatcttgcacctaattcctgttcagttaaagacccaaatcatgatctctgacttacctggatatttgaaagattaacttgctgtggtgataccatactagagtcacaaaatcaagccctaccctgccacagccacctaaaggaaattaggtgatatacaaaagaaattgaccatattgttgtccttttagtgactctcctaattttcttcccctgaaaacttacagagaaatttgagtatgtttgccttaggtggatgcttgtttttttattgatatgaaaagcagtaagaggaaatggagttttttggcctgttaaggaagggcagccactgtaaacacagttgagtgcaaattcacagtgttagaatgttgaagtgtatataatgattttgcaaaattttctacaaggctgatacagtatccaatcaggactaggattagatatattgtcatgtatgtttgcgcaggaaatgcagagactctaaggtgctacaactgcaatttgacatgtgggatagttcactggtaactgttgatctccctgaggtttaagtttacagttccacagctctttatctgaaactcttgggctatgtgttatggaatttagaattttttccgaaatacgttgcatatattgtatattatgacatgatacctccaagaaagacttggagtcacatcctataaacaaacacatgaatatatcccagtgaaatgtatgactatttttactaaaacaaatgagaatcataaatagacttacattacttcaggtcagattttgctgccgaattagtttgggcatcgaacttttggtttcagagacaaaactgtgaaattttagattatattatggggttgtggacccatgtaaccctcctctccgtaattcctaaaagcaagcaattgcatcaaccagtctcatgagtagctgcgattctagaaatcaagaatccggatctgaaattagccgggcatggtggcaggcacttgtaatcccagctactggggaggctgaggcaggagaatcgcttgaacccaggaggaaactgcagtgagctgagatcgtgctgctgcactccagcctgggcaacagagtgagactctgtctcaaaaaaaaaaaaaaaaaaaaaaaaagaatccagatctgggcaggaccgaattgctgacatgcccccggtatagcagagacgttttgcctacatgttacacacctgagtaatagttgtcagcagctgatgaagaagatgaatgtgctcttaatgtccatctttgatttccagtcattttgcttctgggtcttggcttcctgaggaaagaagtctccagtaggtgaatgcagtgatatggagaatactttcttctggctgcatgcagtaactcacacctgtaatcccagcacattgggaggctgaggtgggcagtgcacttgaggttgggagttcgagaccagcctggccaacatggcaaaaccccgtctctactgaaaatacaaaaattagctgggcgtggtgacagacacctgtcatcccagctactcggtaggctgaggcatgagaatcacttgaacttgggaggtagaggttgcagtgagccgagatcgtgcctctgcactccagctgggcaacacagcgagactctgtctcaaaaaaaaaaaagtgtgtgagagagagtactttcttcctgtttcctcataggccagttctctctggcatgtgagtttaacatcagtcacctccttcacacacagcgggtgcattcgtaataggaggtccttagctgggagtttttatggcacatcagtggggcgtgaaaacaccacataggagctaatatatctttgctggctgctttctccggctccgcagcagacagaaaccctatgaatcatatccaggggtcaggtgcaggcaacagacaactaatatctcccaagtgagttgaaaaggatcttgttacccagcatcctaaggaggttgtagccttgggaaccacaggcaagaataattaactcagctcctcggttagtgcctcttcagttcgagatggaatttatttgcaggcatggctccttaatatgccaaacccatgctcaagacatactccttctcctggaaggttaacgtggctcctgtggctgttccatccctgaggaaaagtgaggaccatgctctccaaacaggccatgtgctggactacctctgtttctgtctcctgggattccaatcagcaagtgagcaacgaagcaacccagacagtgtggttcataggatggctgggtaagtggctgtttgttttttccttactgtggatatgtatcagtgaaggaatctgtagaacattcttgatgggaacatttagtcatatcaagtcaataaattaatgtttaggctggg

SEQ ID NO: 47 - DNA, 58884 bp, Homo sapiens
  source 1..58884: mol_type = genomic DNA
atgcagctgagccgcgccgccgccgccgccgccgccgcccctgcggagcccccggagccgctgtcccccgcgccggccccggccccggccccccccggccccctcccgcgcagcgcggccgacggggctccggcgggggggaagggggggccggggcgccgcgcgcggagtccccgggcgctccgttccccggcgcgagcggccccggcccgggccccggcgcggggatggacggccccggggccagcgccgtggtcgtgcgcgtcggcatcccggacctgcagcagacggtgagccccgccgccctgggcccggccgtgcccctgcgctccccgcccgggattcccccacccccgccgggcgcgcccggcgcccgggacccccggcccacggctactcacccctcccccgccgcctccgccgggaccctccccatcgccagggcggggccccgggaagcccggcccctggggcggggcttcggccgcggttcgcggaggcgcggggtcccgggcgccggcacccgagccccggactccttcggcgggggcccggggctcggcaccccgcatggggccggcggggcgggtccgcgctcccgggacctgagctcacgagcccgctccgctgcagaagtgcctgcgcctggacccggccgcgcccgtgtgggccgccaagcagcgcgtgctctgcgccctcaaccacagcctccaggacgcgctcaactatgggcttttccagccgccctcccggggccgcgccggcaagttcctggatgaggagcggctcctgcaggagtacccgcccaacctggacacgcccctgccctacctggaggtaagtggccggcgcgggggtgagctgaggagcgcgcagggtggatcaccaagccccgtggcgggaccagtgaagggcacggcagtggggaaacacaagtgggaggggtgaggggtggaggctgtgtgtgtgtgtgtgtgtgtgtgtgtgtggtgctgtgtgcagagtgcagtgagcgtgtacagggtgcagcgagcggacacagtgtatgcgatgagtaggcgcggtgtgtgcagtgagcgggcagggcgagcagtaaggatgtacagtgtgggcagtgtgcgagcatgtgtagtgagcaggcagtgtgtgcagttagcaggcacagtgtgtgcagtgagtgggcagtgtgcacagcatgtacagtgtgagtggtgtgtgctgtgtgccgtgagcatgtgtagtgagtgggcacagtgcagtcagtgtgcacaaagtatgcagtgggcacgtaccgtgtgtgcagtgagtggtgtgcagtgtgtagtgtgcagtgagcagtgtgtacagcattgcagtgtggggcagtgagtacagtgtgagtgttgtgattgtggtaagcaggatgcgcagtatacagtgaacagtgtgcacagtgtgtgcagtgtgggctgtgtgccacagagtcagtgtggtgtgtgtagtttgaacagtgtgtgcattgagcagcatggatggtgtggacgctgagcattgttctccagggaggagtgtgagcacgagagagtgccagaggggtgtgtggtgtgagcagggctatctgtgtgcacgtttgttcctttctccagctgtgaagtcttgtgaaggccaaccaagtcccctcctttactcacccatgcatggtgtgaagatgtattgagtgccttgctaggcatggggacgtagacggggtcagtcctgtggaaggtcttggagtttggcagggtggaggggggtgcccaactgcagtgggcattgaataaagattttgtgagctgagctcaaagttgggcgggcctccgtggtggcacaggaaagtggggtcagttctacctggagagtggagggggatgtctaggatggtaagcctggaatcaggccttcagagaggagtgggattttgccgagaatcctggggatgggaaggcgacgggacagtgcaggctgcgggcagctaggcacgtgccttccatcgggctgcatcatgcctgagtgtggtgggtgcatggcagctgttagctctgtccactgtggtagtatgactgatggtgtgtacaggagggcagtgaggggtgcggtgtggccagcatgagcgggacggggtttgtgcatggactcacttgctcagccggggtgggggcattttctctaccttttctttatctgagcagtttcgatacaagcggcgagtttatgcccagaacctcatcgatgataagcagtttgcaaagcttcacacaaaggtaaaggatcacggggagggggctcctgaggttccctcctgcctccctgtggctgctgtcccccaccccagcttggggctgaccacagtcccccagctttagctcagtccatttccccatcatcaggggcccagagcctgtactgggtgtggctgaagggctgggcacagattcctggccccatggttggggtcaggtggtacagtgatgtgttccagttagatcagactcttgccgacccccctggcttaggggctggagtgtcctgtgagaagctgggtggagagggagtggacaagcatctgatgtgatggctgtcgggacaaggcacccagcatcgagtggtcgaccagtgctaggcatttgtgattagacctctcattaatcctcttccagagggactattataaccctgtttcacagatggggacacagagtacccgactgtgtagacagtgaagctggggctgaacccagatctgtctgattccaggccctgtgcccaggcatgcctttgaggtgtctactgctgggtgccacccccaactgggcctgaccccaaatgctcttgaggggggcaccttactatttcccgctgaatgtcagaggggcagggtgggtgccacagcccctccccaggggcttccacccgcagctcacagtccagcaggcacttgtttgctggatactttatgggcggtctcgagctcaggagaggggtcagaatggagggtctctggagcccaggagaggaatcagaactgtcagccctgtgtcctaatggtcccatcagtgactttggagcctcaggcttctgtgccaggcttttctgctgccccagggcaggcggtggtcaacggccttggcactatggctgggcagagtccactgtggaaaggtccccctctcctgccactggccctcacttgaccttgtcagcctgggttcctaccccatggccacctctccctccggatctctcttcagtgaccaacaagacatgagtgactcactctgaagtaggtctcgtttgtttttaggatgagcctgaacttcttacatagcccgtgtttctgcttgcctgggctccagctggcctttccctctcccctggtagtgagcacttcctcctctttcactgcctggcccgcctgaggaggttgcctcccaaggcaggggtccctatggcaccctcccctatttctgaggtacactgggtgtttatggaagggccccggcctttggccagggcaccttgccttgtgtgtgtggtgtccgtagtgccggctggggaagtgaggccttgtggggtgagtgaataaactgggtgaatgagtacaaggccatcaaagtcatgtcacaggatgggtccctggggtgggggtctgcggtggggtgagctggagaggaagatgggccgaagaaggagcaggttgtctcagggtgctgaggattcagggctgctgtggggctggttcctgcctgggtggacctcgggctcttctaggccaggcaggtcggggcagcagggccggagagacggagccagggcagtgactgggcctggagtgggggacttgcttggggccccaccagggtgacctggccttggtgaggggctacttgggtacaagctgacagtcgtgactggtttggctatcagggcgcaaggaagggctttgagccgtgcatgggcccacccgagtgggaattggggccgtggtgggagtgcaggaccgtggttgacaattgtgatgtcaggtgacaggtcagactggtagggatgtggcgggggttgcctgaaggtggcctgaggcttgccggaggaaggcgggtgatgttcagatgatggaggccttggtgccaggctgactgacggccggtgttccaggcgaacctgaagaagttcatggactacgtccagctgcatagcacggacaaggtggcacgcctgttggacaaggggctggaccccaacttccatgaccctgactcaggaggtgaggagtggagtcggggaggggcatggcctttgcgcggctgggagcctgacccttatctgtctgtgaacccagagtgccccctgagcctcgcagcccagctggacaacgccacggacctgctaaaggtgctgaagaatggtggtgcccacctggacttccgcactcgcgatgggctcactgccgtgcactgtgccacacgccagcggaatgcggcagcactgacggtcagtgagggcggggcctggcctggaggggctcttgcctggtgatggggctgggggcagctgggcctggtgtggatactgaggctgctcaccctcagaccctgctggacctgggggcttcacctgactacaaggacagccgcggcttgacacccctctaccacagcgccctggggggtggggatgccctctgctgtgagctgcttctccacgaccacgctcagctggggatcaccgacgagaatggctggcaggagatccaccaggtgtgcagggagccgaggtggggtcccggcctctgtgtgctgggttgggggtcctggctctgtctgtaggggtgggggccctagcctctgcccagggaccctacagcaccttgctcttcccccaggcctgccgctttgggcacgtgcagcatctggagcacctgctgttctatggggcagacatgggggcccagaacgcctcggggaacacagccctgcacatctgtgccctctacaaccaggtgcgactgtgtgtcctgcacatgcctgcaccagcgagtgtgcatatacttgcctcttctgggggtgtatgtgtgtgtgggcacacaggtgaccctgtacggtgattgcatgtgtgcaccgagtgtggatatacttgcctgttctgggggtgtacgtgtgtttgtgtgcacacaggtgaccctgtacagtgattgcatgcgtgcaccagggagtgtggatatacttgcctgttctggggttgtacatgtgtgtgcacacagatgaccctgtacagtgattgtatgcgtgcaccagtgagtgtggatatacttgcctgttctgggggtgtacgtgtgtttgtgtgcacacaggtgaccctgtacagtgattgcatgtgtgcaccagggagtgtggatatacttgcctgttctgggggtgtacacgtgtgtttgcacacagatgaccctgtacagtgattgcatgcgtgcaccagggagtgtggatatacttgcctgttctgggggtgtacacgtgtgtgtgcacacagatgaccctgtacagtgattgcatgcgtgcaccaggtagtgtggatatacttgcctgttctgggggtgtacacgtgtgtttgcacacagatgaccttgtacagtgattgcatgcgtgcaccagggagtgtggatatacttgtctgttctgggggtgtacacgtgtgtttgcacacagatgaccctgtacagtgattgcatgcgtgcaccagggagtgtggatatacttgcctgttctgggggtgtacacgtgtgtttgcacacaggtgaccctgtacagtgatcgtacacgtgtaccagggagtgtggatatacttgcctgttctggggttgtacgtgtgtgtgtgcacacagatgactctgtacagtgattgcatgcgtgcaccaggtagtgtggatatacttgtctgttctgggggtgtacacgtgtgtttgcacacagatgaccttgtacagtgattgcatgcgtgcaccagggagtgtggatatacttgcctgttctgggggtgtacatgtgtgtgcacacagatgaccctgtacagtgattgcatgcgtgcaccagggagtgtggatatacttgcctgttctgggggtgtacacgtgtgtttgcacacaggtgaccctgtacagtgattgtacacgtgtaccagggagtgtggatatacttgcctgttctggggttgtacgtgtgtgtgtgcacacagatgactctgtacagtgattgcatgcgtgcaccaggtagtgtggatatacttgtctgttctgggggtgtacacgtgtgtttgcacacagatgaccttgtacagtgattgcatgcgtgcaccagggagtgtggatatacttgcctgttctgggggtgtacatgtgtgtgcacacagatgaccctgtacactgattgcatgcgtgcaccagggagtgtggatatacttgcctgttctgggggtgtacatgtgtgtgcacacagatgaccctgtacagtgattgcatgcgtgcaccagggagtgtggatatacttgcctgttctgggggtgtacatgtgtgtgcacacagatgaccctgtacactgattgcatgcgtgcaccagggagtgtggatatacttgcctgttctggtgttgtacatgtgtgtgtgtgcacacagatgactctacagtgattgtatgcgtgcagcaggtagtgtggatatacttgcctgttctgggggtgtacacgtgtgtttgcacacagatgaccctgtacagtgattgtatgcgtgtaccagggagtgtggatatacttgcctgttctgggggtgtacatgtgtgtgcacacagatgaccctgtacagtgattgtatgcgtgcaccaggtagtgtggatatacttgcctgttctgggggtgtacacgtgtgtttgcacacagatgaccctgtacagtgattgcatgcgtgcaccagggagtgtggatatacttgcctgttctggggttgtacatgtgtctgtgtgcacacagatgactctgtacagtgattgtatgcatgtaccagtgagtgtggatatacttgtctgttctgggggtgtacgtgtgtttgtgtgcacacaggtgaccctgtacagtgattgtacacgtgtaccagggagtgtggatatacttgcctgttctgggggtgtacgtgtgtttgtgtgcacacaggtgaccctgtacagtgattgcatgcgtgcaccagggagtgtggatatacttgcctgttctgggggtgtacacgtgtgtgcacacagatgaccctgtacagtgattgtacacgtgtaccagggagtgtggatatacttgcctgttctgggggtgtacacgtgtgtttgcacacagatgaccctgtacagtgattgtacacgtgtaccagggagtgtggatatacttgcctgttctgggggtgtacacgtgtgtgcacacagatgaccctgtacagtgattgtacacgtgtaccagggagtgtggatatacttgcctgttctgggggtgtacacgtgtgtttgcacacagatgaccctgtacagtgattgtacacgtgtaccagggagtgtggatatacttgcctgttctgggggtgtacatgtgtgtgcacacagatgaccctgtacagtgattgcatgcgtgcactagggagtgtggatatacttgcctgttctgggggtgtacacatgtgtttgcacacagatgaccctgtacagtgattgtacacgtgtatcagggagtgtggatatacttgcctgttctgggggtgtacacgtgtgtttgcacacagatgaccctgtacagtgattgtacacgtgtaccagggagtgtggatatacttgcctgttctgggggtgtacatgtgtgtgcacacagatgaccctgtacagtgattgcatgcgtgcaccagggagtgtggatatacttgcctgttctgggggtgtacacgtgtgtgtgcacacaggtgaccctgtacagtgattgcatgcgtgcaccagggagtgtggatatacttgcctgttctgggggtgtacacgtgtgtgtgcacacaggtgatcctgtacagtgattgcatgcgtgcaccagggagtgtggatatacttgcctgttctgggggtgtacacatgtgtttgcacacagatgaccctgtacagtgattgcatgcgtgcaccagggagtgtggatatacttgcctgttctgggggtgtacacgtgtgtgtgcacacaggtgaccctgtacagtgattgcatgcgtgcaccagggagtgtggatatacttgcctgttctgggggtgtacacgtgtgtgtgcacacaggtgaccctgtacagtgattgcatgcgtgcaccagggagtgtggatatacttgcctgttctgggggtgtacatgtgtgtgcacacaggtgaccctgtacagtgattgcatgcgtgcaccagggagtgtggaaatacttgcctgttctgggggtgtacacgtgtgtgtgcacacagatgaccctgtacagtgattgtgtatgtgcatccctgcctctgtgccatggtatatatatgtgctctgtgtcctgcagtgagttgtggctgcagcacagcctcataggcatatgtgtgcacatttgttctctgaacacacaggggcttcacatgtgtgcacgtgtgttctgaataaccaggtatgaattgggtacatctaggccctctgggccaggtgagacctgagcgtgtatacctactggcttgtctctgcaactcaggtgtacatggaacaaataggtgtgagtccgtgtgtgtgagcctgtgccctgcgcacgccatgtgtgcattcctgtgtgcgcatgtgctgttgtgctcggatggtctctccagccacccagctgtgattccctcttccccgcaacaggagagctgtgctcgtgtcctgctcttccgtggagctaacagggatgtccgcaactacaacagccagacagccttccaggtacaccggtggtttacaggagctcaaggctgccccagaggtgtctgtctctgtgtccatgtgacttgacttctctgaaccttggttcttccctggaaggccctaagggagcacctcccccaggactgcccacaggaggtgttgggggacgagcccagcacgcgaggggtatttggtgttgatgttcccttcgtcccctcgccagggagagaggagggtcagcagggctctggggcaggggtatggggaaaatgagaagactggggtgacaggtgtgggtctgaccccccaaccccgagagaccagcaggggtgcagaagccaaactgcagagggggtggagaggggggtggtggaggggggtggtggagaggggggtggtggagggggatggtggaggggggatggtggaggggggtggtggagagggggtggtggagaggggggtggtggagaggggtgtgatcctagccgctgatgtaattcaggggaggtttccgggccctttctctggccaggttggttggcactgatgaccaggtggacgtggtctctgacttggagtttgttggggagtcgggaatattgtgggggtttgcggaccaggaacagagccagaactcctctattttcagtaggagtgagatgtgggaagagtggtcaggctgctgaggttgtgtggtcatagaaggtggaggcagcagtgggctgccagatgggtttgggcacactgggaagcagatacgcccgggcctgttggatgactgggtgcagggtcacaggaaggggaggatgagcttggcagcttgggcagctgcggggccttggctgagatgggaaacatggctgcatgttgggacagaccagtgtgcccgtttgcttgggactgctggttttagctctgaacttctgtccaggcagcccctcagtcccaggcagacagagggtgggtcactccagttatagggtgtgcctgtggcatcccagttacagacaagagtgtgtgtcagtagagaagaggaatgggctggggtctccggggcccccaaccaaggaagactccacacacgaactggagaaggagcagctggggctggctggcgaggcaaagctggtgctgctcagcccctccctgctcctcaaggccttgacctcccctttccctcaggtggccatcatcgcagggaactttgagcttgcagaggttatcaagacccacaaagactcggatgttggtgagttctgcccacctgggcgaccctgctgaatgtagattcgtgtggttttctggggcccagcagatgtgggggtcagtggtgacataaaggggccccacaccccacatctacactgtgtggccagtggtctctgagtggccactgcgggcatgaggaacgggccacagggcctgtgttgagtgaacattgtttttggtctgggagaagagcatggtgaggtttgggctgtgggccggggctagcattcagcttagggggcagcataggttgagagtggggttgaagttagggtcagagtccctgtttcccgttaaatcctaggaagagccagcaggagacatgggggtggtggacctcacttcaccctggagcaagcatgagtcttggtggtccgtagcaagctctcagcatggaaagatcatgtaaacgacacataaggaaaacaacagtgatgggaaagcagaatggggctgggaatagtgccatagccatcctcagggcaaggagctctgagccccctgctgcctgcgagtagaggaaagcctggtgtgtgcgtgactcacggtcctggaaggaaaaccaggagacacacacgtggcctcagccaggatacccgagcctcttggaggtctctggtgggtgtggggccaggctgggaccgtcctgttgtagctgccggagtcccctctgggagagttgtagctgccggagtcccctctgggagagttgctgctggccaggctgggaccgtcctgttgtagctgccggagtcccctctgggagagttgtagctgccggagtcccctctgggagagttgctgctggccaggctgggacggtcctgttgtagctgccggagtcccctctgggagagttgctgctggccaggctgggaccgtcctgttgtagctgccggagtcccctctgggagagttgtagctgccggagtcccctctgggagagttgctgctggccaggctgggacggtcctgttgtagctgccggagtcccctctgggagagttgtagctggccaggctgggaccgtcctgttgtagctgccggagtcccctctgggagagttgtagctgccggagtcccctctgggagagttgctgctggccaggctgggatggtcctgttgtagctgccggagtcccctctgggagagttgctgctggccaggctgggaccgtcctgttgtagctgctggagtcccctctgggagagttgtagctgccggagtcccctctgggagagttgctgctggccaggctgggaccgtcctgttgtagctgccggagtcccctctgggagagttgctgctggccaggctgggacggtcctgttgtagctgccggagtcccctctgggagagttgctgttggccaggctgggaccgtcctgttgtagctgccggagtcccctctgggagagttgtagctgccggagtcccctctgggagagttgctgctggccaggctgggaccgtcctgttgtagctgccggagtcccctctgggagagttgctgctggccaggctgggaccatcctgttgtagctgccggagtcccctctgggagagttgtagctggccaggctgggaccgtcctgttgtagctgccggagtcccctctgggagagttgctgctggccaggctgggactgtcctgttgtagctgccggagtcccctctgggagagttgctgctggccaggctgggaccgtcctgttgtagctgccggagtcccctctgggagagttgctgctggccaggctgggactgtcctgttgtagctgccggagtcccctctgggagagttgtagctgccggagtcccctctgggagagttgctgctggccaggctgggacggtcctgttgtagctgccggagtcccctctgggagagttgctgctggccaggctgggacggtcctgttgtagctgccggagtcccctctgggagagttgtagctggccaggctgggaccgtcctgttgtagctgccggagtcccctctgggagagttgctgctggccaggctgggaccgtcctgttgtagctgccggagtcccctctgggagagttgtagctgccggagtcccctctgggagagttgctgctggccaggctgggaccgtcctgttgtagctgccggagtcccctctgggcgagttgctgctggccaggctgggacggtcctgttgtagctgccggagtcccctctgggagagttgctgctggccaggctgggaccatcctgttgtagctgccggagtcccctctggtgcctgtgcctctctctggtatatggactcccaggacccccttcctgccatgagtgtttactcgtgggtgtccccattttttgtttttgttttaatttgaagtgacagcgggcagcaaacgtctggagcagatgttagggttggactctcacttggttctaatgtgaggtcatggtcagggctggagttgaattttggactggggttaagattaaggtcggtttcatgtttaagggcccttcttctgtagagttccccctgaacatccccctgtaaggcttggttatgagcccctccaccccaggctgtgtcagttgaaccatctgaggctgtggcagaccctcggtgaatgccacagctgctctcaaggccactgcagggaagtgtgtgttgaggaagtaactgggccagtgggatgggtaggatcggagtccagggtcaggtcaggggagaactgtggtaaggtttgggtttgcataaggggcagcagatagttacttctggtttgggctggtgttttggaggtggcccttagtgttggaaggccctggtttgtgcatgtgtggggcctcttcctctttttttttttttttttgagatggagtctgcctatgtagcccaggcaggagtgcagtggcgcgatcttggctcactgcaagctccgcctcctgggttctcaccattctcctgcctcagcctcccgagtagctgggattacaggtgcccaccatcatgcctggctaattttctgtatttttagtagagacggggtttcaccgtgttagccaggatggtcttgatctcctgacctcgtgatccacccgcctcggcttcccaaagtgctgggattacaggcatgagccactgtgcccggccagggcctcctcttctgcctataattgtctaaccgtgggaaagctgtctgggacctctgcgcctcagtttctcttaagtgaaacatggtctcttatggtcatttgcatccccttccccctgtggtgtcctgtggcgtttgatcctgggtggggctggactcttgccggtggccttggtctagttgcttggagggagggcgggaaggccccatctgcccctcatctgtgcgttgtggacagataccccagggctcttggagtcaccatggttgcgacttactggctatccaacctaggtgtgcttgcttggttggagttagacacacgtccctcagtggtaaggagcaggcacctgtgtcagttcatcctgatgtggtcgtcggctccatgggccaacaacacccttacctgatcaggtgccacacacagacactagggtgacaccgccagatttccctgagtacaggcagcatatttgtcaggatttaatacaagccccttatctcaatttgccctctcaacaaccccccaaggagtgattagactgttttacggagaaggaaactgaggcacagagggggttaattcagacctgattgattcagggtctgcctttgtcactcccatgccctccgtacacatttgctccaaggacaggacagtcatgacttgctacatcctatgcccactggggtcccagagtggggcctgtacacagaagaggaactggaaggaggtgccgccttctctggtgggcaggtgccacccggtgggatctggtagactgggacctgtgtaacccttcaggcaacaggatagcttgctgcctctcgacagccttgcttgccccctctagactgacaggccttgggtggggtccctggcctgggcgtggaatgggcatcccacagtgcttttgatgagtaccttggggaaatgcttctccagggtgctgtcatgcccatgagaacacacctgtgcctgggagtgtgtgcctgagagagggtaagagacaatgtggacccaaagagtgacccgacgtgacagaggcaaggaagcagaggtgaccacttctaggccagaatgattcagtagcgttctgtatattcacggtgttgtgcagccgattctattgaattcaaaacattttcatcaccacaaaagaagaccctggacacattaagcaataattctgcatcaattaccctctccctccaactctgtcagccattaacacactttcgtctctgtggactatagatttacctattcttgatatttcatgtcaatggaatcatataataagtgacacttagtgtctggctgcttttactcaacatgtttttgagcttcaccttgtaggatatatcactgcttcattccttcttatggctgaataatatttcactgttggtataaatgacattttgtttatgcattcatctgtcaatggatatgtgggtttctaccttttgactgttttgaatattgctgctgtcaacatgtgtgtacatgtacttgtttgaatatctattttcaatctcttaggtatatacctaagaatggaattttggaatcatatgataattctatgtttaacttcttgaggaactgccaaactgttttccaccattttgcattcccaccagtgatgtatgaggcttccggttttttcacatcttcaccaacagttgttactatcttttttttttgaccgtagccatcctagtaagtgtgaaatggtatttcattgtgattttgacttgtatttccctagtgactaatgatgttttgcatcttttcatgtgcttattgggcatttgtatatcttctttggagaaaagtcaagtcctttgtccatttttaaattgggtcatttatttttgttgttgagttgtaagggttctttatatattctgaatactaaacttgtgtggaatatgtgatttgtaaatattttctctgtagaataggagatccttgtcacttttttgataatgtcctttgatgtacaagaatttttaattttgataaagttcaaggtatctatttttttcttttgttgttcatgcttttggtgtcataggtcacgagggtttatcctctaggttttcttctaagaattttacggttttcactcttaggtcactgatccattttaagttttaacttctgtttatggtgtgaggtagggagccatcttcattattttgcatatgaatatccaattgtccagcaccatttgttgaagagactattcttttcccattgaatggtcttggcacccttgttgaaaatgaattgatcctagatatgtgggtttatttggactctcaattctatcccagtggtctacatgtatattcttatgccaggaccacatggtttgattactgcagctttgtagtaactttttatttttatttttttggagatggagttttgctcttgtcacccaggctggagtgcaatggcgcagtctcagctcactgcaacctccgcctcccaggttcaagcaattctcctgcctcagcctccaaagtagctgggattacaggtgtgtgccaccatgcccagctaagttttgtattattagtagagatggggttttaccatgttgggcaggctggtctcgaactcttgacctcaggtgatccacccgcctctgtctcccaaagtgttgggattacaggcatgagccactgcacccggagtgtagtaacttttgaaatcaggaggtttgagtgcttcaacttgttcttatttgttatcgttttggctaatcagggcccctggcaattccatatagacttgaacattgcttttctatttgtgcaaaaagggacattggaattttgcattgaatctgtcatcactctgggtgacattaacattttaacaccattgtcttccaattaatgaacatgggatgtccttttatttatttaggtcatctctaagcagtgttttgtcattttcagtatatagatttttttacttccttagttaaatttattcttgattattttcttcttctggatgctattataaatggaattattttcttaatttcctttttggattgttcattgctggtgtgtaaaaacaagtgatttttgtgtgctgatcttgtgccctacaactttgctgaatttgtttattagctctagtagctcttttggtgtattctttgggattttctacatataggatcatgccatctgcaaatagagatagttttacttcttccttcccaatttgggtgccttttttttaatttttatttttgcctgtctagaactttcagtacggtgttgaataccagtagtaaaagcaggcatctttgccttgttcctgatcttagggggaaagcattcaatctttcaccattgtgtatggtgctatctatgtgtgttttttttgtttgtttgttttttgttttttaaatatggaatgcttcattaatttgcatgtcatccttgtgcaggggacatgctaatctctgaatcattctaattttagtatatgtgctgcagaagcaagcacttcggatttttaataaatttcctttattatgttgaggaagttactagcttctattactagtttcctgagtgtttttataatgaaagagtgttggattatggcagatgctttttatgcatcaattgaaatgatcatttttccccctttgttctattaatgtgatgtattatattgattacattagtctgtagatttcttttcctgcaatgcccttatctggctttggtagcagggtaatactggcctcgtgaaatgagggagtgttccctcctcttctgttttttggaagagtttgagaatttgtgtcaattctttaaatttctagtagagtgcaccagtgatgccatctggtggtggacttttcttcgttgggaggcttgtggttaaggattcaatctctttgcttgttataggtctgtttaaattttctgtttcttcttgagtcagttttggtaatttgtgtttttctagaaatttgtctacctcatctagcttttctatttgttggcatgtaattgttcatagtgttatattcctttttaacttctgtaacactgatagtaagtccccaaatttcatttgtgattttagttatttctgtccatcttctctccttactagtcaatctagccaaaggtttgtcaattatgttgatattgtcaaagaaacaaccttttatttccttgattctccgctgtttttctcttttgtttatctctgctctaatcttactgtttccttccttctgctagcttttctttcttttgctagtttggtttgctcttctttctcttgtttttttgtttgtttctttttggtctttctctagtctgtccgtccctccgtccctccctctcttgcttccttcctctttattttgtttgctcttctttctctagtttcttcttttcttctctctctttttttttttggagatggagtttcgctcttgttgcccaggctgtagtgcaatggtgtgatctcagctcaccacaacctccgccaactgggttcaagcgattctcctgcctcagcctcccgagtagctgggattacagggacccaccaccatgcctggctaattttgtattttttagaggcagagtttcttcatgttggtcaggctggtctcgaactcccaacctcaggtgatctgcctgcctcggcctcccaagtgctgggattacaggcatgagccactgtgcccggcctcttttcttttcttttattggttcattcatacagacaaggtctcactatgttgctaggctggtcttgagctcctgggctgaagtgatgctcccgctttggcctcccaaagtgctgggattacaggcatgagccactgagcctcgccttctcgtttcttttttgtttcttttttttcgtgagatggagtttcactcttggtgcccaggcggtagtgcaatggcgcaatcttggctcaccaccacctccgcctcctgggttcaagcaattctcatgcctcagcctcctgagtagctgggattacaggcatgcactgccacacccggccaatttttgtattattagtagagacggggtttctccatgttggtcaggctggtttcgaactcccgacctcaagtgatctacctgccttggcctcccaaagtgctaggattacaggcgtgagccactgaacccggccttctcttgtttcttaagatgtataattaggttattgatttgagattgttttcctttttaaaagtaagtgtttacagcgttgtttccctttaagtactgcttttgctccatatgttgtatttttgttcttgtttgtcttaaagtgttttctaattttccttatgattgatttcttttttctctttctttcttttttttttttaagagatgggatctcactctatggcccaggctggagtgccctggcttgattttggctcactgcagcctcaacctcctagtctcaagccatcctcccacctcagcttcctgagtagctgtaactacagggtgcagcaccacacctggctttttctattttttatagagatgggggtgtcactatgttgtccaggctggtctcaaactcctgacttcaagtgatcctcctgccttgacctcccaaagtgctgggattataggcttgagccaccatttcttttttgagcctggtttcttttttgacacattggttgcttaggagtatggtgtttaatttccacatatttgtgaattttccagttttctttcacttctcgatttctagctttgtttcgttgtggttgaaaaagatactttgtatgatttcagtcttttaaaactttatcaagacttgttttgcggccaaacatacagtctgtctgggagaatgttccatgtgtactcgagaagaattcttgaatatattctgctcttgttgggtggcatgttctgtacgtatcgttgagtctaattggtttaagtcttctatgtccttattgatctctccagatgttctacccattattgaaagtaaggtattaaagtttcttactattattgtggaactgtctatttctctcttaaattgtgttgtttgtatcatattttgatgttctgttgttcggtgtgtatatgttagtaattgttaatcaacatataatgtccttctctgtctcttgttacagtttttatcttaaagtttattttgtatgatgttaatataaccacccagctctcttttggttactatttacattagattgctttttttatcctttcactttgaacctatttgtgtctttggatttaaagtgattattttgtaagtagcatatagttggataatactttttaatcactatctgctttttaagtaaaattctattggaacacaaacacacctatctgcttgtatgttgtttgtggtggttttcatgctgcggtggcagagttgagtcattgcaacacagactatatagcttgcaaagccttaagtagttactgtccaattctttccagaaaaggtttgctgatccctggtctagaatgtcttttatagtttccctggttatagttaactgcaaatggtcctgttcagcagtagtctggtgagattcgtcacatgtagcctgttttgtctctcctgaagcttgtgaaatgcagttcttagagcatatctgagcaccctcaaggcccctttcggctgagaggagaagcaggcttctacctctgaagctagggtgagaggcagtttgactgggatgtggccccttaatggtagcttcatttgtagggtggccaactcttttggtttgcctggaaccaaggcagttcctggaacataggatttagttttaacatctggaaagcctgggcaaactggacaagttggtcacccagctggctgttcagagtcttacctatgcccccttaccccagtaccattcagggaaacccccagctatgcgaagcggcggcgactggctggccccagtggcttggcatcccctcggcctctgcagcgctcagccagcgatatcaacctgaagggggaggcacagccagcagcttctcctggaccctcgctgagaagcctcccccaccagctgctgctccagcggctgcaagaggagaaagatcgtgaccgggatgccgaccaggagagcaacatcagtggccctttagcaggcagggccggccaaagcaagatcaggtaggagggggctggcaggccctggaggggttgggagggtggggtgccgggacctgagccaggaggagccagcaccgggaggcagagagaggcctggtggtgcctagcacctgtgtagtgatgggctagggcttcctggttggggaagggaagaaggcatctctggaggtggggacaggcacatgcacgctgatttccggttggagctgggcttgccatgaggacagtgggcagttgagggagcgtgttaggtggagagggtatgctcctacctgtgatttagaaaacacactgcattgtcaggcatggctgggaagagtcagggctggtggcctgtggtaagggggacagggatggagttgccactccagtagggcccaaaacctacaggtaagccccagccctgtccccagggtatactcatggtttcccccagccctggcacacctacaggactctgtggcttctattctttaccctcaccctgaggcctgggtccctgaggcagggatgcctggaccggagcccactggcctctctgggctgtgcattgggtgctgaggtgggcgcactggctctcagccactttgtgcctgggcttctcatcagtaagtgggaatagtcctacctaagtcattgtctttgggaagccttccagaatgccctgggcaggtgagggatcacctggcagagtctggcaactgccggtaaaagcacctgccctccctgtgccttgaaggcaggcaccgtctttgtcgtttcctagtttcatcagagccaggcactgaggagggtgtttggcagacattgttgagtggaagagttacataaacagtatgttgttgtcaggatggccgccggcctttacagttctgtcagtccaggcccgctgttgggctgaatggcatgtgtatactagctcctttaaccttgacgaacgtacatgttcatgctctattaataccatgttacagatgagcgtcctggtacgcaggtggggcctgtgacgggtccagagtcacagagctacggatcagcttcactgggccccaggtagacccaatccccaactttctaagcctgagtgttcagcagagggctcagggtgcagcagggcctatggaaggcgccccttcctgtgctgccgcccctgctctgcagcctggtctcagcgatgtctccgtgtctgtctttgcctgggcttgttggactcgcaaggctggctgtactgccccaaatctcaattctcccctgaagctttcttatagacccgcggattttctaagggctgggcggcccagtggctgaaagaacacattctgcattccggatgtttccatcccgcagaaaggctgctcctgagttggaggcacgcgttgccacaggctcctccctgcattcattttttgtacgtgttcattcatcctttcagcagacacaaaactaagacctgctgtgtgaggggctccagctcacctgctctgtggggatggcagaattctgttttttccttcctcgcaaacatttattgggtgcctggtgcgtcagaggtggtgggtctcaggaagttgacagccgagggcccgggctaagcagcagttaggtgggcagtgatccccttatggggctgccctggtgagtggacaagggtctgcagctctcgggaggggctgaggaagttcggtgccccgaggagagaagtcaccccctgggggaggcgaggctgggccctgcaccgcgcgggtcgctgcgccctctgtcggttgagccggaccgggacccgacccccatcagccccccagtatcacacggggcacggcgggggagtttgggctgagagcccgtcacttaacagctggcccaggggtcaggatgttagagtagttcaggtgttggcaactgcgtgacggacagcccacaggaggggaaggagaggtgccccgtgtgactagagcgtagcaaactgccaagcccgagggagcctggctcttggaaaagcgggtggctctggcctgcctgggtactagggagccactgcaggcttctgagcagagccccagtggaggagtgagagctcaggctctaccccagtctgggagtggtctggggaaggtgggcatcacgcagtgggcgtgggcaggggccggtgtccaggacgaggggacccaggcctagagggggactgggcacccagcgatccgggccctggacctggaggggtggggggggcgcccctccctcccgttcaccggctccaggcggctttgctggtgcccgaagcccccgccccatcccccgctcccactaggctgccctgaccaccgtcccgcgtccgcgtccgaactccccctcccgggggtcggcggcgaggggagggcgggagggagggcgcgagggccgccaccaccgcccgcagagggaggagcccggccgtggaggaggcggggcgcggggcggccgcggcatggagcgagcctggcgcgcccaggagctgtattcgaattcgagctcggttccccgcgccccctgcgccccccgcaccgccgccccggggcccgaagcggaaactttacagcgccgtccccggccgcaagttcatcgccgtgaaggcgcacagcccgcagggtgaaggcgagatcccgctgcaccgcggcgaggccgtgaagggtgaggggcgcgggggggcgcgggggggcgggcccggcgcggggagggggcggcgccgcgcgcggtgctggccgggccggggcagtggctctggggtctcctctgccggggcggccctgggcccttgtgggatccctggtgtcacggtgaagggctctgcctggggaaggttcctgccgtgcgggtccctccggtgctctgtcgttccgggctccctgtgtcaccacggaggctcctctctcgccacgggcgtttctgtgtccccgggggtctctgcctgaaggaccctgtcccattacagagcttccttgcattgcggggttcccgtggcacttctgcagcttctccattggaggcccctgcgatgtgggggacccttgccgtcgtggggtgtctgtgaccgtcatgtgggtgtttgtgttatgcaggcttctgtcaccggggcttcctgtgttctggggggatcgcgtgccatgacaaacccctctcattctgggggtctcggggccatcactgggctcctagcctcagggccggctgaggtggaaacagcccagctggtgcatcacgtggcctcacccactggccacagcacgatgaccccgagctctcggcagtgacccctgggtgggtgacagagccaggatgggggtcggttgaaggggctgggggagcatggtcagctgggggtgggggcagcagcaggagtgtggcccctgcccctgcctgcgcccctccccgagtgtgtccatctgtgtgtctctctgtcccccacatgcccaccctgtgccgagcccatctgttcctttctctcttctgcgtggatcccaaaatcttcccagggaaaaagctgggagaaagtgggaagggaaggagggaaagggcagggggtgggtgggcagaacctgctcctgaggtggggtaggcgcccagctctgctccccactgacggcctgtctggcttcttcctccagtgctcagcattggggagggcggtttctgggagggaaccgtgaaaggccgcacgggctggttcccggccgactgcgtggaggaagtgcagatgaggcagcatgacacacggcctggtgagtgaccccacggctccccgggcagctcccaaggggaccaccccttccagtttccctttgttctctcttggtgctaaatccacatggatattcatagagaaaagactagaggtaaactcaaacaaacactcaaagtagatgcaaacttgtgtacatgacacagacacgtgtgcacacactctgcatatacttgggaacatgcgtgtatgtaacctgacgcttcacgtgcagtggagacacataggacgtgtgtgacggggcctctgtctgtgtgatcccacattgactcccagtgacttgcaccccaccagcacagtccttcagaaacaccaggtgtgtggaacgcatgattcctgcgtagctggcagacatgtaaggaggtcagtgtgagaaaagaggcgtttttccaaagtggacagattgtccaagtgggcagagcaggcaggcccggagcagccaagaggaaatgaggccagttgggcctggaggtgccctggtgagtgccctggggcagggatggtctgagggcagcaggtgaggctgggctggtcctcagcctgcagggaggatgtgaaggtgaaggctgcagctcctgggttggtgagtggctgctgtccagccctgctgaccatctggtcctttgggggcccccgggctggagctgggtgcgtgtcttgggggtgcccttgcaaggaaccctcaggggtcccgggaggcccccagatccatgcatgtgcttctgtcctggagagctggtgggccaagcaaacctctcctgagtgatggtcactgggggccatcggtggtgtgtctggatcaagggtgcatgcaccctccctctgcatgtgaagggctcaggcctggggttactgtgtccccatctctgtgtccccacctctgagagtttcccagcgactccacccctgtacggcctggacccctgccctgtgctgagctcagcagaggcccagggaggcaggagcttcgccactgaccttttcctgggccggtgccctttcctccttccttggccttgttctgccttgctctgactggtggcttagagtgtggaagggacttggccccctgttctcagcccgcggagggtggatagggcagggtccagatgggaaatggtttcagagatttgggccctggttcagacagtatgggagaggggaggggaaggagaggtagggggatccacacctgtggcgggagcgggtcttgagctcccccacgtggtggtgaggaaggttctggtttgaggactgtgtggagtgaggggcatttggacctacgtctgaagctgacggggagggaggggggtttaggctggagtcagaattggagagcagcaaatgttttttaggtgtttgtcatgtgctgggccctgtgctgggagccgggatcacggaggctcagctggaagccttgtgggagcagtggctgtgacgggggccgtgtgagcgtgggagctccctgggctggcctgaaggagtcagagagggcctcaaaacagaggcattgtctgagctgagtcctctaggtggtcagcggctggggctgaggggacagccgtgtgtgcagggtccgtgtggcgctctacagctgtgtgtcagcacggcctgctctgagtgcctggcacagttttagcacttctacacgtataagtcgttgactcatcccagcagtcccaagaggtggggccacttgttgttattccatttctagggggtcacatggccctgaggggcaaagtcttgtttgcaacacaggcagcaagttctatgtgagtgaaacgcctgcatggggtgaggggcgaggctggtgtggggaccacggggtggtcaggtggcatggagtcaagtgacagtgtggcatcatggcggagggaacccagccgcagtgtctgattgtgcaggttgtgtaggatcaaagcccgggctgggcagagcagagcaatggagaggagggttcaggtctgggctccagccagcagccatggtgtgtgtgacctggggagtgagtgtcagaggtcccggggtagacgggagtatttcatgagtgggcagcgggagagggacctgcggaggctgcctgcgaagggcagggagtgggagcagtgacagtgccctctgaccttggctgcaggccctgctggccacactgcgcagagcctctgctctgggatcccggggccgagttctgccagaggccagagtgcagcccaggaacaggaacctgcttccaacaggcccagatctgctccccccaccccccaaaaaaatccatttccgggactggagtggggacagaaaaggacttaaaggttagggaggggacatagtccctgtgcgtgcaggggctggtgcccagagccggtgcctgctgtgggatcgggaggcgagtcctggtcacttacccagcagagagcagtctcccacggcacctcctggcaggcagagggtggagctgtgagggagggaatggagaagcgaggtcaggtgtgttctggaggcccagcaggagcaggccctgtgccttccctcccctccctccttccctttctttgcagtaaggtcagcacttgggtgggtagtaggagatggctgtgttgggcattttctcttcagctggcttttatgtgtcttattaacaaaactggaaaaatgagtttgtgttatgtaatccatacaatttgtttggttgacaacatctgaaaacaggaggctggtcaagtgcaagtgtggcgggttcttcagcaggcagcaccatgacacttccgtgcctctgtcgacgtggagaagggtgtgatggaggaaaggaggggtctgatgccccacctgagtggtgatgaggcttggcctgagctggccttaggttcagcgggatgaggggtgcaggtgtggttggggaatgccaggataagatataggtcatcagaaccaaggggatcctccaagttggatttctctattctatatgggcgggcttagagggggctgttgacttactgagagtcacacaacgtagtagctgggacctggaatccagcccgatacttttttgatatctgtgccttctgatagaaataggcactctttcctctttccgtccggccactgctccacctatgtttacagccatctatcctttgactcacccacccatcccaccatcatcttcttaaccgttgactcaccagccaacccaatccaccacccctcccttcctccatccatccacctctccacctacctgtctacacacccagtccatccatccatctacccatgtatctgtctgctctttgacctatctacccatggccctctccttccctccctccatccactggtccagtgcctttcaatccacccttctgtccgtctatctcagatgcacctgtccaccatttactctcctagtcagcatcccttctgtccgtctatctcagatgcacctgtccaccatttactctcctagtcagcatgcagaatgcctgtgacgtgccaggtgctgtgctgggtgctaggatcacagagataaagaacatgtggcccttaccctcaaggagctcacaattagtgggggaaacaggtcatcgaaagctgcaggttatctttctgatctcatttcctgccactctctctagctccctctgctccagctgcacaggctctgaactctctcaaatgctgcaggctgatgcctgccgtgggcttcccctgaccacccccgctcctgggaagccctttgcccacatatccacaggctgctccccatcctcagcctctgctcagccctcccgtgggggtgaggcctttgcgtgcctttctctgccctccctgatctgctcgctggtctcctgagcacttgccagcattcgcatgctatgtctttatcctctgtttatcctgtctcccagaacagattataaaccccacgagtgcagagactttgttctcttctctgctgtatttgcagagctggtacacagtaggagctcaataaatacttgctgaaggaaaacatggatcttgagaaatgctaccaagagaggaaatgaggaaggtgctgagggatgaaagcgaggcagtggtggtgctgcctgtggggcctttgcggtcctggagagtggagctgcggggctgggaaggctggtgggtggggctcgcaggcagctggaggagctcgtgggagcagagaggtcatggctggaggtgtggctcgaaccttcaggtcagtgagggtggagtggtgggcagacagctggctagcttggtgctggccatgtgggacttgagatcaagaggacagttggggaccaagctctgtgggatgcatcgaggtcagggcaggggacccagcccacacacctagatcccctgccccactcacagttagtctgaagcaagggaccccatgaggttgagcatcaaggagctattgtgaagaagttggtgaagacagaacgctgcttccatgccagcgcctataggcacatagcacggcatttgtacatgagtgtgggtaatgcagattcagatgtgcacacacacatgcatgaacacacctcacacgcacatgacggcaggtcacacagacacatgagcacggcacttgcacacagtgggctcatatagagacacgtgcatgagcacagcatctacacatgaccacggatctctcacacacacacgtatgtgcacacccccctctttgctcgcagccttggggctcacttacgctctgtggacggctctggccttgtttggactcctggttcagcagctacttaggaaagagatgagctgctgccccctcttgggccctgacccacggaggtcagaattccctacatcatcccctcagccttcttacctctggacccaggactccaggatttggggccccctacttccatctggacacaaccaggccaagggggtgtgtgtgggcagagactggtgaccagcatgggtgagggcagttgaggcaggccagctggaggccacgactgtccatcagctcccgatactcccttcagaaacgcgggaggaccggacgaagcggctctttcggcactacacagtgggctcctacgacagcctcacctcacacaggtacgtgcagggaccctggctggcgggagcatgcatgtgggacgtggggcaggacctgcagtgtagagggaggccaggtatgaagaggtcagaggagggcaagggaatgtgcctggccgacctctcttctgctgcccggcctgtcagtcccggggtgactgcagggtggactgtggccggccaacctcgaggcagggcttacctcactcctccctgctttccttcatcagcgattatgtcattgatgacaaagtggctgtcctgcagaaacgggaccacgagggctttggttttgtgctccggggagccaaaggtaatggggagtgggtgcccgggggtcaggcaggcaggggctgcacaccgctcagggatgtcttcagcttcttgcttctgcccccaactctgctctgccccacactccctccctgccttgcccctgcggctcccgcttttggccccggctttcctggttcctctgctcggtcgcgaccgtcgtggtttgcaacgtcccggcccaggcggcaattccttcccttcgttgttttccactgtctttgctctagagtctaaccgagtgggggcttttctggcatgggcaaagggagttttgcagagggtcatgtctaggatccttgggccggctcgtccctgcgctgtggctccccgtggccctcccccagccccgggtcactgccccccgcagtcatctctttcctgtgctgagccactcggaggttgctgtgtggcagccgcccccacccgaacctagctggtgaagcgccttcctaattgccccccgcagcagagacccccatcgaggagttcacgcccacgccagccttcccggcgctgcagtatctcgagtcggtggacgtggagggtgtggcctggagggccgggctgcgcacgggagacttcctcatcgaggtgaggtcgttctggccggtgctgcccagtgggatgctgagccctgagccctgtggtggacgtgcctggggcgtccccacccagctgcctgtctatcccaggtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagaggtgaggggtcacgcttcaggcctctgtgcccaaactttcccctgaccttagacctttgacttcaggcccacattcctcttcccatccctgacccccaactgctgacatcagattcctgaacctcaatgaaccacccacacgtgtgggctgggacccctcccgatccctggtgctagactgccagtcctgtcccctggcctgaggcctttgacccctgacccctgacctcaggctgcccctcctcagatccctgccccctccttcccggcgttcccccagcccctggcgtggcagagccctccttccctacaccgccagcagctgcctggaggccggggttgccatagcaactgtgaggttgacgctgccgcgctgcttattgtcggagggaagggggaggcggcacctgagggaagaggaaaagcgtcttctccccgcgacgacgcggcacagcctgggcccaggaggctttgccggccaggcccagcccaggcccgtggcttggctgaccacaccctggccccacaaggggcagtggccacccgggcctggggggagccctggagcagcaggagccccgcccgcaaggagacccctcccagcccccaccccatggctctggtgcccccttgcttagccctcgaagcctgcagggtgggtgctcaggccagagccagccggcaccgtgacccccgccagcacccttgatcgtctcctgaggccctgattctgggggttcccagggcccctgaggccctgaccgcccgcccccccccccccgcactccctgagctccttgagccatgaagaagtttgcgtccagccgtaacctgaacaagatcctggcacagtgcgactcatcctcgcgggagtacgaggagatccaggcggtggagcgcaagtggcacctgcacctggccacgccgcgccgcctgctgctggacaggaggtccaaggcctccctcttctttgcagccccaccgccccccaagagggcccccagcaccacactgaccctgcgctccaagtccatgacagctgagctcgaggaacttggtgagtggcgggggtggcggtggaggtggacgcaggtggacggtccatgatgggcagacagggccgggagacacaggtggtacgggagggcaggcggtccagccagagggtaggaaggacaggtgggtacaagagcaggtcagaggtgaatgggtgggtgctggcgcgatggggaaatttggtgcttgtggggtgaggagagggtggcatgtggaaggggtgagatgtgagaggctggggatggacagtggggtgtccaggacagatgacggggagcagggcctggcccaccagtatgtttgcatgtgtgtgcatgtgtgtgcgtgtgctgcctctggttttccacgtctccactttgactttactcctgcatttcatccaagtgaggagagagcggtagtgaggtgaccagggtctgctgctggctctgccaggcactggctgtgtcagctctgtgtttattttaccctcttggtgactgtgcactcattgacaggtggccctgctgaccccacaggccacaggagtactgtcggtgggatgatggggcagggcctcgagcgcggcaggaggggagcaggagtgtgttggggtttgatggggcatgttctgggcacaagccctggttgaccatcaacagcctcttcatgggcaggtcttatatatgtgtccattaacaaccttgtcatgtgcacgtccagatatacttgatcatgtcctgacgtgacagtcagtagcctcttcatgggactgtcccattacgtgtgaccgttgtcctcactgtgggtatgtgctatacatgtggccatcaacagcctcgtcatgggcatgtcccactgtacgtgacagttgacaggctctttctttctttttttttttctttttttttttttttgagacagtttcactcttgttgcccaggctggagtgcaatgacacgttctcggctcactgcaacctccacttcttgggttcaagtgattctcctgcctcagcctcccaagtagctgggattacaggcacccgccaccatgcacggctaatttttttttttttttttttgtatttttagtagaggcggggtgtcaccatgttggccgggctggtctcgaactcctgacctcaggtaatctgcctgcctcggcctcccaaagtgctgggattacaggcgtgaggctctttctttctgtgatctgagcccagttctgttcccagacttaactctgcctctggtcatagaaggaaccccaactttggtcctaaactgaaccctgaagtcctggccacaggaagggaccccattctggttctaggctgagccctatccctggcttcagtcttggttctaccccagccatagaaggaacccttttcctggtccccagaattatccctgacctcactcatgaaccaagccctgaccctgtccttgccacaggctgagctgccccatgccaagcaggtggtcttaactgcagtttagttcagggtggagaacagctaccaacgtccattgggctgacgtggtcagaattttcaccatagctattccaaataaaataaaacccaaagaaaaaaacaaaaaaccccatgtagataattcagaatgaaaaggagagaaaccaaagccagaggcttccatagctcgttatctagtacgcaggggcaaggggttggggtcctgaggcccccacaaggctgggagacgtggctggacctgtgagaagcgggaaggttaaaaaccaagcccaaccactggaattagcttcgaaagaactggaaatcagagaagaatatgaaaaacattaaaataaagtaaattgtcacaaagattaaaagaactaacagaactaatgagagaataggacagaacaaacaagcaaaaaaagaataagcacattttagaatgattcttttttttttttttttttttttagactgagtctcgttctattaccagctggagtgcagtggcgcgatctcggctcactgcatcctccgcctcccgggttcaagtgattctcttggctcagcctcctgagtagctgggattacaggcgcacaacaccacacccagctaattttttgtatttttagtagagatggggtttcaccatgttggccaggctggtctcgaactgctgaccttgtgattcacctgcctcggcctcccaaagtgctgggattacaggcgtgagccactgcgcccagccagaaggattcttaaagaactgttattgaaacaaaaagtgtagtcactgagataaaaaagaaagccatgcctgggataaacagtacactagacccaggtgaagaaagaaacagcaagttagaagataaatctgaggttacccagaatatagcacagaaatataaggagatagaaaatatcaaagagcagttaggacacacacacacaaaaatcacatagataattcaatgggactattgggaaaatcccagcatctacctaatgcaaggcgtggaagcaaaaataaaatgttgcctggaggcaatatttggagatgagatggcttaagaatttccgaaagttgaacaaagacatgagtcttcagtttaaagaaatataagtctcagcaaggaaataaaaacaaatctgtatccacatctttcatagtaaaactgtagaatgctgtgagcaagcagaaatctttaaaacaatgagagaggctgggtgcggtggctcatgcctgtactctcagcactctgggaggccaagacaggtggatcacttgagtctaggagtttgagaccagcctggggaacatggcgaaaccctatctctactaaaaatacaaaaattatcctggcatggtggtgtgtgcctgtggtcccagctactcaggaggctgaggtgggaggattgcttaagcctgggacgtggaggttgcagtgagccaagatcatgccagtgcactccagcctgggcaacagagcgagaccctgtctcaaaacaaaacaaagcaaaaaatgatgagagagagagagagatgggctgctggatgtcttagacgggagcagtggtccaactgacaacagacttctcatcagcagtggcagatgacagtagatgatggaagaagagcttcaaagtgtggagtcaaaattcttttccacctagaattctataccccgctaatcctgctcattcaggagtgaggcagagaggctaatcctagacctctggcactcgggtcatgagggtccaaggtcagtcacggggagctgacctgtcaattgaagatccaaactgatcaataagccagcaccagtaggcagctgggtcccaggattctcctgccagaggctgtcacatagccacagtcagctgcatgttcagaagggactcttctattcagcaccacggggcttttgggcagcctgagatccgtaatcctgggacccagggactctgccctatggaaacggaaggactgcgctttgctctctgggcttttctgcctgaagaaactggtgaatgaagacgctcctttccctcccctctgggctgagtgttccctcttctgcaacaagcctcaggacaggttgctggagtcactttgcagagcccggtcttccagaggagttgctcacagcttcaggccaccataattttccaggcttttttctgagcagagtctgggggaggatgaagggacagcttagcgcagagcctctacccacacttctggagctcaggaagccaccctgtccccagaagacagctgtcctgggaagccagcagggcttctggaagtcccctctggaaatgcctgatttgaggacgccatgccagcatcagggtttccccaggtacctaagggaccatcccacaacccagtgtttttgctttcagaagatagaaatgaggcctgttggtcactgctggcatgaacacatcagaactgcctcacactgtcaagagctattagagccctttaggatccatagtctatcgagaaggtgcctggacacctaaaaagaaaagaaagtgaggtgtcagagaaagcaggtgcaagtcggaggctcctgtccaggtggctgtttgctgctcggaggatgtgggagaggcatggccctgttggaggaaggggagggaaggggtatcctgtgggggaatggggtgagcaaaggctggtgcctggaaaatggagggttgcagagctgggagtgagaggaaggggctgggtggggaccctcctgagataggtggtgagagagagaagagggcagaacacccctcctcccctcagcactgggggctcctcatggtcgccacatgcatgtctgctcggtttgtaccaggaatgtgctggggccacaggtcagtggagacccaggccagggaaggccctgtggcgggtccaagcccttcctgtgtattcacgttcccgggagaactctggacttccctgtaatttctgggcccctttttcttttgtgatgagaacatcagggtaggtgccacacccagcatctatgtgagtggccttgtcctggaaaaggtttctgtgccaaacacacttgccctgccttttaagaccgactttgaacagaacacagaggtgaccaccttaattttcagcgacacctgaacttgttttctatggggttttgccttttttctgaacaaacgtttgactgagccaagcatgatggagttgtgcatatctgtgtgtgtgtgcgtgtctgtgcgttggtgagcggacacgcgctgtctgcacctgcgtgcatgcggcacacatgtctgtgcgtgggtgagtggacacgtgctgtgtgcacctgcatgcgtgtggcacacgtgtgtgcatgggtgagcggatacgcactgtgtgcgcctgcatgcgtgtggcacacatgtctgtgcgtgggtgagcagacgcgctgtgtgcacctgcatgcgtgtggcacacgtgtgtgcgtgggtgagcggatacgcgctgtatgcacctgcgtgcatgcagcacacgtctgtgcgtgggtgagcggatacgcgctgtgtgcgcctgcatgcgtgtggcacacgtctgtgcgtgggtgagcggatatgcagtgtgcgcctgcatgcgtgtggcacacgtgtgtgcgtgggtgagcggatacgcgctgtgtgcccctgcgtgcatgcagcacacatgtctgtgcgtgggtgagtggacatgcgctgtgtgcacctgcatgcatgtggcacacacacacaagtccctgcttgtggttgtttcctccttggctttcaaggcatgtaccaactgactccagagttgggcagatttgctattcacggtctgataaagaggtgtaggctgggggcagatttgggaggtcatggtttttgggggaggtggtggtgagagggatggggtggggaaatgagtgtggataatggggcccgggtgccgagcctgcctcttactccctttactctgtttcttgattccaagcctccattcggagaagaaaagggggtgagtcatctgcctgtgtccccagggccttggctttgcctgacccctgtctgggggagtgctggtgtgtgaggaggttccagcgcaagtcagggtggcctggaagcctgggctgcaccctcctgttggccttctccctgggcatctggtaggggcatgagagaagggcctgcaaggatggatggggagttcccaggggtgtgaccctctgagactgtgatggccttgggggctcaggtgagcctggggcctgtgagctgtgcagatagcctgatggaggcagcccgtggggaggagctgggagagccccgtggaggccactgcatgcaccatggcccggacagcaggagggaaagggctccgagggtcccagagggggagctctagggagcagggagactgggccgtgttggcgtgcacgttgcttctttctgctggtcctctcggggcctgtgcttgggttgtgggacctactcccgtgctggttggttgtagggccaagcccagagctgatggtcccttcagagcaggggtctgagtcccacagcactggggaaggagcttggagctcccctggccaaagaccccaggctgttgactaccctcctgaacccccgttcaggcctccctctaccctttggggctgctccctgtatgtcctttatgttcagcctggttgcaggggagggcgcattcaggtggggacagtcacctgggcctgggtactgaggtccactgtctggtgaagtcctgggacccggcttccggcagcctcctctgcctctcgggtggatgggaatcagggcccagacagaggcttgaggtggctttctccacccaggcctgtatatttgctccacgtccgtgtacctgatgcccatccctccctctctctcgacccactgggctttccctgggtgaggacacatctgccaggcccttggcccagccctcttgaggtccccttgctgcctcttgccccagcccaggtgaagggcttccccagtgtcttctcaggtattaaaaacaggtgacaaggtctcctccagtgaccttttctgcatgcctttggggcagacatacaagctatttctggaatcttctggctctgccctctagctcgttagtggggctcccagggtgctgtgttgcagcccaggtgctgctccagttgtggaagaagtgatggctggttgatcatcccgcaggctggggccctgttgatcaaacagctgcaaacccagctgtgtcctgctgtgcacccagagggccctgggagtgagcgggtccacttggttcctgatgggctttgtttcccttaattatctaaaattatttatttaagaatatatcctctaatattggggggagatttatgtcaacctcatcagtttgtaatttgcagaattcttgatgaatcctttcccttttgaaaacacttctcacccggctccagcaccatcgccggatgaccagaaacagctgctcactaaacgttatgtgcgtcccgctgtgggtctctgggatgggtcttccagacctagagagacagcctctcctagcccgtggctcaggcggcaacgtgtctcccatgatgctgagccgtgtgtgcctcacggagttttctctccattcatatctttacttctgcagtttccggggagtatggtgcttaagtctcatctcttacttcctagtcagagatttatggcaatttcgcttcagtttgctcctgggttggataagggtgatgataaaatcctcgtgtagttgtgggatgagaggagtggtttgcataaagtcccgcatactctagaaatcaccaagaacttaacagatggtggcaatggtgacttcaactcccaaaaagaaatcattcacttcatgacaaaagcaaatgagaagtcccctcaaaccagcagcccctggtctgtacctgggcccctgtcacctggtggcactgggagctgtgcacaggcccagatatctgcagttggagcctgttttgctggtaaactcttgtatcgttcaggacacaggctgggcgctgatggaacacagagaacagtatttgctctgttctgcagacccggaagctgtctggggagatggggcacacagacatgaattgtactgaattgtgtccagtgccagcacagttgtaagcctttcttctgtgctaattctcactagagacacgtgagcgagcactgtttttatgcctgttttatcaatgaggacacagaggtcacaaagaggttatgtcaggacagagtcagtgtacagggtgggtctggtctgggttgggtacaggacagtcttggggagttccttccttccagcaatgctaagcttggggagttccttccttccttccagcaatgctaagcagattgcagaggtagaatcagcaggtgctgtgaacagctgcagattggagttggaaggagtaggaggtgtccagtctgaccgttgaaattctccaacaaggggccaagacaagagtgaaaggtgccaagacaagtgtggccagacagtggtccctctagggttggcatagccccaaagagtggagaagggcttggggttgggtgcagcctgagtgatgggtggggtgcagtggggctgctgaatgagagggccggtgcagcagccaggtggacatgagtgctgccccagcccttgctgcatgctgcacgcactggtcctcagtggacccacagggggcgagagctgcttatgtcctgggggagccatccaaccagggctctgatggtcctgagatacacgtattagtttaacagtttccaagtcactttgatcttctgtggaaacctgcttgtacatcagggtctgtcctcgggctgtgacccgctgtgaacagcttcccttccagtgcggtacagatagccaagagtggcctgtatgtgctgagaacagtgacaggacgaagggaaatggagggaaatccagggagactgtggtctctgaatcgtttgtctgtcctgtgccctggtcttctccctcatggtcagagtggcctttccttaagtgaggtccacagggtcacctggagtctccttgaggctagagaggctgcctggggtggggtctgagttctggggtgagggccttgtcttgggagcctggggtgggagctcaaggagggaggggagcggtggcctctgtcagcatcacgggtggccgggttggggaggacatggcagtggggcaggaggtggcccaggcagctgagatggagcctccttgctgtgcagagaagctggacgagatgctggcagccgccgcagagccaacgctgcggccagacatcgcagacgcagactccagagccgccaccgtcaaacagaggcccaccagtcggaggatcacacccgccgagattagcgtaagggccacgggcggctgggagcgctgggtcgggcaggcatgggggtcagactgtcctgggccctcttgacggaggtgagagcctatcatgtggacccctctccagaggggtgtgtgcaccccatggcctctctcagagactcttggggctgtctctgccccctaaatggccacagctcagcacctgctgggtttgctcttgtagcttttggtgcctctgccttcaggcagtccctgtctcacgcctgagaccaccaaggtaccccagctccgctgagaacacgacaaagcatgtctctgttccctgcccacttgccaacccggcgccttctaggctcctcccccaccctcacccagggtcggccagggtctgcacccaccctgcccaacaccgtctacactgtaccaccatctgcactgcccacacagcccaggctccaatgggctgcatcctctgctccctgagggcagagtccagacgtgattcctgggtccaggcacccacaggcactagtgccattggagtgagagcgtggggtgtctcacctctggcttaggaggaggactgggggcccccagtgccctggaacctccatattcccctccctgacccccacagtcattgtttgaacgccagggcctcccaggcccagagaagctgccgggctccttgcggaaggggattccacggaccaagtctgtaggtatggctgcgctgtggggctgcatggggtggggaggaacggggctggggccggcagggtggacttgggtttgaaggacactgcctctctctgcccataactggggtttccagtttccctctcagtcctgtctcttcctggccccagctaaaggatctcatacgttgatggacatgtggggattaggccttccccaacccagagctttcccccggcagccgacactccctgtccagtgggcaccgccccccatcgcctcatccctcccatgggcagtctcatccctgtccccagctgccactccctgtccactgggcacccccacctccccatcacctctcatccctcccatgggcagcctcatccctgtccccagctgccactccctgtccactgggcacccccacctccccatcacctctcatccttcccatgggcagcctcatccctgtccccagctcagctgcctccatcgcggttgctcccttgcagcccaagtgcatgtgaagtttctgaccctcaaaccccctgaacttgcctctcccctacttctccatgtattgctgtctccccccttcacagccagttttccccaaaaagtcacctctactgtccatcttgtctcccgtcccccaccggctcctcagcctgcggcagacttcctctctccatacccaaattgaaactgctcccaccagggtcaccggcggcctccagggccttcctccccatggatgcatggccagcactcctgctgacctcagctggcatttggtttctttgctccttcttccgtgaaacgctcctccccaaagctttaggacaacacttactggttttcccctcctttctcagatggcacctatttcaaccctgccgccccagcctcccaaatatgggaccttttcaaggctgtgtcttcagcctccttcccctctgtgcctcaccactccccagccaccatcacactccacactcaccgtctcctttcctgacccagatggggacatgtaacaagccctgcccactgtgcatccctccagacatccactctcccgtcccctgcccacctgtgcatctgtccacccacacacctgcccacttgaccgtccgttgtccatacaaaccccagcacacctcccatctgttacacataggagtaaacctctcagcacttactacgggctggacactgagcatttaatacttagaataaccatattgaggttgagaccactagtacctccattttacagatgagaaaactgaagcaaggagggtaaatgacctgcccaagatcacacagctgcccaaactcggattcctcacctgcctcaggaccctgccaatttgtgttcacacaaggccgatcctgggccaagtctggggcttggttagggaatgtgacgtgtgcagagagctcagcgggcacattgtgggtgccagggctcacggaccaatggagcccactggggggctccaagcacacctggtgtcacagaaggctgtgtgtgtcggggtgggggtacttttgagctaagatgtgcaagataaatgggagtttctgggcgataatggggtgaactgacagagcagtgtggaaaaggcatatgggtgtgtgacctggtccctcagagactgccaagagttatttctgtaggtgggattgtggggaagaaggctggtgaggctgcagctactttggagctgagaagcgctctcccctgctctccctggcctaaacactgagtgtcttccatggtttctttcttatcctctgcctcacctgatgtgtcggggtgggtggcctcacagccctgccctgcacaggtctcatcaccttgcagctggaccatggctttgttctcatgactgcctgccctggctctgccctctggtccatccctctggccaaatcaggctttccgcagagctgctatcaccccatatccgtccagcttgaccctctgtgcactcctcattgcctcagggccctggagatcggccccagtgctctcctgcttcatctggaaacatttgtctctgcctcccttgacctgggtcttctgactcttgctgttcctgggcccgaccctgcaggtctaggtccatgcacctgccctgcaggccttgagccactctcctaggactgccagttctgcactggtccctcaggcaccctcttgtactcggttgatggatgggtggacaggtgctcctttttggctcctcttggcctgctgggcctcagctgccagcatgcacattggttgggttgtcagactccccaggcccctgccccatgccctggctctgttgctctgggcacacgatgcagcccttgaaacatcaggattttgatccataaacatggagaccacctattacccacctccaaggaccactctgagtctcccccggtagatggcactcacagaccgcgtggcatgctgggagtgctcagcagctgccagtgttagtagacgtagatgctgcctcttgaggttggcacacagtgggtgctcgagaaatgctctctgctatgacctaggcagacaaagagggtctgcctctgcccccaaggggtcccacccccgccccagatggtatcagaacagattccccattccatgctgaggcaagtgacttttctttaccctaagtcagaacttggcatgctattagcattaagtttccccttatttcatctttgcacgtcactcccgccttctgcatcctcaaggtgcgctcattctgcgtcgctccatctaacacataggctgtgggtgttcactgcgtgttcatacacagtgcagggaatgcagcaggagacccaggacgaactgggcacaatttctctgtccagcggttggggatggggggaaggcagacctaaaaatcacgatgatgatgacctcggcccccttcccccattcccaggatactgctgcagttcagccctgcactgtaaaggtgaaatcgccccacaatagttgcaggctgtcctcttgacatgaggaaactgaagttcctagaggcttctgaagttcctggcagatctaaaattcaagcctaggtctgtacacaaaagcccacccttggtaccttggctacaaagagatattatgcccagcaagaagcagtgtagtactggaggcctcattagcactgcggtggctggaggaggatgcgatcaggaacaggcagtctgtattttagcgagttcataaaaatgttgaccaatctcagagtgaggctgggaacaggagcaccacgagacctgggtgtgtgggtgtggggccgtccgccccctgcagcctcactgaacacacctgcagcacgtgtgtccgcatcatgatgtccacaggggtgttcaggaggttgtgtcaggttctgctggacagcaggagcatgagggccctgagcactccagcccctgcacaggaccctaacaatgatgtctgagcaaggcatgcagaggggggttactgaagctcaaaggggctcagggcctggcctggggtcacgctgccagtaggggttaaaatgaaacatgctgggtgctcagcctgcagttccattttgattgatccgtccgttcttcccttcacccactcacccatgcgggtctctgggaggagcctctcaaggcttcctccacagggcacctccttacctgggtgggcattaggtctttctctgctggaggcctggctccagtggccacagccctgctgcccctcaccctgccagtgtgtcactcctgctcatttccgactatcttcctctcacctctggttgcctccagggctggtacttctgcgtcggccttgttgattctggggtggggagccctgtactggcccctccaagcccctcagcagttctgtccccatgtcttgcggggctgtccctgcctttctgggatatcttctcagggcctgcttgatgaccctgggtttgggcaggtcttggccccaacccaggccgtcagagtttgtgtcctttctcaggggtccccggtggggccctcctccatcctgtaactgaacgcacacctctctcctgtcctcttcacaagagccctccccgtgcagccctgggcctggggcacagagcttgggcatccagggaccagcccagaccagggtcttgctcggagcccgggctctgggctccctgtttctcccctgccctccattccccgcccaccacgggtcccaaccccatcttcccgagcattctagctcctcgcgccgggttctgccgcgggcgtccattgtgtccggacggtggcttccccggggtggagtcgggtcaaggctggcctctgtgggagggggttgccggggtccccaggaacctctccgaaggcagcaccaccccccgcccagcgccctggctggtctcaccggcccttccgtccgcaggggaggacgagaagctggcgtccctgctggaagggcgcttcccgcggagcacctcgatgcaagacccggtgcgcgagggtcgcggcatcccgcccccgccgcagaccgcgccgcctcccccgcccgcgccctactacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggtgagcagggcggtgcggggagggatccgtgccttgtccgtggccccgtctgtcattcctcttgtctgttctctggctctcctgttcctccttgttctgttccattccttctgtggcaacccccaacccgcccccgccatccacctctgaatccggtcttgcttggcctgcccgagagaggaggttcttctgggcgtctgacacgtcagggttgctgctcactgtgtccctgttggtgccagaagtgggagctgggctcccctcagagactcaggttgggcatgaggcgcctccatggccctcctggaggctcttggccccagggattcctgtgagttctctctctccctcccgacacaggctgtctttaccattaagggttgttttgtgttttactttggaggtacgcctccctcctcccatcctctctgtggccatgtggctgcccagtgtggctgataccctctgccttacagctgcctcctgccttgcttcctctggcggcttggagcacactgactccttttcttttgggggatctgccactaactccctatttcccatcccagaaacatttgtctcttggcaccaccttagaatcccttaaacatggattcccgtgtgtcatttctaaagtgcagtaagaagatagatggaagtcacgccatctccctgcactccatctgccctcttgccttctccccaccacttccccgtctgtcctgcccctgcccagaaggatctgagcaggggcctggcttgctgctgaggctgtcacagctgccagagccctgggctgatcccataggtctttccttgaggacccgactcccaaggctccttccaaagaggagcccttcgggcccgtgggctgcatggatgctggcggcagagctggtcatcccccacccgcccccttgtctgcctttttaaagctgcttttgccttctgtgcccctaggtctcccctctcctctttgggtctgggggggtggtatgtggatgccacctcttgactcctgcttcttgctgcctggaagaccaacctagtgggccccgtactgtcagccttggaggacagagttcacagcgtagcaacgtgttcagaacttaaggactttgcaggtcttacaaaggcctggccattctaccttctttagttcaggattcaaaagacaggtaggagcttgggaagctcatgaggcctctcctaaggtcccgggatgctgcctccagctcctgtcatcctggggaattgctctggggtcctctccccttttagccttttccaactctcagccaaactggaaagccctcttcccagcagtgcagtgttgaaggtgcccgtagaatgggtgttataatcagagtgagcagcctggtcctaggcctctgtacaggaccagacccctgaggctggggtctcctgacccacacctgaccagcccccatcttccctctctgcttctccctccgctcttctctgcctcttggtcttgatgaaaatcaaagccattttaaaaagtgcatagcacagtgcctggcctggttcgggccctcaataaacatttcttaaatggatgaaagaacaaagcaaaatgcaaatgctgtgttttgtgatttgagatctagggaggtggcttaggacaaaaacccacagaaggacttactcagcgttcagactcatcaggtgtcgatcccccatggtcgggctcaggtgggcccaggtctcgtcattggctctgtcctctcctgtgaggcagctgcagcagttgcagggcagggtcaggggattcctcagccggaacctctggcacttccccttctctgagttcatcctcccacggtgctctttagcattctgtcttgatcagggtacggttctcttagcccttggctctggctttcaccaggaccctgtttgtttttctttctcagatgtgggatggggaaggacaagaccagcagccctgacccttacgtgacgtctgttcttttactcagtagttcctgcaaaattctgatctctgattgggttcatgtgggtcctctgcttttccctgactgatcactggggtctggggacatagggctgtcatcggccaagcttgagtcctctgttctcccaggagccagggggatgggtccgcccacctagcaagcaggtgctgagagtgaggggagggggctctccagatggaagtccagtgctgtcccttgagtaagtagatgctggacagcctgtagcaaccaatgttctgtgacacggcccccactggcatcagcaactcacttccttgccggtcattggcttggagccatcagagggccctgatgtcggtgctcaggaggtcacagcttagtgctgtatccctcccctgtgaagtgtatttacagcgagccaactgcacaggctatcgcgaggctgcacacggcatcacctgtgaagcacctggtaggcccagggctggggcctgtggacccctcactggtgtgagctgccattgtctttgctgtcactgacgacacctaggtgaggtcttagagtcctttgtgggaaaacaagcctgttggatgcagcactggagacggtcctgccgtatcagtttgtcttcacaccgttctgttagacggacactaacagaatcctcatgttccagacaatgaaactgaggtaccagagagcttccttgcagacagaaaacggtggtctgcctgaccatgagccctgctctctggctgccgtaaccagggccgctgttgttaagccccttctgatgacacacaatgggcttttgcccagtaacgcccctccacagaagtggcaggtgtgtgcatggcacagactcacccccgctgtttactggtcatgtttgtcataagtagcacctggtgccacctgagtggcctacccgggcctgcttttccttctcagtttgcctctgtgttaccttctgttccagctcactcttcctttcaccctcttgcgctccttctcgccctcagacctgggctgaactacagccatctggaggggcccctgcccaccctgggcccttaacttccggtgcttctggctgcaggcagcggagcggagcacaggacacttggtgatgtctgagtccagtcctgtttcagatctggtccttgtgtgcccaccgtggctgttgtcagctcttgtcctgcggcccctaatggctggagtccggtactcactgctcacttagggataaaactgctggtggaactgcctaaagtgtgggaggttctgacatccaggtatggctgcttccttcccagggccagtcgtggcagaggcgctaggtcaccctcagggccataccctgagctgtgtctccagccccttgtgttccacagtgtttgtctcccaggcccatccttctcctccctgaccgacaccatgaggaagggaatgcccacccaccttttccagagatggctcattcctgatgtgctttagccacaaggtgttctgtggcctgagagctttctggacaagttaagctgtcctgtatgtcgtggaaccaaagctcggtaacctgtggaaaaatgatgagctctggggccacctttgattttcaggggaacctggaggatgtggcactctcatgctgcctctggaaggtccaggaccttcggccttttgaatcctcgatcccagattgtccacctgctctgtgctcccagctccaagtctagctctgctggacagaccattcatctgcccagagcccctcctcggtctctgggccccacacctgactctgaggctacatttgggcatgattcagacctgactccgagccccacaactggccacaggcaccccatctgtctgaggctctcacttgtctctgagaccctggcttcacacctggctctaaactccatttgtcttccaggccccgtgctcggatctgaatcccatgtggggtctgaggtccatagtaaggctcacgtctgccttggcacttagctttacatgggactctcacatctggttttgtaggtaaagttcatggcaaagtagctttggaaacacaaaaagaggttctttgctgcagtacttctggtgcctttgacaagcttgtgtggaggagggcactgtgtgccgtggtctccagacctgctagagtcagttcctaggtctcccagaagacccatgttcctcaaaatggtcaagaagccctgccctggtggcctgctgcagaccctgcctgctaatatatttgtcagggctctggacaaagcactgtgtgcttggtggatcacactggtaagcagggccaaggccagcagggcctgctcttttgaaacccagactgaatgtgtcacatacctgccagtgggggcccctgcaggccacatgcagctggggcaggtgtgttcccaggatccctgaaccctgttcggggagtaggaaggaggtacagaggaggggtcataggacactggggcccatcagagctggagctgggaacaggcggggtgccgaggagcaagacgtgttaccgcagaggatgcactggaagcttccgagcccatgtctggttttgtgctcctctgagaattagttcccttaatgaggcccctagtttgcaaaaggccacaggcctagaccggccccacgtgagtgcagtggcagaaggcccgaggcagtatcccgggcccgagtgtggacattttcctgcctgttggccctagtgggctgactgagttgggcacgcctggcagggacatgtcatacatactatttttgcattttgttagtgcatctcgtattcctggctttgtgctaggtaccaggaggcaaggagaactggtaagaagtggggtgaagggcctgagaccatgaacggtctggatccagaaatggcaaggggtaaagagaaggtctgggttgatattaggagttagccattggctgtagggtaaaaagaggagctgatggtggctcccaggctctgtgtgtggcaatgacagggtgccgttcactgagttggggatggagggacatgtgtggataccccagtagaggtgttggactcatcagaggctgtctgggtctcacatgtagcattcctgggcacactggccatagcaaagggtgtgagtggataatgttgcccaggagaaactgcaaactaagaggggagctctccgaaaatccatctaggaaggaagaggcctgggaaagaatgtctcgaagggaaacatgaacaggtcagcagcggggtcttgctgaccgcctggccaactgtggggcagagggcggagtggggagggtgtggcaaggccagacctctctcactggctgagagtcactgggaaacagtgagacggtgcaggattcaaatgtaggtggaaagacgtggggccgtgggggcctcagtgtgatctggactcagcctcttcagcgtggctgctggaggtgttcgtgggtgacggtgcctggtgaagtatcatgtgttagagggtgggtggcccagaagctctctgggaggctggcaggtgctgtgatgtggctgtttggcggccggagcctggccagggaggtggccagacggctgagagtgacagtgggtgtgcagagaggccatggaaacatggaagtcagacatggacactgctcgggtttgtgccctggggatggtgtgggcagtaccctcttccccaagagaaagaggagaagcagacacctgggccatgggtgaccccaggcccctccctcctgtgccctggggcctttggcaggcacagccttccttgggcgttttctcttggcctcctgacatctccagcatgctctgggaggcgggagcaatgtgaatggctctcctcacatctcttgccctcgggcccctggctccgtgggtgcctctggagccagcctgccctctgcccaggtctccagctcagcccctgccagtactacccagacaggcacaactctgctctgcccagctcggacctcctggagcccagaccctgctctgggctccggccgagcctcctggctgcgctgcccgcgcctgccctgtgcctctgccttcactgctgtggtcctgcaactcatcagtgtgcttcagtcacacctgagactccaggtacacctgccatcacaactccactgaaagctaagccttggggcaggggcagggccagggtaggtgtccatcctgtgatacaggtccccaggccagggccactttgttggggctggtgggtggaggccaggtgcatattcctggtcctgcccctctctgggtgtccacagtcaggtccctctgagtgattctctcggagtctcctctggcaagcccctccagcagtcaccaccacctgggcacccacccccaggggaccccccgacccaacaccacctggcacctccccttgggaatccccccaaccttggctgcctccccactttggcccactgtgcaggtggatccatggaggccaggtccaatgggagcaaagacagcttattctggtggttggtgcctgtgctgaggcccacctcaggtgttcttgaagcccctttctgtttgggggcacagtgtggcctcttcaggaagttctgctctggatctgagcagctgggaggaggcagtagggacagaggctgaggagaggacagaaatgaggtcccatgggagagacagagctcagatctccacagagggctgacctctcacaggtgggagacaaaagacgaaacctgctttaaggggagccccatgcgtgtgtggggcaggcactggtgatgctgtgtggtgaggacagcctttaaggggagccccatgcctgtatggggcagggactggtgatgctgtgtggtgaggacagcacagaggttggggtggggggactcagcctgggcaggggcagggagagggggtgggagggccactggagaggggcccggccaaagaggatgtcaggggctcagcacccccaggcggccaggcacctgccgagcactgcagccacgcttgtggttcacctgcacttggagactctcgcacaggcgcctctcctccaccagcagctccagctttgtccctcccacagcagctgggccctctgcacctgagttcctccctccacacctggctgcccattgtgtggttgcagctgtgggtcgcgtgggcctggccggctaactctctctctcattgctctctcctgcccatctgcatgtggctgctctgtcgagctgcgccgtggtcccgagcgccggctgtgtaagtgagcatgcccatcccatgcctcttgccgtccacacgctgtgcctgtctgcctgggtctctgctctgcgtggctgtgagaggctctggtgccactgacagccccttgaggcttcccctgacacagtggggatagggatgggaatgggaggacatgggagtgggttttctctggagctatcaccccaggtaggcctcccaccacggcagagccaaggaggggctagagctctagggtcctgtcaggtgaggctgggaagtgagctgccatcggttcttgtgtgtgtgcgtgcgtgcatgtgtgcgtgttgcgtgtctgcgtgtgtgtgctgctgccaccgcagcatgtctgtaacgcgtgtgggcaccgttgctgctgttgtgtgccgtctgtgcaggaggctgcctttgtgttgagggtgtgcacggcctcacacctgccctgcatgtgctgctgctccatacgggtacgagccctgcctagtgtctgtctcctgtgtcacggacctgttcaacctcgtgctgctgccagcctttatcgcgactcagctgtccctggaacctgcccaggatcccctgggtcttctcatgagagcagagctgtgtggggggtgggcggtgaagggtactgcccaagtctcagcgtcccgggtatctgtggatcccgccatgcccagagccggtgtcggaggctggcaggagggagaagcccgccctttgccatgagaggctgtcttttctttggttgggctgcacttggagcctggatggagtggagggggccaccagtcattcctcatattccagccagtcgctggctctggtcccaggggccaaagaaaagggccagggtaaccgtaggatcccaccctttatttcttcctctggccgggctactcccgccagccgcagccccagcccgtttcctcctggaccctgcccgctcccctccgcccgtccccccttggctgtgcgcccctcacctggcgctgacccctctccctccgcaggctcttcagcagcctcggtgagctgagctccatttcagcgcagcgcagccccgggggcccgggcggcggggcctcgtactcggtgaggcccagtggccgctaccccgtggcgagacgcgccccgagcccggtgaagcccgcgtcgctggagcgggtggaggggctgggggcgggcgcggggggcgcagggcggcccttcggcctcacgccccccaccatcctcaagtcgtccagcctctccatcccgcacgagcccaaggaggtgcgcttcgtggtgcgcagcgtgagcgcgcgcagtcgctccccctcgccgtcgccgctgccctcgcccgcgtccggccccggccccggcgcccccggcccacgccgacccttccagcagaagccgctgcagctctggagcaagttcgacgtgggcgactggctggagagcatccacctaggcgagcaccgcgaccgcttcgaggaccatgagatagaaggcgcgcacctacccgcgcttaccaaggacgacttcgtggagctgggcgtcacgcgcgtgggccaccgcatgaacatcgagcgcgcgctcaggcagctggacggcagctgacgccccacccccactcccgccccggccgtgccctgccggcagggccccccacccccaccccgggccgcgggctcggcctgccccttacgacggcgcccgggccaggaatgttgcatgaatcgtcctgtttgctgttgctcggagactcgccctgtacattgcttagtgccctcaccggccgcccagcccacccagcgcacagtcaggaagggcgtggaccagggaggctggggcgggaggtgccgggggtggggtgccctagcgtgaccacctccttcgcagctcctggtggccattctcccagagggggaacctagtccagcatgcgaggtcaggacccgccttggtgactcggggggaggggggagacattgggattctcgatgggggccaaggagcccccctgttttgcatattttaatccactctatatttggaacgagaaaaggaacaaatatctctgtccgtaatagtttcctctcccctcccttctacttccactggtcccactgcagctgcccagtcttccatctccggcccctcactgccactgccaccccacaacggggcaggggacgctccagctggtctggggttggccagggccctagtggcccgccctggggccccagctcggcccctcgcctcgctgagctctagtgtgccccaccgacccttcaggtgctgctcgtggtgggaggggcggcaggccgcgggtcctgctgtgcacccgcgggaccagccggcctgggagaccatcggccgggggggatgagggcagggccctgccgctccaccgcagccatcttcctcacagggtctctccccaaggagggggctagcttggtccccatgctcttgggcaactacagcagagaagcctccctgccttggaccccaaagtctcctgtcctgccctttatgtgtgtgggtgaaactgggtgcgtctgagcacgtgggagccgtgtgtgtgcctgattactgagtggccaccaggggccgctctggactagcgcggggccgtggaggcgtgcaccgtgtgcatgcgtggggtgtacctgtgagagcaccctgtctcctcttccaaagaaagtcagaggccatcctgcaccctgggtccagctgtttgcccagcctgtccttccagagcctcacccagcctgagcggggttccctggtgaatccctgctgcttggggaggccccaagggccccttggaggcagcgcccccaccttgggcttctgagggcatcatagggggacccctagagtcagttcaccacaggccctggggagagtcaaagacccccgagggtgcccagccccccacactgtgactcctcacactcagcgatgacctgtggggtggggggccctgggacgtttttaaacctagggtttggagtctggactaagctccatccacgtcactcacaagtttctgtttatatttctagctttttttaataaaataaaaaaaaaaagaaaacagaagttttcacaacccaggggcctggcacgccggtctgtgcctgcccgccccgccctggcccaccggccccactccctgggcacagagtcacacccactcatccttccgccaacagtccaggtcacacagcagcagtcactgtaacagactgccacatacacactcggtctcacactcacctgtgggttttggttccgttcaatttgggtttttaactttacagggtcagttccgcttcacctccttttgtatggagttccatccggggggtttcaccccctgctccagtcctgaggcctcctgaccctgacgttgtgatacgccccacagagatctatgtttcttatattattattattgataataattattataatattattatgtaataaatttataagaaatgaagccatggctcagttgcctgcttgaggggatatttgtgtctgtccctcataccggccacacaaacctcctcagcctggaccacatgc

SEQ ID NO: 48 - DNA, 105329 bp, Homo sapiens
  source 1..105329: mol_type = genomic DNA
gctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggtcagtgttgccgcggcctgcgccaggcggcgctggctcccctccgtcactcggccggccttcggggcccgctgtggcgaggtcgacaccccccttccccgccccccgccgccgaggcgagtgtttgggggcgcgtggtccgaaggggctggtgccagaagtaggcccctggtggccgcggctgctgcagccgtaactgtcagtcctggctgagcgacggcgggagggttttgtcgcccgaggggacgcgagcgggcccggggcggggcgggacgtgcgaggcgtcgagatttgggcctcctaggagccaggctcttcgagccagccggggccccagacagggaagggcaggccctttccttcaaaggggagccctttctcggcgttttcaaggtttttggctctcttggggaagacatatttagccgtgtgcttggtgggttggggttttgggggtggattgatgggaagggagggcggatgaagtggtatgtcaagcccaagggttgtgcgcacaggttactctgtgttaccggccaccaggatttctgaagttgaacgtgagttattggctttgccagagactgctgtgttatatgcagacctgtatgcaagcagttggccttttttccccccccttttcagtgtagaaaatgaaaaggatgctttcctcatcttggtggtaaaggcttttgttggtaaaggtagaattgaatgtaccaaatgccttagtccgtaaaattttagaaataattttaatacagacactggtgaagcttggcaaccttgaaagagaatttagcgtctacattttttaaatgactttttatggatatgctaaattagtaacagtccaaaatctgtttgagattattaagtggcgagggtgctgttgaaaatgtaaactaatagcatatggggtttacagtgcacagttaacctcaatcatgaagaaatgtggatatgacccgtaattttggatcattttactgcctgcaatattgagagaagcagcaaattattacagttttttttgggagacgacctaaagtttaagaaatacaactgttgaaagttacctgtcagagacacaaaggtacccaatcaatcttgttgaataaattggacaagtgggataaggtgtttgtctcacacttctgatcaataagtactcttacttaagaagtgatttggtaaatcatgtaaaatttagaatttaggagagataagaaagttgtaacttggtgtgtatagtggaaatagctttgaaattagatcctgtttttaaatccaagctacttaccacatttttagtgaaatgaatacattattaatgatgctactgataagccctaaggatgaccagaagcccttttaagaaacactaatacagttgaccaaaaaataaaaaaggaaatagcttcaagaaataattttcaatctttgtgtatttataatatacacaggagaaataaaagaacagaatatgaagaggtaacttataatctttacaaaattagaatgtaaactatgctagtcttactgtgtcaatatttattaacctgcattagtttgctaagtagtatgctcactatcctctggacattgcccctgtccctgaggagcttaactttatacagagatacaaaatactgtgttttgatttcctttcagaggatttataagctacttatgttttatctgtcctaaattctgcccttttttttcccatggctgaaaaaataacttcctaagaaaggtacatactagtcagaggtgtggggaaaacgtgttctcatcccacttgtgcagtccatttaacaggatttattgggtacctacagtgtctttgacatgtaacatttaatcagttgtatttcttaaactttagataatttctatttcgatcatttctatttcaatctcctccctctcccctccaaaaaaatttactgtgtaaactgtgataatacactgtttctctcagtgtcagtcagtggaatgatccagatttataggtcatagcaaaatttttcatcccaagctcttgaaatgatgtttccaaatgtccattttcttaaatgactgctagttatgttctccaatcatgttacacatattttgtttagacttataattgtgtaggtctaaatgtagaaacattacattatgtacatatgcagctgctgaaagaaaattagttttctaatttttagatcggggtgaagacaaacttttagaagtgatctttcggtaaaatactggatgaagtcttaggtgctctttttatgttggttcaggacaaaagttttttgactgctttttgagttttcccctcactgccaaatgtaaggataaaatgtagtaacaagacatcttggtatgtatagtggtaatatctttggaattagaccctaattttaattctggccttattaatcttggtaagccacagttttgtcatctgtaaaatgggttggtgaaacttccccagagttgtgaggcttaaagtatgtaaaacgcctaacacgtaggcactcaataagtattaccttagaaatcttcctatccagtttttctgaatggtctggaagcaccttgtatgtagtggactacagcatgttatcctttatgttgtttatttcttttctcattagctatgaactttttaaggccaggaattcctagtgtttaccagagaatgtgttactagatgtcttagtctgttctggctgctattacaaaacaccacagacagcatggcttataaacaacagaagtttatttctcacggttctgggggctgagaagtccaagatcaaggtaccaacaaatttgacatcttagtgagggccctcttcccttgttcatagatagctagctgtcttttcaccattacctcatgtagtagaagagtagacggggctctatagggcctcttttatagaggcattaattccattaatgatggcaaagcttcccaaaggccccacctcttaatactatcaccttggaggttaggctttcaacatgaattttgggggacacattcagaccacagcactagagcaggcatgaattggttattggtaaatcagtaaatgatcaactaacatttattaggttcctcctgtggcttctatgagctgagctaagtacaggacccacaaagacaagaaagatgtctgtcttttttgaatgcttatagttgagtgactttctcacatttgtgtgtgtgtgtgtgtgtgtgtgtgtgtaaaaccctatcacataatggaacttcattttcccatgcccttccaatctaagagcagttctatggactcaatacctcctacccaccagctgctactgtaaagatttacttttttactccttttaaaaagttcaaccctctggcacatgcattacttcattccttggtcccagcccaccaccccagtatctggcacgtagtgtattagtatttgtgtgtgtgtgtgtgtgtgtgtgtgtgtgtgtgtgtgtgtgtgtgtgtgtatgtatatagaatttaaaatttttactccggcagttgtcttcaaatactctaattttggggggcatgattatcattctgtcttctggcagtacatggatagatgctacctgagtaggattgtctatgaggtcagctgctccagtcattttatacaagaggaaattggagtgcaaagctttaaaatgattttcttaaagtcacccaggtgtcagaaccagaaccagagtccatgtctctagttcaggactctgcacacattggcacatgttctgtcctaccttttgggatgaatagttatacttgctttgtgattactcacccacctttttggagacatatgagtgttttgtacactattaatagaaggcagccttcacaaaatgccatctgcagatctgttatttcttctaataaaggaaatgatgtaaaattaccttaaatagaaatagtgttaattcttctggagacatattccataatccaaacacgaaatgtttgaaatacttgaagatgccatataaataagtcctttgtaaaaagataatattaaaaatttttgttttatagagatgggggtctcactgtgttgcccaggctggtcttgaactcctcagcttttactttagcttcccagtgtgttgggattacaggcatgagccacaatacctggccaagtccttttttttaatcaaatgacttattaatacacagtttctttgccagcttttgttttcatttgctatcaaaaatgttgcttagtagtgctttgatctgagttatcaataacaggtaaatgccattatggataataattcaaaaagaagcttattaattattaggcctatctgagagtgaagtaaagttagcattttctttttgtttattttacttattgtttatttgtttagagacagggtctcgctgtgttgcccaagttggagtgcagtggtgctgtcataactcattgcagtctcaggctggagtgatcctcccatctcaccctcctgagtaggtgggattagcatatgccaccatgcctggctaatttttttattttttaatttttttgtggagatggggtcttgccgtgttcaggttggtttcaaactcctggtctcaagcggcttggcctcccaaggtgctaggattacaggtgtgagctaccatgcccagctgagcatttttaaaaaatactggtctttgtacatgagtcgttactatttgattctaagccttatgactgatatccctaaaaattatttataaaattttaagtgcatcagagtcattgaaatggaatgagcactgtcttttggtcttgaggttgttttaactagcttcgtaatggtcatgagcaggttatttagcttttgaagccttcgttccttcttttgtcaaatgaaagtgatagttgctttgttttaaaagagtatgcttttcaaacgtgatcattcttgaaaatgtagattaagagctttttagaggccaagtgccatggctcacgcctgtcatcccagcactttgggaagccgaggcgggcggatcacgagatcaggagatcgagaccatcctggccaacacggtgaaacctcatctctactaaaatacaaaaaaaaaattagccggacgtggtggcgcatgcctgtagtcccaactactcaggaggctgaggcaggggaaacgcttgaacacgggaggcggaggttgcagtgagccaagatcatgctactgcctggcgacagagtgagactgcctctcaaagaaaaaaaaaaaaactttttagaaacgttgttttggggaatttttagtgtgtgaattcattttaaatatgtgaactccatttgacatggacaatggatcttaatagtttgtgatacattattcagtgtattaatcaaaagtcaaatctcttttgtaatttgctgtaccagacctgttgtgttaatctgatcaatggcaagtgaatcataagattgacctgaaaggaaaagatatttttaggggacatagaatcatattggataagattattcctatagttcattttcaggaaatctgaacaggaatctcgtgtaaggaatcacatgtgaattatagaagagagtctgatgtaagactttatttattaaggtctgcatctgtgtttcaagtaagagcatagaggtagtatatgagccctgaacactcatacaagtaggataaaatttttcttaaaactgttggctggacagtgtagagtctaatgctgtgactcttaacagttttgtgtgttccagaagttcatctcctcaggatcaattgaggttagtctagcacagactttagttatagaaaccaaacatgagaaaaattttttgacccatgtcttcgtagcatgcaggcttggtagctctttcctagttctggatgtgtgcccgttgtatatactttcagcaattcaggatgttccttttcatatttaagacaagcactcttgcatacaaattacatagctgtgggctgaatgaagatgctaccattgctgtacttctacacaggttcttttcatgtaatgaaatcagaagggatggcttttccatttcaagcttctgttaataagtagtcttagaattgcctttgtgtactgtagccaacaccccaactcatatatttttataatctttgtgatgcagaataaattctgaaactttccacctcctaattaaatatagaaatactgaaaacaataaagcaccatgtattcactatggacatatgtcacattttgtcactttcttgcactcttgtaatccctctctaaagctcatgttaaactcatgttctttattttcttctcagatgattcctttggcactgcatgtaacagtacaggaatttcttcctttcgtacttccaacaaatacttttttgtctcttaacagatgtgaaccataatgctgttctttagaaagcaaaggatgaagtgcacagcagtgttttctatataaagctaatgggtcataaggggaaatatgggttatttccagcttgttaattgtcttaatacatttttcctaagaattctattgtgcctctgtggttatatgcaccaatattgataatcttacagcgtgccataaataaggatttttatattatctttgctaaatattttaagtttttgttttgggaattgaaaaaatcttttgtgcatctatggtatgtgatacgtatactaatggataaatcctgtttcacacaaagattaattgggtaacatttttctttcctagttttctgaagtcagtggtcatgttgtgtgttggtgattgaaaatatgctgtttaggctgggcgccttggctcactcctgtaatcccagcactttgggaggccgaggcacacggatcacctgaggtcaggagttcgagaccagcctggccaacatggtgaaaccctgtctctactaaaaatacaaaaattagctaggcgtggtggcacacgtctgtaatcccagttacttgggaggctgaggcacgagaatcgcttgaacctgggaggcagaggttgcagtgagctgagatcacaccattgcactccagcctgggcaagcaagatttcatctcaaaaaagaaaagaaaagaaaagaaaatatgctgtttaagatcattcaaattcagtttctaagaagtgtaaagttttcctaattacttaagctgcttcattctcattcccttttgtaacacattttgccatctctgtaacatgttgaacatgtttaaagaacagagtgggagaataggaagttacgtggataaagtttggtaatcaaggtaggaatacatcctgcttcacagaatgggaatatttctgaaaagttgactgtagtattgaagaacacttaagtgtagtgtattagacgaactgagctaattttggtcttttatacacataaatcaagatttctgcatttcaaatcatgcatatttctttaaatttattgctcagtgtactgtatttcaaatattgtaaaaatgaaaagatcttgtggtcttatttaactcagtatgggataagtccttcccaccttcccattcttattccctcttttaggctgaatgaaaggctgggggagtgaatttaaaaatagatggatctcagctggagaatgggttggtcacgtatctcaactgatattaaataatttcttaaatcctggattgaagattataagaaaacagtaaatgtttgctctcagttcatttctttgttttgttttttcatgtacagttttaggcacttgtaactgctggatgcatgaactactttctagttctttcaggcctacttttagatatctgctgtggggacagtcctcaacacttaaagtaattttaaatagtgataggcagaactaggggtcagttttactgcctatgcctgtgctgaatttgacatggcattcctaggaggggaggtggaacgagggcggtgcacacattgtccatattgctagtcagtgccagattttgagaaactggggctaatctctctcttaaatggtcaagatctaattccccaaagtgctgtttcagataacctagtatttgtccaaaattgccctgctacaatagtatttatcttatatatatgtattatatatataatatatatataatcttatatatatgtattatatatattatatatataatcttatatatgtattatatatataatatatatataatcttatatatatgtattatatatataatatatatataatcttatatatatgtattatatatataatatatatataatcttatatatatgtattatatatataatatatatataatcttatatatatgtattatatatataatatatatataatcttatatatatgtattatatatatataatacatataaatatatatatatatatatatataggtttttttttgtttttcctcctgagatgtagtctcgccctgttgcccaggctggtgtgcaatggtgcagtcttagctcactgcagcctccgcctcctgggttcaagtgattctcctgcctcagcctcctgagtagcagagactacaggtgtgcactaccacgcccggctaatttttgtatttttagtagatacagggtttcaccatgttggccatgctggtttcaaactcctaacctcaggtgatctgcctgcctcaacctctgaaagcactgggattacaggcatgagccaccacaccaatcctattacattcttaaaaaaatgtttgtttgtttgtttttgtagagatgaagtttcactatattacccagcctggtcttgactcctgggctcaagtgatcctcctgccttggcgtcccaaagtgctgggattatagacatgagccactgcgtccagcctgtatcatatttttattctgatatcttttgtaattttgtttttagtgaagtagggaggtttatattagataatcttccaaggtaattatcagcttggacattatatgctaatatgtcttttgtttgtttttaaaataagtgtatatgttttaattgtaaaatttttaaaacatccagaaaatgacatagcaagtgcctatttatccaccacctggaaatataaattatgtccatttttatcccttgggggaaaggatgcagttatataatcacttttaacaaccccaactgttcaagtcctgttacccgtctctacacaaagtaacaactgtcttgagattcttaagtaaatttcacatccttgttttatacttttactatacatgtgtacatgtatctgtaagtgatatgtggtgttggtttttgtattaaatttttacagacatgtataacgctgtctttcaatagcttgatttttttaaactcagtatcaagtttttgaggtgtatatgttgatgcgtgtacatgtagtttattcagtttcactgctgtatggcacttcattttatgcatagataaaatgtatgtgtcccactattgatggatattttgagttgttttctttttgctattataaataatgctgcagtgtttatttttacatgagtgtatgtgcaggtgttttgggaaaaaccgtagaagtgaaattgctggttactagatattggtaaattcttttcctaaatggatatgcccatgtatactttatcagcattatgtgggcatttctagcatcctcacccatacttgggattgtcagattttaaaatagttactaatttgaggcatgtgaaatgctatctcattttaatttacagttgcttgattattctgaatcgtaggtaaaaggataggaaatttattattttctgtatgttttaaatatctcaaaaataaatgtttttaaaggaaaggcacactatcgtacaacatttatgttgaaaaggaccatgaagatcatttcatccaaccttcttactttacagtgcagccaaagaaagttaccagaataagagtaaaatataaaatcctgcccattgtagtattctctggtagtatgagccttaatttttgatgtaaaaatcatgtctttttctttatgattgtgctttttgtttaagaaatcctctttttatattgtctgctaatagttgaggattttttgttactctttgttatttgcatttaggttcatctgaaaggagttaggattttttattttaaatatgaaaagctagttgttccagcattaagtattgaatttttaaaattttgtattgaggttaaatatacatacataatttaccatcttttttaagtgtacagttcatttttaatgattttttaagtgtacagttttttaagtgtacagttcagcaataataaatacagttatgttcttctgcctttgtcctctcactccccacttcggctgctagtaaccaccagtctatgcttatcttcttgagatatacttttttagcccatgtatgagtgagaacatgtggtatttgtctttctgtgtttggcttatttcacttaacataatggcttcttgttccatccgtgttcctgcaaattacagggttttattcttatttttatagctgagtagtattccactgtgtgtataaactacattttaaagtctattcgtcctaattattgaattctccccaccccacccacctttttttttttttttttttttccaggagacagggtctccctctcttccccaggctggagtgcagtgccatgatcatagctccctgcatccttgaaccccctggcctcaagcgatagtcttgcctcagcctcccaagtagctgggactgcaggcaggcacctccaggccctgctaagttttgtgggtttttttttttttttttttttttttttttgtagagatggggtcttcctatgttgcccactttggtttgttagttttagtagtttataattcctttgtattattgtgaacaaataacagttattttgaaatagaagagtgctttctatttaaaattttgctttgatagggttctgtctactttctgagccttaccttcctgtgcattcccctttggtcagtaccatcttaccacacaggctgcttttagtttcttgagttatccatcttccttctatcttatagggctcaacctaaatattactcagggaagccttccttgagagtctttctttttgcactcattggtttggggcttctttatattatactgttaattgaattctgagtcgtgtttatctcaactgagattaggtaatttattttgagaacagtaaatgtttatcatctgtcattctttttttcatgcccacattcagttatttgtaagtgctgaatgtataagtgttcatctacagataaggatcagttcttttttccccaactagaaatgttactccagttgataataacagctcaaacggaaatataaggcagaggtgagagagtcacttgaggccacgaattggagaccagcctgggcaacaaagtgagaccttatccctatgaaaaataaaattagcccagcttgggaggctgaggtggggggattgcttgaaccctggagttccaggctgcagtgagttgttatcacaccactgcactccagccgcggtgacagaccctgtcccttaaaaaaaaaaaaattataaccagccacattgaaatattttgtaagacattaatagaagactaaatgttctcatatgtttactgtttgtgttaagtacgtatggtttttagaacaacagttttctatcaagtgtggtctggttcacttagaattagatggggtagattttttgaaaagcgttttgaagttaaattagaagctaatggttttttgtcactaaatcaaattttgttttatgcgtttaagtgctacatttatttgataggcaggtgaatgtaacagattaaacttgaaaataatgtagctatgattccttcaaggaaaaacccacctacctttagttcttttagtatattgcattataagtcttttgtgtgtgcatatatagcaggcataaattggcataattctgggtttaattttaggctaggcgctatggaagtttgaactctaattacagtgtaaaaataacccagaggaaaatttcagaataataaatcattgggactatatggtacagatgtccctgttttcagattgtagaattgttgaccagtaggaatgctttatgattaaaagccaggaaattaaagtaattctgatgatttggtatttctaaagattttcatagatgacagttgagaactactctcagatgagattcttccattgctggtaagtcatgtaataaaacacttaagtaaatattttaatgaggaatgataacattttaatattggcacattgtgagtctaccttctgtagttagtaggtaaataagaaataaacataccttatttaaaaaaaaaatttcaaagaacccaagggaggggagagccaaggtgcacattagaaggagattacagtactcttccagtgcacagtggatgtgttgtgattccagagttctatgtatgtatgactgtgtagcccagatttaccagcatgggctcagttttaaatgttaggttaggctcataaatcatgaaaagttcctaggaattctaacatttttacatttccagaagagagcctcttgtattttgtggtagttgccccaccatccctcaaatattggtgtgtagaatctatttttgaggatgaggaaatacagaaaagaaaaataaaaagctatttttttttaagtataagaagaaatgaaaggtttctcttcgcttcatagccaattctaaaacttaacagttgttaagtgtgtttaactgtagagggaaaaaaatgcctggaaggaaattaccaatcaaatataaaatgtaagatagctgtaaaagtactgatatacatacagcttttttccttttggggaggcagtatttaaaaaaaatcctaccaaacatattctctaactttcaaaactgttaatagctttattgagataattcacatactataaaattcacccttttaaagtttttagtatattcacagttctgcagccatcaccactattgaattttagaacattttcatcatccccaaaataaatcctaacctgttagcagccattccccattctttcctggcctctggaaaccactaatctgctttgtctctatgaatttatttattctggatatttcatataaatgggaatcatacagtatgtgtccttttgtgtgtgggttcttttacttaccatggtattttcaaggtatgttcattgacatgtatgtctgttttttttgggtaacacacactcttgattactgtagctttgtagtaagtcttgaaaccaggaaatgtgagtattctaacttattctttttcaaaattgttttgggtctctgggtttctcaaatttccatagaattttagggttagcttgcaaaaaaatgcaactgggattttaataggacttggatttgtgttgaatctgtaggtctatttgggaagtattgctaccttaatactgtcttctcattcatgagcatgggatatctttccatttattaaggtgttctttaatttctttcatgttttgtagttttcagtatacaggtcttgtacttattactttaaaaatttatttctaagaattttatgttttgatggtattgcaaattgaattttttaaaatttcatttcaggtttttaattccttgtgcatagatttttgtgtactaaaacttgtgtttcatataatttttttttcctcttaactgtgttataggaatctttcaaatggttggctacatacacatccatctgattcacttagtaaacatttcttgaacacctactgtgtagtgggcctttttttctaggtcctggtagagacagcagtgtataaaacccactcagtcctttgctttcatggcacttaaatcctaaaaagagatcataaagataggtaaaatatatgttacatagtgctaaggagaagaaacaaataagggaagtgtttgcaggtgaaaaggatgatgggaaattttagatagggtaggtagagaaaacttcactgaaatggtaacttgggtgaagaactgagggagatgagagagctagccatgtggatatttgggggaagagcatttcaggcagagtgtagtgaatagggaaaccccaaagtgagagtgcctgatgtgtttgaagaactcgaggtgtggccagtgtagctttagaaaagtaattgatgggaaatagagagaatggagggtacagatattttgatcataataaggtgtttgatttttacctataagtgagatgggaagctattggaagtctttgagcagagtagtgaaaaagtatgacttatgtttagcaaggtcactctggttgctgtgttaatcatagactgaaaaaggggacaagggcagaaacagaccaattggtagaccattagtacagattaagacgtgactgaaatggacagagtggtcacagtgagggtggtgagaagtggttgaattcttgatatatgttgaaatagagtccataggatttggtagtagaccagatgaaagtgggaaataaagggaggagtaaaacatgatgccaaagttttttgaccagagcagctgagagaatggagttggataattcttataaattattgcattaaatctgtgcatcatatcacatgcccacttaactacaggtaattttaccatataagcttgtggggggaaaagaggaaaaacagaaaaaaggatggaaaagcatgttttaaaatataataaattaggccttaatgaaaaattgtccttgagaaacctgagatggaatactctaaatctgatgtgttctctcaatctttagaactgaactaggaattaactctgagagttcatgatgttatgagaccctttgcctgttttggaaattcggttgttttcaatatttgcttttgcaatgatggtacctgttattttttctgtaaggtagattcctacaaataagatgtcaggccattagatcatgtcaatctaaatatttgataggttttgccaattaccttttaaaaaataattttagcaagtttcattccttaaaatatattagggactgctcatttaccttgttttgattcatgtatatataaaatctgtttaagtctttataaataacctgggaaattgcctggttttttggtccatttctattgtggtgtttgttttttaaatttgtaagcattctttatatatcatttaattctttattataatttgcaaatattatctctacctacctttaattttatagtatctagtcatgtgaaattttaaagtttttatgtaggcaaatctgtccatcttttatggtttctgggtttcagcatgctaacaaagttgatataaatatgatctcatatatatattacaaaaactttttagagataggatctcactctgtcacccgggctggagcaaccatagctccctgcaacctcaaactcctgggctcaagtgatcctcctgcctcagcttcccaagtagctaagattatagacatgtgccactatagctagttggtttttttttggttggttggtttttttttttttttttggtagagaacgtatctcagtgtgttgcccagactggtctcaaacttctggcctcaagctatcctcccacctcagcctcccaaagtgctgggattacaggcatgagctactatacctggccaatctcttgtattttcttctgatacttttgtgattttactttatagactttaatttagaaagttagatatgagcattcagcatatttttggatatggtatgatatggtttagatctggattgcatttgtcatggtttgggaattatatctaccttttattttcttccacttgggtagctgattgtcttgtaaggcatcctttccccactgataatgccacctttttctatattaagttctcacaaactttgaaaaaaatcaagtttattgatgtataattgatacacaatgaaatgcacccattttaactatatagttttattgattttgataaatatatacactatcactgctactacaatcaagctttagaacaattgaattacctccaaaaagttccttcctgtctgtagtcatttctccctcttggccccaggcaaccactgatctgtttattagttttcctactctagaattgcatatccatggaatcaagtaacatgtactcttccatgcctggtttctttcacttggcatgtttttgagattcatccaatttgtgtttgtcacagatttttgtttgtttcgtttttttaaatacaatatgactataccacagttcattcattttctggtgaacatttaaattgttttcagttttaggctgttgcgaataaaggtactgttttgtgtgcatgtttttgtgtgaacatatgttttcatttttctagggtaaataccttaaattggaattactgggtcacatggtaagtttatgtttaaatgtataaggaactgccaaactattttccagatgattatactactttacattcccatcatcagtgtatgagagttccagttctccaaatgtcagcatttgatgttctcagtctttaattgcacacgttctgagaggtgtgtagtggtatcccattgcagtgtttttttttaagtggtactaaaatacacaacatcaaatataccattttaactatttttaagtgtacagttcagtgacataaagtacattcacattattctgcagccatcaccactatccatctctgaaactttttcatcttctcagtctgaaaccctatccattaaacagtaactcttcattgcctactctccctatctgctggtaatcactgttctacttcatatgtgaatttgactcttccaggtacttcatataagtggaatcatacgatttttgtccttttgtgtctggcacatttcatttaataataataatgtccttgcgttaggccattcttgcgttgccttaaatgaatatctgagactgggtaatttaaaaagaaaagaagtttatttggcccctggtgctgcaggctgtacaagcatggcgccaccatctgctcagcttctggggagccctcatggtgagtttactcatggtggaaggcaaagggggagcaggcgtgtcatatggcgagagcaggagcaagagagagggtggggaagtggcacaccctttttaaacgaccacatctgcgaactcactctgtatcccaaggagagcaccaagctatgagggattgctcccatgacccagttacctcccaccaggccccacccccaacattggggattatattttaacatgagatttgggcaggacaaatattcaaaccgtatcagtcatcaaagttcattcatgttgtagcatgtatccaaatttgattctttaaggttgagtaatatttcattgtgtgcatatatcactttttgttttatttatttatttgtcagtggacatttggactctttgtaacttttaactatgtgaatgatgctgctatgaacattggtatataagtatctgtttgagtcccttcttttaattcttttggttatgtacttaggagtggaattgctgggtcatgtggtaattgtatgtttaatttttttagagactgccatactgttttccacagtgactgcaccattttacattcccaccagcagtgaataagggttccaatttctctgcatcttttctaacacttggtaatttctgttttttatttaaaataattgccattctaatgggtgtaaaaagtcattatggtcttaatttacattttcttcatgactgctgttgagaagttttcttttgtgtgtctgttcaaatattttcacattcttttcagaacatatgttctttgtcagatagataaatgtatttcttctgtatccttactgattttctgtccacttactaattaccgagagaggaatgttgaaatcttcaactataattttgagtttatcttccttctgctctgttcattttttcttcatatgctttgaagcaaagtctttaaagttgtgtccttaggtgtgttcacatttaggactgttagatctccttgattaattgatgtctttatcattatgaaatgtctctgtttatcgctggtaatgttccttatctaaagtctactttgatattagtgtatccattcctttcttatgattaatttttgcacattatatcattttgctgtgtttttattttcagcttattggtcatttaatgtctttcttttagatagcatatagttgcatcttgctttcagattgactttttacgatcgttgctttttgattaagtccatttacatttattgcagttggcaatataattgtgtttaagacactatttgttttctatttgtctaatcttttcttccttttctgccttcttttcggttaatggagcatttttggaattttgtattgtctccattattagcttgtccctctgttttttttccccccagtgatacttctaggatttacaatatgcacctttaacttacctcaatctaccttcaaaaatattattcctcttaatgtataatgtaagaattttggaatagtatacatccatttactctccctcattctttttggtattatgatcttaacattttacttctatatgtgttatagattccacagcagcgtttgaaactatttctttcaaaggccagttgtcttacgaagaaacttaaaaactaagaataacattcctttatatttaccttcatatttaccatttttatttatttttctttgtggagattcctttttgtagatccaagtttgttgctggtgttattttccttttacttgaaaaaatttcttaaacatttctaaagtataggtctactggctacaaaatctttcagcttttgtttgtatggaaatgtctttatttcactcttcattttatcgtacaatttttcaaaccacacagactttaaaataattgtagaatataatttcacaacattttgttctatttgttattgtcttctatcttgtccatctatccatcctgtcttcttctagtgtctttttttatgcttttcaaagtaagttgcagttgttagtataccacacccttaacttgagcatgtatgttaactaaaacttagtagtttagtatttttaactagaatttactatgctgttccagttatttattgctgtgtaatacattgccccaaacttagtgccttaaatatcagcaactatttattttgctcatgaatctctcatttggtcagggattggcaaggagagcttgtctttgacaatacattgtaacaactgtttacatagcattacattgtatttggtattataagtaatctagagatggtttaacatatttgaagatgcatgtaggttatatgcaaataccatgccattttatataagggattcgaagcatccttggattttgggatccatgggagtcctggaaccagtcctctgtagatagttgaggtatgactgtagtctttggattgaaagactcactaatttcactcagattcaaggagaagggccatagactccaccacctgatgaaaaaatgacagtgttacattgttaagagcatgtggaatggcttctattgtgaccatctttggaaaatacagttgaccacatataccatttcatgagctgtgacaaatgtatacacctttgccagaaagttctatcagggtatagaacctacacctcttcctagttattccttccccccacaccacccctagaacctaacattgttcagattgttttcatcttagtttagcttgcgcagaactttatgtaagtagagtcatacaatacttatatgttgtaaaaagtttctttttgctcaacataatgtttttgagattcatccatattgttgaatgtttcggtggtttgtgacttcatctgttaagggacacctgggctgttttcagttccaggctgttttcagttcccagctattataaaaaggtacaatgaacatttgtgtaaaaaaagaagtctctgtgtggacatatatgtttcttttttcttggttagttgatgtgtttttctttcagcatttgtttttgatgagaagtctggttatacagtcatgtgccgcatgctgacatttcagtcaacgagatcatagttgacaatagtcatttaagattataccaccatattttcactgtaccttttctaggtttagatgtataaatacttacactttgttacagttgcttacagtattcattcagtatagtaacatgctgtacagctttataacctaggagcacccgggctataccatgtatcctagttctgtagtaagctataccatctaatctagatttgtgtaagtacgttctatgatatttgcacaatgattaccatgctgagagttgttggggttttgttttttttttctttttgaatctgtacatttatggttttccttaaatttggaagattgttgccattgtttcttctatatatatattttttaccacctttactcctctttcatcatttcctctttttctgggactccagttacacatatgttagactgtttggtattatccacaggtcattaacatcatattcattatttttcagtctttttatttccctgtgcttcagtttgctttgtcttctattttactgttttttctcctcccttgttaaataatttcagatatttcgctttatatttcaagaaattccatttgattcattttattcatgtatttttttgaattcttgagcatatttgtaatagctgtttgaaaatcaggttacttattgatttcttgaattttttcactctgaatttgttggttggttttttctcttggtcatgggttgtattttcctagtatttattttattttattttttgttttttacatatttaatgattttttaagattggatgctggacattgtaatattttgttgttgggtgtctagattttgttttcttttagagtgttttgttttgtagccacctaaataacttgctggtcagttttatcccttcagggctacattggagtttgtctagagaaggctttgctttaatggtagtagctcctacctaaggcatgatccttctgagtctttactaaatgctcccagtgtcaccgtgttctcttcactcaggttagagagaattttaggagtctcccagtcctttataagtactgggaatatttcagcttactgcccctctttcactagcttcatggagtcacttaccttaatcgtgtacagttagtactcagcagtggactctcaaatggcagatttctgaagccatttctctgccttctcagacaagcacttgtctggcacttgtcatcaattttacccacttcagctttctcagctctgatctcttgattctgaactcagtaaaactgctgtcttctcactggatttcccctccattgactgcaggttggaaattacctccaggcagacatccaagcagtggatggctcacctcctttgtttttgtcctttcatgcattatagtcctctgctgcctgttatccaaggtctgaaaattctcgtttgagaaggagcaactgtcagatactttcggatctttctctgaaattagctttctgttgtgcttgttgtgcttacctctttgtctaatgctaataccatatgaggtttttttttttttttttagaatgttttaagctatacacttctaagtgtatagcttgttgcactttcacacactgagcacccgtttagctagcattcagatcaaaaaacagcagcagctcctgcgtagccccttgtgctctgtgtcactaccccttttcttccatgtgtaaccactgtcctgacttctcatagcatagattagatttgcctgttttcatcctttaactagaatcaagcacatttagttgtgtctgacttcttttaatgtatttgtgagatttattcacattgttggttgtagtaattgtttatgatagtcgctgtatattccattttaagaatggaagtgatattccattttaagaatatgccatagtttaatctgctgttacggacatttaatcatttttggtttggaactgttaagaatattgctgctgctctaaacatttcagtgattgtcttcttgtgaatatgtttacttctgtttggtatacttaagagtgaaatttttaagtcataaggtatgcatatatttagtgtatactcagttttttaaaggcatgccgattttaattattccatttaagttaatatgttttaatatctggtagagaaaggaacattattagaaacaattgttttggttattcttacatatttagtctttgaaaaaacgtttcttaaattggcatttacttatatttgtgttaatttgggaagaaatggtatctttgttcatctatgagtcacatttggaactagctcaaaggccatgggtcctgattccttttttttttttttttttttcttgtagaggggaggtatggtgtcaagaaaacatagtcaccattattacgaaaagtaaaatatggaagagatgatccctaccatcaatcagcttacaactagaggcactgacaaatgtatacagatagctgtaatgtaaggtataacataataaatataaggagaaattaataaattattttatggtattaagaatgtataataagacatgaaggagatggtgattatgtataagagtttagataaccctgtgagatacagtgtttagaatgaggccagtttttaacatggcatgataggtgggtgggggatagaggttagtaatggatagaggaccatttccgagtgaagtctcctcagaagcaaaagcattgaagtcagaaacacaaatatccagtacattatagccaatagtcaaatgatgggactagatctggtaactggtgatgatgtcatatagtgggcagtagtgctgggatggctggggtcagggccacatggcaggggcctcaaataaaatgtgaaggagttagaaatttattctgttggcatgagaaagtgttaaagcttttgaatatagaatgatatgtgtaactttgagtttttaggaagataattctagtggcaaagttgaggataaaggcaaaagggaaaccagatgaaataatggggcactgtagtaggacagtgttggtaagtttgaggaaaaaaggagtaagagatatttttaaggaaattcatagggtttgagtataaattagaaggcaagtacaagggaataagcgtggtctttagaatcagacaaattagggtttgaatcttaaccttgcatttactaaaggactgaaagctagttccctaagagaaaaattttctcttttgtaagatgcttattctataaacatttgcaagcactggaagtataaaagcaaatgatacacatgttctcttgaagtctggtctagtctgtaagaagaggctgcactggcaggttttgaccaaattgtgtagaatctcatctgacgtgattgggagctttggctttattctggaagcaactaaaagcaatcaaaaaagactggggaataatgtgagaatgtagaaatgtaggggaatttctaaggatgaattggtagcaattggtaaacaatttgatatactgggaaagagagagactctttagaatatgactgagaatcttccaatttgagcagctggactgatagtgctaccatcattacctcacagggtttttcttagtgtgtcttgtaaatcttgcttgtccctcataaagaatggttttccttttcttcagactaaggactttttattacagtacacaacttaacaccccctgtatctctccatcacaacacttaactgtgcattgttattgcataattaattgtggtttttatttgtgcccatttccttcaccacatgagggcaagaaattatgtctagtttttctacctctgcatcttcatccacctagtaggcactcaaaatctagtagacagtttttgaattaatgattatgaagaatttgaaggctgaacaagtatcaacctacacagtggttagggcaaataaaaatgagggggagaaagtaatgaatggcaccaatttttttagtccttaaccaggacagtgagattaggcagagtgagttctttgggaaaataattgagtttgatattagatacgttgaatgtagatgttaatgagacatccaaatggatgtgtaccgttggtaatatgtagttgcaggcataccatgccagacataaggacttaaagatacagagttaggggtttgtaagcatagaggtgctatgggaatggatgacattgcgcagaaaattggtttaggttaagaaaagtggctattgacagaaacttggagagaggccatgtatgaggtaggaagatgaactagcagaagaccttattgcctttagagagatggaagaaaatgagtggatacaacattagggaagccagaggaggtgaggagtcattagcagtcttaaaagctacaaaaattaagtaggattaaggggccaaagcactgggaatatacagaaatgatggaaactttacaagaaaaatttcagtagatagaaaaatagcagctgagctagtggttttcacgtctttttggcagtaaaaggaaagaagataaagaaatggtactctgaggagctaatggagttgagggaattatgttgcaagtattatttgaaagcagtatttaaaactttttaagtcttaactgcagaatggactggaataaggagaaactaaagcaggaggacttaggaaaattgttgtagtagtcctttaattgtgaaatgtgtaaacggacaaaacttagacagttttaataagtagcattatccataaatataagacaccataaacatgatgcaaaggagaacagaagtgttgggtgttataataaaaagtgatagaaaaaaacagtttgtgaaattaagttttgaaacagctttagaaggaggtgaaggaaaaatagaaatgaataaaatgaaaattttagggaggtagatatagatcaacataggcatttattattagactatacttatttataagattattagactgagccctctgttgaagagataaagtaagagaactatgtctggtattaggattcttatggttaaattggcaagtgagtgtgcctaatatttgtagtgcttacagtttttgttattctgtatttttatagatttggtatatttcctccatgattatgtgttcctaactcataatttggaaggcagggcttcttaaaatgagatctgtgtgtcatgtgaagtatatgttaaaatgcaaattcatttctgcgttcttgggttggtctgaaaaaaattaaaaaaaaaattcatttacccctacttcatgcactgaatgaaaatctttgcgagtagagcccaagtagttgcatttttagatttccccaggtaattctattatagactgaagtttgaaagtcagtctctaaaaccttaaaagttggttaattttatttcaaaatgttttatatgcagtgtattcactttctaccatcaacctctaggacactggataggtttcttaacctttgagatttgctttctttatatgtaatgcagtacatgaaaggactttatttttgttccattgaggaatgttctgattgtatacaaacaagttaagaatttacagtgataatttaggggcttgctttaagcttcaggatttttttttaagagttaagttttgatatatattaagtggttgatttaataaattataattatcgtcgtatattgaagtcctgttttgtgccaggtaggcattatactataactttttaacgcattttctctgctacaataacctgacattggagactcaagggtcagagggtcggcccaaggctgctactctagaaagtggtagatgcccagatttgtacctaacatagccgatgcttagcatatagaatttaattaaaaacaaaattgctataggtatttgaaaggattagagggatatagtcaaatagttttcatatgtgtttagcccttttggagggaggatagagtaaataaatagaaggcactaagctttatggatgaatatgggaaatatggctttgcctgctgaaagcactcaggccacagggcctgcctacctatgctttcctcatcccggcaacagcagtaatttgtttcttgatacgtttttggatgttcataattatagaaaataaatttgcctttatgatgaaatttagtacctttttttttgaaagttcatccagttgtttatgtaaaaagaattgagtgaggtgttttatattttaggttaaaaatctgtaagagcctgattttagaattcaccagctcctcagaagtttggcgaaatatggtatgtttttgttttattttttggaattcgtattgcatgtgtatcttaatgtcataataatgacagatgtgttcagcaaatttgggcccctgccatttttaaagcattgtgtcaggtgctcactaactacacttccaagactgtatgagggacccaggtagggtgctgaaaaaatttacaagagattagtgtgctatgagaggtaaaataatatgcataaaaagattgagagggcaggtttggattttgggctatgagtattaataatagctttcatttgttgttgttgttgctgctgctgctgctgctgttgtttttgagacagagtcttgctctgttgcccaggctggagtgcagtggcaccttcttgactcactgcaacgtccatctcccaggttcaagtgattctcatgccttggcctcccaggtagctgggattacaggcgtgtgccaccacacctggctaagttttgtatttttagtagagacggggtttcaccgtgttggccaggctagtctcgaactcctggcctcaagtgatccacccgccttggcctcccaaagtgctgggattacaggcgttagccaccacgcccagccatttgtgagcacattatgtcaggcactgttctgagatacttagatgttagcttgtttatccatgacagctctatggaataggtactattatcctagttctacctataaggaaactgagactcggagaggttaagtaacttgcccaagatttctcagctagtgaatgaccaaacagagacataagtccagcctggccttggagccttttgagcaccggatctcataaaagaggggactggaagagaggacttgactctagttttcaaaatacatatagctctttaattacattgaggtcaattagtcaattaaaagatattttaactttattatttttgtgtttacaagatggaaagttagacttgtttgaatcttctaattccacataccattagtctcttgagaacccaaggggaagctgtatcatgaccacattgtttattttagggaaggtggtgtttcccatatgacctcagcaatgtctaagttcttattaggcaatgtatagttaggataggagtatctgggagattgcgttatttcttacagatactataaatcccatttattggaatcccctgcaattatttttatatattcaggccaatcctcacctaatctggattttgaagccctgcgttcatagctgcataggtatgggctcaaacattcatgttttaaccgttggtattcgcagataccttgctgttttatattgggttctgaatccacactggtaaccaccttttacgcttgactattgttgctttgaggatgttaattatgaaaggtttcttcctcctaatttcctcatctttccgtagttgatgcctcagatttggcctggataggggaatcgtgaggggaaagaactagttgcacaaaatgatcttttgatactgggatatttcagatgtatggtatctttgccagaactacagtgtcagtaaagaggcctgctaaatttgaactgtgacaatcagaaaagttcagctaaggccatgtaaggggttaaaaagatatttggttgagggaggaggatatgctttcatcttttgccatactttttcatgaaattaaatcttagtagatttatggccaagaaagagtagaatatatttttatgcagtacttaaggggttttgactgatgttttttattattattatactttaagttttagggtacatgtgcacaatgtgcaggttagttacatatgtatacatgtgccatgctggtgtgctgcacccattaactcgtcatttagcattaggtatatttcctaatgctatccctccccttccccccaccccacaacagtccccagagtgtgatgttccccttcctgtgtccatgtgttctcattgttcagttcccacctgtgagtgagaacatgcggtgactgatgttaaatgactttacgtacatacagaattagtgggactagactttgtgtttatgtgtgtgtgtttatgtgtatgtatataactattccattaagcagttgccctccttggtgactgattgctctatcagcttaggaatcttttgactgaatttgtccgtatttgaaagatctcaatctgtgttctgaatctttactcatttacatatacttaaatcttgaaacccagtatagcaaaactaagccaaaacaaacaaaaaaatccatcccttgataggaagtcagtatatctgggttttagtcagtccttcaacactagttccaaaatcttgggcaagtcagttaatcactcggaggctgcttaattttttttttttttaattcttagtatattatctgtcttgattaggtaaagccaaagttgttataagactcaaggtactattgaccaaaatgcttcagaaactataacattacataaaagtacaaggaattattacattttctcaaatgaagagatcatttaagaaaaacaaaatgctggaaaatagtccttaaaaacttttctataataattactcttctgatgaattttacattgacacctaatttgaagctttgaatattattttttgaacaatgaattgggtttatatattaaagtgttctaaccaaaggtttgtttaatttattagagttattaagcctacgctcagatcaaggtagcagctagactggtgtgacaacctgtttttaatcagtgactcaaagctgtgatcaccctgatgtcaccgaatggccacagcttgtaaaaggtaattttgaattattttacagcctttaaaaggctgtcattgtaaagtgaaatacatactgtaaaaatgaagacaatgtatagttggcaggaatactgctaagaatagtgggcctgagagttgacctacttcatttaatctccttaaaatattttagtgtctttttttctcattaaaaatatcagtagccactatcaaagacctatctgtatgtataaacaggaaagtatttctcaaaaaaacttcaaggttttaaacattttactataaacattatagaaaacattaaaaatttcttaatatgcattttaaagtatgccttttatgtggtgaacgttttaactaaacatttctctagaagtttttataacattaataaaactagtatacttttctctcctagagagttacagtggaggtaaaaggagtggcttgcaggatggagaagctgcaccagtgttattggaagtgagccaccatttgaatttgctagctcatgctgcagtattcagattagtgggtgttttgtgatcatattttctgcgattcaaatcaagacctaaaattgattctcattctgagatttacattttattatccaatgttatttggttattgtttcagttttaaaatttctgacttgttattctgacacactttaggataacctaagtcaatagtttaatacaaaaatttccctttggttatatgttttgaattaggttatatgttctgcatttacaagcacatacaggattcttacttccagcaacttggcagtaaaagaataagtagactctttaggagccaaagtcaagcttgggaactgttgctaggtggtatatatttcatagtttatgtttgtttccaagacaaggtctcactccatcgcccaggctggagtgcagtggcacgatcacagttcactgcaactttgaccttctgggctcaagtgaccctcccacctcagcctcccaagttgctgggactaaaggcacccaccaccacacccggctaagagacgaggtttcatcatgttgcccaggttgaccttgaactcctgagctcaagtggtccttatgtcttgacctcccaaagtgctgagattacagacatgaactaccacacctggcatatgtcatagttttgagagtttgaattctaacctcgggactttggtaacttatttataatattctagaaatatactgttattaggatgagtagaaattcattcagacagaaactattataaattactgcaagaaaaatgtctgctagttctgcatatattcatttttctcttgattaaaaaacaatttccaatttgagtagaacaactttgctatgtttaatagacccaggacagatttattttaaggtaataatctttcaatccttcttcttctatactggattggtttaaattacttagcttgtcttatcaatggtttttaatagcctactttaatatatgtaaaaagtagtaattaatatgttacagtttggtggcaaacattttgatgccaaagttcacatattctcttgcttagggaacagaaattgggaagatagatgtagttatcatttgataatgtatttaaactctatcccatttcaggatctcaaaactttgtaacagttacatattgtacttctaagacttagatttgtttttcttcttgtgtcttacctttttgcagtaatatttttattttcctatcatcatgtcctcattttttccctctcttctctttccctgttaattttgaaagttttgctgcctacgtgtttgaaaacttctaatctgcctctcttccctcagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccaggtgtgtcacataggtgatttgcttgctccctgggggagagggtggagtgaaatttttgcatttgtgtcacagccaagtcactgccacctccagcatgccccagtttttagttgttatgtaattttgtgcaaaattgaaaatttaaatacattgcaaagaagatctaaaataaatatttgagctgctggagtcttttttttttttttttttccttttccattcttgtccttggaatctgaatgaattgcagtgagggtaattttgagagtctgataaagaagtgaggggttgttttttgtttttgtttttgtttttagctaagaaatttagaaaacaggtttgtgtgtgtgcgtgtgtgtgtgtgtgtgtgtgtgtgtgactgattttaagattcttgttagagttgcttaaagttggaagcctaaagtcagtgagaagttcacaaatcaggactttgtaatgccaatttgaaaatttagcttttgacctcaaaaaacattttttatctagtttgggaatttctaagtgttagaaatcaatattatattgactcattcattgttgctgatgctgtttataaaagtgaatagatagggaaatactgattcatatctcgtgaaatgaaaatgaaaggctttttagtgacttagaattttaaatatttctacatgagagagcagtagtatatttagaaataacaaagtaactggcaactgtttaaaactgaagttaattcacagctatccagtgcaaaacttcacctcaggtgatacacttttgacaggtaatacatacagtaagtgtatttttagggaaacagtttcattgttgaaccaagataatcatcattagaatgttgtatctgatttaagtgtctttaaacttaccaaggtattagattttagtttgaattgtctggagtagcggtagcggttggcacatttgttcttaaagggccagaaaataaatattttaggctttatgggccatgtggtttctgccacaagtcctcagctctgttcttttagtgtgaaagcagccatagatgatacctaaatgaatgagtatggctgcatcccaataaaacttcatttacaaaactacatggctggcctaagctttagtctgtctgcctagggagtagtttactgagccactaatctaaagtttaatactgtgagtgaataccagtgagtacctttgttaatgtggataaccaatacttggctataggaagttttttagttgtgtgttttattacacgtatttgactttgtgaataattatggcttataatggcttgtctgttggtatctatgtatagcgtttacagtttcctttaaaaaacatgcattgagttttttaatagtccaacccttaaaataaatgtgttgtatggccacctgatctgaccactttctttcatgttgacatctttaattttaaaactgttttatttagtgcttaaatcttgtttacaaaattgtcttcctaagtaatatgtctacctttttttttggaatatggaatattttgctaactgtttctcaattgcattttacagatcaggagaacctcagtctgacgacattgaagctagccgaatgtaagtgtaacttggttgagactgtggttcttattttgagttgccctagactgctttaaattacgtcacattatttggaaataatttctggttaaaagaaaggaatcatttagcagtaaatgggagataggaacatacctactttttttcctatcagataactctaaacctcggtaacagtttactaggtttctactactagatagataaatgcacacgcctaaattcttagtctttttgcttccctggtagcagttgtagggaaatagggaggttgaggaaagagttgagtttaacagtctcaacgcctaccatatttaaggcatcaagtactatgttatagatacagagatgcgtaataattagttttcaccctacagaaatttatattatactcaagagtgaaagatgcagaagcaaataatttcagtcactgaggtagaatggtatccaaaatacaatagtaacatgaaggagtactggagtacccaggtatgcaataggaatctagtgtagatggcagggaagtaagagtggccaggaaatgctaagttcagtcttgaaatgtgactgggaatcaggcagctagaagcatgagcggcttattccaggcagaagtatgagccaaagttagaagcagcatagggagtaggggacaataggcagttgaggacttttagatcataaactagctgagaggtaggaaaatgaagaagataagatgtgatagaaggtattagggagtcagcaaagaatttgctcagtaggtagatagtaagtttgtcaaacgtgtatttttaataaccttgcaagagagaaaggattgaagagaaacgtgtggtggtaaggtagttcagtcagtgagagccttgacaatgacagtggtataataggaattcaaaataaatttttctggatttaagacaaatatttaggacatgaagtaagtaagactttagtgatttattgtgaagactaaagatgtttcagataatagaggtagtaattatcaaagcaaagtttttcgaggtattaagggttggaatgaaaaatacaggtgtatctctcatacaggtaatataaaaaaagaaaaatgcagatatagtgattgaccttgaataagaggaaagatgcccatctaatgaaattagaacaaggaagtaaagatggatgtgtgatattaattgtaattgtgggtgagggtggaaaaatcaagatttttttactgaaaatattggaaccttatttaaatgccggtatatattgtgaatctgcaagaaacgactataaaatgtatttctcaaatttatgtgacccaaccatgtgacttgtcttttaagctttaaaaaattgtagtaaaatacacataatgtaaaattttccatttcaccatttttaagtatttggctcaatggtattaagtatattaatattgttgcacagtcacgatcagaactctctgttttgcagaactgaaactctgtacccattaaacaataattcctcatttccttatcttcacagcctctgacaaccattattctactttgtgtctaattttgactgctctaagtaccccctataagtgcaatcatacagtttttgcccttttatgattggcttattttacttcgcagtgtcatcaagtttcatccatctttagcatgtttcaaaatttgcatcctttttcaggctgaataatgttttattgtatgtatataccacattttgcttatccatttacctgttgatgagcgctcaggttgcttccatgttgtagctattacagataatgttgctatgaacaggagtgtacaaatatctttttgagaccctgctttgaattgttttcccagaagtggaattgttggatcatatggtaattttatttttaaaattttgagaaactgccatactcttccagagcaactgtacctatttgcgtttctaccactagtgcacaaggggtccagtttctctacatccttgccatcacatattgtgtgagagtgtgtgtgtgtgtgtacttcaatagtagtcattgtagtggatataaggtagtatgttactgtaggttagtgaccacgaaactttttatgaaacattttttaataatattttgtggaatacaaggtttgtttagaggttttgagaagactgaaaacttaggaagctactgaggggaatgggtgaagaagtggatcagaagttgagagtcttgactggctggctacctgaaatcagaaaccgtatcagagtaggagaatctcattccactgagtgactagttaagattaaagactttatcacatttgaaatttaaagacttttctccaatagccagaagattatgcatggtattttagggttggatattagcagagctgatggaacagaatcattagtggcatgtgcataagatgttaacattggagtatttgaatttatatgctgtggatgatggccatgattggaaaggttgggatgccagaccaaagtgttgagttgttttaagaaaagcctgaggtctagataacagcaagatggcagactagcactttgcagcactcatctcattgtagaaccatcaatttgaacaactgtctacacacaaaaatataagagctaagaaaccagacgagagattacctgaatgtggcacacagataagaaaagacacattgaaaagggtaagaaggacagttttacattacttgtgtcacacctccctcagtccctgagatcccagcatggagagagagactgttcacctgggggaaggaggggaagtgtacaccagacttagaccctaacattgagctcgccccagtaaaactcaatgctaggcaggcccccatggccccaaacttcaggccaatacccacaaaccaagcttggaggcccaccccagcaccaagctggatcccacagccctaggctctaagcctgtctagtgctagggtggtccctgcagccctgccctctagatcggcccctgtggcctcacatcactgcagaacaagggtccaaacccagtacttggccagccccttgtgatccaaattctaggccaacatccacctacccagccttcacactggtccttgcagatccaaggttcaggctcactctagtagaccaggatgccaggccagcagcacctgtgtaccaaggctccaggacctaccctgctgacccagactccaggccagccccggtagactcaggctgcataatctctggacaggctgactggtgaagggctttacccaataaagtcactctgcaaagactggaacaagtctcagcttcttcaaatgtgcaggtgccaacacatgactacagggatcaagaacagtcagggaaacgtgacaccagtcaaaggaacacaataaggcacctgaaccaaccataaagaaatggagatatatgaactgcctgacaaagaattcaaagtaattgtttaaggaagctcaatgaatttcaagaaaatgcagataaacaattcaacaaaatcaggaaaacagcaatcaaaatgagaaattttgagattgaaattattttttaacaaattctgaagctgaaaatgcaataaatggaatgaaaaatgcaaaagagcattaaaagcagaattgagcaagcagacaaaagaatctgaactcaaaagacaggttatttggctagactaaggaaaaaagagatgactcaagataaaaaaaataaagagttgtgttttttgatgataaaagcaacaagtctttagctagactaagaaaaaaagagatgactcaagttaaatcagaaatgaaagaggaaccattgcagctgataccagagaagtacaagaaataagaggatcataagagactgaacaattatatgccaacaaattgattaccatagaagaaatggataaattcctagacacatgcaacttgtccaagcttaatcatgaaatgaaaaatgtgaacagtccagtgacaaggattgtatcagtcataaaaatatctcccaccaaaggaagcccaagacttggtgactttactgctgaattctagcagacatttaaagaagaactagtacagattgttctcataattttatgagaaatttaagaagagggagtaatttcaaactcattttgggagatgagcattacctagataccaaagccagacaagaactctccaggaaaagaaaattacagacccgtattcttaatttagatgcagaaattctgaagaaaataataactaaattcaacagtgtattagaaggatcatttactgtgatcatatgggatttacctcaagggtacaaggattatccaacagacctgaatccataaaatgtgatatacaacattaggagaacaaaggccaaaaccatgttatcatttcaatagataattgagataattgagaaaaagcatttgacagaattcagtattctcttgtgctacaaaattttaaaaaattaagtatagaaggaatgtacctctataaaataaaggccatattgacaaacacactgctaacgttatactgaatgttgaaaagttaaaagcttttcttttgagatcaggaagaaaacgagaatgcccacttttgccatttctattcagcacagtaccggaagtccttgcaagagcaattaggcaagagaaagaaaaggcatcccagtaggaaaggaagacattgttgtccctgtttgaagatgacatgatcttgtatatagaaaaacctaaagactccaccagagaattgttagaactgataaattcagtaaagttgtaagatataaaatcaagatacaaaaatccgtagaatttctgtacattaatgacaaattatctaaaagaaaaatcaagaagacaattccatgtataataggtaccaaaaacaaaacatgcagtggctcccagtatcagtggttctgcatttgcaaattgaaccaacatttggatgaaaatatttgagaaaaaaatacaacaataaaaatactgttttcttatacaataaggaaactacagtatagcaactatttacatagcatttacgttgtattaggtactaagtaatgatttaaagtatacacgaggatgtgtgtaggttgtatgcaaatactataccattttatataatggacttgagcatccatggattttggtatctacaggagatcctggaaccaatatcctgcagataccgagggatgattgtacttagaaataactttaaccaaagagttgaaaactatgtaacattgattaaagaaattgaagatgatacaaataatggaaagttatcttgtgtttatggattggaagaattaatattgtaaaatgtttttattatccaaagcaatctgcagttttaatgcaatcctgatcaaaattccaatgttaaatttcacagaactagaaaacagtgctaaaatttatatggaaccacataagatcctaaatagccaaagctgtcatgagtgaaaagaacaaagctggagacatcacactatctgatttcaaaatatagttcaaagctacagtaattataacagcatgatagtcacatagaagtagacaggccaggcacagttgctcacacgtgtattcccacactctgggagactgaggcagaaggattacttgaaaccaggagttcgagagcagcctgggcaacatagtgagaccctgtctctaaaattaaaaaaaaaaaaaatttttaaagccaggcgcggtgctgtgtatctgtagtcctagctacccgagaggctgaagaaggaggattgcttgagctcaggagcttaaggtggcagtgaactgtgattgcatcactgcactccagcctggatgacagcgtgagaccctgtcttttaaaaacaaaagaaacaaaaaaacagacacatcgacccacaaaacagaatggagagcacagaaataaattcgtgtactatcagttgattttggacagggtgcaaagaacacagcggggaaagggaagtctgttcaataggtggtgttgggaaaatggaatatctacatgcatgagaatgaaatcagacctgtatctcacatcatataccaaattcaagttaaaatggattaaggtcttaaatataagacctgaaactgtagaactaccagaataaagtataggagaaatgtacatgacattggtttggacagtgatttttttggatatgaccccctcgaagcacaggcaacaaaaataaaaattgatgaatgagatcacatcaaactaaaaagcttctgcatggcaaaaagaaaaaatctacagaatgaaaaaactcacagaatggaagatagtatttccaaaccatatatctggtaaggggttaatatgcaaaatatataaggaactcagacatctcaatagtaagaaagcacctcacttaagaaatgggcaaaggacttgaatagacatttctcaaaataagacatacaaatggccattagaatggctattaaagtatgatgaggatttgcagacaagagatatattgcgcatggcaggaatgtaaattagtacagcatttatggaaaatagcatgacgtttgctcagaaattaaaaaatagaactaccatatgattcagcagtcacacttggatatatatgtatttttatatatatatatatatatatatatatatatatatatatatataaataaaagaataaaatcagtgcgctgaagagatctgtactcccatgttcctttcggtatcatttgcaatacccatgatacagcatcagcctaagtgttcatggataaagaaaatgtggtatgtatacacagtggaatatacttcagccataaaaaggaggaaatgctgtcatttgtgacagcagggatgaacctggagggcattgttgaaagtaagccagccacagaaaggcaaatactacatctctcttaaatgtggaatcttaactcagggatgtaaaatggtggttaccaggggctgggggtgagtggactgggttgcagaggtgttggtcagaggacacaaaatttcaattaagaggaatttgttcaaggtatctattgtacaacatggaaactagttaataacagtgtatttttggaaatcactgagagtagattttaaatgttctgccataaaatataagtatgtgaggtattgcatgtattaattagcttgatctagccattccacagtgtatacatattttggaacatcatgtgaatacaataaatatgtatccttttttttgttttttgtgttttttttttttttttttttttttgagacagagtcttgctttgtcacccaggctggagtgtagtagcatgatcttggccactgcatcctctgcttcctgggttcaaatgattctcctgcctcagcctcccaaatacgtatcatttttatttgtcaccaaacctggtgtcttgacaggtgaaaggagatatgagtatgagtgaaactcttacaaagatagctgagatgatcattgtcagaggttttagtatgtctaacaaagacaagggagtgatttgctgaaatgaggaggtgaagatgtctcaaatttagaaaggcaaatattttgggggcctagagtattgggatagaaccatgtacagggacattgaagtcactttgctgatgatgtaactgggggcaaagtggaggcttaaatatgtgggtttaattgaccagaacagggagggaaagagaaggcattcggttagatgacatgagtttcaaattacaagctgtttttttgttgtttttaatacagggaattttgccgtttatttttaatacagggaattagaagaataatggtggacttaggagttttaggagtcacataaaagggttgcatgataggcagtgcctttggggaggagccaggctttcatgaaagctaagaagttgaggggccattatgtaaagtagttgaagatgggggatagcctatgggtcttcagaaagcctctgggtttctagagatctttctggaagaggttaggaggatgagtcaagtttagaatggaagaggatagatgaagcttgcatttggtagtaaaaaccaaggatgaatgtgtgaggcatgattatttgtcacaagtttccaggtgacactctggcactcagtccttgttgaattaagcaagctttcttactgttttacttggctgtgttaaagtagagtaacaggaaattagacttcccataatgtctcaatagagctgttttaagtttctagccataattggtatgggaatatagctctaaaccttcaaggctgctaccatttctcacattcctatatctagaaactgtagccaggcagcactttcagtgaggtgagtgggtccaggtttgttcaattacttttgtaccaacctaataccttaatagtatttgtcctaatttacaaaaataggtaatgaaggattcttggttttacctcagagctaactgtccattaatggcaacatcccacatttgttgaagcatgattttgttgtttgtactttgacatgcatttgatattttaagtaacgccttgaatgcatcttaaataataatttatatacagttaacactcctgtttgtttttaggaattcttagtgttgccaatttcctaggatgtagaagagcatagtaaaaaaaaaaattattaatactcttaaacaagtgtttttaacaactggacaccattttgtagttaagcctagaaacagaactaatgcaataacccagatcttttcatttattcgtatgtttattttacctggatttactttagttttttgttttgtttgcttgttgtttgagatattgtcttgctctgtcataagtgatacagctagagtgcagtggtgtgatcagagctcactacaactttgaattcctgggctcaagtgatcctcatgcctcagcctcctgagtagctgggactacaggcatgtgccaccatgccaggctaaaacagtgtttttgtttgtttgtttgttttttgtagagacagggtctcactatgttgcccaggctggtcttgaactcttggccccaaagtaatccttctgccttggcctcacaaagtgctgggactacagacgtgagccaccgtgcctggccatggattttgtttaaatttataaataccgtgttgtagaatctctttgtatgtattaatttagacaccttagttttcttaatgatttcataccagtttctcagtaacttcagattttttttttgagatggaatcttgctctgtcacccaggctggagtgcagtggcgcaatttggctcactgcaacccctgcctcccaggatgaagcaattctcctgcctcagccacccgagtagctgagattacaggcatgtgccaccatgcctggctaattttgtatttttagtagagacagagtttcaccatattggccaggctggtcttgaactcctgacctcgtgatctgcctgcctcggccttccagagcgctgggattacaggcttgagccaccgcacccaaccagatcagattttttatgtttggtatttactctttacctctaacactaaggctatgtttccagatgtataactataaatggagcaggggtaaatacaacaagtgatttatggttcagtaaagcaagttagttttaataaatgctcagtttactgtaaatgtcagaaatgccccaggactctgtctattgacaactcttctatttccatcgtcagctcttgccctctgaactgtagactgatttatccaacagttaagtctggttctcaaacttaacctgtcctaagtggagctcctgattttcatcatcccaaacctacgtctctcataatattttgccatctcagtcaataacagcttttttcccctcctgtgcagccagaagccttggaagcatcttttaatttctctatgtcacatactcaaattattggtaaatcttgttggctacaccttccaaatacccataattcattttattttttttaaccattatacttctgtttactctgtttaaaggcatcatcttttggcaaaagaaagaaattgtttcccaggagtcttgtgctttacagtgtattctctagtagcagccggaatgatctttttaaaatctgagttaaaccatgttatttactatgcacagaacttttcagaggcttcccatcttaaaagtaaaatctggagatttacatggccctgtgtgaactggcttcctttcatttctgtgatctctctaccgcacttgctcatctctgtctaaaatggctgtatctttgtcatcttaaggcttgtaactattgtctgtgaccctgtgacccttctctgtgataatccatgtggcttccttcctcacttgattcagagagctctctgctcaaatgatgcttttcctgaccggctgcatcaaagaatgatcatgttcttctgcattccccttaacttgctgcatttttcttcatgggatttaatgtcatttgacttcttgcatattgatttctttgttgttttgcttctttaccactagaatggaagcctaatgacagtgcctggcatacagtaggtagtcagtaactacttcctacatgaaagaatgaagctagtaaatttatgcaaaatgtttgtttctgcctttttaattatcttgcagaaatgtaggaagaattttttaggatcagtttatgtatatatataaactgataagtatgtacacagcctgtagaatgtgggtaataccacctatcatctttttgagcatttaccatgtagcaagtgactgtgctccataatccacatgcattatcttgaatttgataggagagctgagctttttaatcagagtagaccatagaaatatagcttggatgcttttatttcctatatgacttcttcggtgtacttacacatctataagcatttatgggtcaagtaacatactgaaatattttctgaagtaaaagaaatctctttaatcaaataagtggttctcctataggttctcatatcatattcttggtctccagattgagaaggtccttttgtatgcttccagtatactcgaaaccaggaggtagtctgacatctatttcccttcaaggtcaaataattagagaaaggtttaattgacactgttatcgagacagtatcagaagagaaattgaaaaatctctgttgagactctgtaatttgctaggttctgaggatacgacagtaaataagttattaggtcatatacctcagcttcccatttaattaataggcagttattatatataatagaataggtactggttggtatgagactacagaggaagaatacctaattatcttaaaagtggtatataagctgaaaccttgaggatgcttgggaatagctaagaatcatagtgttctaggcaggaagaataacacctggaatcagagaagacagcagaacaagtccactgagtagtaagaagttccgtattgcagtaatgtagagttagctgatgggagaaggtgtgaaaaaatgcatttggatatagaaagccaggagcacgctaaggccctttgctttcttctgacagacacaggagcccatgaaaggcatcacgtgtggaaggaagtgacacgagtcatagtctgccctgcttttctaccacctgaagcatcatataaacctatatcttctgtttcaaatgtaaggaaacatacttctagttcacagtagggatagttgaatggatgaactgtttctggctgaatcttctcaaagtagaatgagcaaaacatggctatattatgagattatctaaggaaagatttttataatcatgtgaattttgaatttctttatatcttaattattccaagagatttttgggaacattaatgagaatagtttacctttagtacatagaacttcttgtcagctataaatgaggatcaaacccaaaagagattaacaaaaataaaagggatgctatttccccaaattagcagaactttttgattcaccgagttctttgttttttaactgctgtctgcctcttaacataattgagtattcagtgatataatataaataaatcacttactaaatgctgatgaacgcttgtttttactaacatctcagcttgtagcatatcttgttgcccataccagaaaccctacccattacctctggctcttccagcttatttacctcttacaaactacttattttaaatatttcctgggtcaatttcatctttttttttcttcctactgctacattatttgtccggactattacagtagtcattacctaactggattgcttgcctccagttttgcccactttggtttcagttattgaaaaggcaaattttgtcagtcacttaacctgcttaaaacccttcagtgactccttgtgttttagttcttatctaatggtttatgaatgtagtgggttacgaatcttccggaagagtgcatttgcactcctgaagtgtgcatgtatttttatgaggagaagatctttagcttttattagattactcctcttttggctaaaaaaagaattacttatcatggctattgaggtcttccatgatctggcttttccctgcctctccattttcatatttttgaaacttttcttgaactttaggctcttgaagtgcttggaattgtcttataatatcatgttttcaggcccctgtgcttttactcattttcctctatctgaaacattcttcccctgtctgaaacattcttcccacccatagtgtcatcagctcctagtcatcttttgtgattcacctctcctaagttgcctctctttttattgctattcctctgtagtcatctctgtgatattgaaatcgtggctttctctttctttagacatcataattccttgaagagccctttttatgtagcctgacaagcagaatttatactgaagtagacatttggaagtcatttagttattgctcaatccttgaaagatgaaactgtccaaagggaaatttaaaagggaaagtatctaatagctgatccctggagaatacaaatgtctctagatttggaagggaagtctctgaaaaacagccagagagaagggaggaaaccaagaaatagtgtcctagacccaaaagtcaataatttccaaaaggtctatatttcttaggaaggccaagtaaaataagtagtgaaaagtgatgacctgactagagcagattcttcatttccagttacagaagctaggttataggtacagtaagctctggacatgttcttttcccacatggaacgttattcgtgttctccactgctgctttgaactattccttttactctctcagcataaaaatccctgctcctttgaagcttatgccttctggttttgtcttcctctgtctgccttcagtgagctatcagtttcttctcggtttttgaggactgctacctgaacttattcttcttcactctttcccaaatctgctgccatctttatttatatgattaacccctcagtccctagcaagtcaaattcccatccgtttttatctacagtaatgttcacctctgcatcactgctgcttcccatgtctacaggcatgccaactcaaaactgttttaccccaaaagcttcagtgaaaacaccttacctcaggttgccgtctttgaatgcttttctactatcttaaacttgttttctttcattgcgccttttcttccttctcttagagacttgtcctatggctcttctactgtcttccagctacaattccctcttgttcctgacatgtactgctcagagccaggagatggataagtagtagtatttcacatgcacttttttctctggggagcagtagtcatacaataattgattaagataaaacaggtttttatcagtttatataagaggtaaagaaaacaatggggtagagttttaaaaattgtcaaaaacaacacattttaccatattaatgatttgaagtgtacggtacaattgtggtaactgtgcacattgttgtgcagcagatctctagaactttttcatcttgtaaaacagaaactctacattcattgaacaactcttcttttcccccttcttcctattccttggcaaatgccattctactttttgcctctaaaatttgactgttttggctacttcatgtcagtggaatcattaagtatttgtcttttgttgactggcctatttcacatagcaatgtcctcaaggttcatttgtgttgtagcatattacagaatttctttcttttcttttaggctgaataacattttgttatatatgtataccacattttctttaaccatttgttgatggatgtttaggttccttccacttcttgaatattgtaatgttgaaataaacatgggtatacaaatatttttttgagaacctgtttttaatatatttggaagtatacccaggtgtaggattactggatcatatgtattctatttttttttagattttttttttttttacaggagttctaggttcacagaattgagaggaaggtacagagatttcccctgtacctccttccacacacatgtatggattctctcatagccagtgtgcatctcccaccagagtggtacatgtctttctgatgaacctatattgatacatcataattacccaaagtccgtagtttatattagggatcattcttagtgctgtacgttctgtggctttgaacaaagtacaatgacatgtatctaccattatatcatacagaatgttttcactgccccaaaatcctctgtgttctgcctatttatctttccttccctcccactccttggcaatcaccgatccttttactgtgtctctaactttgccttttccagcatattatatacttgtaatcatacagtatatagccctttcagcttgactatttttacttactaatatgcattaaagtttcttccatgtcttttcataggttgttagtacctctctttttccattttctggacatatcacagtttgtgaatgaatattcacctaatgaaggacattgtggttgcttccacattttgctaattatgaataaaactgctgtagatatcggtgtgcaggtttttgtgtggacttaggttttcagcgactttctgtaaatactagggagtgcaattgctggatcttatggtaaaagtgtttagttttgtaggaaacatccaaactgtcttctaatatgacgctatccttttacatttttcaccagcaatgagtgagtgtttcttttgctctacatcttcaccagtatttggtgttatcagtgttctgaattttgtccattctgataggtgtgtagaggtatcttataattttaatttgtgtttctctgatgccatatgatgtgtgggacatcttttcatatgctgaattgccatctgtatatctttggtgaggtgtctgttaaggttgttggccaattttttaattgggttgtttgttttcttgtggaattttaagagttccttacactgtctctgtctgtcttgtctgtctgtctgtctgtctgttgagacagagcctcgctctgtcacccaggttgcagtacagtggcacagtcttggctccctgcaacctctgccacctgggttcaagtgattctcctgcgtcagcctcccgagtagctgggattatacccgtgcaccaccacacctggctaatttttgtatttttagtagacacggggtttcactatgttagccaggctggtctcgacctcctgacctcaggtgatccacccaccttggcctcccaaagtgctgggatgtgagccaccacacccagcctccttacacattttagttaatagttctttatcagatgtgtcttatgtaaatatttcctccctatctgtggcttgtcttttcatactcttgacattgtcttttgcaaaagacaacaatttttaagaaacaagtagacaattttaatgaagtctggcttatcagttcttttcttcatggttggtacctttggtgccgtatctaaaagtcatcaccaaacccaagatctagattttttcttatgttatcctctaggagttttatagttttgagttttacatttaattctctggtttattttgagtttatttttgtgaagggtgtaagacctgtgtctagactctttttttttttgcatgtggatgttcagttattaccactgtttattgaaaaagactattttcttcattgtattgcctttgcctctttgtcaaatactgccattgctcctttgactatgtgggtccatttctgggctctctattctgtttcgttggtctgttttgtcagttcttttgtcagtaccacaccatcttgactactgtagctttacagtaaatcttgaaatcagtagtgtccatctgactttttctgtcaatattgagttgtctctcacgggtcatggaatagctcttcattatttagttatttgatttctttcatcagagttctaaaacatttttcctcatatatcttgtactaattttgttagatctgtacttaaatatttcattttgggacacgctaatgtaaaatggtattgtgtttttaatttcaaattcaacttatgcattgctggtttacaggaaagctattaacttttttatatgaaccttgtatcctgcagctttgctataatcacttattagttctaggaggtttttgttgtttttctttttctttttttcaattcctgtctatgttctacacatatagtcatttcatctgcaaacaaaggcagttgtatttttttgttccccgttagtataccctttatttccttttcttgtcttagctaggacttccagtatggagtggtgaggtggggatattcttttcttgttcctgatcttagtaagaaagtttctagtttctcatcattaaggatggtgttagctgtatgttttttgtaaacgttctttatcaagttgaaggtgttccctctattcctagtttactagtttctatcatgagtgggtgttaaattttgtcacatacttctctccatctatggtatggtcatgtgatttttcttctttagtctgttgatatggtgaattgcattaattgattttccaatattgaaccagtcttgcatacctgggataaatcctactttgtgctggtgtatacttctttttatacattgtagtaaaatttagtttgctaatactttgctaatacaaagatttttgcatctttgttcatgacaaatatgggtctgtagttttcttttctgataatgtctttgtctggtttgggtattagagtaatgctgacttcatacaatgagataggagcatctcctttgcttctgtcttctgaaggagattgtagagaactggtgtggtttcttccttaaatgtttagtagaattcatcagagaatccatctgggcctgatgccttctcttttagaacattattaattatggatttaatttctttaatatatgctttttaatcaagattatttcttcttagagttctaatagattgtgtcttttaaggaattgattcatttcatctaggttaccaaattcgtggccgtaaagttgttcataatatcccttgattatccttttaatgtccatgagatctgtaatgatgtccactcttttcattctgatattagttattttgtcctttgtctctttttcttagcctggctagaggcttattgattttattgatcttttcagagaactagttgatttctttgatttttctctattgatatcttgttttcaatttcattgatttctgctctaatttttattacttctatttggatttaatttgctttttctagtttcataagttggtagctcagataattgatttttagatcattcttttcttttcttttttttttgagatggagtctcgctttgtcgcccaggctggagtgcagtggctcgatctcggctcaccgcaagctccgcctcccgggttcacgccattctcttgcctcagcctcccaagtagctgggactacaggcgcctgccaccacgtgtggctaatttttttgtatttttagtagagacggggtttcactgtgttagccaggatggtcttgatctcctgaccatgtgatccacccgcctcagcctcccaaagtgctgggattacaggcgtgagccacagcgcccggcctagataattcttttctaataaatgcatcagtgttgtatgtttctttctaagcgctgctttcactgtatcccacaaatttggataagttgtgttttcatgatattttcaatttataatggtattgggacacaacccaataagtaagtttaggagcatttgtatgcataagcacaattgttgacattattttgaacaaattcttatttgttagatcaattaagtataagaaaaataaaaggttttattttactttcagtgtttccttcttttgatgctctatatatgtagatttcagtttctgaacttcccaacacttattgcaaggcaggtgtactgacaacaaatttccttaatttttgtctgagaaagtgtttctttttaacttttgaataataatctcacaaggtagagtgctaggtttatggtttttttttctctcaacactatgaatatttcactctttttcttgttggaagtcacatgtattttttcttttttttctttttttcctctacaggtaaggtgattttttccctctggcttacttcggatttttttcttatccttgaatttctgtaattacaacgttttatgcccagatgtagttttttggcatattttcaagctcagagattcttcatccatgcccagcctactaataagcccatcaaaggcattcttcatttctcttacagtgttctgttttttgtttttgtttgtgttttatctctagcacttccttttggttcttaggattttcatctctacttttttaacatgttgtttactcagttcgttagggcccttagcatattaatcatagttgttttagattccaagtttgataattccaaatccctgctgtatctggtcctggtgcttgttttttaccttttattatgccctgtaatttttttcttgatagcttggacatgatgtactaggtaaaaggaactgttgtaaatgagcatttagtaatgtggttgtaaggtgtagggagaggagaagagttctgtagtcttatgattaggtcagtctttttagtgagcttatgcctctggactgtgaacttcacaagtgtttctcaatcccacccctccctcattcccttagttagaacaagatagctataatggcctgaagttgggttatttctcttcccccacatcattttggctttgctacaaccccagcaggttaggctctggttaactagtttctcctgaggacaaaccttgttaagactggaatagtctagtgtacttgaaaatcatttctctttgcctcccctgctgagggttgaggatttttctcctatatttactgtgagaagctggtcaattgcctggatgtaaaacttagaaaattgtagggctccccctataattgggtaactctggagtttttagctttcagagttgtccacactgagccttcatcaatttgtctattacacttcaggatttcctaccccgtggaggtttctgcttgtgtttttcatctcagataaatggtgatgctatgtgttcacctgttctctgctctcacaggcagtcatttgccctgtgacctcacttatcctatctcagatttgtttatttttaagtttgtcattttttacttgttgttaggatggagtggtgacttccaagctcttcatatgtggaactggaggtaattctatttcaaattttttgagggaccttcatgttgttttccacagtgcctggcaccattttacattttcaccagtggtgcataagggttccagtttctccatatcttcaccaatacttattttctgtttttttaatggtggccatcctaatggtttcagatgatgtatcattgcagttttaattgacatttctccctactgatcagtgatggtgagaatcttttcatgggcttattgcccatttgtatatattctttggaaaaatgactattcaagtcctttgtccactttttaactagattttttgttgttgaattgtaggagttatttatatattctggatattaaccaaataacagatacatggtatagaaatattttctcctgttttgtaggttgccattttactccatttactgtttgctttgtagaaatttttgagtttatgtatccccagtttgtctatttttgctttggttgcttgtgcttttggtgatctattcaagaaatcattgccaagtccaatgtcatgaagctttttctccatgttttcttgtagtagttttataattcgatgttttaagtttaggtctgtaatccagcttgagttcatctttgtatatggtgtgagataaggctccaacttcattcttttgcatgttagattccagatttcccaatacagtttgttgaagaacctcttttccctatttctgtgttctctcttctgctcacttggtctgtatatctgtctttatgccagcaccatagtgttttgattactatagctttgcaatatctttagaaatcagggaatgtgaggcctctagctttgttttttgtccagattgttacggctattcagggtccttcaagattctgtattaattttaagattttttttttctgtttctgtagaaaatgccattgggattttgatagggattgctttgaatttgcagattgctttgggtagtattgccatcttaacagtactaaatcttccaattcataaacttggatgtctttccatttatttgtattgtctttaatttctttcagcattgttgtataattttctttttcttttttttttttttttgagacagagtctcactctgtcaccaggctggagtagagtggcgtgatcttggctcactgcacctctgcctcccaaattcaagtgacaactcctgcctcagcctcccgagtggctgggattacaggcgcgcgccaccaagcccagctaatttattttgtatttttagtagagacagggtttcaccatgttggccaggatggtctcaatctcttgacctcgtgatcagcccaccttggcctcccaaactgctggggttacaggcgtgagccaccacgtccggcctatgttgtttaattttcaatgtacatgtctttcatttgcttggtgaaaatattccctaagtattttttactctttgatttcattttaaatgggtttaaaaaattaatttcctttttggattcttcatttttagtatttagaaatgcaactcttttcttaatattggtttttatatcctgtaactttactgaattcctttattctaacggttttttttctttttggtaggctagagttttcaacataaaagatcatgtcatttgctaacagaagtaattttacttcttacttttctcatttaatacctttcatttctttttcttgcccagttgctaactctggcaggatgtctaacagtatgttgaatagaagtggtgaatgtgtgcattcttgttccatttgtgatcttagagggaaaactttcagtttttcatcattgaataacattagctgtggtctttctatatatggccttcattatgttgaagtaatttccatatctttctagcgaattgagcgtttttgtttttgtttttttgagacagaatcttgctcttgtcacccaggctggagtgcaatgatgctatctcacctcactgccagctccgcctcccgggttctcaagtgattgtcctgcctcagcctcccgagtagctggaattacaggcgcccaccaccatgcccgattagtttttgtatttttagtagagacagggtttcactgtgttggccaggctggtctcacactcctgacctcaggtgatccacccaccttgcccttctaaagtgctgggattacaggcatgagccaccctgtctggcctttttttaaatcctaaaagggtgttgatttttgtcaaatgcttcttctgagtcagttgagattattggtttttgtcctaagaatgcagtgtattaaagtgatttttttgtatgttgaaccatccttggattttatgaataaattccagttgagaatttatgaaatataatctttttaatgcattgttgaattctgtttcttggtattttgttgattttttttgcatcagtatttattagggattcttttttcttgtaaatttgtctgatttcgatatctaagtaatgcttacctcataaaatgattttgaaagtgttctgtcctctagttttttcaaagagtttgagaagggttgttagtttttaaatgtttggtagagttttcagtgaagccctggcgttgttggacagttactgattcaatctctaatagttataggtccattcagaagttgtatgtatttgtggctcagtcttggtgggtttgatgtgtctatccgttctcaaaggttatcaaatttttttgggtcatagttgttcatattagtcttttaaggtcctatttatttctgtggcagcagttgttgtatcgcctttctaatttccagttgttgctgtttgtgtctattctcttcatttcttaatctaagaatttgccagttttgttgatcttttcaataaaacagctactcctaattttgttgattttttttctattgcaaaaattttctatttttctctattttattttagctgtaatttatttttattttttttattttttggtaagtttgagtctcatttgttcttcatttcctaattccataagatgtaaagttaatttgttgatttaaggtttttcttcctttctaactgtgaaatatgacactgtaaaacagattttcattttacagatgaattatgtaaatatttagttctacaattttacttttttttttatcatatatcacgcattctggatattgagactataaaaatgaaaaaaacagttcttttcttttcttttttttttttgagacagagtctcgctcttttgcccaggccacagtgcagtggctctgtctcggctcactgcaagctccgcctcccgggttcatgccattcttctgcatcagcctcccaagtagctgggactataggcgcccaccacggcgcccagctaatttttttttgtatttttagtagggacgtagtttcaccatgttagccaggatggtctcgatctcctgacctcatgatccgcctgcctcggcctcccaaagtgctgggattagaggcgtggcgtgagccactgcacccggccataaaacagtaattgaaggttaacctatatttcaaacaactgaaaatactgatttgttcatatttattttttcatgaaaatcgtcttgttctatatttaataggtttttgttcggttcatggtactaatgagttcacaattgtaggtttagtcttgaaataatctaaattcacttcatcccattgtaacagaccctacatcatactgaatatagttgtgtcacagatgtctcttacagtctatttctacaaggcctagaactatttaggataccgttgctcactcttacaaattttaacattaaaaataactttgagatggaatggagttttgcaacgtctcagaacaaagagactccacttacgagaaattactaagcagtggttcctagctttatagactaattatataagccttcagttgtttctattttatatctgttttttagattcctcacatgttcattctgctttaccttctgtataatataaaggtcactctacttacagtcacattttccttttaatctttccgtttttattttttattctttgctttgttcaccattagtttttatattgcatctcacagttcatgtttcttttttgtcatttctgattctaattgtaattctaatcttacttgtttggcgttcactgtcacatcttcactttctggcagctgtttctatggcttcatcttcttagtgcttgtattcattgcttatattccagttgtcttgtaaattcatttttttagtgaactaagccagacacggaaagacagatatcacatgttctcactgatatgtgggaactaaaaaaacattgaacacaaattttacagctgacacacatatgcctgccacctagattctgccattaatacttacattgctttatcgtataaccatccttgtatccatcaatccatcttaatttttatgcctttcaaagttaattgctaacattagtacacatccctctaggtgaaaccatttttaaactgattgctgtcaagttgtctagagtaaactctgatcttccaagtatgacttattccataggacttctgtttgtagcactgtcccattaattcaatcatagaaataaataattggaaagtattgtctgttttaaatggataagtattttcatgtgtctgactttagaggacttttactagaaggtctcacttgaccttcattgctgactaaataagaaaagtttgttttattttaaaaatcaacacattataacatactttgttttttgagtaataagaaaagtcaatggaatgtgaagaaattatagcaagtaagctgttgttcctcttctaggaattttgattatgaacagctgataaggtattactaagggatctcatcagggaaattcctttctttccttctttttcttttgcatcctctccctttcctcactttcttttcccctttttcccttttcccctctcctcttcttttctttaatagtacttggggaaaggtataccttttattttacggatttgctcagggtaaagagagagttaagaggccaaatgattagatggcagggtcactggagggcagagataaataatagatcctaaactaagggttggcaaacattttctgtaaagggcaggtggtatttgttttaggttttgcaggcctaaagtactcaactctgccattgtagtatgaaaaacagccataaactatatagtatattgtattagtcctttttcacgctgctgataaagacgtacctgagactgggaaaaaaaaaagaagtttaattggacttacacttccacatggctgggaaggcttcagaatcatggcgaaaggtgaaagacacttcttgcatggcagtgacaagagaaaatgagaaggatgcaaaagcggaaacccctgataaaaccatcagatctcgtgagacttactaccacaagaacagcatgtgggaaactgcccccatgattcagattatctcccagggggtcactcctacaacacatgagaattatgggagtacaattcaagatgagatttgggtggggacacagagccaaagcattatcatatatagtatatttataaatcaatgaacttgggtatgttccagtacacttgatggatactggaacttgaatttcttataattttcacgttacaaactattattatttttcaaactttttccagccatttaaaaatgtaaaatattctaagcttgagagacataaacaggtggtggactcgatttgacttacgagctatgatttggtgacccatatggtacaaggatttcccttgcgcaggaactataccaaaaagtcgttattagtgtatacttttccaacgtagaggcccttttatgtgctctaaattttgtatgccttttacatatcctaaattagatagtgatgcagatgaggtcagataaattaaggtgtcattggagtgaggaaaaaagaagaatgcttaatatagttgattccaccattaacttggaggttctggcatggcttcctttagtcctgtctcatcagtgtagctgctatttgttaaacttggcacagaaaggcagatcaaatatagagggctactttcagatcctcctcttaatagttattaaaagctcaagtttagtagctgagttcaaatctcttattagatgtatgacttatgtaatttctctgagcatcagcagaatgaaggtttatagtgctaactcatacacttgtgagggtgatagtaacaattacaacaataatagtagtagctaacactttcatagtgcttagtatgtgccaggcaatgttctaagcactttatatatattaacacatttaattttctcacaattggtaatgtgaagaagaataatactctcaccatgataatgctcgtagatactaccatttaaattacgaggaaacttacgtccagaaagatcaagtaattcattcagggtcacatagttaattaagaggtagagccattatgtgaacttgggcatctggcctcagaatgcgagctcttaactgttaaggtttattcccctctaaagtgggaatgtctataaaatgcatagcacataggtcctcaacaaattagagagaaattaactttgcagaatatagtggttccatttcctcaagaaacttggtctgcctttgtggtaccagatagatgcataaatgtgaggttcacgttatgattcttcagatttttttcccagttgcacattagttatgagatttttttccatagaattcttcagtattactcatgttaaaaaataattattttgaaatgaatcaccttctgcaaaacaatatagtcaaaatgacttagactctgaagctgaaagactcctggactcctattcttgtcttggttctgtactttctttgagatcttggtttcgtgatttgactccagttctatttctctctttggctgtggactgaagataatcctcaatgtcatggtattcaaatgagataacccatgtcaaagtgccccgcagtgtgtgtaataagttatcaggcatccagcaaatactagtttcttgctcacctccctattacataaaataactttaaaattagaactgaagggactcataaagctgggaaaactgaggcccagacaattgtttccctaggatcctacagctgcttagggacagaaggatgacacttaatgcagatcttctgatttttcagtctcgttctgtttgtgctgatcactctcctcctatgtagtatataaagaagtactatgtatctgacaagttttggggaggttattttagtataaaagctcacattaaaaatatctattttggtattttgacttttgtaatttttttaaaaatcagagacaatttagtaaatctcggggccattcaaatcatgtatatgaagttttataactgctattgttttccccttatagttattaatttttaatatgcaagtagcatccttactatggaaagaataaataagaaatcaaaagatggaagaagttttaaaactcacttaatcacatcatccagagaaaatgctattaatgctttgaaataacaatgggttcatcctacacctgctactttttaactgacttttgtcagttagtgatatatcaggaagactaggcagttctttgtcgaattcaaatcttgatagtttttattttattgtgtgacctattatcagttcatttaagtaatcttttattagacatgtttttttcagatatagaaacaatgcatttttgtaaaattgtcaaattattttccacaagtaggatctcattcacacggtattcgtgtttttaagactttcgatacatgttcactgttttcctccagaaaggaaatacctacttacattttcaccagggaagtcactgtagtttgggagaacatgacattatctccctttctttactgaagggtagcaatatatattttaaattttctagattctgcatttccattttatttttacatgttttcactttcatattttgcatagtgctaaatctgtgataacagtttttaattttcaggtggggtttatagcttcatagatagcaaaatgtctttaagtcatgtttatgcaatttttacatgtgctttgtgggttttcttttttctctgtttgcatgcagtgagtggtaaatttgcatggaacatttgaaaaataagcaccagaatgaattgaatgtgtgtgaattatcactttttgtcacctacctggacagagagtgaaagttcttctgttgagacaaaattggatctcgtgtgtttcttcacttacttgctgccttgttaattgttgagtttctcatgattagcaagatgtaaactctggcattggtcatctagtcctacatgttagataattctgtgaatgttttgaaaatcagctgaactatttttcttataattttgattctttgtagttgttatttccatgcttgtgaatttgggaccaaaaggaatggctatgacttatgtttctttggatccagtagtttattctactgaaattatggtaattttatcagttagtagaagcatagactctttagtgttgaatataatgtcatctaacttcttacatggtcacataattcctccctcagttttggtagctctcctgaaacagccataataggacattaatctgtgtactttaagttgacagagtaaaaggaatataagatttcacgtgatggaacttaaaatattccatcttgtgacgtggaactaatgaggaggtttagtgacaagttttagatttaagattctacactttggagcctctttttctttttctttttggtttttgtttgtttgtttgtttttgagacaaagtctagctctgttgcccaggctggagtgcagtggtgcaatttcagcttatggcagccttgactctcaggctcaagtgatcctcagcctcccaagtagctgggactacaggtgcatgccaccacacttggctaattttttttaaaaaagtttgtagagagtagcctcactatgttgcccaggctggtgttgacctcctgggctcaagtagtcggcctgcctcagcctcccacagttatgggattgattacagtcatgatctgcctcactcaggctgcagccgctttctttcagtgtaacactatctttggatattccacttacaaatttatttttaagtctcccatgttgttgataattgggaaaaatagtttttattccagatagatattctgtgttaactataagtcaaatgtttacaagctgttaaaaatgaaatactgattatgtaaaagaaaaccggattgatgctttaaatagactcattttcctaatgctaatttttaaaatgatagaatcctacaactcttagctgtaaaccttgtgatttttcagctgttgtactaaacaacttaagcacatataccatcagacaagcccccctccccccttttaaaccaaaggaatgtatactctgttaatacagtcagtaagcattgacattctttatcataatatcctagaaaatatttattaactatttcactagtcaggagttgtggtaaatagtgcatctccattttctacttctcatcttcatacacaggttaatcacttcagtgcttgactaacttttgccttgatgatatgttgagctttgtacttgagagctgtactaatcactgtgcttattgtttgaatgtttggtacaggaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaaggtaagatgttttattttcaattgagaattgttgcctgaaaaccatgtgggagatttaaatgtattagtttttatttgttttttcttctgtgacataaagacattttgatatcgtagaaccaattttttattgtggtaacggacaggaataataactacattttacaggtctaatcattgctaattagaagcagatcatatgccaaaagttcatttgttaatagattgatttgaactttttaaaattcttaggaaaaatgtattaagtggtagtgaatctccaaaactaggccacaacatctatttaagttatagaataactggactaagtatctggcatgagttctggaacctcaggatgatgtgatgaaagaagcagaaagaggaaacagtgggttttttccatttttgaaggcaagacaaaattttgtgatagttatgtgagaattctacgtttccttcagatatatgcttctcactctccttccggacatttggtacagtcatgctgccaaggatcatgacctaccaatgacagtcttcactcaggtcttttgttttctaaatggtcctacgtccaaaattcagaattcgattaccttgtcgctaatactaaaactccaagttattttcttcagtgaaggtaattagtaacaaagtaatcaaatttttgaatgactaccagggcttagcgcccctccactctcacccctacacacacccagaggcaattgtattttaagagagaaagctttttttttatgacatacaagtcagagaattttagaggcatttgcctctaaaactttcactaacatcatttgaatcaagtttgaaagaattagtgaagtggcattgtgttataacctctactctgtttccacaataaaattattttcgtcactttacacaactttgttgcttcagagtgtataattctgtttcatgaattagttcacacactatgggaaaataggtaaatgttgtctgtatatatagtgtgtcagtataatgtggaagctgcattgactttattgtacacagttctccagtaagtgtgcaccagagagtaccagtaactgaatgtagagtgctggcacagtggaatgcagccagctgcgggggatgtggtacatgaggaatgtgctcatctgctcttttggccacgtgctccatcttagaggtgcttattgtgtggctttatccagtctttatgccccctcctctttttgctcaagtctgcattatagcagttgtgacctttccttatccctgttttctaatatgctactgttactgttccctgttcgttactggtttttttgtttttgtttttgcattgttctatagttactattgtatattggaaattagagatgctttctgtacactagtactcttattttgattattaattatgtttgttaacactaattacaaagttgcataagtattaagtagtctgcaccaaactgtttttgcgtaggaggtttttaagtgcaaaatttaaaagattgagtattttcagggacacatttatcacaagaaatcttataaaaatgtctttctcagtagaacacctgtatcaataaaccaaactttttgaatgttcatatctaattacagtgttttttgactaatttttatctatatacctgaaaaattcagtttaacatattaaacactacaggccaggcacagtggctcacgcctgtaatcccagcactttgggaggctgaggcgggcgaatcacgacgtcaagagatcgagaccaacctggccaacgtggtgaaaccccctctctactaaaaatacaaaaaaattagccagttgtggtggcgtgcatctgtagtcccagctacttgggaggctgaggtaggagaatcgtttgaacccgggaggcagaagttgcagtgagccgaaatggtgccactgcattccaacctggcaacagagtgagactccatgtcaaaaaacaacaacaaaaaacactccttggaaaaagtataggtacattctatataggattagtagactgtcagaatcacttgaagatgttccgaaagcatgacatatcaacaaaggacatgtgagtctagaatggtgatccctaggacaggccatattactgcatgcaaagcaagtctttgttaaccttatgacttgctcaggaagcaaagtgtttcatgtcctaataggatagtagtattttctgttatgttacattttaggaaattaggagttttgcattgtcttgtaagaaggtattttaaaaattttcaatgaaaataatgagaaataggtttccagtggttttatgcttttggggaagaggttactgatgtttagcaaaagatgcttatatattcttaatagaacaaacctgagaattagttcttaaagagttaaggcccataaaagaaactgtaagtgttggtactcttgtagctgggccacagatcagatccttagtatgataaaatttggtatttttgtgcttcaatttttggagaccattcaatgatcacttacattttatattgtctttcattgtgaaacatatattatagcagaggtgggagtcattaaaaattctacatgttgtacactacatgtataagggtatatttggcgcaatggaggtaggattgtctgtgtgcctctaaaattaacctctcaagtagttaatctgatgatgacaagtatgtcactttattgataaaagggagaattaagactattctcagtattatgttggtcagtacacaaaatatatcatttgtttttacctgtgaaatgaaatatctttcatcctattagccagaagggagaaagccttggcctgaaaataacacttatctcaaaaagttgggaaatgtggtccaactctgtgcccaggaaaagaggaaatagattttgatgactacatagtctctgcactgcttgccagctcataagtttacttctttgcactgtttgttttcattgctcaaaaactattttctgtcactctatgagatttagtctaacctgattcctggctgtggaaagcagtttctacttaagagccgatgagaaatggtatattcttctcaatcactcacagaatgactaccctggaacaaactaggaagacccaaaatgaaccagtttgattttaatacatacatagatgctgaaggagcctttttttaagaccttgccttcttagtctttggagaacagagtactgaaacaagaaaactcacagattagtagtatttctgtgtgttctacagtgaggttttaagagctgtattatgattaatcagtacatgacatattggttcatatttataattaaagctatacattaatagatatcttgattataaagaaagtttaaactcatgatcttattaagagttatacattgttgaaagaatgtaaaagcatgggtgaggtcattggtataggtaggtagttcattgaaaaaaataggtaagcattaaattttgtttgctgaatctaagtattagatactttaagagttgtatatcataaatgatattgagcctagaatgtttggctgttttacttttagaactttttgcaacagagtaaacatacatattatgaaaataaatgttctcttttttcctctgattttctagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccgggtaagttgggctgctagattaaaaacctaataatggggatatcatgatacagttcagtgaattcattttaaaagtgactgaaaaaaatgataccatatagcataggaacacatggacatttctgatcttatataagtattatacttttgttgttcctgtgcaagtttatagatgtgttctacaaagtatcggttgtattatataatggtcatgctatctttgaaaaagaatgggttttctaaatcttgaaaactaaatccaaagtttctttcattcagaagagaatagagtgttggacaaagaccagaacaagagaaatgtggagatacccaataataagtgtggatgtgcagtcttgaactgggagtaatggtacagtaaaaccataccataaaattataggtagtgtccaaaaaattccatcgtgtaaaattcagagttgcattattgtggacttgatgaagtgaccatggcagatcagtgcctgttgccagtaagagttgagtcctgctgggccacttagaatatccctgtgtggacggcactgcctggctgtggtagtttcttcccacttaaaaattcatagagacaactctgggtcttggaacttctggaaaacagcagctattccaaaaatctggggattagtggtgcctgtaacatcaagtccagggagattgagcagggaaatactggaaactcaggtactcatcctaacttcctggttttccagatggggttgccatttgttccttttctttcctccacaagataattttagtgtatctgtttaagaatataagagtggccagaagacagaaagcagtcgtcagtcacatttcaccaaaatttacatttgtctcaggtgcattatcgcagagctttattgtatttctagtattagctatccctgtcattgctgctacttttttatcatcttcaagtaaaatttaatgtcaacaaaaattaaggtagttaataatactatagtatactagtaaagttgtctgacacagacaactaggaaatgtgatttttactttaaaatgtattttagttttagaatgtctaaattttagttttagaattgtctaaattcgagaattcataaagctgtagcccggtggaaaaagttatttgacatctcagaaattaaaaattgcagagattttgtgtgttttttttttttttgttactggtttgttttttttttttaatgtcagatatgtttatagtgttggagaaagattctgcattatttaagcaactcaggtggttttctagcagagacaaaagggggctttaactgcctgaagtcattattattgcttgctttctggtaccctttttatttcacttacatagttttgagacacatgaataattaatacacttaatgactgatcataaggcagccagcaccttactttacatagtttagcagaatgatagggtattttataagaatgtgagtgatgttttatgaaaggtatgttgaggtctgtctatgactatccattgttggagcagaactgcaaatgccaaagctacatactttatgtttggcttcttgaggtgagatcccttcagctgtcttcatcaaaagctatgtctagcctttaaaaggcaatgaaattacactgtaagaatcattccagggttcaaaaaattgtctaccttccttatctgtctttcgctcagaagtctactcagtcttattttcctcagtcccccatttttttctctagtaaagcaagactaaaaacaaaagtttaagtacttggtatatactttattctatattttaaattctattctagaattttaaggaaacaactgcttttaaagccttaggtgttagtgtaaaattaactgtgagctctttaattatggtaacttgtttttagcaagttctgcttaattatatcaaaattagataatatagtgtggcctatcataaatcaggattcactagatagtatatgtacttgaatattgccagcccacaaaagcagttcacttcagaaatcatgtgtgttaggcagtttaataaactgtgaaaatagaaagagatgatgcttacagagaagcttccttaggggctctgaatgctcacactaagcagattttactcttaactttctttctcccttgctttttcttccttttcttttttttaaaaaaataacagaatgtgaaaagactagaaaaaccagcatcgaaataggtcttataagtaaaattgataacctgtgtaattttttgaagtaagtattcacagcaggtgatgattatgataaagccacatattttagtaacacatagtagaagttctataatagaaagtggtttaagattattctctcatatgaaagctcaaaagtgatgaatttttcaagatcttatttcccaaggatctctgctttttaagcctcattcttatatatcacagtgaacaaactagtggccacttttttatgacttgctaattttggaattgtatagcagggttgggtggaaaagaagaaatgagaaactttgtggtaagcttaatattgataaataaaattatgggatcctaggctttaagagctaaaagaaaccttagagttatccactccttagtttagaaatcaagcccagaaaatagtgacttcatatatgagactcttgtatgttttctgttgaggagtggtaacttgaattaataattgtggatttttttaaaaaagaaaaatatattcattgcttttatatattgtgaaattcaaaccagactagcagcttttttcctgaggtttttagagaaattgtctttgatgacaagagaagaattcatgttgatagtattttcactaatctctgattgtaggaaacactatcattttattactgctaagacagaaaaataccagcaattcattgtaagatgctatcatttgtatggtgtaatctgatttcagagataatgtgaaaaaagtgaattttagaatcaatagaatataagttgtctcttcacaaataccttagaactgcttaagaacacccccaccctacccgtttaacttactgccatagttcccctaggacttattttcagtattttttcgttattgttccttagaaaacagtacagtgataaacatgagcttagacttcacctttcatttgaatgacattcctaatgtgatgaggtttttacaaatatgtaaaaccatatttacaaatttacatttttaatataaatatgtaatttaatttaatatgtaaattaatttaatttaaatatgtaaatatttacatatttacaaatatgcaaatatttacatatttacaaatatgtaaatatttacatatttacaaatatgtaaatatttacatatttacaaatatgtaaatatacccatttgtgtgttcttttacaagtagataatttctcatttttcttagatgaagcacttccaatgatagtatgtattaagattttttaaattacttcttaaaggagaagatagaggttataagtttatggaagaatatagtattgccatcatgaggtccctcaaactgccttcacatctgaatgggaaaattgtttaaaaaaaataaataaataaataaataaaatccagggccctaacctctagaggtttagattagaagctgtattgtagagcctatgaatctgaacttctggtaatactccacaaatattttgataaagccagactccaatatttgggaagatggcctttggttcagctcaggtgggggtgtgtgtgcatgtgtgtttatgtgtgtatgtgtgcatatatagagagaaagagaaaggccattttgatatacaagtatgtttatgtgttttggaaactcagatttttaagaggatcatggggacagcaagcttggaatagaggatgatgatgatgtgaaacttggttccaattagtcagggagttctagcatttcacataaatatctaaaaaccaaaaggaatggctgagatgtggaattgaatagggaagttcaaaaataggaattagcacagataaaggtgattggcacagataaaaagccccactaccaggaggttctgcaaaatcccctctaaaagtcactggccctttttatctggtttctaatagcctagtctaacccagcttccagcattttcagctcccagcttccagcattggtgaacactcttactagtgaaacatgaacgtaattcttttatttattcattgactcacagagctttaaaaatgagattattctgtgctgcactaggtatgtttaattttgtcttacacatacactatattgtggttaacatgtaatttccattgttctttcttgtgatttattctaattgaaatcaaaaatgaaaccaagaaatatgcttggtttatgccctcaaagtaatttctcagaaactgaatgagagaatgaagcctatatatacatagatcctcagcattatataataatttaagacaatgaaacatcaaacttagtattacatgtgaggaaaatgaaatctaaaagagattccagcctacataaattaatggcagaattggaaatagaagtcaggattccaggtctcatggacgaacgtgattatgtgatttggtgttacccaaacatttaaactacatttgagatataacagacttttcttcatgtgtttatcgtgaacatgaaaaaattaatttggataatctggaaatctcaagcaatagtttaagcctcaagttgactgaagtagttgaagctagcctttctttctttttcctctttttttttttttttttttagacggagtcttgctctgtcacccaggctggagtgcagtggcgcaatcttggctcactgcaagccccgcctcccaggttcatgccattctcctgcctcagcctcccgagtagctgggactacaggcgcctgccaccatgcccagctaatttttttgtatttttagtagagatggggttcaccgtgttagccaggatggtctcaatctcctgacctcgtgatccgcccgcctcggcctcccagagtgccgggattacaggcatgagccaccacgcccggccttgaagctagcctttcttagaaatcccaggcattcttaagtattagaggtctcttttatctgattattgcttctacttaaatattcatggtattaaggaatttttttaaaaaattatgaattgatttgatgtaatagctcagaaaactataagattttaagtgataaggttttccttttgattcctgtaagtctagtaatatcatattttgatattaagatgtcatcctgctaggtattctgcaaatgctttgatatcaggtcagattttttttttaaaaaatgaactccctaggatttcatcatcatggccaattaaaaagttcagaaattaaaaatcattttatccagcaattgatgaaatcaagagtcttaaagaagaggaagttacgcagtgaagaggtagatatgattatatccaggatatttttgtttatttttccccagtaatctctgtctgttgctagtctccatgttaaataaatacaacatacactgtacttttaaatatacctaaaaattggcctggcgcggtggctcacacctgtaatcccagcactttgggaggccaaggcgggcagatcacaaggtcaggagaccgaaaccatcctggctaacacagtgaaaccccatctctactaaaaaatacaaaaaaaaatagccaggcgcggtggcaggcgcctgtagtcccagctactcgggaggctgaggcaggagaatggcatgaacctgggaggcggggcttgcagtgcgccaagattgcgccactgcactccagcctgggcgacagagcgagactccgtctcaaaaaaaaaaaaaaaacaaacaaaaaaaaccctaaaaatccacgtgtgtattgtaaataaattcaggcatgcatgcacgttctccttttcagaatgtttagacatagtcctccaaatttcaaatatcctaatgcatttaaaacaacttctgacttaaaaaatacagttttatggtgaggtttgggtttaaacaacaacatacaattttaaataatatagctattatgtaaagaatacacctttacagtttatttgttaaatcttttttaaattgaccgaacaattgatggaggttatttttaagaaaaagaattatcagtacagctgtttatgcaataatggcctttatcaaaatggttattgctaaattttatgtgttaataatttaaaataaaatagttttaaaggctatttatgtattctgtttttactattttatttattttaatttttgagacagggtcttaactctgtcacccaggcctggagtacagtggcacgatctctactgactgcagccttgacctcccacctcagcctcccaagtagctgggatgacaggcgcatgccaccaccccccactattttttatttatttatttatttatttatttatttatttattagttttttgtagaaacaaggtttcatcatgttgcccaggctgatctcaaactgctgggctcaggcaatctgcctgcattggcctcccaaagtggtgggattacaggtgtgagccacggcgcccagcctttattcttaagtggtacagtattttatgaaatcacttatgtgtaccagaatggtaatctaaaataggtaataacaaaatttttgcctacagaattcagttaccaactacttttcaaattattctttttacatatttatatttgaacacattctgactctgaaaaatgtatttgttgtaaaaaatggaaaaatatggaaaagaataaggaaaataaaaatcactcataatcctaaaaaaaaaatttttggtcgtcattgaagagagtgagtaaagcatagtagttaagagcttgtttcctggattagtatctctgttccacaacttactgtgacttactgtgacttgaagttatttcacctttcagtatcttggggtccttatctgtaaagtggagttaatgtttccttcctcataagggtgttgtgaagattaaattagttgctatgtgtgaaatgctacaaaagtgctatatattattgttgctgtattcatggaatatttttgttctataatgctatggtaggttttcagaaaatattttagaaccaataaaataacagcaacaacagctagtacttttaagcactaactttatgcagggaattaatctaagcagttcatacattaatttattactatattattatggttattttacagatgaaataagagaggtaaagttgtatgtttgcatttacaatagaacatattgcattgcattacattcttttggcaccaaggtggggagcatagaatagagatcagtggaagtggacagacatgtaatattttatggagaataaagataaatttgcttcagttatcatttgacatgtcttaggtagagctaagactagatagaacacagggcctctcaatcctgtagaaattcaccaccacatcctttaaaaggttttacattgataaggagtcagctctcatctatgaatgttagtggggaaaagctgtagaatgcacagtctaaataccagataaccttttttttccccactttggaatacattatatttgataaaagcaagtatacctttggatgtaaaggtaaatataaacactgacttacatctttaacacctagccagttgggaactggcataaggaaactcagaatggattacatggcaatatggaatgttggcctggtcccacatttgagctaagatgttaattctaattttagtctcctcagaattctgtatactccgtagcttgaaacaggtttccaactgaaactatttttttccccaaggttattttcacatctacatttgtttgactctagatcttggaactagtctatatcaagttcctttggggacacaaaattgcaaatctgttgttcagagagcaaaactattttaaaaggtaacactcgttctcatatattcttaataagccttcacaacttacagtatgttgaggaaactgaggcttaattgaatcgcgtgctaaagtttaaaggttaaaagttatggtaagtgagagttgggactagtaaggtgaattctgactgactcttggtctttccataacaaaacattgtctaaaagtaaactgtgtggcctaaaaatgattttgtaaatattagagatcggtgttgaacaacaacagacattatttaaagctaaagactaaattcacagaataggaccctaaagttgaagatacccagaagataatttcagctagttttgtcaaactctttgactgcaatccctagtattttacatagcatcccagtacatgcttatccatctgtacatctaattgaaacaaaagtttcacaaaacagtaggttccattactatgtggaatgcattctgattttcccattgctgattgcaaaccactaaatggattagactacccactaatgagttgcaggtgacaagtttgaaaaaacaatgctctcgggcaacctgacctgatgcgttaatttatgagattttattttttgtagacagactagattgtccaaatgagtattattactttaactactatagtgctgtgttacagttgtttcagtgattattgcatttttcaaaaccatttttaaaattctgtttgaaatagttggaataacctgaaaacatttaatatcctgttttggtaaattttcatctccaagattaaatttttttaaccagccaacagatgtttgaaggcaagttaggagatatgatggatactggatacagtatccatccatgtactagatacagtatccatccatgtactggatacagtcatactgttagcaaattttagatacataaagtaaaacaaacaaaatgcagtataaacagttaatattggaatctagtgttgattttatgattaatctcaatgaggttactgtatattcataattctataggtacacaaaaatatttggtaaaagatttatagttgagaaaatgctagacactaaagtttgttaacttacaatttaagaataagggctgggtgcagttgctcacgcctgtaatcccagcactttgagaggctgaggtgggcggatcatgaggtcaggagttcaagaccatcctggcaaacgtagtgaaaccccatctctactaaaaataaaaaatttagccaggcgtagtggcgcctgcctgtaatcccagctactcaggaggctgaggcaggagaattgcttgaacccaggaggcggaggttgcagtgagctgagatcgcgccactgcactccagcctaggcgacagagtgagatttcatgtcaaaaaaaaaaaaaaaaagagtaaggacatgagtaaggttatgtctcacctgtttttaaggaaatgtggatataagatgggttctagtccattaaaaggtggtaatttatactaagtcttactgtgagagaccataaactgctttagtattcagtgtatttttcttaattgaaatattttacttatgacttagtagatactaagacttaacccttgagtttctattctaataaaggactactaatgaacaattttgaggttagacctctactccattgtttttgctgaaatgatttagctgcttttccatgtcctgtgtagtccagacttaacacacaagtaataaaatcttaattaattgtatgttaatttcataacaaatcagtaaagttagctttttactatgctagtgtctgttttgtgtctgtctttttgattatctttaagactgaatctttgtcttcactggctttttatcagtttgctttctgtttccatttacatacaaaaagtcaaaaatttgtatttgtttcctaatcctactccttgtttttattttgtttttttcctgatactagcaatcatcttcttttcatgtttatcttttcaatcactagctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtaaatacattagtaatgtgattatggtgtcgtatcatcttttgagttagttatttgtttatcttactttgtaaatattttcagctatgaagagcagcaaaagaaggatttggtatggattacccagaatcacacatcatgactgaatttgtaggttttaggaactgatttgtatcactaatttattcaaattcttttatttcttagaaggaatattctaatgaaggaaattatctctttggtaaactgaattgaaagcactttagaatggtatattggaacagttggagggatttctttgctttttgttgtctaaaaccatcatcaaactcacggttttcctgacctgtgaacttcaaagaacaatggtttgaagagtattgagagactgtctcacaagtatgtcatgctcaaagttcagaaacactagctgatatcacattaattaggtttatttgctataagatttcttggggcttaatataggtagtgtttcccccaaactttttgaactccagaactctttttctgccctaacagaagagttgttattgaacacagtttgggaaaggctgatgggatttggaaatttgaaagtgaaggatcagaattttagttttttcccttttgtgataaagtagaacagggaaaagatgcagtcttttgggtagtctacttaacttcataattctgaactggttcagtttctactgtaaatataaccacttagtaactgagcttgcttacgtttaaaattgagtacatgacaattacaggaaaaggtttccactgaaggtaccatcagaattgtgaggagtgtgcatagaataatgtatgtcatttcccttcagctttgagatttgagctgttatagcctgttgattctaattgagttgacctttctgttactgttcttagtcacacacacacacacacacacacacacacacacacacacacacacgcatcccttatctataatctagctagtgttttattaataactaaaaagctatgccatttgtatgtagtttgttctaagtaaatcagagatacataagacgacgccctttttgagatagaaaattataaacttcataaagttcttaaatttggtaaaccttagctctagcttttgatgtatctagaaatgttaaaccttagctataaagcatacttgcattatatgcagaaatacttgtaagaaaaaacatagattaagcagttccagtaagataactgaagtgatggcagtagaagtatcaaaaaggagtattttaccaggaggttatggtgcttttctccctggaacatgagaaaatgtgcctaaaatggaacttcagagttatattctgattaacttatagcttgttgctcttggttccaaggaagggcatttgtgacattttattaaattcattaattttttagacacaccattgtcagcttgaacaaatttattaattgtaattatttgtcagctgttcttgatcctgttaataccatacttataactaaaagcatttccatggatgttgtaacttggcctgtaaaaaaaatgtttagatagaaaccatgaaactcaaatatgaattgtttaattttcaaaccattttgcattcagaaaatgtcctaagcttaattcatactcctagtgatcaaggaaacatgttaaagctccttatttttaaacttaaagtgacaatgacattttcaaagattttaaaattcttataaacaggttaaaatacttatatactgtataatttgatttctgatttctaagctctacttttctattggaaattacagatttttttcagacttaattcttaagatgttttcattgtttcacagtagcaactaaacatgtagtaaaatgatttaaattcaattaaaatttttttccttagtcatttaaaagggaagaaatcaatttttagtagtactcattccaaagattccaattttccttttttttaatcttttattttttggtggagggaggcaggatctggctctgaggcccaggctggagtgtagtggttctgtctcggctcactgcaacctccacctcccaggctgaagactcaaaccatccccatgcatcaccctctcaagtagctgagactataggcacatgctaccacacccagcttattttttgtgtttttgtagagatggggtttctccatcttgcccaggctggtcttgaactcctgagctcaagtgatctgcctgcctcagcctccccaaagtgctgggattacaggtgtgaactaccacaccgggccccaattttccaatgagtgatataaaaaaggcctccacgcaggcgcctgtagtcccaactactccggaggctgaggccagagaatggcatgaacccgggaggcggagcttgcactaagctgagtgctgctgcactccagcttgggcgacagagcgagaccgtctcaaaaaaaaaaaaaaaaaaaaaagcctccatgattggggcttgcatagtgaagaccatgtgaaattgaaagactacgaaactacttttcttttacgtattggcccataattaacatgtgtattgaatagctttgtttatctaagttcatcagatttatccaggtttatgtatttcagatcatctgattttattaggaaaatgctagaaaaatttcatggcaccattgtctaattttgaaaaaacgaacctttctttactgtgattaaaaattgttttttaggccaggtgtggtggctcacgcctgtaatcccagcactttgggaggctgaggctggcagatcacgaggtcaagaggttgagaccatcctggcaaacatggtgaaaccccttctctactaaaaatacaaaaattagctggcgtggtggtgcacacctgtagtcctagctactcaggaggctgaggcaggagaattgtttgaacctaggaggcagaggttgcagtgagctgagatcgtgccactccagcccaccctgggtaacagagcgagactccatctcaaggaaaaaaatgaaaaattgttttcaaaaatagtacgtgtggtacagatataagtaattatatttttataaatgaaacactttggaaatgtagccattttttgtttttttatgtttatttttcagctatgggtggataaagcatgaatataacttttcttatgtgttagtagaaaattagaaagcttgaatttaattaacgtatttttctacccgatgccaccaaattacttactactttattcctttggcttcataaaattacatatcaccattcaccccaatttatagcagatatatgtggacattgttttctcaagtgctaatataatagaaatcaatgttgcatgcctaattacatatattttaaatgttttatatgcataattattttaagtttatatttgtattattcatcagtccttaataaaatacaaaagtaatgtatttttaaaaatcatttcttataggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagtaagttctttgtcatttttttaattcagtctcttagattttatttaaatgcaaaaatttaatttatgtcaaaattttaaagtttttgtttagaatctttgttgatactcttatcaataagataaaaatgttttaatctgaccgaagtaccagaaacacttaaaaactcaaagggggacatttttatatattgctgtcagcacgaagcttttgtaagattgatttcatagagaagtgtttctaaacattttgtttgtgttttagtgaaatcttaagagataggtaaaaatcagagtagccctggctaagggtcttggtagttacaacgagtgtgcctgctcctaccacccccacccccaccttgagacaccacagaatttctcatagagcacagtgtgaattctattgctaaattggtggtatggggtttctcagcagagaatgggacatcacagtgactgacaatctttcttttataggttggaaactatttgggggactggagggatactgtctacactttttacaatttttattgataagatttttgttgtcttctaagaagagtgatataaattatttgttgtattttgtagttctatggtggcctcaatttaccatttctggttgctaggttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggtaataaatgtttttatgtcacattttgtctcttcattaacactttcaaagcatgtatgcttataatttttaaagaagtatctaatatagtctgtacaaaaaaaaaacaagtaactaagtttatgtaaatgctagagtccacttttctaaatcttggatataagttggtatgaaagcacacagttgggcactaaagccccttttagagaaagaggacatgaagcaggagatagttaatagctaagtgtggttgtagtataaagcaagaagcagggtgtttcttgtattaagctgtaagcaggaacctcatgattaaggtctttatcacagaacaaataaaaattacatttaatttacacatgtatatcctgtttgtgataaaaatacatttctgaaaagtatactttacgtcagatttgggtttctattgactaaaatgtgttcatcgggaatgggaataacccagaacataacaagcaaaaaattatgacaaatatatagtatacctttaagaaacatgtttatattgatataattttttgattaaatattatacacactaagggtacaaagcacattttccttttatgatttgatacagtagtttatgtgtcagtcagtacttccacatttttgctgaactggatacagtaggcagcttaccaaatattctatggtagaaaacttgggacttcctggtttgcttaaatcaaatatattgtactctcttaaaacggttggcatttataaatagatggatacatggtttaaatgtgtctgtttacatacctagttgagagaacctaaagaattttctgcgtctccagcatttatattcagttctgtttaatacattatcgaaattgacatttataagtatgacagttttgtgtatatggccttttcatagcttaatattggctgtaacagagaattgtgaaattgtaagaagtagttttctttgtaggtgtaaaattgaatttttaagaatattcttgacagttttatgtatatggccttttcatagcttaatattggctataacagagaattgtgaaattgttaagaagtaggtgtaaaattgaatttttaagaatattcttgaatgtttttttcttggaaaaattaaaaagctatgcagcccaataacttgtgttttgtttgcatagcatattataagaagttcttgtgattaatgttttctacaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccgggtaagaaagcaggtgtctgcaaaaagtcatgtatcgatttattgtttgtaatgatacagtagtatagcagataactaagacatattttcttgaatttgcagaatctagatttccaagcactagaagaaactacagaatatgacggtggctataccagggactctgttctgattaggtgaggtacttagttcttcagaggaagatttgattcaccaaaggggtgtgtgattttgcttcagacctttatctctaggtactaattcccaaataagcaaactcacaaattgtcatctatatacttagatttgtatttgtaatataatcaccatttttcagagctaatcttgtgatttatttcatgaatgaagtgttgttatatataagtctcatgtaatctcctgcatttggcgtatggattatctagtattcctcactggttagagtatgcttactgctggttagaagataattaaaataaggctaccatgtctgcaatttttcctttcttttgaactctgcatttgtgaactgttacatggcttcccaggatcaagcactttttgagtgaaatggtagtcttttatttaattcttaagataatatgtccagatacatactagtatttccattttacaccctaaaaaactaagccctgaattctcacagaaagatgtagaggttcccagttctatctgcttttaagcaaatgcccttactactctactgtctacttctgtgtactacatcatccaattctgaaagacataggcttccccatcccctgctaagactggttcaagtggcagctactgatggattgcagtgagaaggcatgcaaacacgtaccttcctggaagttgtctccaaaggctattgctctaagactcaagtatataaacactagaatgaatatcaactctatctagcaataaatgttatttttatattacagttgacccttgaacaacacagctgtgaacttcatgggccctctgacatgcagattttttttctcaactaagagcagattcagtattggtgggactcagaacctgcatatacagagggctgactttcatacatgccagtttcacagggccaactgcagaacttgagcgtgcatggattttggtatacacacgtggtcctggaaccaatccctgtcacatataccaagggatggctgtatgttactttatattcatttgttctgttattttataaggttgttcgtcgtggtatgtgggaattcaccagtatttcttctttctggtgcaccgttggtcatttctggcagcagtggtgaatgtatttactcttagcaacctctgtgctgctacctgttctgagtttcaaaggtgattcattaaagggttgggataacatggtgataggaaaaacccccctcatcagtcacaaggagtataacagcaatatctctgtaatatgattgatcatagatataatttctagtaggaaaaaaagtcatatcttgatgcatctctgagaatagttgaacatatcttgtgctattctttatagagaaattatctttgaaattaaagtcttaattttacttctagctttttataacaacataatccctacttggtatgtatcttaagatcatttttaaatgtatgatttgaagggcaaactagtgttatgtgaaaaatgacagataaagtagcttccaactcatcctcaagagttgatgatattctaaaccttttctaactaaattcagcttcttaattttctcaatataaatatgatgaaaatattaattcattaaatagtctacaagtattcggtagttgaagacttaaagtagtgcttgtaataacagaagagaaaaaagacattacaggcgtatctcactttattgcactttgcagatactgagtttttttggtggcaaccctgcatcaagcaggtctaccagcaccatttttccaacaaaatgtgctcacttcattagcatttttagcaatgattttaaattaagataatgtacttatttttagacaatgctgttacacacttgactacagtataatgtaaacgtaacttttataagcactgggaaacaaaaaaatttgtgtgactcactttactgccataatcactttatttgccatggtctgaaactgaaccggcagtatctctggggtatgcctgtatagatattttggttggtatttatttattgtatgcagaattcataaaaataaaaactgcgaggctgtttaatacatttcaactaaaagttgccagcatcattaatatgtaaaccactagaaataagattttgttaattttttgtttgtttgtttaaacagtcttgctctgtcactgaggctggagtgcagtggcgcagtctcagttcactgcaacctccgcttcctgggttcaagtgattctcctgcctcagcctcctgagtagctggggttacaggtgcacaccactacacctggctaatgtttgtatttttagtagagataagggttttgccatgttggccaggctggtctcaaactcctgacctctggtgatccgcccgcctcggcctcccaaagtgctgggattacaggcgtgagccaccatacctagcaaaatcaactctgaatctgaatcaaacctttgaaacaaaaattaccaatcaaaaaaacgtgcaatccctgctcctaactttgaaaaagtgacaaggaaggacatttggaaagatgtctctaagcagtcaacaagaaatgaaatcagggagagctttttcagcacctgaaaaaatacatgcaaaaacgcccgaggcgggcagatcaccggaagccaggagtttgagaccagcctggcaaacatgggggaaaccccgtctctactaaaaatacaaaaattagctgggtttggtggcaggcagctgtaatcccagctcctcgggaggctgaggcaggagaatcgcttgaacctgggaggcggaggttgcagtgagcctagatcgtgccactgcactccagcctgggcaacagagtgagattccatctcaaaaaaacgaaaaacagattcagagtttatttccttcccaaatacttcatagatgttggtttgtaggaataacttaaaagtctcactcgctttctgtcttttctagtaatttttatcgtggattctgattgcctagatctgctaattcattgagggttacaaaattgtgatactcgaattctttattcctccttcctttattacctgtaatacttcttaagaaaaactctttctcatcaactctatgactaccctaaattacagatccacatataggatctgtatacatgtatataaatatgtacatatcatatacgataatgcttaattctttcccattacttactaattttcaaaataatgtgattccctaactgctctctgaatgttatcaatgtggtggtaataatggtggtgtcgatgttgtgtggggtaaaatttgaatacagtgaaatacccagggcttaattgggttagtttttaaaaattacatttatgtaaccatatttcagtcaaggtgtagactatgtccatcagcacagagttcccatgttttcccttccagtgaatctccatcccccattagaacagacaataactgtcctaattactgtcactgtagcttacttttgtctgctctagaatttcttatgaatggaatcttatgtacttgtactgcatgaagactctttagattcatccatgttattgcattgatttatagtgccttttaaaaaattatagagtagtgttgcattatatgaatacgcaaagtgttttttttttacctgttggtggacagttggattgtttccagtttgggactattgtgaataaagctgtgtagtcttattgtggaaatgttttatttctcctgggcaaacatgtaggagtggagtttccaaagcatatagcaggtgcatatttaactaaaagtgtcttttcctcatttttaatattggatttttgtatttctattgactatagatattttcttaaaatatagcagtatgtcttatccttagttttgcttttttttggtttcagttatctttggtcagcagtggtccaaaaatatttattaagtagaaaattccatgaataattcagggtttttgatgtatgtgtgtgttggcgggtgcagggcagggagagttggttggttggttcgttggtttttttttttttaaagagacaaagtctctgtcatccaggctggagtgcagtagcatgactacagattgttataaactgaaactcctgggctcatgcaatcttcttacctcagtcctctgagtatctgggctcatgcaatcttcttacgtcagccctctgagtagctggtactacaggtgtgcagctaatttttagttggttatttttttgtagaaacagggtctcactatgttgcccaggctggtttcaaacccctggactctagcaattcttccacttcagccttccaaagtgctgggattacaggcgtgagccactgcacccagccaacaactcttaagttttaaattacatgctattctgagtaacatggtgaaatctcccacctttccacccagggcatgaattatccctttttccagtatatcgttgttgtctagactacccaccacttttagtctactggttatcagatcgactgttgcagtatcacatgcttgtgttcaagtaacccttattttacttaataatggccctaaagcacaagagcagtgatgttggaaattcgaatatatatgccaaagagaagctggaaagtgcttcctttaaggaaagaatttaaaaatcatatgttgaggttgctaaaatctatggtaaaaatgagtattgtatctatgaaattgtgaagaaggaaaaataaatcatgcatagtatatacagggttcagtactatttgcaatttcagacatcactggaggtcttggaacgtattccccatgggtaagtggggaatactgtatattctatataaaaggcccatttctgataagtagtttatgattattttctccaagttttcattttcttaagtgtcttctggtgagcagaaattattcattttttgaggtctaatttattttttcttttatggttttttatgtccttttatatctttgcctagcccaaagccacaaatatcttatgttttcttctaattgtgtaatataggtttaacttttatgtgtaaatctgtgatccaccaccaataaaattttgtgatgctgttagacagtggatgtcattcattttctaaatagttttatttatttgttccagtaccatttgttaaagagacttttctttccccattgaattgcctttgcacctttgttgaaaatcaatctgtgtgtgagccgtgtttctggattctccattctgttctattaatttgttttgtccttttgccaaaatgacactgttatggttactgcagcttcaaatcagatgctgtgagtcccacaactttttcattaggttgctttgacttttatttgcatataaatattagaatcagttaatttttacaaacaaaagggcaaagcctgcagagattttgatttgggttgccttgactggggcaggtcaatttggagagaattcacattttaacaatatattcttccaatccttgaacaccgtacgtctctccatttatttagatgtttgttagtttatctcagcactgttttatagtttttaatgttgaaatcatgtactctttggttaggaataaacttaaaatatgtttctaatgctattagtggtattttttaaatactgcttttcacttgtttattactatcttgaaataaaatcgatttttatatattgatcttatatcctataacctttctaaattgacttattctagtagttatttagtagatttcatagggttttctagtaaacagctatgtcatctacaaatcaagacaggtttctttctttccaatgtttatgttatttattactgttcctctattgcactggctagaacctttggtagaaggtattcttactttattcctcattttattgagagagactataatatttaccattaactgtgatgttacttgtaaacaaaaagtttgtatttctctgggattaaaaaccaagagtccatttggttttttactgttgagttttaagggttccttatgtattttctaggtatgttcttccttcattgaattgtttttttcacatacgttaaaaatcacttgagaatatttatataggtctgcttctgagatttatctgtttatcaggttttgtttcatttattttgaggctctatcatttggttcatacccatttagaattactatgtcttggtgattggtcctttatcattatataagttttttctgttttgcgattttctttgctctgaatctgatatgagtgtaaccatttgtttttttttaaattaatgtttgcatgatctgtcttttactatcattttactttcatcctgtgttgctgaatttgaaacgaatctcttgtaaacagcatatagttgtcattttaataaaaactgttagtctctgccttttaatttttttatttagaccatttatatttaaggtaattattgatatgttagggagaggtctgccattttattatttgttttctgtttctgtcttctgtttatggttatttatttattgccttccatgattacttgaacattttttaagatttttaagacccttgatttatttagtgtttgggttttgttttgtttgtttgtttgtttttgtttcgagacacagtctcgctctgttgcccaggctggagtgcagtggcacaatctcagctcactgcaacatcggcttcccaggttcaagcaatcctcccgcctcagcctcctgggtagctgggactacaggcacatgccaccacacctggctaatttttgtatttttattagagatgaggtttcaccatattggccaggctggtctcgaactcttgaccttgtgatctgtccacctcagcctcccaaagtgctggaattacaggcatgagccaccatgcctggccttctatgtgttttttatagttgttttcacggtcattgtgggtatcacattatagataatgtgacttaccaccattcactgccatcaataccattacatggaatgagatatggaaaccttaatttcagttgggtctctttccccacttttaaatagtattgttttgaggattaatgctattacagtttttgtatcagttatccaatatgacttatagaacttatcaagggagtgatgctctgttgtatgtacccatgtttctgctatttccattattttttccaagattccatcttttattacttccattagccagtcttcaaaggcagttctgctagtgagaaattctttttgtttttctctttctgaagatgactttattttccctttattcccaaagaatagttttatttgtgctatttggggttcgctcagcttcttgaagctgtaagtttgtgtcttttgccaaacatggaaaattttcaaccattatttcttcaggtgttctttcagcgtcactcttttctccattctaggcctctaatgatacaaatgttgagtcatttgttactgttccacatggacctgaggcatggttcatttttcagtctattttctctcttttgttcagatttctctcctttgtcatcttcactctactgttgagcccatctaatgattatttttctcctattgtattttttaggtctataatttccatttgcttttttttccttgtatcttgtttccttgctgagattttctattgtttcgtttttgaaacagtagaacttgtaattgcttgtcaaatcatttctctgatggcagcattaagatccttgccagataatttcagcatcttactcatcccagtgttggcgttttctttccttcatgtaattttcctggttcttggtatgacagataatttttggattgtgtctcggacattttagttattatatcaggagactctgtactttttaaaaattttaacttcagtagtaacctgttaaggtatagcatgtaggtactagcatatatttgtgagctgtggttccagtgaccatttttcagaggctttatggtgctgttttggtttgttgcttttatctcagtccactggggctcgcactggttcctagtagtgctgcttgaggggccttctccaggctgagctgcgcagagtgtgtttgggtgagggaagaggacccccactagattttcgtgggctggagagtgcttcctgagccttgtgcctgttgtggcaggctcccccttgctggtgttcctggcagtgctcctgaccacattgtgtccctgggctgtggaacacttgcaggaaaggtgaacactgccaggaccaattatagcagaattcctcctgccagtacacagcagcactgtggctctggaccagcaaggagagtctcaagcatgggtttgtttctttttgattttaagatttttcttctgccttcaggttctggtattattgttctgttttattcacctttatgtttcttctagtttagttttagtttctttgtatttgatgggatttttttccttgcatttctaattactccttagttgtgtcatgtcttcctttttttcagttaccctcattcagaaatttcccatttctaatgatttgttattttttaaattctttttagctcagtttgaaatttgtttacagttttcatgttttatttgcatattgtttcatgtactttgattttctgtagggacaccattctcatgtatatgcacatactttttctctaataattacactgtttcactctgttctgttatttatttatttgtgtgtgtgtgtgtgtgtgtgtgagtgaaatgagtttctcatacttggacgagggagagatgggccaggataacttttttcgctttttagggacgaggagaagtctgtgtttttgtaaaatggtcaaaaatatgcccttgtgctttctgaaactgccttctttactcctctatcccacacatatatttgaacttttttttggtttttattactgacctggtccattcggaagttattcccagaagtttttcctcggtacaaggtttgtttctggtgggggtttggtattcgggtgttttaagggcccagagcttactacatcatgatccctttgtaatcatctgcaaattagatcctgtagaactttttaaaactttaagccctgttttcagattggcctgtgctttccagtgggttggcagtgttctcagggctgtcagaaacccagtcagttaccttgcatctgcttccttactaaccagtcttgtagttgtcagagctttgtttctgtccaattatatgcaatggttcatggttttgttgtagataatgtctctgggtctttggttttctcattcagtttgctgtttttgtaggggaggttgggagggaataaaacaaaaaataataataataataactatgtcgttgccatcatcatctttccagaacctgctacctgcccttcacctgattttcgtatttatcagtatcattaccttaatctgttatctcattggggattgcaaaatggctgtttggggaaaaaaaatttccatctgcttgtcctacatatatacctggcattcttttttctcatcattgggtgccatttgattaccttgaaaaacagttctacagaaaaggcatgataaaatagatttaaggtttttagagtaaggagttaatgtaataattttaatagtgacaatttaattttgttttttggttggtttttgctgcctttttgaatattacgaactaatgaatgtttttgtatttaatacgtttcacagtcattactctaaatgatattcaaattgcttagctatcgtgtgcttttaaaatgaccctattagattttgagatttctaactaatctcgaacattcattctcaggcctggaataagttatttttccaataaattgttggagaatggcatttagaagtcagattttagatgcaaagtatggcctttgcttttgaacgttactgcttgtaggccttatcagaggacagaactaggaaaataatcttcctagtgtatcctgagaatcatcccacattattgcagaggtgttttccattttgttttgtatgactgaatactgctcctttgtgtggatgcagcatagcttatcaatatttatgggcatcgaggttatttttaaccttttgctgttagtactaatgtcacagtgaatcctcttaatgttcatgcattattccgtacatatgtaaagtatcattaagataaattgttagaagtgggattgttgcatcaaatggtagatgcatgtgtaattttgctagatactgccaaatcctccttcacagaaaaataacattttgcattcccaccagcagtttacaacagtatctcttttcttaaaactttccaaacagaatgtgttgttaaatgtggatgtttacttatttgccaattgagaaatggtattttactatagttacaatttttgagcttacctcaattatgaatgataatggacattttttcttgtagagctgtttatagttttatatagtcttttgctcattttgctgctcagctggtcgttttcttcacttttagaaactttatatgttaaggagattagtcctttaacgctggtaaattcgcaaatattttttcccagtttgtcatttgtcttttaaccttgcttataggatttttttgccaaatgaaaggttttatgtttatgtagttagctattaatctttttcgttattatgctttgatatgcatttctttagttatgtttattttattcattttctttgttttttaattttctagagtctgtcctcagtagaaattttagtcatactgcttcttctttggtcaccttataataaaattagcctttatttccaaagttaccttgcatatttcttcagtattttttagtattcttatttttatttaagatgtgctcatttctttctgaatttgtatttctcatcactggtggtctgtcttgtctgctgctgcattctccttttgtgttggaatgtggtgttactagtttcccattgtttatgactgaatttttctggtctacttttgtctaccggaaagttttgcttctcattcgccagactcttcccataataactttatttagacttccgaattctgtttttcttgtttatgtttctataacagatgttacttttttctggacctgttattactagacctcatggtggagcagggaggaattgtgtggctttaggggtcttggttgaagggatccctcttctgttgctttagtaagggcagaatcaccactttctgatttttcagctccatgtagcttaatgaagactctttttcattagctgcttccacccctttacagccgcttaagggacacttctgcttttgaaggtaccccccttcctttcatgcatggtgccttcctgagcctgccattgctggacccaagtacttttctgtagtccttcctttaaccaccctgttgccagtgctctaacctacactcagtagtgctctgttgaggggcaggtggtggagggggtggggtctggccttgggtgatccctaatcagtatgattccgcacaagccactcttcgatgtagctcctgctggaccctgctcatttccccacttctttggtatttggagtttattgttctgtctcctagttttactctagacctaagtcataggttttttttttattttcccctttttgatccgggtagatttttagagatgtgagtaggatgtgatcgatacagccaccacttttatgtggaaacctggaagcttcttcgtgttttcttcagctttctaaatatatgcattcttgtttaattcaaaatgttaatgtaacacacataacacttataggaatagagatgcattttgttccctgttttcattgtataaaatttttaaaggtttcgtttaaaagtccaaagaaacagctccgtaataatatagccagactggtcattgtgaccactgctgatctgccacttcctgcagggtctgtctctgttcttcggtggtgctctttggtctacctccttaggtgtagctggttcagttaagcttcagagccctcctgcagtgtgaggaggctttattaccacccactgcagggcagcttttctgctatgttggagggttctgtgctacagcagacttgttttctcttgtcagcctccccaaaaggagtatcatgaactggggtccgattcctctcctccttacctgagagatgctcctgcaagtttcatgtccagttttctgttgttgtgtgtttcttttttgttttctcttgctgactggtggatttgtaaaggggcagggaagggaagtggcaagagattggagaaagccaagaattctaataaaacttttaagttatttcagataaatggtgttgcagcaccaaaaatgccagcattttggtaataaaaatagtatgttgggatattagaatatcaaaaggtagaaaattgtaattactggtttgggatgtgtgatgttctctgctaacattctggaattttttttttttttttttttgagatgaaatttttttttttttttgagatggctcaaaatgtttcccaggctagagtgcaatggtgtgatctcagctcattgcagcctccgcctcccatgttcaagcaattcttctgccttggcctcccaagtagctgagattacaggcatctgccaccacgcccggctaatttttgtattttagtagagacagggtttcaccacgttggtcaggctgatcttgaacccctgacctcaggtgatccactggcctcagcctcccaaagtgctgggattacaggcatgagccaccacacctggctctggaaagaactttctaaataactattaaaatgcattttatattatataagcaactaaaaatacttttaattttttttttaattttttaatcttaacattatttagctataggccaggcgcggtggctcatgcctgcaatcccagcactttgggaggccaaggtgggcggatcacgaggtcaggagatcgagacccatcctggctaacatggtgaaatcctgcctctacttaaacgtacagaaaattagccaggcgtggtggcaggcacctatagtcccagccacttgggaggctgaggcaggacaatggcgcgaacccaggaggcggagcttgcaatgagccgagatcgcgccactgcactccagcctgagcgacagagcaagactctgtctcaaaaaaaaaaaaatttatttagctatgaactagtgtatatatgttttatagatgcctgattattcaaataaacttcaagattgcactttatgagcttgtatttcgttttttagaactcaaactaacataagtgtcattaaaacatagcttttattacatagattttaggaatgccacaggataaatcattctcttaaaataactgcaggtggcagaaatgtcagaataattctcctcctccatacacagcacatattacttgtttaaagtattctagttcatataaaaattgaacttttgtattactgctattaggtatgtagttgtttgcatttggggccagttggttggggcagggggtctttttttcttttgtccttaatctgtatcactttttcctcccaaagttgagttaaaggatgagtagaccaggagaataaaggagaaaggataaataaaatatatacccaaaggcacctggagttaatttttccaaatattcatttcagtctttttcaattcataggattttgtcttttgctcattactgactgcataatgtgattataccatagtttaaatagtcacttcctgttactacacacttgggttttctcaattttttactattgtagtactaatattttactatattgtaatctaatctaaatttttacgtattcagagctgttcaggataaatttgcttggaaatttttaaatcaccagaagtgatactatcctgataattaacttccaagttgtctcttaatatagttttaatgcaaatcataagcttatgttagtaccagtcataatgaatgccaaactgaaaccagtattgtattttttctcattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggtaggtaattattaacttgtgactgtatacctaccgaaaaccttgcattcctcgtcacatacatatgaactgtctttatagtttctgagcacattcgtgattttatatacaaatccccaaatcatattagacaattgagaaaatactttgctgtcattgtgtgaggaaacttttaagaaattgccctagttaaaaattattatggggctcacattggtttggaatcaaattagtgtgattcatttacttttttgattcccagcttgttaattgaaagccatataacatgatcatctatttagaatggttacattgaggctcggaagattatcatttgattgtgctagaatcctgttatcaaatcattttcttagtcatattgccagcagtgtttctaataagcatttaagagcacacactttgcagtcttgtaaaacaggtttgagtattttctccaccttagaggaagttacttgacttctcagtgacctaacctctaaagtgcatttactgatgtcctctctgtggttttgttgtggaaagatttagttaaatgaactgtaagaattcagtacctaaaatggtatctgttatgtagtaaaaactcaatggatacagtatcttatcatcgtcactagctttgagtaatttataggataaaggcaacttggtagttacacaacaaaaagtttatgatttgcattaatgtatagtttgcattgcagaccgtctcaactatatacaatctaaaaataggagcatttaattctaagtgtatttcccatgacttacagttttcctgtttttttccccttttctctatttaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctgga

SEQ ID NO: 49 - DNA, 429351 bp, Homo sapiens
  source 1..429351: mol_type = genomic DNA
atcatgggaccgggtgagcgctgagaatcgcggccgcagccatcagccctggagatgaccaggagcggccactgctgagaactatgtggagagaggctgcggtgagtgctagcgcgggacgccgggcctgggaggcccccttgggaaggggggaggtgggaggcctgaagagggaggaagcggcaggatcacaagagggtcgctgcgtgggaaagatccacctccctcggggaaccgggaccgcgggagcccgcgtccttccctccccctctcctactgctggctcgtcacaaactcagccagcgcccccccaccctcgttacctcctctttctctccctacctccctcgctcagcagctcccggtcgcacaactcccagcagccggcgctggggaggtggtagggggtgcgggtggaggtgcccagttagcttctcgtgggtggccaacctggggctcccattctcctgtgcaccctggagtggagctcccgctatcagccacaggggctgaggatccgcactgggggcgtcgtgggcatcgggcttcagcttcccccctcttgtctagcccccctgggcgcataggggggcttgtgagcactgcagactgcagccttcccctcaaccctccctcccctcgttggtgggctgaccctgcctctccttctctcctccgccccgttagagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacaggtacgtcccagagggagatcagggctccttgggccggggaggagggagactcgaccggagggagagcgggagagggatcaggctagagagggagagggaaagcgggagggagcccagcggcgaagtgcaggaggggcaccagggggcgctgcggctccgcgctccgcggcgcttacccaggaacgtcgaggcctcttggagttcgcctcaacttcccccggctccagcagcgtccgtcccgagaggcgcgcgtcagggcacgcgtgcacgaccgtgctggtatttgcaggtacgcagggctgtgcacctgccgcagttcatgcgtgtgcaccacctgaggacatgtgaggactccggctggccgtgggcaccgctacagcagtctgaggaagtgcgcagaaaagcgcgcgtgcctatgagcgtgtgcggcccactgcccacgtgcacctaggacttggcaacagcgcccgcagtagaaaggctagggaggggctgtacagtccacgtccgtctgggagcttcttgggagcctacctttccccctacgcacgttctttgccagctcctacgcgctggcccgcggggggacgcgcctactctccagaattcagcattgcacacggcgcgcgtgagagagggtgtgtgtgtgtgaacatgtgtgtgtgcgtgtgtgtgtgcacgtgtgtgtgcacgcgcgcgtgtaggggtgaaggactctccacggccccttggctcgaggtggggcgagccccaagttccccaggcacagcggagcctgggcccaccaggcagcgtcctcactcccaagcacttggggtgtactctgactgagaggagccgggtctgtagttggggctgggcgtagagcaaagtgtgtggtgcacacgacgggctcgtagggggcggggtcagccaactagctgagctctcaagctgggacgcggggtctgggtgccgcctccgcacgccctgcggggtctgtagttcgctccgcgccagcagggggcggggttgataacttggtcctctctatcccaggtgggaggggttggatggagggtttattctgtgcacctaggagcttggtggggtacagaacacgcgcggcgcttagggtctgtggcccgcggcgaacttggggaatgcggtgggggatatggacagagatggggatggggaagtgcctggagacaggggatgaggaagctggatgcgagaaggggctgggggatggagaattagctcgaattggagttgtggatagagttagagatggatcgagggatgtggatggcgtcggggactcggaatggagtccgtgatcccagcagcctatcctgctgctgagttccatgcctggctcctagagcaggaagccaagttggtaatccctttcttctggtcgccttgctcaccgcggccctgcctctcactcttcaccttgcagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggtaaggccggaaactgatgccctgccaggacctgggaagccaccagctgcatggcagctgctgcaggtcttcggacgcccctagaatctgtcttgatgtgaagtgggggtgggggtgggagggtcgtggccactggccctggtgagaaccaggtcttgcctctccaacccagaaatgaatggaaatgccttttgccttgtttctgaaaatggtgtacacaggagcactttggtgtgtgtgtgccaggaagcgctcagaaaactgagaagtaggctgtggggtggtggtggtggcggtggtggcatgtttggagatttacgagtaccatggggcacagaggtgggcccaggagcactggagacatatgcttcctattttcacaatgccagttttacctgattgttttgtgggaaaatgtccattttttcctcttatggtaagtgactaaaactatttctaaaaattattaaatgtgggtaggttctggaagaaaatgcaaagtttttaggtaaagcacaaaagggcagaaaaaatgtcatgcttcctctgactctgcagttagaggaacagaggtggggagtttgagaagccctgggccagaggagcggaggagagacccgttcctcaaggggagtgggtgggagtggaaagaattaactccaaacccagagcatggagggcctggcattttccttacgtgttctttgtctggggctccaaggccctcagatgaaggagttggctcctgaacaaagatgggtcttggtactaaagttggagagtctcaaaatgcaagaaagagtgtacaaaaatcagttggctctgaatgagagggagggtcttttttgtggacagcctgggagctttggtttggagaagaagggagagagatttgaagatttgaaggcgatgttatgacagcctggtttgggaattacacagaagtggagggaaggaagaaggctggaatgaagaagtaaagtgaggaatgagaaaaaagggaaagattggagttgtgtgtgtactgtcctctaagtcctgagaaaagattgggagttcagaaggcgaggaaagagtaagtgtacttgtgtgccatagcctctagccctgagaccttcttggagagtgttccttagatggcaggagatattctagtggagtgagcagacattcactgtagcgctttccttttgatgctctcaaagcacttttatattcatcacatcagcttttgcttctgtttcagcgattcctaccagctcctttggtaaccgtattaattctttcaggtctcctgggctgcagcacattcagctgtagcacacaattgatgcagtgtcttattaaacattcattttaaatgatttgcaggctagcagaattcctgtgtgtagctgagcattttcccagtcacttctcagttttggggggctcctgtctgggaagaagagagtagggactagccatgctctgccaccactgacaatttcagaactggagagcatcttagggtttcttggagcatgctgtaactttcagatgaagtgactgagccataggggagttaagggaatttgccaagaccacatagtggctgatgtagctaggtagctgaatttctgatcccaaggtgtgatcttccattccactaaatcaagcccatactttaatgatgtcatccatcttcaggagggacaagggatcagtttcattttgtgggaggggctgagcatggagagctatgatgaatcacagcctagagggcttttgtatgggaggggccaatcttctaaagaaggcattgagggagaagaacagccagtttccagccacgccttggagtatgattttgggatttaaatattaccacggatcccttcttccttcttgagtttttctaaaggagtgatagactggaaacagtaaccatactgaaagtgaaatttctggatccatgagggtttggcacaacccaatggagaaatctgggaaaagctgaattggaaaaggtggtgtgagactgggaggttccgggtaggctttggctcttacttctaagtctcagtcgataggtgtgtggctcaggctgtcatgtgactcattcatccgaacgtaggcagagagaagccggaagagtgtagggtcatggaagggaacccccttgataggcagtgaccctgcctgctagtgaatcttgacccagtgaatggcaggttgtgaccaactagaccagcaactgttcttcccttgaagggggcattagaaagaaagttttgagaagtccagggagtatgggtggaaacattcttctctcctttgggatgaaactgcgttttggggatgtggaccaaaatgtgacctcacttaagagtaagaagagaaaaggaatcaggaaagggcaagaggaagatgagaaaagacatttccagagaaataaagaatagagacttaagaggggttggagagaagaagaatgaaagggtccattggttcaaaaatggaggaggggattcgatactcctgattgttgttgggactttcagagttggtcttggagacattggccactctctgtgattctggtggaactgtagggagatgaggcaaggtggcagggaagcaaagagctcagtggaggtaacatcggggtatatgtctggtccccatgtggaacggtgatattgagaggagttgggtgataccaagagaagttggtttaaaaggtcgtattttgagaaactggggatgtatttagaaaggagattgtctgagaggtgaacagcccttccttccattagtaacatatatagatggcttgtgcttctgccacatgtttcatttagagctgaacattgagtttatttgtctccaaagaaacagtcacggtgcattgtttaaaactctgccttgcctcgcttgcaaatggtattatgactacagcctcaaccttcctagattgacaaggcctctgcctcctgttaaaatgatgttgatttggtaaagtcatccagaacacacgtgtgttatatttacttctacattggcaacatgatagtgcccctgctggtaagaatagtagtcaatttggttatcagttaaaatgaacacacacacacacatttttttaactttttttatttttatttttatttttactttaagttctagggtatatgtgcacaacgtgcaggtttgttacatatgtatacatgtgccatgttggtgtgctgcacccattaactcgtcatttacattaggtatatctcctagtgctatccatcccccctccccccaccccatgacaggccccagtgtgtgatgttccccttcctgtgtccaagtgttctcattgttcaattcccacctatgagtgagaacatgcggtgtttggttttttgtccttgcgttagtttgctgagaatgatggtttccagcttcatccgtgtgcctacaaaggacatgaactcatccttttttatggctgcatagtattccatggtgtgtatgtgccacattttccttctgtctgtctacttgaccattgaagaaaataacaaagccttataacaattgaaatgtcatgcaaatgtggtggatttttgtggtgttaatttaatttacaatggaggtgctaatgttttgctcgcatcattgggtagtcttgcaatataactaaattagaggtgaaaataaggctgagcgaggtggttcacacctgtaatcctagcactttgggaggccaaggcgggtggatcacctgaggtcaggagttcaagaccagcctggccaacatgcttaaaccccatctctacaaaaatacaaaaatcagctggatgtggtggcaggcccctgtaatcccagctactcaggaggctgaggcagggagaattgcatgaacctgggaggtggaggttgcagcaagccaacatcatgccactgcgctctagcctgggtgacagagtgagactttgtctcaaaaaaaaaaaaaaaaaaagaaggaaaattaaaatcaataaataagaggtgaaaataatgctcgatgtagatgaagttctaatcttatcttggcttggccattttgaccctgtctaagtgaaatacactccagctgcagtaatagtccctggtaagcccagaatatgggctagatctttacacttctgctcagtgtccttaaccctctcaccccccatcacttctccccatattcctaattgctccatgcaggaaaagacgaggctcagattttagctatatccatccatgccagttatcacttgggtttcgttttctatgttattcctatgcaagcctcatgtcttctgccagagtgtaagtcgtttgagggcagatttttaaaaaaactgtttatctgtatatgtgtatttgacatgacaaatgcttctctcctccgcagacatataaaaataatgccttttcattgtagagcacttaggaaatacattgaaatttaaagaagataaaaatctctctccaaatcctatcaccatgggtaaacattactgacactttggtgtatttccttttatctatttagttgcatgctcaggattttatagtatatatggtttttcttattgtgctttgccctctgtggactttcttagaggattcaagattttctttaattctggagaaaatctcagccgctatctgttggattctttctttccatcattctttctattctctccttctgaatatacatgcatatgtatagtcatgcgttgcttcatggtgggacacgttctgagaaatggatcgttaggtgatttaatcgtgtgaacatcacagagtgcacttacacaaacctaggtggtatagtctgttacacacctaggctatgagctataggctcttgctcctaggctacaagcctctacagcatactctactgtatgaatgctatactaaatattgtaagcaactgtaatacattggtgagtatttgtgtatctaaacatatctaagcacagaaaaggtacagcaaaaacttagaatataatcttatgggaccagcattgtgtacttgtggtccattgttgacctaaacctccttatgcagcacatgactgtactatatatatatgtgtaatttctcaatcaattctccatgtatcttgtttttttttttttccagttctctgtttgtgctgtgtttgggaaggtttcttcaattctatactccagttaactacatcatttcatttgtgtctggtctattattttattttagaaagaaacagcatggatggtctattattttgactatctgttgagttatagatttcaacaaggatatactttatttccaagataataattggttcctctttacacctccctgtttttttgtgttataaataatgaaaaactcttctcactttgtgcatgtaactccctcccctgtcccttcaaagattaaaaaatatgtattataaagttcttctctgattgctctagcatctttccttcttcagttgtgaagtccttcatttgtagaatcagttagttggatgttcacatatgttctttaatttttgtttgtgaacttattttcaaggcaactttatgatttcttatgccctgtatctgtgagggtgtgtattttaagccagagcccatgtcagcagctcaggtttgtactctcttcccattctacgtggcctgtggtacaggcttaggagtccatctcatgtaggtgacttcattttggctccttgacacagatagggtcctgctttttggctgtgactaatggtggatggtgcagatgttccagcaccatccacagctagcagcctgattctaggtccagttcttcccctttttccctggatggacattgacacctctgttctcatggctcatattggacctatcctccatggattatgtggctttgattcctacttgaaaccctagagtcccgtctttcagttcatttatttttagggattactctctatttttgatctgtgattctcttttcttatttgcaagcaatactatgtaaatttaaaaataactaaaggtttctttaaaaattctatgtcttaggagcagaaaaggaaggttactgagtgtgttcactcggattttgaccccgttttatttcacaacctgcttttatatatttttttaaacttgattatgtattcttggaattttcctttatcactacatagacttcttaaacttgattttcaatggctgcagagtgttcagttcataccacaattattttaacaatttctctctttttccaccattaataatattcatttgtgctccataggggcatccttttcagtacctcacacttgtcctgccctttgcgtttgttacacggtaaatgtttgttgattgaatgaatctagtcattggctccgatgccagcttgttggagcttccggatgaacatatcacaatatggttcagggcattcgtgcagtgtttgttccctcaatgctgactgatttcataggtgtttgccaatttttctcttctctctagtgggcagataattaccagccatcctgaggattagcataaattggggggttacatacgaaaggcctgtagagaactgctgagtaacagctcatcagcaggaggtggaagttggtgctcttgtaacctggcagctccagagtttggatgcgagtgatgggccttcccattaaacactgagagctctcgaaaagggcagacgcacagatcggaatgttggtggagcccactcagctcctgctaaagaggcatcaggtagttcctgggagagtggggagacctatctttagtcttttccatgaggcatgtcagatgcgatcatcaacacctcctcacttaagtcatcagagaccaacaggcgtcctcccggtagcgtgactcacactccaagtagccctcaggggttgctgacaatcgtttgggccctgaagagctgtggtctggtgggtttgcagcggtgtttatcttctttctcatagcctcagatggaaaatgctactgtaggcagagtgagtggggaaagagagagaaagagggctgtgcagaagagaaacaggaactgaatctctggtttgtaatagagagttggtagcctctgataagtcatcacataaatgagacattataaggttattaattggtgtcttttgtttgtcctgcatcccccatccttgatctttcaacttctaattctttgccaacattttaaagttggaagacatcccattgaaaagaaaatccaaacttcatgctgctttgaaacagtcagaaggcctggccatactggccccgattccccctatggcaacagttggctggagatgaatctcatcccccaaccccacctgccacgatccctgccctcccactgccatcctgggacaggacaggtgcccctcctttcttaaattccccaaagtcacttcacttcacttcacttcactcatttatgttacatacacagtatcctgaaggcacttggctgtgaggcctatgatgtaggtgagggaagtagctcttccaggggctgctcctggataagacggcagatctatggcatgtatgcaaccatggatgccatgttcactgctgccatcattaatctcctataacacctggccctgttgagcccactggccttaaggccttctcaacacagtactccaggcagccatgatgaatcaacttgagttggaagatccaagaaaaccttggacaaagagtctgaagaatgaaattcaattttcaaaaatacctgtgtgaccttagaaaaggcccttcacctgtctgaacctctggttctcctgcaaaatgaggatttgggacaaaattatcactaagatctcttccagctctgaaaattttgtgcctcatcaaggaaagactggcaacaaacataccaaaatatgaatagcagttatctttggggtggtagactcatggctgctttaatcttttaaagaatgtcattatcaagtggttaatatattgtactttgagttagattgcctgaatttaaattcagggattccacctcttactggctgggtgatcatggggaagttcttaatatcttgagcctcaatgtcttcatctctaaaatgggaacaataatagcatccactttgtagagttgtgagatttaaatgacatcatggatattagtccatgtctcagtgcctaccttataataaatgcttattacaggaatgctattgttattgtgtctgcattttttagtttttatttttctccagtgtacatgtactttttaataaccagaaagagtgattaaggatgatgtggttacatgagggtatgctctgaaagaaactgggagtgaatcccacagaactgtcagaagtggagggtctaacatgaaatgatttgtattttcttaactgagacaatcagaagcttcctttgcctttgtaggacttgctgagagctttatcctggcaaacggaagctaaatgtggccagcatgaaagtgatcgcaggagaagactatctcattgacctttgcactaaatgactccaccaactggaccatatgtttgcacgaggcttagggatttagagtgtggacatatatagtttctcattttatctctgccaaggattaataactcagtgatagcctgggaaacctggcagctccaacggtatttgtttaaagaatctctattttcagatgaggaaataaaggatctgggagttgcagtaatttgtgcattgttcaaagctgtaactagaacctagggctttgggttcttattcttttgctcttattttattaccctttcaagttaatgactacgaatacatttgatttagggaaggggctcagatgcaagacaaataacagattttgatgttcatattttggttgtcttgactaaaaggattaagatgttggatgatggaattaaaattcaaaacttcagattgaagtgatggagtcactctaaagactgcactggaggttccccccataccgcactcagctttaatgaggttaactgacaaagaaaaattgtatatattaaaggtgtacaacacaatttttttttttttttttttaaagaaaacagtgtttcactctgttgcccaggctggagtgcagtggcatgatcatagttcactgcagcctcaacctcctgggcttaggtgatcctctcatctcagcctcccaagtagctaggaacacaggcgtgtgccatgatatccggctaatttttaaatttttggtagagacgggggtctcaccatgttgcccaggctggtcttgaactcctggactcaagcaatcctcttcccttggcctcccaaagtgctggtattacaggcataagccaccgtccccagccccaaatgatattctgatatacaagtaaatgtgagatgattgtcaccatcaaactaattaacatatccattacctcacatggttacatttattgtgtgatgagattacttaagatgtggtatcttagcaaattgcctgtatacaatatatttttgtattgtcaccatgctatcaccagtcaccatgctatacattaggtctctagaacctatttaccttacaagtggaagttggtgccttttgaccaacctctctcaatagtttgaagaagaattttcactattgcagaaagggggatgtgagactttgcaactcacttagtcataatgtggctgcctctgttccaactatcacatccaactcacttgggaatggtttttgcaagggtcatgaaccggtgtactgcacgctgaatctggctcatagatgcattttgtttcaccagtacagcatttttaaatgcttgaattttaatgtctttagacagcatgcattttcaaattcactacagctgtccccactctgttatcccatatctagggtgattcatacatttatgttaatgatatggtttctgtgagtatttgagatcatggtgctcaaatacagactttttatttgtttgtttgtttattttgtattgaccagaagctcagcagatcctaagtggggatatgtggaggccacatatctagaaatatatgtggaggccacatacgttgtggccttataaaaagtggaggccacatttatagaaatataatgtttaaatcaagggaggtgatagctccattatacctcttctgttgtttggagtgctttcaggtgcaagtaacagagtctttgaccaacagtgtcttaaaccattaaagacattcagttttttgcttagtaaggagcctcagatctagcttagtgacttaatgtcacattgaggactcagatccttcccattcttctactttgccttcctcagctgctggtttatctgagtcacaatatggctgcttctgttccagccatcacaccttcacctcctagcattcaaaactggaaaaaaagggagagaaaaataagccttcttctagggcctctatcctttcattggagtagacttcctcttacatgtcagtggccagaactgggtcacattcccactgctcaaacaacaatgatagagatccaggattcctctctgagaatgggtaattgccactgagcaaaattgcttctgttagcaagggtgtggggtgatgcttcagtggtacaactggtgatgtctccagcaacactaacaccattatatgtagcattgcacttagttccgaggagtgatatctaaagatggacgttgaaaaattgcaatgcatgcagaaaaagggcctttaggattgcgtagactctaaatgaaatatattaagagtttcagaagaagtatttagggatgtttagcctggagaagggaaatctcagaggggatatgggagaagtgttcagatactccatgggctgttacaaggtagaaggttaagtcttaattttgttattgttctggggacagacataagagtgaaattattattattattattattattattattattattattattattgttattatttgagacagagttttgctcttgtcgcccaggctggagttcaatggcacgatcttggtttactgcaacctctgccgcctgggttcaagtgatgctcctgcctcagcctcctgagtagctgggattacaggcacctgccaccaccatcagctaactttgtatttttagtagagatggggttttaccatgttggccaggctggtcttgaactcctgacctcaggtgatccacccgctttggcctcctaaagtgctggactacaggcgttagccacggcacctggccaagagtgaaactataaggagtaaagtttcatcttgatatgaggaataagcttcggcaattaggtctctaacagaagactgtgaggattcatggaataggaaggctatatcaggatatgattgagctaacagtgactgtctgtccctcaggaatgaggtggaaaattgggcttgcaaggttgggttgggtcacctctgaggctctttcttattcaaacactctgtacctctcaaatccttgatttttaaaaaaagatctccaagccttggtgctttaggccaagcatttggctgaaaaccaacatcctcactttttccaagtgtgtgagtaattcagtataaatttgcctggcatggaggaggaatttataatccctgcatcatcacctcaagttcccaaaagactttacattatcctgaaggtagaagatatttgaaaagcagacaacctatgtatatatcaactcacacacacatatataaataaaaacataagtaggtcagccggcctcatatttactagtgaaaatgtttttggctaagaagctcatctacagaagacaatgtttagaataattgccaatgatctcgaaatggggtgtttttgcacttgtatcaggttaatcattattacttaataaagtatattcagcttgttttgcacatcttactgtagtaatatgtttgtattctaaagagccagccagactcctctctggtttttcagttgacaaattattctttttagtcagttgtattctcctgcatttggaacatctgcttatggcagaaaatactctagatactattctgttgtttatccacttctcctattcccccacatccccccaaagaaaaacgaacctgaaattgctttccaaatgctttcactttctgttcaaattttggaactttccatgggatggcaattgatatattgtctccattttttaaactttgaaatagatgttgatgtacagagcgaaaaaacctaaataatacaatagagcattcagagaaagaatatttgctccattaatgcatcgtagatcttcgaactcaggttcccttccatggaggtggctatgttacccatttcaggagggaaaatattaattggaatggaaatttctttctgtttgtgatttttttttgctgaagtcggcatatggaaaggatcttctcttaaactacaatccctgacttgaaaactacaatccctgacttgaaaaaggttaattgtttccattggtccctaacagtgactcttttgccaaaacaaaaataaactcactctaaaatgtaagttgtgatttccaaaaatcactgacaccttgaagcttggctcacaaactcactcaaagaatttaagataatttggggtgattttggggggagttggggaccactttaaaatctaatgaaggctacggacccttccagaggagtgcgtgttcataaacatgcagtcaaaattatgtgcaatttcaggggatcacagaccctctgaaaccctttcatagacttccttggatttgatttatttattggtttattaaacacagttgatccttgaataatgcaggcgctagttgcattaacccccatgcagtttaaaatccatgtataacttttgattcccataaactatagcccactgttgatcagaagccttaccaataacatagacagtcaattaatacaaattttctatgctatatgtattatatagtagattcttaagtaagccatagaaaagaagatcataaggaaaatcgtaaggaagaaaatatgtttgctattcaagtggatgtgggtcatcataaaggtcttcatccttgtctttacattgaggaggctgaggaggaggaggaagaggaggggttggtcttgctgcctcaggggttggcagagggagaagaaatttgcgtataggtagacgcatgcagtgtgttgttcacaggtcaaatgtatgttcattcttcatacatttcttggctttgtccttggaccaaaatgctttgtggatgcatctgttatcaatttgtttcagaatctagctggagagactcataatgcaagtgcagtatgattgtattcacgggaccatgggaatgcagaggagggacagcttcatccacaggtctgagggtagggatctggggtcaaattggagagctggtctggaagaggcttgtgtcctgggtgcctgcccctacaggttgtcatcccccacagctgaagatgagctgtagagggaaggctggctcatggaggagcagaattgagttcacaatctaagccttcctctcctcttaacctgttcctcaaggctgccagtcttgagtggtcttgaaagcttccaaattctcctctggatggcatttcttaccatcaaacattgagctttttgcagatttccgttttgttgtcacaaatggctgaatgtctcctgctctatcttgtctcttcaaattaggaatacctgcccaggaagagtgagtggcatttgaaatccatatcgtcttgctagtctgctgtcctaggggtgaaagaaaaagacatattttcctggcgaattgttttaatgctaagatatctgtaggactgaggaaatgtagtattaactgacttgggtgagtagactcagaacgatgtgaagaagctgtggagctgtggaaaaaggcaggcttgctgtagttctggtgttagggtgtgtgcatggcttccatgaatgggattttgaaaatggcaggccttgggtgaagaccttcatggtcaaatttgcactttagttaaaaacaaatttgctattggttttgccttggttaattgatactagtttttcctcttctcttctcctctcttctttttctcttccctcccctcccttctccactcctctcttctcttctcctctcccctcccctcctttctcccctcccctcctttctcccctcccctcctttctcccctcccctcctttctcccctcccctcccctcccctctcctcttctctctctctctgtctctgtctctctcctgtttagcagcattgaaagaaatatttttatcatggacccactgctggatcattttaaagcaaatccaagacatcattgtgttcatcagtaaatatgtcagtatatatatatacatatatatatatatatgtatatatatatcaaaaatataagaactttaagaactgttgaaaaaaatcacagctaatatacaagtaatctatacatatgtattttagaggattttgtgagaatcagggcagtataaagaaaataaaaatcacctttactctcagcatccacagacaactgctattaacattttggtttatttccctctagtctgttttcctataccttatttacaaatacacactatataattttatagatagcttttaatttgcttaacattttatcatgaggctttcagattacttgtaaacatttttatcttctatgttttctattctgtggatatctcatgatttacttgataatttagattttccccaattttttgccatgaaaaccaataccttgtttaacatctttgtaatgaaatgtctacatcacagattattggcttttaatagaatccattactgaaattaaagaattttaaaactatcaatacagaaccaattaaggttccgttaatttgttcccagaaagattgaatcactggacacttctaataactatgtcttaaagtatctctgtcacttaactctggctggctcttgaaacagaaatttttctgattggctagacaaaaatattaactcattgttataatttgcatctcttttaagacacctgccatggaatatattttaatttaagcatcgcttttatattccctaggtattgcatattttaactgctttgatatttctcattgtgtaaatggaaaacctcagacaatgatggcttccaatataacatacagtggagtaatttgaatttctaaaaaataataaatattttgaagcctggcggggagttctatgattattcattcttcatcaccaggcattgctcacccattgtctctgtatcagtgttgtttcaatcattgctttaatatgtaaaatttctcagcagaaaatcattctgtgggaccccactgttatgatttgccaggagtctaggtagagactcacgtccaattgggctggagtcatgttcgtgtcccaggctttgtggggaacggtagggatgggaagcccttgtttgttcctttctctaaaaaagcagaggcagggtgaggttttgcggggtccgtcccgcagaccctgacccaatgacagatgaataaagttccctgacgcacagatattctgctttgccagtctagctgagtgtccgtgccacttacagacaccaaggaaggttctgtacagagtcagtggccacggcctcgacttgccagtgagactcacatttattcagtaaatattaattgacaaaggttgtgagtaaacacattggtgggtaattaacctggttgcccctaccccggagagagccatcatgcactcaagaatgatcaaatattggtcttaagaccacgtgagtaaacaagctagttagataaactgctctgccttcctttgtacccacttcaagctatttacttaaggtaaggattaggttgccttaagccataaacttattctcagacttttgcaaaaaccttcaggccttccaagaaggtttgtggctattctctataaccaaaatttttcccaccagtctgattgaatccccacaaggttgtaacaagaactgccttgtgataggaaagggatattgcccaggtggcagggggcagtaaaatgagttttaaacaaaagtgggagagatttatgtttgatattaacagctgtgaggaatactcaaaatatttaaccactacagcattatcacagctgaatcagaatagacactcactttgtagaattctggagcacctgttatgtgaggtgttaatcctttagtggctggttatggggaggtagggggttcccaagggaggggctgagtggcagggggcacttggggttcctggaagatgtggctattcacaagcaaaacggaagcatttcagcctttaaataaccagttctgctgcaccagtgcacaccagccaggatatcagcgagatctcacgtgtcatttatgccaacgtgtatgcagaagttttctcagggaactgtttagaaaaggacacaggatggctgtctcctctgccatatattaaccatgccctgaaaaagggaggtagggctgagagcattttgaagatctctttcctaaaatatgaaaacagaaatgtgcttccttctaaccttccaccttctgagcctggtgctttggcttgtctcttgtgggttaattttctagctgtctatcataagcctgcctttctcccatgaaaagcacaggagctgaagccagctgtccatgccaccgcccactccccactcccatgttccctgtcttctagggcaagagattcccaaacaattcctgttttcattggggttgaatgaagagggctgttttagtctctggttttggggtgtgatgtgctcatttgcagaagcataaaaataatcttttaactcaccaaaaaatactccacagcctaaattaactttgttaaagatcaactttcaaaagagagccttggatgtgccttcgtgggatcatgtgcttagtttacttgtagagtctgtggcttccttccctcctccgaaataggaaatcctccatccctgtcctggttcatggaggttttcaaatgggcttcaggagaaagaagcacgtctctggtttcatccgagggtaggagaaccctctgatatgttgtttattgttgagaatgcactgaattgtatctccctaaaagtcatatattgggtcctaacccctagtatctctgaatgtgacactttggagctggagtctttaagagtaattatggtaaaatgagggcatataggtaagccttaacccaacatgactggtgtccttataagaacaggaaattaagacacaacataaacacacaaagggaggaccatgtgaagacacagggagaggatggccatctgtatgccaaggagacagttttcagaggagcaatcctgcagctcccttgtcttagacttctagctttgagaactgtgaacaaattacatttctgttgtttaaaccatctttgctgtaataaagactgtgatcctttgttacagcagcctgggaaaatgaatacagagaggttgggaggtagttagagcttaattccaaggcttctcctcactcctcttctgtaactgagcctcagtggagtcaagacacctcagctcagaacccagacctccacctgctctaacactgactttgttcttctcatgtgggctccctttctggacactaggctcctgctttgaggaactgagtccctgtcttagaatccttcctaaaacccttctaggacttctaggttcaatgcttctcaggaatttttactcaaatagtcctagggggtgtggtaggcagaatcatgtccccaccaccccctcttccccacccaaagacatccacattctaattcctggaacctgtgaatactaaccttatatggctaaagggactttgcaaatataattaaattaaggatcttgaaatggagagactgttctggattagcctaggtgagtccaatttataatcattccttatgaaagggaggcagggaggtgagagtcagagaagcagatgtggcaacagaagcagagattggagtgatgcactttgaagatggaggaaggggctgtaatccaaggaatgccagcatcctccagaagctggagaaggcaaggagataggtcctcctctagggcctctggaaggaatgccaccctgccagctgcttgacccacttcagactttggacctctggagccataagagaaagaatctgtgctgcttagagccactaaattggtggtaatttgttagaacagcaataggaagccaatacagggacagcgtctgataaacacacgctctgcacatcaggctgtgccctttgtggccttttctctgaatttgatcttaaaaattcatgcagattttggttcctacctcataatgtaactatgttggtactaaggcgaaataatttaaaatgacttaaaagataagtgtgtccatttttcccttcatcaaatagttaagttgtattagttcgttctcacactgctaatgaagacgtacccaagactgggtaatttataaaggaaaaaggtttaattgactcacagttcagtgtggctgggaggcctccggaaatttacaatcatggcagaaggggaagccaacatgtacttcttcatatggcagcagcaaggagaagtgtgagcaaaagggggaaaagcccctaataagaccatcagatcttgtgagaactcactcactatcatgagaacagcatgggggtaaccattctcatgattaaattacctcccaccaggtccctcccacaacacgtgaggatgatgggaactacaattcaagatgagatttatgtggggacacagccaaaccatatcacaagtaaaagcaatgctctaggaagttctactgtatttgtgctctgcacgtgtgttctgctgggctgtgtgtgcctctgtttgagaaccctggggtggtatgcactttgaaacccgaaaccccaaaacctggctccacgaacgtgcctctgcgaaattcttcccaagcaaagtttccttatcatttttgtgcctggaggggagaagagacaagaaattcaggatagctggagaatacagaaggaggaagagcaaattaacagtgagctttctgttcgattgagcatttgtccacaatatattgagatcaagttttgtttcttaaacaaatctgttaacttttacggtcaatttggggcggtgcaaccggttagaagaattcattaaaacagccaaaatctctggctccgctgaatgtgggaaagtctctgatgccctccaagcagttgtatgaaaaagatgaatcatcaacaatgcagagatgacatgagagatgcagatggggctttgatccttcttgttaccaaaatcctacttagaatgtgttgtcatgaggtccccacttcatgctgccatatcgtggttcctaaagccaggtctggggtacttgctggggtggaatttagaagctagaaacgaacttgctcaagtctacaacccatccacagttcacatgcccttggtccacgcccacttgtgctgtgtgctcctgttctcttggtttggggagaccatatcccgcttgtattgatgacttcatcattctatacttccagcactcagaacattgttttgagggagagtaggtacttagtagatgttcaaacaaaatagtgagttaggagaaggggctaggtccaggattgtattagtttactacagctgctgtaataaattatcatcacaaacatggtggctgaaggaaacgcacttttaccctcttacagccctggagggcagaagtctgaaatcaggttccctgcaccaaaatgaaggtgtcagcaaagctgtgctccctctggagactctggggaagagtctgtttcctttcctttactagcttccagaactgcattccttgacttgcggcaaactctgaaattcagtttctcctgcaagtaagaaagttgggctaaatgctcttacagctttaatatctggccttctttgggtgggttccacataatgagaacgatagtttgtattgcaaaaatgtggagctttgagttaggcgatctgggatggaatttgagctttcatattctctctcacaaagaataatatatttgtgtatcatttagctatctataaaataatatatattatctatctaaaataatacctttatagtgtatcttcttccttcctctctcccttctggaccttacctttcctcatctgtaaaatgggattgggctaaggtccactccttgacagactccgctgcttgttggaagtcaggagtcactccagcctcattgatgatgatctgccttttgcatgcttgggggacctacacctctgtacaggcgagagccctccaagcatcccatcagctcctcttctctagatatagtccttagtagttggagctttgcagatgcctccacaatctacagttgtagcctcaacctcttgccctgggttcctgacctgttcccctaggtgcttggtgggcttctctccttgacatggccatgggtgcctcatactgaacctgcccaggcctgtcctctttgattcatgcttattctggatttcttctctctgtcaatggtattcctgttgtccaagccttccttgcttggaaggaacatgagggacggatgtatattgagctccctgatgtgcaggcagagtgttgcaggcagggatccgaggaccaccaccctcattgtagagaggaggaaagtgaagcccagggaatcacagaagcttatttttggtgacactgctggtaggcaggtaacagagctgggccctgaactcaggtctcctgactccacaacctctgtttttttgatcagaagaatttcttaagttttgtttccttccatggcaccttcacaacattttggccactttgactaattttttattgtgatataatacacataacatagaatctgccattctaaacattttaaagtgaacaattcagtggcgtttagtacgttcacaatgttgtgtgaccagcacctccatctaggtccagaacatcatcactccaaaaggagaccagtaaccatcaagcagttacgatctatttccccacccctccagctcctggaaacctttaatctgctttctgtatctgtggatttactcgttctagatgggatgggatcgtctgttatgtgaccttttgcatctggcatctttcacttagcataatgttttcaaggtccatccatgtcgtagcatgaatcagtactttattccttttcatggctgaataatattccattgtatggatatactatatttaatttatctattcaaccattgatgggcatttgtgctgtttccatctgttagctattgtgaatggtgctgctataaacatttatgtacaagtttttgtttgaacacctgttttcaattcttttggatttatacccaagagtgaaactgctgggtcacatggtaatactatgcttgacttattgaggatagatatccccctactcccaccaccagaatacttttctttacatcttaaaataaaatgatgccagatacagtggctcacgcctgtaatcctagcactttgggaggctgagacgggtggatctcttgagcccaggagtctgggactagcctcggcaatatggtggaatcctgtctctacaaaaaatatgaaaattagccgggtgtgttggcacatgcctgtggtcccagctgctcgagaggctgaagtagtaggatcacctgagcccaggaggttgaggctgcagtgggctgtgattgggccactgtactccagccttggtgacagagtgagatcctgtctcaaaaaataaataaataaataaataaaaataaatatagtttaaaagagaatggtatatcactgccaataatgaaaaccagtttcacttatgataagcagaagataacagcaaactaacaatcaaataaacaaacaaaatcttgccactagtaaaaaaaccaaaaataaagattacagtagtaatattaaaatataacaaactactgttcctgccaagtctcacttagcatatgatatggtttggctctgtgtcctcatccaaatctcatctcgaattgcaatccccaagtgttgaagaagggaagtgattgatcgtgggggctgtttcccccatgctgttctcatgatagtgagtgagtgaattctcatgagatctgatagttttatagatggtagtctttcctgcatgctcacactctttcctgtctccccgtgaagaaggtatttgcttccccttcatcttctgccatgattgtaagttttctgaggcctccccagccatgcagaactgtgagtcaattaaacctcttcctctataaattacccgtctctggtagtatttttatagcagtgtgagaatggactaatacagtatattattgtctcctttaaataattagcaagtgttagaaaggtgttgaagacctattagcaccaagatgagacttcctcactgactaattagaaggattgaaagataatcagagttttatcctgcatacttttaatattattttgtgtctcatctaagtaagacataaaacaatctctgacactatacctggccctctggtgttttccattcttccactgcccaactcttggttcgtctccatccctggcacctggtccttatcaccttccacctgagctttgattccagtcttctgagtttcctgcttatacgggaagctctcctactcaaggggcgcattggacatgttactctccactcttaaagctttggtgatatcaacattatattcagggtaaattctaaacccttagccaggcatccaagaatcacctcagtctgccccccatcaccaccaggctctgtctcccacagtgcacccatcaggtgaattagataacttgttctttctttcacgtgcccatagttctagctccatcgctgagttcttcctcccacctccatctttacttttggaaagcacagttgaaatctacctctcagggttcttattaggatcgaatgaaataaggtgtatgaaaaccctgaaaactgtaagaagaaatacaagtgtgaaacatgtcattgttagtcccgctttgcctttaagtcctttaagttttaagtgtcaagttctccaaggtgccttttccatttcttaggcttgaagcaatcgccttctgcctcctatgcactcagtctttttttatgccagaagacagacagaatggcctccccacatgactgtgaatttattcctcttctatacccttgctgtagccattttcatcttcctcccctcagtgcccagtatacgtgggttgaaagagcaaatctgtgcctacttgcaggagaaaccatcttgtcgtcaatcagaagtggagaaagctatagccacactgcctctgtcaaacatactttctttccttatttctcttccctcattagttgcatcttggaatgtgctttgtctaataggaagtgacagtttaatcgtttgggtttttaaaatttatattctgctacacagctgaccacatgcgatgatcaggcagcccagcattatggcatgagtccattccacttttgcatcagaagatttgggtggagccatgaaatggctgacctcatgcatagcaagagagttgaaaatcactgtgggggacaggagctcttctagggagaaagaagtcaggtatgcgtgcaggtgcagagtgggcagatgggcaggaagcctgacagttttcctggaccctgggctagatcacccttttcatcgtccagggtccctcctaccacttaaagtggatttctgtgcgattatttattcttgccccttcttttgaagtcctttgagcctttgaacttgatatggtttggctgtgtccccacctaaatctcaccttgaattgtagcttccataatcctcatgtgtcctgggagggattcagtgggaggtaattgaatcatgggggcaggtctttcccgtgctgttttcgtgatagtgaataagtctcacaagatctgatggttttataaatgggagttcccctgcacatgctctcttgccatgtaagatgtgaccttgcttctcatttgccttctgccatgattgtgaggcctccccagccatgtggaactgtgagtccattaaacctctttcccttataagttaccagtctccgatatgtctttattatcagtgtgagaacagactaatacagagctctttcagtggaaaagatagtacattaaatcgttataccaaacattataatcatggatggtattgcagtcacattatctgccaggagaattggcagggactgtagaagggatgtccactatttaacttgaaccatcatacagatgtgaaatatgaggctcagagaggctcagggacttgctgagggacacactgcttcctgagtaccagtcccatgggtctcctggcccatcagatgttgattactggtgctgatgaaaagaccaacaaggatattcattttctgtgatgggggatggtaataaaacttcttcctgcaaactcaccatgtgcactgcattgccttcagataaaatgtaaactcctggctgcacaaatccctgatttctgacccctgctgaccttttgagcttcaactcagttctctcctcattttgcagtttgctctagactttcccaaagagggctctgaggaatatgaccctacagaaaaaagtttaagccaaaataaatttaagagatgctgtacatcatgggatcctcagatatttacaatgcacatgagcctcttcaaagctctgagaagtcctgcgctacagacacggtttaaacttatttcctgctgtttgaacgaatgtttcccaaatctatttgatcagaagactccccttctgttttttatacaacacttgttcttgttggcttgataaaatatgacaaaaaccattgccctgattgctaaaatataacaaaaacccacattgctctaaatgtgcctctttcacattttctggcacttgtctgtgctgctatttctgtctgtctcatatccttcaaaactcatctcagaagccatgccctctgagaaaccttggactgctgtcccccacaggattaggtgccgttcctatacttttgtagctcctgcattctgataatttatttgttgatttagcttcccagctgtcctcagtgaggacaggaacagtgtcttatgtgttaatgtgttcagtgagtcattccataaacatgtactgagcctcctctacccaggcacacagttcagggcactgaggatgctgggggaacaatgtccctgcccttatcaaacttatattccaggggatggggacaaaatataaacacggtaaatatataatgttagattgcattaagtgccacaggcaaagcagggtaaagagactgaaagtgacaggagatgccctttaagatagggtttcaggaaagctggatcagctaggatggatgaggccctgctgcacaaacagcccctgtatcttaatggcttataacaataaaggcttatttctcgttcatgcaacgtgcccaccgagggttggctacgacttctgcgccatatcgcctcacttgtgggcccagatggagcatggctggttgttgtggtgtaggtggggagggggatgtggtgagtcatacgctggctcttaagggcttcagctcacatttgattgccacaactgattcaaggggccaggaaagggctctcctgccatgtgcctggaacgagaggaaaactggactgtggggtggacagcattaatgaatgcacaggaaccctctctgacatgaggacttttgcacagagaccttaatgcagaaaggaggggagccttgtgaatacgtgggaggagggtggaggaaacagcacttgcgaagaccccgatgcccctccagcattcagcacggggtttgacatgaagtaggtgaccaggcagtgtttgttgaatgaatatcttgaattccaggacatgctgcattaaggagatctttccgtctcagttgtccaagtggcaggtctagatgaggtgagtgttcatttgtaagagtggaaaattctaaccagcccaaacaaagattgtttggtattggagtctcaattataggacttagagtcagtatactgaacttagctctggctacaaaatttattttgacttgtcctctgactcaaggccaggatcttatgttctagcacaagaaacaaggcagaaatatgtaaaatcaccctaactatagtagagtgtttagaaaaatgtttataaaatacctataaaaatgaaaattagcttttctccttgtgtatacctgatgggtttatcatatttgaaatgacttcatcactgtccagattccctgctaaactccacctgggcaggagcatatccccttcgtagagtccccccagcacctagatactgcctggcaagtgatggatggccaatatatccagtacttgtggactggttggcagagggagggaaagctatgcagcatttttcagactttatttttaagagcagtcttaggttcacagcaaaattgaacagaatgtacagagatatcccaaataccccctgccctacacatgaatagccatccctgtgatccacataccccaccagaatagtaccaacttgtaacaatattaattgttacaactgataggcctacatggacacaaaattatcgcctaaagtccatagtatacattaaaattcacccttggtgttgtacattctatgggtttgaacaaatgcataatgacttgtatccaccactatagtgacatacagagtaatttcatgaaaaaaaatcatctatgttctacctatttattcttccctaagcccctacctcctggcaaccactgatcttttcactgtctccatagttttgccttttccagaatgtcatatagttggaatcatacagtatgtaaccttttcagattggcttctttcacttagaaatatgcatttaaggtccctcaatgtcttttcacggcttgatgtcacacttcctttttgcgttgaataatattctattgtctggatgtaccatcttttagggtatggctatggggagagttctgacctcagcactattgcttgtcaagaaggtgacatggatttaactagcggaagagtgggtttatcattaaaggcaatggtgaactgaacatgaaaccaagaagggtgatcaagctagagaaaaatcagctgaggctcctggagaatgaaccaggtcagagtgagtgatggttggggggaaaacggactggactcagtggatgtatagaatttcaatagtggagctgggggaagattggcacatgggatccatggagttgaaccatcattatgtccacgttaaatgctaactttggcaaaaataaaccatttccatgagcttctccagccggagaaaacagcatgaataaagacacgtaggtggccaagtacatggtgcgtatggacagccatatgcagatcgctttggttggagcatggggtgtttgtattttaaccctgactcttcctaactttgatgctaattttgagcaaatggaaatggcactagccacattcttggatctgtctggtatctggatttttgggttacactgcttgatttttttgcgcagtcctaggtcctcccttactgagaccactattgtactggcttccctggtggctgctgccaggggcagggtgtctgagatgggctccttcaggcacactgtgtctccttctcaggacgaaggacaagagcagcatctctgtagacatggtgctaagtcagcagaaggttctgattgtgcagattcagcatttctcttcctgctggtttgaatgaatatctcacctgcagctgccttgggaaaagctgtagtgtcagatgaggagggtcggaggtcagacagaggctgggctgttttggtgactcagattctttcgtttataacacgttggtaattccacttggggagcctttaatgcctcgaactcggaggccttggtagagactaagttaatggatttgaaatttctttgaaaagctgaaattactggacaaacacaagatggtagtggttgttatagtaattatgataaaaatgagaggaaacttttaattttccagcctgatatgatttgaaggatgcaaaaattgaatctgatgttggtcaagcattgatcttgcagaaaatgtcctgttttcctatagcaaagagatgtcctaaaaatggccctgtaacttttgaattgagtccctagggaaccatggagttttagggtaatatgtttgcaccttgaaggaacatttgattttcatgccccattgtttcccatcgcttcatgcttcaatgccttggtgcaagttgttacctctgtctagaatgcacctccccacctaactggcaatgtcagaaacagttcttcacttgtaagcaccagacacattctctggctagctaaagttgaaaaggaaaagagggggaactcacaaacttgagaggttgaggggactaggcaggactctgagggcatgctactcaaaattaaaaagcctgttggacacagcttgcatgttgcatctcagctctcgatcaagcaagtgcatttaatagactcatcaagatggcggacaggaagagtgagcattccccgagggcattgatggcagtagtggttgctatgcagccaaagaaattaacacatgcctgtttcatcattgtttagtccccagctcaacagtcatctcctcgggaaactttctttgacttcttctgggtagggtcattcaacatgcatgatattcaacagatatattagtatctaccatgtgtcaggcatgttcagggcacaggttgcagccataaacaagatggacatgatctctaccatcaggaagtttacctttcagagaagcaagatgataaacagaatgaagaagcatataagttaattttaggtagtgttaagtactagacagggaaataaagcagggagaggtaagacagagagtgctgtggatggataaaggtggagtatttaagagaggctgagcaggaaaggtctctctgaggaggtgaggaagtgagccgtgtggagtataggcagcaggtgactgcaagtgtctagacgctgggtgggtaggggagggtgggcttgccatgtctggggaatagtaagaagactaggatggctgcaggagagtgatcagataggaagtgggaggaaacaggttctgagaggtagagagagggcagctctcatgggacttggccatgaaaagactttaaaaacaaatagatcttaaaatagacctggttttgtttttctcctgaaaacaggagataccaggtcaagaaggttccttctactctaacccttataaaaaataacctgaagcccttgttcccaccttataaaacccactgctatttcctagtgggatttgaaaccaaatagtgacagagtgatgccagtgcctaaagttttggtcagtctctcaactgagaggttgatcaaaagggggaattattaagtttagcgaaaagctgcctctttacatactttaaaggtttctccataagtagtgaactgcaacctaactggatgtgtaaacagactgtaacccactgttgtccaaacaaccgagtttcagccaatcaagggggaccaactgttcaaactgggctcaagtagggcaaatgccaagctgtaatggatccagctgtttctgcacctcgcttccattttctgtctgccactttccttctctgtccataaattttctttgtggtagaaatggagcctcttcacacctgttctggttcgagatctgtacaattcttgaatcattctttgttcaattaaacacaattaaactttttaaaagagcagtttgggttttatttcaactgtgatggaaaaccactggaggggtctgaacaaaggattgacctaactttatttatgtctttaaaaaatactactctggatgctgcatggatagtaggagttctggagtgaggaggggatagggggcaccagggaggccagttaggaggatattacaataatccaggtggagacaggacaggatggttacttgggtgaggaggtactggtggaggtggtgaaactgaccagtttggggatgtgcttggaaagtggactgctctgtacttgctgatggatttgatgtgcggagtaacagaaagaaaagaatgagagagaaagaatgattcttagggcttttatttaatcaactttaaaatttgaggataattttagagttgtagaaaagttgcaaaattagtacagagaatttcagtatatgcttcacccaggttgccccactgggcaaagtcctagatttctttcttaaatttttaaaattgttaattattgtgcatacatagtaggtgtatatatttgttaggtatatgggatattttgacagaggcatgcaaatgtgctataatcatatcagggtaaatgtgatatccatcacctcaagcatttgtcctttgtgtgacaaacaatccaattatactcttttacttacttaaaaatatacaattaagttgttattaactacagtcactctcttgtgcattcaaataccatatcttattcgttctttctattttttgaacccattaaccatccctattccctgccctcacacccccaataccctttccagcctctggtaaccattgcactactctctctgtctgtgggttcaactgttttcatttttagctcccacagatgggtgagaacatgtgaagtttgtctatctgtgtctggctttttccacttaacgtcatgacttccagttctatccatgttgttccaaatgacaggatcttattctttttatggctgattagtactccattgtgtatatataccacattttctttattcatctgttggtagacacttaggttgtttccaaattttggctattgtgaatagtgctgcaataaacataggagtgcagatatctctttgatatactgatttcctttcttttggatatgtgcctagcagtaggattgctgggtcatatgttagctttatttttagttagagttttaatatggtatagttaacgtgctggatggagttgacatttgttgagatggggaagacgcagagaagagggagatatctctagctctgctctggccatgtcagcaaatcatttcacattcaagtggaagcagatatcaaacaggttggctagatctgtgaacacggagctcaggagagagcctgggttgtgggtgcagctgtcggcatttagatagtatttaaggtcacagaatgctccactcttttatatttggtaattttcgtaataaaaaattcatttaaaatggagtcagtttaaggaaatatgattaactgataacttaggtcatacttttctacaaatggccagtagaaaatgttttaggctttgcaggccataggatctgttgcaactactcaactctgccgttttagcacaaaaggagctctagataatgcatcaatgaatgggcatggctgggttataatgaaactctatgtacaaaaactgggtggtggactggatttggctcacaggctgtagtttgccaattcctgggctctacaatgttgagaggttgggaaggtgatgacaaaccatcaaggaggctgacagggagcaaccagtagggtagcaagaaaaccagggcagtgggaagctcaggaaggcaagtccaggaaaggaattctccattatgtctgatgctggtaggacaaggaatgagaattgtcctgtggatttgacaacacagaggttgcaggatacctttcagtagcaccgtcgtggccacacctgaccagagttcgtagaggaaagaatagcacagaagtaggcagggtggttatagccaactctctagatcatttttgctataaaagggaacagagagaaatggagaattatctacagagggacacgaggtcacataagggttttcatttctgtttttaaggtagaagctatgcttgtattttggggtgatcctcctcatgattttgctatggttggaccctgtatacacttcttcttcttcttcttttttttttttttttgagacagggcctcactgtgttacccaggctggagagcagcggtgcaatctcagctcactgcaagctctgccctaccaggctcaagagatcctcccacctcaggctcctgagtagctggggccacaggtgtgtaccaccatgcctgcatgcctggctattttttttttttttttttttttttgtatttttagtagagacggtgtttcaccatgttgcccaagcctggtctcgaactcctgagctcaaatgatctgcttacctcggcctcccaaagtgctgggattacagtacacttctacaattaattctttcacattatcatttctttaaaatctgtgtcttcttttagcagggtttctcagtctttgaacgtgacgttatgggccagacaattatttgctggggggagggcaaaattgctgctcgttaagctcctagagtgtgggactagatttactcttcttgttctccctggtctttaatactatgcctggcatacacagggggtgccataagtattttgctgagtgagttggtgaatagaagtgttcctttacaaagtactgttttgatcatctcataagaaagtcacatggtacctgggtggcctgagggaaaagcaaggcaggtctccagggttgagtttagcatgcctgatctttgctgagattcaggatttccaattgcactggagaggattgtgtaggtagtagcaagagggtggctacatttagctgacgtttctcatgcggcttctggactatcaaggtctcttgcttcatgcctcctcatctgcttgggaatgttgcttatgtagtttctccaaaagcaagtggacatgagggatggggaagctctttatctcaagcatgattattacacgtggattccattatttaggcaaatgctgtctacagacgctccaggagccacctcccaacacctgtctttcacctcttgccagagactcaaagatgagtgggctttcagagtcataacaataataatattaatagctgtcactctgaaatagacatggcaatttatactctgtgggggagtctttagtccctcactggctaagcacagtggaagggcacctgtatgtgaggtgatctcagtgggagatgaagatggtgaggaataggctaagtacctccctccccttgtaccaccctctgatgcaaacatgacctccacctttaggggattctataaaatgttgttgaatgggctgggcgtggtggctcatgcactgtgggaggccgaggtgggcggatcacctgaggtcaggagtttgagaccagcctggccaacatggtaaaaccctgtgtctgctaaaaatataaaaattagtcgggcgtggtagcacacgcctgtaatcccagctactcaggaggctgaggcaggagaattgcttgaacccgggaggtggaggttgcagtgagccgagatcgcaccactgcactccagtctgggcgacagagcgagactccatctcaaaaaaaaaatgttgaataaatggatgagtggatatgcatccgtgctcccatcttgttcctgtcttccttttatttgtgtttctacctggcaccaagggtgtcctatagctgtctctgagtaagactgaattcataagaatttattaatttctctaaagagaggagactcagggtcccagtaactgaatgctgttcttatttcagtctttcctgtatcaccttcctggattttgccatatcaaggtatcacctactttacggatctataaactatggcctgccacctgtctttgtaaataaagttttattagaacagaattgcacccatctgtagatgtgctttctatgggtgctttcgtattacaacagcggagttaagcagttgctatggcgaccatatggctcacaaatcctaaaacatttactatctggccctttacagaaaagcatgctggcccttgaagtacattattatttaatcaatttttctttaaattgactcagtttcagaataaacttattgctatggagattagcaaacatacaagaatagagagaatgtgtaatgaacactcatgtaccctcaattcagcttcaactcatggtcaattttttttttttaaaaacagctgcattgacatctaaataatattaaaaactgcgtgtgtttaatatacataatttgatgagtttggatgtatgcatgtgcctgtgaaaccatggccacaatcaaggtaatagatatatctttcacttcaacagtttccttgtgtctctttgttttgtttttgttgttgttgtagtgagaacacctgagatgagatctctcttaagaacattttaagggcagaatacagtttgttaactatagacactatgttgtccagcagatctccagaacttattcatcctgcataactaaaactttattgaacagcagctccccatttccctatgcccccaacccttggcaaccaccattctattctctgcttctatgagtctattttagatatcctgtatgggtggaatcatgcagtttttgtcctctgtaatggtcttatttcacatagcagaatggtccaggtttttccatgttactgcaaatagcggacttttttttctttttttttttaggttgaacaattttccattgtataaatatgtcacattttctttattcattcatctctcttttttttttttttttttttgagacagggtcttgctctgtcgcccaggctggagtacagtggcacgatctcagctcactgcagtctccgcctcctgggtacaagcaattctcccacctcagcctcctgagtagttgggattacaggggtgtgccaccacacctggctcatttttgcacttttagtagagaccaggtttcaccatgttggccaggctccattcatctcttgatggacatttaggttatttccgtatcttggctgttctgaataatgctgcaatgaaacttctgcgaagcaaaggaaacaatcaacagaatgaaaaggtatcctatagaatgggagaaaatatttgcaaattatatatctgataaggggctaatatccaaaatatataagaaattcctatgactcagtagtgaaaattattaaatggacaattaaaaaatggacaaaggacttgaaatatatgattcttcaaagaagacatgcaaatggccaacaggcattaaaaaggttctcaacatcattaatcatcagggagatgcaacacaaaaccacaacgagtgactgtgaaattatctcacacctgttaggatggctattataaaaatgaccaaagataacaagtgttggcaaggatgtggggacattggaacccttgtacactgttggtgctaatgtaaaataatgcagctgatatgaaaaacagtatggcggctcctcgaaaaatttttaaatttttattatcggttggtgcaaaagtaattgtggtttttgcaattaaaagtaatagcaccagcgtaatggaactatcttatgatccagcaatcccacttctgggtacatatcccaaagaattgaaatcaggatctcaaagaaatatctgtaccctcatgttcactcatgttcattatggcattatccaagagagccatgttggggacaatcttatttaaaaaaaaaatttttttttgagacagagtctcactctgttgcccaggctggaatacagtggcgtgatagtggctcactgtaacctccatctcctgagctcaagcaatcctcctgcctcagcctccctagtagttggtactacaggtgtgtgccaccatgcctggctcatttttgtgttttttagtagagatggggtttcaccattttgcccaggctggtctcaaactcctgggctcaagagatccacttgccttggtctcccaaaatgctgagattaaaggcatgagccatcgcaccctgcccaatcttgttttcttaatactccctcctccctaataccttaccaaccccctgattattttaatgcaaatctcagaacttatatcattttaatttaaagtttcagtaagtatattaaaagaactcctgtattgactataaatacaattttattattcctcttaattaataattccttaatatcatcaactatccttaaataactcaaggtttttaaacataaatacctacttaagcttcatttcaagcaataatttgcttgaaattatggttcagatatgctatttatattttttaatatagtagaatggctcctgaatttttgaaaatttaagaggaaaatgtatccctgcaccatctaaaatgatcttgtacaccatcagtataccacacactggaatacaccacgttaaggaggcccttagcggaaggcgttgtccactttcttctttgaaaggtatgaaaggtcttacagtgtccttgttttcacaacccagacagagttagtcagtgcctggagcaaacaccagcgacatgcataccaaccatgaaatctgaaggaacaacaacttcatagtcatcttcaccagctcaacacaatttatagtacaattaagaccggcaaatctaattggataaacagaaaatagaattaaggtaatctatcctaagtataccaaattcctataatgagttgctttcagcagttgtggaaacatataattaccaaacaaattacatgttatttttatctaagaagctaattaagtgttctgtgtaaattattatgtggtggcaccaggatcagagttgtattaaatacctaattggaaaagggatgagacccgagaattttacatgggaatgtgactgagagagatcatagcaagagggtctgattcagagacagggacttgagagaagctaggtggaaatgggagagggttagggtgtctttggttggtttaaatttgtttgtgtttttagagacagagtcttgctctattgcccatactagagtacagtggcatgatctcagctcactgcagccttgaactcctgggctcaagcaatcttccctcttcagcctcctgagtagcagagactatactcaccaccgcacaccaccatgcccgggtaatttttaaatgttttgtagagacagggtcttgctgtgttgcccaggctggtcttgaacttgtggccttgatcctcctgccttgacctcccaaagtgttgggattacaggcatgagccactatgcctggtcactttcgttggtttaacttgagcctggatggttgaggttaagtcagggctctgacgtgtatggagccttagtctttttaatttatctgttctttaaacttattcgtctccctaaatgtaagctgcaagtctctgtgtgctgcagctaaccttaaccctgggttttttgagtgtgtgtgtgtgtgacccttatataacttccttactttgctctcatttcctcatttccctgtggctcagtaaatcttccaatatcttcttgtgggttcgtgctcttttgtaccctggaatggtaggacatgggcgctttgggatatttcctataactcagaacaggtagcctggaagaattttgcaatgaagctttgagctggcatcagcctcaagaaacatatccctgttgagtgtgataggagaggcagaggcttctcctaagttgaggcaggtgaggattgaagttgctgcatttccaccaggttagacatagtgctgtggtggaaagcactctcagctggagtcataagaccagatttattgtccctgtcctgctgttggtgagcagtgtgacctttggcaatgcatcattcccttctgagctctggtatctcatttgtaaaatgtggaaaatagcccttggcctatttacctcacagaggtgccctgaggatggcatgccatagtgtaaatgaacatcatctgtaaaatctcaatttttacaacagaaatatatgaaaaggtctggcattatggttgtttttaaccaatggcagctgtaggaagtcagacaaggtgggtgatgtaactgaaaagagcaggaatcttccagcctggctagatccaggtgtcatttggatttggtctctcctgcttttccccttgattcttctctgtattcattgtgtttttattttattttatttcatttttttagatggagtctcgctctgttgcccaggctggagtgcagcggcatgatctcggctcactgcaacctctgcctcccgggctcaagcaatacttttgccttagcctcctgagtagctgggactacaggcacataccaccatgcctggctatttttgtatttttattagagacagggtttcaccatatttgccacgttggtctcgaactcctgacctcatgatccgcccaccttatcctcccaaagtgctgggattacaggagtgagccactgtgcctggcctattttttatttttttgagacagtgtcttgctctgtctcctaagatggagtgcagtggcacgatctggctcactccagcctcaccctccggggttcaagcgatcctcccacctcagcctcctgagtagcttggactacaggtgcataccaccatgcctggttgcttatttttatttttgaagagatggggtctcactatgttgcccaggctggtctcaaactcctgggctcaagcagtcctcccaccttggcctccaaaatttctgggattacaggcaggagccaccacacccagcctgtattgactttattcagggaatgtctccccaccccaactcccagtgtggcaagacagtcactagcagaagtgttgcatctttattctgtcagttaagtgacttaggggaaacagagtgcagagtccacttcctggtcgcttcatcagaagtcccagggctaactctgattggactcctcttcctcacttgcccataaatcaaccaatcacattgttcaggataggaatacactgactgaccaggctggtcatgtgcatatcctgagagctggagatgctgaagttgccccacttgagctacatggaatgaaaagtggggacagttggttccccaaaagtgccagaagaaagagtgttttctggactagagaaaaccaaagatctcattctcccataggctacctatttgaattataatagaaaaatttactagattgagagtcagggaagacttggattctagtcttgactgtgtcactatcactccgaccctggatgtgtcaactctctttttgggaacccagtttccaaatctttgaaagagatttgggcctgaattcttctgaagttcctcaccttttcttcaccagggactcttcttatcctgcggctttttatcgtcatggtatactgtgtgttttgccggcaaaacaaaatacattaattaagtactaatcgattttatttaaaaaaatgaattaacagcatacaatcaattgccacttagaaatgcagatcaacagaacataaggtaaccagtggaactacactgagttatatatattccagcccaaagcaaataaacttaaatatttctttaatcttgcctgtgttgcctgggacagcctgattacagggcagaatttgaattatgccaggccttatgaaatgttcagcagggctatagattcctatttctcatttactggatctcaggtgcctgtaatcccagctactctggagactgaggcatgaggatcactttaacctgggaggcggaggttgcagggagccaagattgcgccactgtgctccagcctgggggatagagtgagactcccttcaaaaaaaaaaattatttatctcatctctctgggttctgcacatatttgaatttgctgcacctgatacagaccaaatcagtgtttcctaaacctctctgatattaaaaataacctgtgagctctttaaacttacaacctcttgggtattccccccaccccactttgattcagtatgtttgggtaaggttgcatacttgcctttttaacaaggtatccccaggtgattcttatcgtaaagaaagtctggaaacactggactaagtaacatccaaggccttactactctaagtgtgagcagccacatctgtatcccctgggatgtcttgtttaaattgcacaggccaaaccctacagacagacaactggaatctggattttaacaatggaagcagattggcttttgtttttaattggcttttaatttgatctattttctgttttcattgtaatgaggctttcagctgcccctcttgccctaggcctcttcagaagagacatttccctctcctctccctgcctccccacagggtataataaacacctgttggggtttggtggggaagctcaccctgacctcccatcactgagacacgaggtgcaaaagtgttctgcacacagcctgagatcttgcctctcaaagcagacttgacccccaagcttccacccctaggtctcaggaagaaatggcctcagcagattccaggcctccagggctgtctgtttcatgctctcaatttttacttggcttgatccgtgctgtctccatccggtgttctgaggcatttcacacacgactggtcttcggcaactgggccaagcctgttctgttctttttcagttttcttaattgcaaggctttttgtttccccactggagaactcccataccaagaattctgaaatctaggtactcagaccttagtggatgatgttctctcagcacttaattcactcatcattcaataaactatcctcaagcaattctatattcaaaacattctgataatgatggcatagtaataatgataatgataatagttggcatgtattgaaattttattatgtgcaagaaactatgccaggtactttaaatatctcatttaatcctcacagtaagtctgggatgctggcactattcttacccctgcttgacagatgggaaaactgaggctcatagaaggaaacagagtgcacagtgtctctgatatggtttggctctgcgtccccacccaaatctcatctcaaattgtaatccccacgtgtcagggaggggcctggtgggaggtgattggataacgggggcggattttccccttgctgttctcgtgatagtaagcgagttctcacgagatctgatggtttaaaagtgtgtgtcaattgcttcttttctacccatccccatccttccgctgtgtgagatgttcctcgcttcctcttcgtcttccaccatgattgtaagtttcctgaggtctccttccccagccatgccaagcggtgagtcaattaaacctctgttccttataaattacccagtctcagatagttctttacattgtgaaaatgaaccaatacagtctcacagttgaatagtgatcgaatgtggtttcaaactcagccctctctgacttctgagtcttcagtgttaaccatctcacacacttatatgatttaggcttgatggaaacagcccacttttcatgaagcattatctacagagcctttaatttctactaatgccaagaggaaagtgccatgcccaccttggtgatgacagaactagggtctaggagtggattcatatggtcagagtctcatggccagggattggtaaaatccaaatttggaatctggcttctggctataagcccaaggttctttctgtcatcccagactgtacagcccattatctcaaggagctggcccctcagaggcagagagatcatgttcagtatctaggagtttatgacaagtactatgtggtgcatcccaggctctgaggataaagtcatgactcttgggtgagctcataatgcgggcttgcattgcttcagcccttactttgtgctaagcatgtcacactctctcatttaatgctcttaaccctacaattacccccattttacagaggaggaaactatagtgtctcacacagaataggtgcacagtgaatttttattgaaaagaagaaaaatggcacgtgagttgaattaaggaaatgtaggccagggctggggcaggaaggcatacagtggccatacagccagctgacgggaataatcgagtgcctgaatatggagtttgaacttcgtcctccgttttgtaagtagctaaggaagggaaatgaaattgtccatagtgtgcaggaaggactggaggcaggtgaaagcattaggtcattgcagacctccaggtgtgggtgatatggctcaaactaagatggagaaaataggaacacctgtcagcatgtgtagggggcaagaatgtgactttagagtcaggcctgctttcaatccagcctcctcatttaagcaagttactttatcttctctgagcctcatttttgttctccttttaaatgagggtggtaccacctacttattagggttatgtagcatgtgctgttggggctttcccatatgcccccagtccttgcctccatatactgaagcttgctcactgtgaacccctccgactctgtcttttctggctttggaagcaggtttagcccacctgcagggggagtgaaggtgctggaagcagccaacggtagggatttgtggataagcactccagtccgttgtcttgtaggcaggataactgtgatgtagagtagatatttcatgctatatcccagatgtctctagtgatcttaaggcccagttgccttaagcagtcacttaatttaaaatttaccatttattgtttccttttacttccctgtctcacttctctttcctcttaccagtgtttcctgggatcatttctcaaaccactgggagctcaaattctttttcagggcctcaggtcataataatgataaaacgaaacattgtatgttaagtgcttagcacagtcgtgaggcccaaggtcagttcccccataaatggtagctgctataaacatcatcatcattaccatccttgtgaaggtggagtgaacttattctttcaagacatttccactgacagataaattcatccaaaatatgaagaaaaatgggggaggaaaaggtcacctagaatatgcagagcaaaatattgcaatgatttctttttttaatgagatagtttattaattattaatcagtatctttaacctttagtccttgtttaacaccatggataacaggtctacaattgagtataattagccaaatgcctcttgcatcctaaattggctattctgagttacacagtttgattttcttggaaggaggacctggtttcattagcacctagttgcaaatgaatctcctccttgaagtttttgttgctatttgagcttgtttttagctggagatttactcttggattttagttgttttcgccttcatctgttgaagaggtgggatgatattgcgtgtgtgtgtgtttgtgtgtgctggaagttatgcttccaatatttacaatattggctttccaaagcagaagatgatgggctttctgggagggtggttcaataggaaaccttcagaaccagtggggttggatggtggagcagagtgtaaaagggagagtgatgaaaagtagagtgattgaaaggataagcacatctgcttttagacttgctcacttaacttacatgtgcttatctggaccttggccccaggggaggagatagaggaatgcgtgagaagctgtcttgagtgttagggacggagtatgatgaatgcaacaactgtcagttctgtgtcaacttggatggggctacagtctgtactcagtcaaactctaatgtaggtgggttgtgaaggtgttttgtaggtgtgattaaagcttataatcagttgactttaagggaggttatcttagataatctgggtgggcctgattcaatcagtcagatgccttaagagtagagctgaggcttctctgaagagtaaattccacctgaggagagaaggtttagctcatgcccagaagttccagcctgccctgtggatattggacttacctacccattccccacaatcatgtaagccaattccttgtcatgtatttcttaatatatgtctcccgctcatctgttcctttaattgaaccctcaataatacagattttggtgccaagaatagggctctgttgtaacaaataccttaaaaagtggcagtggccttggaattgtgtgttgggcagaggctagaataatttggagacacatcagagaaaaagactagacatccttcaacagactgtgagtggaaatacgaatgctaacagttctgtttctggggactcagaagtaagaaacatgttagagaaggcatacatcattttagagactacctaaatcatcatgaacagacttttggtggaaatatggacgttaaaagcattaccagggagggctacctacgaaggaaatgttattgaaaactggaggaaaggacatccttgttatatagtggcagagcatttatctgaattatatgctacagttgtgtggaaatctgaacttgcaagcaatgaacttggtaaagtgttgaaggggcagcctggtttcttcttgctccttttagtaaaatgtgagaggaaagagattgaagcaagaactgttaagcaaaaagaaagcaagatttgatgacttgggaaattctcagcctatctggattgcaaaagatgctaaaattaggagatttactatcaggaaagcatgttaggaaagggtatggctgaacagtttttttttgctagttcgttggaaagataaaaagtcccagtattcagccacacagagtgctctttgaagagattaggtatgagactcatgtaccccttggccatcaaatcagaagcaaagaatagatattaggattatctaggaaagaactgtgaagaaccattttttgtctgatggagtgaatccccatgacatactcaggagacccataaggtttttgaaatttcctaccagcataaacattggcaatttggacagaagggaacagagaagataaaatgaaggaaggccattacactccctaaattttttttttattattattatactcgaagttctagggtacatgtgcacaatgtgcaggtttgttacataggtatacatgtcccctgttggtttgctgcacccatcaactcatcatttacattaagtatttctcctaatgctatccctcccccagccccctaccccctgacaggccccggtgtgtgatattccccgccttctgtccaagtgttctcattgttcaattatcacctatgatatactccccaaattctacaggcaggaaatgacggttaaaactcttaggctggaaacacatattacccttcatgagaaaggactggttactcagagggtagagcctcaagctcaaaggacagagatgggagaggattatttctaggctttgaagcctaatgtttgcctaactgaatctctcctctccattttttttttttttttttttttctggaaacagtgtctcaccctgaaggccagactggagtgtggtgatgtgatcactcactgcaccttcgacttcctggtctcaagtgattctcccacctcagcctcctgagtaggttggactacaggcatgcaccaccatacccagctaatctgtttttgtattttttttttctttttcagaggtggggtttcaccacgttgtccaggttggtctccaatgtctgggctcaagcattccaaccaccttggcctcccatagtgttaggattacagggattagccactgcatccggactgcctaactgaattccaaaattgtttggatgtggtaacttgttttttcttttcattgattccttttttaatcaaaaacccctgtaactgatatcccatgcctgttccacaattgcatctggggagcagataatccgttttctagttttacaggtccacagttggagagaaactttgacccaggagggatcatgctcagattcttataagtacttgacttaggtgattgagataagattttagacatctgagctcatgagatttatttatttatttataattattattttttttgagactgaatctcactctgtcaacccaggctggagtgcagtggcatgatattggctcactgcaacctccacctcccgggttcaagcgcttctcgtgcctcagccttcagagtagctgggattatgggtgcacagcaccgtgcctggctaatttttgtatttttagtagagactggtttcatcatgttggccaggctggtctcgaactcctgacctcaggtgatccacccgccttggcctcccaaaatgctgggattacaggcatgagtcactgtgcctggtctgatgagattttgatgaaaattttggactttgacactatcgtgagttagttttggggagatggagtgaatctttcggagcaagatggtggcctggcaggcagaactacgacctctcaaagatgttcaccttctaaactctgactcctgtataaatgttatgatttatggcaaaagggattttgaagatgtgattaagttatggatccatcttgagatgagagcctcatccaaaattatctggtgggcccaatataattgtgactgtacttataagaggcgggcatggaagagtcagagaaggagatgtgaccatggaaacagagttagagtgatgtggccatgagctaaggaatgtgggcagactctacaaactggaaaaggtaagaaatggattctcctctaaagccttagaaggaagcactaggaaggcctgctggtccattttaggtttctgacctccaggactttaatacattttacatcactctaagccactaactttatggcaatttgttacagcagcaatgggaaacttataatctgttaagtgccaggtcttctgctacactgcttagacgtattattttgcttctttctgcagtcctttaggacatacgtactaaattcccattttgtggttgtggaaaccgaggcaatgaaagttcagatagcttgcttaaaatgacagatctagttagtggtggctctgggatttaaccccatgcccgaatgattccaatgcctatggactagctcttgcatgataaatgtcaagggacatgaggagttaggtcagaaagccatcacgacatagctcaatgtgtggctttacatttgacgtaggatgacctagtggtaagtggtatagcacctgtttaggtgcactggagacatgttgcatggccccaaatccagctttgccacccattactggctgagtttactttggacaagttatttcacatcttttttttttttttttttgagacggtgtcttgttctgctcattctgttgcccaggctggagtgcagtggcacaatctcagctcgctgcaacctctgcctcccgggttcaagcgattctcctgcctcaggttcctgagtagctaggattacaggcatgcaccaccacgcccggctaatttttgtatttttagaagagatgggatttcactatgttggccaggctggccttgaattcctgacttcaagtgatctgcctgcctgagtctcccaaagtgctgggattacaggcgcgagccaccaagcccagactatttcacatctctgaacctcagtttccttacttataaatggggattataatacttttttttagggatatggagcttagaggagaataatggtggtaaaatgcttagtgcagtgcctgacacatcataagcgctcataagtaaaataataacagtagtagtaataataacaataataacatgctaataataatggcgaattactcttcctgttttgccactctaggcagagggatattagtgaagagaatacaagatccatggtgggtcaggggcacaagtgtgttacaagcaaaaagaacagcaggcactcaggccattgcctatgaaatgttcttccccacctcttaaactggctaatcccattcaaaagccatgtctcccaggaagtcttccctgaccttcttggctgaaacagacgccctttctctgagggcctatcacagaaggtactttcctactctagtcttgtcaatgcatttgaagcctctctcagtagcctggaaactccgagagcagaggtgctctctgtccctctcttatttattgttataccctgagcattaaaaaaaaaaaaaatgggataagtggtgagaagagactggagcggcaggccttggccatgctaggagggaccctttagcttccaacttcccgatgaatttccccccgagttggtttgctttgtctttgtaactgagaacagcctagggagaagcatggacatgggggacctgcaggcatgagactggttgcttagcatctccatggcccctcactactacagcccactctacatgctgttctgggcctcattaaaacctgttctccactagcctcggtgtttaatatttatcgatcacccacagcatgcaagctggtcaataagtgttttcagaagcctcactccatgccatcttgatcagcccctgccgctattttccatcatgccagctcttgaaatcttgtggatgtgccttgaattttttaagtgcttttctaacaaaagtcccgactgcagagatgcagaagcttaagttccatttcatttgcctcctgaaccttgagggcactggtttttatattgctgcctctgtccctcttagtcctcagtccccacacttctcaggatagctgaagagatgagtctgtgtttggctctgagttccagctccctggcagctatggattatatgttagcacaatccattttactcccccagctgtttactttcctggggacctgcttgagtcaggctgctcccgaactcccttaatgaagacatgacagtgggtggctggagacgagaagttgcaggagaagcgagaaggagagagagagtcccctgggttatatccctgttactcaacattgttgaattagatcctcaacattccatcatgtgatgtttggatgctgggaggggagttaaatatagaattcctccttttggcatttcagaaggtttatataatgtcctgttccttttgacagtggggagaaagtgaataggatggcttggaagatgggtctgtgtccggagctccatttaaagtctactcagcagcctgacccatctgcctactcaggggatgttcggtgaatcatgtttgcaaaggcacagatgcccttttgagcccaaagatctgctcagctcgaaaattctattaattctaagattctacaagtagccttcacaagagtggatgctgaaaatagatcagccacgtggtatgccctgaatttgcctggattactgatttgattttcccctcaatgtttccctgaacctggcctggaaattcagcttgctttaccatttgaaccctgccgtggagtcccagggaccagcgttccaagtctgcctctatcatttcccagccatgtaaccttgaatgagtctcttggcttttctgagtctcattgtctttagcatgtccccatacctatctctccttcttactttcttgtcttagtaaatgacctcattttccatctagctgttcaaactacaaacctacaagtcacctttgatttctctctccctcttacctgctatgtagaaaccatcagcaagggcttctagctctgcccttaacacagatccatgaaacatgcttctaccttcactgcaactccttatgaaatctgcattcagtgacagcagcatcttctaaactggtatcttcttccagctttgacatcctatgatcaatgcatgacctcgctggtcgagtgagtaagaacgatgacaaaacccatatcttgaatcacatgcatctttattaaaatcttcctccagctttccattttacctagaattaaaatcaattgcttgctgtggcctagaaggagcaccataatctcctgcttatatctcagaccaaatcctgctctcttttcccttggtcctttatctttctggaacattcctcacactcacctttgcacttgttgttccgtttgcttgggaatttcttcccctggacctttctgtggttgtcttgttctcaccattcaagtttcgtctcaaacattgctgactgtgacaggctgttcatgatcatccaagttcaagtagcctccactctagccattagcccattactcagcttcattttctcctatagcttagctctatctaagtattatatggttagtgttttgttttttttttaatcaaactcctcccattaaagcatgtgtcctttgaaagcagggacattagtcatttctatatcttaagagagttatcaccagcctgggcaacacagagagactttgtctctactaaaaactaaaatgacttcaccaggtgtcatggcttacacctgcagtcccagctacataggaagctgaggtaggacgatcacttgagcccagaaatttgaggctgcagtgagctctgatcgtgccactgcattccagcctgggcaacagagcgagaccctgttttaaaaaagtaagtcacgcacgtagtaggtgcttaaaaaaaaaagtgatgcacatagtaggtgcttaataaatatctgttaaatgaataaagattggttacggggatgaaataagagcgtgctcaggtatgcacagacacactcgtgcacatatgtgcattgaaactgccatggtaagaaatactattgttaatagctgggagccagaatttctatgactctccagttgcatcaggcctcccttgactgtattatgctcctaagaaacttttcttgccttttgttgaattaaaattctttaacttctcagctatctcatggatctttgcatctgttttgcatctgtttcttagcagcctagcttggcgcatggtgctttatagagacatttagcatgtaaagatatttataaaggagggattctcttctatttttgcccagtcatctgttggagagagggggagcagcaagcaggcacacatgattcatgctcttgcctggagggtgctgcccacctctagcctagaagagtggggtggcaggagccctctgcattccaaggctggttccagtgaatggagcatctacagtggtggtttggccaatctcaacattctgtaatggcctcttctttacagttcacacttcccagataggttaatattacagctccttccatcagaatgtccttaagtgtgtagctgcaaagttgaggggtacagttcataaaacgatcatttctgacatcacttggaagattgagggctgccaagaccacccttatctttgataattcactggaaactcacaaaactcgctgcaagctgttgcacccacggctatggcttgttatagctgaaggatacagactaaaatcagccaaaagagggacacataggcagaatcatgaaaggtccaaccgtgagctgccagtggtgatcttcctacggaatcatggacagtgccaccttctcagcaacaatggatgaaaataagcatgggacgttgccaacaagggaagctcactgagccttggcgtgcagagtcttttttggggtctgctgttgagttcttatatgggtgaccttggcttccaggtcctctggaggttgagctcatgctatgtgattctaagcccccactctaaatcacactgttagactctctggtgtgacccaaggcccccacaagcaaaaaaacactcctatccaggcatgacattcccagggcttagtaagacaccaagggtaaagaccagacttctttttgggcgaggtttaattctttactatggaagagctcaacttgatactcttggtatggatgacttacgtagatagcggtggtgctggcccttttcttgcttccagtgcctgaattcatccatcaattccacaaatatttattgattgtgagctaggtgccaggctctgtgctagttgctagggatacagtggtgaaggacatagttcatgctataaaaaggctggggagacagataaacaggcaattattcttatatataaatataccatgatgctagaaatgatactaaaggctcttggtgcacaagggtgcctggcacagttgctggtgaagacctcccagggcggtggtagttaggctaagattggaaaaatgattagaagttggccaaccagggtggagtatgggggtagggaggtagtgtttaggtggaggaatatcacatgcagaggttgagtggtgagaaagttcttgaggatggtaaggagctccacattttcatggatgccacagctcacaggtgattcatcttgaacatacagccaataaacacccaaagactttcccatcttgtaccaaggcaggtggatttttttttttttcaagactgaatctctgttgccaggctggagtggagtggcacgatctctgctcactgcaatctctacctcccaggttcaagcgtttctcccaaggcaagtggattttgaaatcaagaaaatggggttcatgagagaaattcttggcccctgttgctgtcaggaaggcttttagactaaaaagaatggagctaatgaaagcagttggatagggcaagcgtgtgagcattggctttcactggcttagggcagctccaactcccccagaaaaggctctttgtttatggtgaggtcaggacttcagagtgtgactcagaaggtcctcagagctggtaaaaagtgtagactggtgctgtaggccaaaagacaaggtttataaaagcagaaggatttctgagacatcttggacatgtgagcaggtgactcacagacgttctagaaaccatatttcaaagacaatatttttggcagaatcaaatggttgctttgtggtcgtttcagggagttccagcaataacataaagaaaattaacagaaaccaacaaatggtagggaaaaacgttggtgatacgtgccaaagggttactatctttaacgcacaaagatgacttacaaattaagaaaaagacaaaacaccctaaaagaaaaatggaagagaaatgagtaacatgtgattagagaataaaaactcaatggctaatagatgcccaagaaaatagtaaaccctgccaatactgcaaaatatttgaaatacggtaatgaaactggctgggcactggctcttgcctctatttctagtgctttgggaggcagtggcaggagtgttgcttgaggccaggagtttgagaccagtctgggtaacatagcgagacccccctctctacaaaaaataatttttttaaatgagccaggtgtggtggtgcacgcctgtagtctgtttcttggaagcctgaggcaggaggatcacttgagcctaggaatttgaggctgcagtgagctctgattgtgccactgcattccagcctgggcgacagagcgagatcctatctcaaaaaaaaatatatatatatataaagaaatccatcaactcacacaaaaatgttgttgatgggactttgcattattcttataattaagaaaagcaaaatgaaaattcagtaagcaaaacagtgcagttggaaggagctctaagcctccctacttcattctggtgaaggcagggagtcaggaaggagtctggggctcctcctgtctgtgtcctcattttgtctcccacctcctggcccccagttttcctgcaggtgtgagtgtgtcagacctccttctgctctgagtgggagagaactcgctgtactctagggagctgagtttggggaaagactggcccttaagcatcctcccacccagcctttacccccagctctctctccctgtaggacgcctgattttcttggcagaggaagaagctaccctccatccactttcccagggtaggcaaggcagcctcttcccctgggccatccagcctcctgtaggcctggggcttagcaaaacagccagggaggggagactcggaacagtctttttttttttttttttcctcccaccatgagcagtatgaggatgatgccttagctccattgctttgctctcagccttcagacttgctgtaggagaatctctgctgtaccctgtcatgtcttagatttgtgtaattgagggaggcctcccaggcaatttaagtagggatttacttattccttgggagtgctgagcttgtagtggaggaatggtctactcactagtgtatttactcgacttctcctaacaagggtctttccacttggggttgttctgtccagcatcccttgggacttccagggaaagccaaatattctttgctgcccctgcttcttcgacaataaatgcaaaaagtttgaaaaaatcccgtactggtgttgtgtcaccagggtcaaagaccttgaatctctagtaagaagtagaaggcgtcaagaggtcaagttctgactccatagtttcaggacattgtgggacttgattgctgcagtgtgaaatttatggttttgtaagacagatttaaaaccctttcatggcatcttgtagcctttggaataaaatccaacatcctcaccatggcctatgaagagaccctgcatgatttgggcactacgtgcttttttggggctttgtttgctgtcattttcctccttgttctttccaaccctaggggctttgtcctcatggttccctatgcctggaatgctcttcccactattctgcactggttgacgatgacttcttcacaacttggcttttggggcatttcctttgagagggcttcgtgacagtcctgctaaccttttccataggagccctcatgtcattagctgtaccacaactttaacttgtatgtgttcatttacatgtttctgtctcttctgtgaaatggttgctccttgagagtggggcctctgctctgtcttgtacaacacctgacacacgggccaacttataaatatcatgaatgaatgaatgaatggatagctctctagttatcaattgtgactgtatctttccctgccatctcccagctccgtctcacctggaccacctggaaaaacctcttgtaccccataatttcagtgcccctgtctgtatctgaggctatggaaaagctctctacccaagcaccaaggaatcctgcccttttccgcttgcccggataaacaaagagttatcaaggctaagttgccagttatgttggcttcttctcctgtttgctcttgggaggataggattttgattacaagcataacagcctccagttattgagcatctactgcatacagggcaggcactttgcatacatgatccctgatcttcatagtatccctacatggtaggttttattatcccaatgttgtaagtaagcaaacgaaggatctcacaggtcagtttgctccctgggccacctgacctgtgctcttttttccctatacatcgtggcctaggttttggaacacacaagggcacgcacacggcccttctcagactatgacaatatagtgcactgcaatacctcgcttttttaacaacctaagctgatgggttgagttgtgagagtcagaagcttgcaatttcacttcatctgtctctggagactattctggctttctactgcctggaaagaaggtgggaacaagggctctgtgagggatgattacaccagggcagaaacagctcacctcttgagtgctcatgtgccatacactgtgccgagtgatttatacatatagctttctgtaacccacggagcagctctatttgtactgttattttgagcactattctgcaaatgtggaagctgaggcacacagtaagaaagggtaaacagtggaggctggatgcaaacccaggtagtctgattacagagtttgaaagctcagccaccaggtacctaccaaccagctaaacagatctcatcattcaaagtgtggtccatgcaccagcagctttgacatcctctgggaacctgaatgcagaatctcaggtcccatccagactgaccgagctagaatctgcctcttaacaagatccctcggcgattcacgtgcatgttaaagtttgagaagaactgccccagaaattctatgaatataaagtaagtgccattttcctgaagtcaaaagctggagatttagagcatcagtgttcttagaaacaacgtgcgacttcagtatcttgcaaactatggcatcaacgaggagctgttcctttgcttgagggaattagtgatgacaaatgaatttagtattttcaacaaaaataaaagcaagttgagcttgcatagttgatccaaggctttaaaaaaaagaggctgcttcagcctgcaggatgttgttgacatagtattacatctaagtacgcagggagccccgagccagggttgctggagtgtccctattgcaagggaagttttggcaaacacaatctagggattgaaaaggtaactccttcattagatctgcctggaatttacacatctgcaaatgtgagaggacaaaaaggacttttgatccaagagagatcggccccatctccctgtgctgggaaaaaactttgattttcttctttgatgtgaaacattgccattgctagctgtatatttgatcatagtcactggacaacttattcagctctagttctttattaggtcctcatggctgctttcttagacatcggaatccttaaaaaagagaattttattttattttttaacctttcccagcttataaatgccccagggacctggaaatgtccacgtgggctttaccaatgatgtatgtcgttctgtttgagtcaaaataatgagtggttgcatagatgatgattgatattgtgtatttccgagtcgcctcattttggggaaggaatatgctgatcgtgcgtcaatttccctcaggttggctctccagcagggggcccaagaaggtctgcacccttttcatgtttctttgctacttcctttcatcttgccaagttacatttagcaggatattcatctaattccttttttaaaattttaatgctccccattttttgggggggtgggggacaaaaagagccttttaggaaataagcatcaggaactaactaatcaaagcgaaactttctgggagagatctgacagccgcatgcctctaatgaccttcaaaaagatcacgtgctccaggcaattacaggatttgggagaaaatagctcattctgaatagccgaacctgctgcaatgttcatcactttgcagccgtgcccctacctccccgcttttgtagcttccttaccccgaagcctcctgaaagagagttcacttggattaaaactcctccagctttaacaaactgcaaaggggacagctgatgctaaaaaaggggatcttgtgcacagtgccaggtttctcctgtagccagagtttttttggctctggctacagaaggtgcctaatacattctgactcatggccaaatattatcaggggactttgctggtcaagctcttgaatatgggtgcagctggaaaaataacctatttgtcaataggttaccagtttcacagctggtagtgcccagaagggcgctgaataaacttcagtgggatccctgctgcttggtgcttgaagttcatctgacgtgaagcctttgtgaaaagagtattcaggaacccagtagcaatcttttcctttattttaattagaccatgcttctctcttgtttgcagggttttttgagattttatgcaaacttttaatgtttttgcctgtcagtgtttccattatttgaaatctttcatattaagtaaaattagccaaggccagtgctatattaaagtatcaaaacttttagcatttgctcaccctcctttcctggggagaacaggtttctctacatgattgcctgtatgctttgctatgagtcatagtttagagaaaacccccacgttcctgtgcaatgaaagaagcagcataatgatctcaactcaggcagaatggcctggaaactcatgatatgtggctgcacccagtcggtgcctttgctttgcttgtgttggaggtctcttgcattagtgttatgaaaatagatgatgagctcatgcctttgtgactttgtttcttgagacctgcctgatttccatggtcacaagaacacagagaaagatgtgtgggctcccggggctctgcctgacactgttgagagcgattccagaggagaaggtatctgtggggtaatcttcggatgttattctgaaaagccccaacgtcttcctcataacagcttctaagcttgaggaccaagagttatcctctaaaaaggtgtccccaaacaaggtaggtgactttcccccagtgtttccaggggtgtgagccaagacatggggcaaaatgattaggggacctcctgggtcttggaagtggtttaatccttcctgtagctcaatgtaactgtctgtggttgatgtcactcggagtcaggggtaggagtgtgtgtgatacagtgtagcagagatgccaatctttgtggttgccccacccttcttgctgtggattgctgctttgaccaagagtgttggaccgatgaaagtatatccagtcctcagtctgaaatttgacgtctgtggctgggtttgaaaggatgagcttaaatgtgggcttttgaattagaaatagaataggatttttcagttagcatcgtggatacaggggctgaaaagatgccacaatgagctgaagttaggaaggatcaggggacagctgtgggaggaggacagtgtggggatgactggaggggagtggaaataggggaccatggggcaggggagtggggagagaatatgaaggcttctggtagcaatctgcatgtgtccttacaataaacagtttctcttgaactaactggagtgggtctctttccttgaccatgcggaagacctaatataagaaaggaaacaaagagattgcaggtgtcttccagagagaagatctgttttcctgtgtgttttaatgtggagtctctttctggtctgcttacccactccttgccccctgcatccaccccccttgtatatttttcccttaatgaaaagaaaatagagatcattttaatacagaggtaaaattctagggcctccccagaaaactgtttcatgaatgaggaagctaagaaaaagggccactggctttaaagcccagtaggttaaataggagaacggagaaagttataaaatgattaattggtcaagttgggatgggaaccttaggttataatatcaagatttaaccttggcactatggacattttgagcaggagaattctttgctgtgggaggggctgttctgtgcattgtaagatatatagcaacatccctggactctacccactaaatgcaggtagcagtccatagttgtgacaacaaatgtctccagccatagacaaacatttcctggtggtaaaaatctcccccagttgaatgtaaatttgttcagccattgtggaaagcagtgtgatgattcctaaaagaacttaaaacagaattatcaatcaacccagcagtctcattatggagtatatccccaaaggaatataaataattatataaagatatatgcatacatatgtattctgcagccctattcacaatagcaaatacatggaatccacctaaacgcccatcaatggtagactggataaagaaaatctggtacatatacagcatggagtactacatagccataaaaagaatgaactcatgtactttgcagcaacatggatggagccagaggccattatccttagcaaactaatgcaggaacagaaaaccaaatactacatgttcttacttataagtgggagctaaacagtgcgaacacagggacatagggaggggaacaacagacaaatagttctaatcgagggcggagggtgggaggagggagaggataaaaaactacctgtcaggtactatgtgcatattacctgtgtgacaaaataatctgtaccaaatgtgtgtaccaaatccctgtgacacacagtttacctatataacctgcacatgtacccctgaacctaaaatgaaagttaaaaaataatctttccctgttgagaaccacggggctagacaaaaagccgccttccttcctttcttgaatgaagcttttgtttgtttgaatctgctgtttatgaagggctgtggaggctacagagatgactaaggcacagtctcttacctgtatgaattaacagatttctggaaaatattaagcatgaaaacaactcatcaaataaagctggaaaataccttcctcttggctttgagtaacagcaaagatatccacctgtgtcaaatgggtaacgctcattctaagtgtaatgaggatctaacctgaggttcccacccaacttgattactttataactttctccatcttcctcctcctactgaattctgctgggttttaaagccaatgggctttttttcccttagcttcgtaattcaaaggatgatggtagatgctataacaaataagccctcaaatatcagtggtataacatagtagaagtttgcttcctgctgatgtaatggtgttcctggttggtgaacagctttcctatggccatgcagtgattcagggacctagatttctgccatattgtggctcttccagtcccctaaatctcactgtcttttctttccaatcagcagaaaaataagtgaggagaaaacacgcccctttcttaagagtcctggcctgaatgtgactttgtttatgctgatcttccattagaaaggacaattggactactgatgatttccgatcaagtagaataaatcaatattgaatggctcatcttggctaaaattctgtgacagtctctggttatgaaaatttaccatcaggatcctgttcacataggacactttattcagcagtggggagagtttagcagaattctctttctgcacagtttaagatggagctgggaaaagaacccaagtttttagatacagcagtctgtctgctacttgaatcttttcttctccgccataccaggactggaagacatagattgtgcccaatttctatatcctaattacctaccagaggattgggcatgtaaaatattttcagaggggatgaatggatgagaaatattgttcacaggcttagaggtatacactcaaggaagattttacttgttaacctgaaaattgcaaaacaggtgcttgtagagctgtacccacagcagtacattgatgtcgcaagtatcggggcgggaaaaactacaattgctgcgtggggtggggtgggggtgaccatagttccctttattagccagagatataagtgacaggagtctaaatgagaacctgaagccaaacaggaacatttatttgatcaggtaactaaaaagttcagggtatctggcttccagcacggctgaatacagatatataacaatgtcttcgagaacgtcttcctgtacctgggctccgctttcctctgtcagactcagtctttggcagattctccttaagtgatggcaaagataacaccagccacaacagatgttcatccttcaacttggccacctcagaaggaagaggggctccagagaatgccccaagattatcattggctggtccagtgccatgtgctcatctctgcacccatcaccagggtctccctctcattgttcagaccaagtcacttgtgcaccattagcacaaggggtgcccagtccacagggataaaggggcaagcagggacaattcttcagtaaaaaactagaatggatgcttgatgaggaaagatattctatgtccactatatttctattgtcattatggaatgaacctgtgtattttttatcttaacactcatttccattcttctggtaattgtatgtaatcaatctctgttaagccctctccccagctgtagcccctgagctttttgtagagattcctcctggtgcagagatggagcatatggttcagtgctggaacaatgtggtcattatatgctcctggtccctgtgaacagttcggggatggttatctggtccaggaagacccagtgaggtgaaatgagactttacctcaaacttgagtaaaagagattcttttttcaaattaactttttattatgatgattttccaaaatgcatgaaaatagaggtaactctaatcataagcagagataactctcctatactcaccatccagcttcagcatttatcaactcatggacaatcttaattcattttatcgccacccacagtagattattttggagcaaattcccaacatcctatcatttcatctctatacttttcaatatgcgtctctaaagataagagctcctgggggaaaagacttggtattttctattaaaagtgaacctgaaaagatgtagggaataaaatcactgctaccatcttgcttccacttggagccaagaattggagccaacaactagagccaactgtgtggcagcagaacagcaagaaggaggaacacgaaatccagatgacagattttgggtcctgaattcacctgtgcatggagtaagcttagctactttttttttttttttcagtcacttgagctagaatattccctgtagctatgttgttgatgccccactcatatcctcttggcccaccctgagggtcacctgaagcttagatggacagttcccaacacagtgatggcttctcacctcaagcacaggcatctctctgcctaagaatgttctctggccatacgattgtgtttggctcctgcatatggcagacctgaagtggcaggggataaataaatgccccccagaactgtctttaatgatgagggatagaagttggcataccctggcttctttgctgctcagggagacagtaatgaggtgtgtcctacactgttattggagggcccttgtggggttaaatccctgttatccccagaagtaaccttcccatgaatttccctgctgctggcttcttttcctttcctgtcttatttttctacttcctcaccacacttcctgtgatcaccttccaactaaaccatgtccccccagtttcttgctttagcatctgctctaaagtaaaacttaactgaagtaattcccctttgcttcattttgcttaagcttccatggttctatttcctttttaaaaatttctatttaattttaagttctgggatacatgtacagaacataggtttgttacctaggtagacatttgccatagtggtttgctgcacctctcaacctatcacctaggtattaagccccatatgcattagctatttatcctgatgctctcccttccccaccaccaacagactctggtgtgtgttcccctccctgtgtccatgtgttctcattgttcagctctcacttatgagtgagaacatgtggtttttggttttctgttcctgtgttggtttgttgaggatgatggcttccagcttcatccatgtccctgcaaaggacgtgatctcattcctttttatggctggatagtattccataatatgtatgtaccacattttctttatccagtctatcattgatgggcatttgggttaattccatgtctttgctattgtggatagtgctaaaataaacatacgtgtgcatgtatctttatgacggaatggtttatattcctttaagtatataccctgtaacgggattgctgggtcaaatggtatttctggttctagatcttagaagaatcactacactgtcttccacaatggttgaactaatttacattcccaccaaaagtgttcatggttctatttctggtcattcttaaaacaaaaaaaaagtcctgagtaattatgctccatatttccatccccagtatttgcttgagaaatgaaataatgaaggcttctgagaaacagtgtccccacgcccccataccccattcacacaaaatgttttcagcttgagaatacagttgcggaagccaagttgggtctcaggaatatctggtttgcactaaatttcacctgcagaattataaaattcaggtgctgttgccttgggcacaactgctgggctctgataagtagagtgggtgtcccagcagcctatcctgttggttcagataatgatttatgggggggcgcaggccccagggtgtgcacatggatggatgctctgcttatcctcctccagataggtttctggcatctaagacaagagaggagtggggtcaacaaggagagcttctgtctcttcctgtttaagcatctctcctactacctacaaatgaaaacatacaaatactatgttgatggtatagcaagtaactttaaagaaggcccccagaaatacttcactaattggagaccagttctccagcattttgaaaccataaggaaattacaaagtaagctgaaaaaaaaaaacttagatcatgcaaaagagtggtcaacaaagtccatgtattctacacaaaggagagccgtcttaagactgtctctccaggctagtttacttttactttatatacaattgcaacagagcattgaaagcagcacattttaagcagggaaggaacatgcacagcaagggctgcaaactcaaaaaattaaatgaaccagagaataattttaaacaagtgaaagaggccagttgatggattaatgccatgtggggacgtgggtccagtgttgacagttcttccatgttttcaggaagaaactgaaaattggaattttaagtgaaataaccttagttttacatagaaaatatctaaacaaaaaatttttaaaacagcatgcagacctggcacatcgggggcgtgactttgccccattaaatgaagcataaattctctattttgccagtgttcctatttggctcatataggacactttaatttgtgattctttggttattagatcactagctttttaagcacaggctttgggctctgtttgccttcttgggaaatactgtcagaaatcagtgggttcataaccttttgaagaagtcactcttattttggttgagtgggcagtgttcttagctacccaaaacaaactagctattcacttcctgggatcgctgggaccggtgcctgcgggtttctggggacacagaagatacatcttcctcctccctctcctgtgtttacacaatctgctttgaaaggttatgattcttctgtgggcgactggcctacagcatctgcctgctttgcttgatttggttcatttcacccaggctggcatcttcgagtctggggtccttttggctttacccgcacataatctcttgggtggatcaaaacctcttcaactctctcttgagtttccaagcaggctcccctgtggggcttttctaagagtgtttagcattggcattgctgcagagcacagtctcactgtgtggttttatgaaggatttgttttttaaaatttattttctatttttgtgtctttagaggcagggtcttgctctgttgcccaggctggagtgcagtggcatgatcatagctcactgcagcgttgaactcaggctcaggcaatttttcttgcctcagcctccagagtagctggcactacaggcacacaccaccatgcatggctaattaaatctttttttttcttttttttttaagaacgagggtctttgttatccaggttggtcttgaactctgccctagccttctgagtagctgggattacatgtgtgagccaccatgcccaactaaggttaaaaatcttaagatgcccttcaagactctactcctcaaggtcatgaaatagtcttttaaatttgttaaaaataatgctgagtgtattttattttcaactcaataacgctgtcacacatattaaacaataatggcattttcccatttatttccttctgcatatatatgtgtgcattgatgtgcatgtgtatgtatgtatctgtatttatacaagtacataagatataaatatatccatacctatttgtaattgcacacaatttatacatgcagtagtgtataagctgcatgtttcacttactatcaaaatctctgtaagcataatttttatttattctgattatttaatacacagtgatgtaactgtgatcccaaaatgtgcaaagttaaagccttcaactgcagctgaggagagggcaggaatggtatatggggacggtggtgagtcacgaatgatgggcaggcggccatgagcagggcagcctcctccccggggccagggacaggggaatggcctaaggagccaggacccaagggtagcccaggaccggggaagggggcagagacctcctcttggcctaggtcaggagctcagaagtgccacatggctgagggggcagcggcccgggaagagccagaggcagagccaggaaagcaccatttcctgggggggctgggggcagggaggtaccctacaggagaagccaggtggggcctcctgtccctggggtgggggccatgctggagcatgctgcagcaagaaagacctgaggcaggcgcagggcctgagagcctggctggctgggctggggggcgcccccaggcagcctggcccagggagcaggcccgactctgtaggggatgctcagcgaggggctgcagagccttcaggacctctcctcctctctccctggaaaggagctggggaacccgtagtgcaaatctgtggaccactcagttatggagagaggttgtgcccgaaggtggacactggggtatgctccctccaccacctcatcctccactgctatcctcagtacagctgcttctggtaagcgtgcaggccatggacgccaccctcgatctgggctgacatggtccacttctcaaatttgagctctcctgagtacatcatggagccatgctggttactcgctatgaggtagggcacaaacttctgaatggaccctttgtcctggatggaggccgagacaccctgcacaatattcaccttttccccctcgctgaagtatcgtttctggctgctgctgctcttctccatggcatctagcgagcccatgccccagtacttcttgagctgcaccctgtctgagaagaagtactcgccgctgggcctccgtggtggtggccagcagggagcccatcatcactgtggaggctccaagggccagggccttgaccacgtgccccacggtctggatgccacatcggctatgatggacacaccaaagtgctgagcgtacttggccaccttgtacacagcagtgccctggggctgaccgcaggccatcacttcctgggtgatgcagatagagctgcagcccataactacatgcagtccatccacaccagtgtcaatcaggttcttagcctgggctgctgtcaccacattcctcccaatcacctggaggtggaggtacttctgtttgatgtaatgcaccatggtgatttgatacaccgagttcccttgggaggagtccaagactatgacgttgatgcctacccaggtgagcaggtccaggcagtatttgtcatcctcatgggtgcccacagctgccctgcacagcagctgcttgtgggaatccttggaggccagaatgtagtctcgattcttcttcaggttggtgtgggagacgatggccactagctcatggcgatcattgaccacaggcagcttcccttgctaggctgaaggatctcatttgcctgtttcaatgtcatgcctgctggagccaccatcagcttgatccttggcgtcatcacctcactgaggagggtggtgtggtccttctcagcaagaaagttgatgtctcgggaggagatgatgcccaccaacttgctccccatggtgcccatctcagtgatgaggatgcaagagaagccatgccggatcttggcctccagcacatcacccacagtgtgtgaggggctcagcaccacggggtccgtgatgaagccctgttcaaacttcttgaccttatgcacctcgttggcctggaactctggggtgcagttgtggtgaatgaaaccaatacctcccatcagagccatcgcgatggccatgtcggcctctgtctcagtgtccataggggaagagatcagtggtgtcttcagcatgatcttccgggtcagggctgaagttaggtctacctcatcagctatgaaatctatgaaccatgggagaatcaggaagttgttgtgggtgcggcagttggcgccgaggaagagctgctgcacggtgagccagtcctggggcacgtagccggtgccgccactgatcagatggttcgccatgctgccgcaaggccccgcgaagcgacaaacacccgcgcggccgcctgccgctgctgccgctgctgctgacgctgtgggcctgggaactgtaagcataatttttaatgcccatagtggtggttatttaaccacttagtgttgggtgccttggtcattttcatggaaacttttgctaatataaatgccactgataaacatctctgtgcataaacctttatatttactgttattttctcagtatagattccttttagaaatggaattgaacaaatcccttgaaagcctccaaactgtctcatttcaatcagttcttttaagagctgaagtaagagtattcttagctccacttaattggtcgagctgatatactagctttttcttgatttttgtctgaagtaattaggttaagaaaagttagtttaacacatacatccctgaatagcagaaactgaatccaccacagatgtacttcttactcgtctgaagtcaaatgtggatgtttgtattcagagggcggccctctgacaagtgacgattcaggggctcagctcctttcatcttttggttctgccaccttcaacatatggcttctaaggccactgacatcatctgtgttgagctgtgaaaggagtggagcctgggaagttttttatggactaaatattcccaggaggaaaacggagtaggatttatgatcacttatccagaacctgctacaagatttctccttatctcatacttgcagtctgtcagcaaatcctgttggttttatctttgaaatatcccttgacttacccacttttctcccttgcccatgcaccccccagtcctggctggcgccatcactcccctggatcactccaatagcttcctcattggtatctctcttccactttgcccccttgccacttgcttctccatattctgttaagaaatctttattaaaacaaacagttccacgacattccccaggtaaaaaccatgtaatagcgtccattagaatttattaaaaaatccaaactatttaccttgatgaggtcctgtgtgatctagccttgtctattctccagtctcatccattaccacgttcccctaactcgttaaatgctattccaaatggtttccattcaacttttcaaatttgccaagctctttcttaccctgtagcctctgcgtgtgccactccctttgcccagaactttcttgttgttcttcacttgacaggttatttctgtttttatttaaaattctttttatttaataacaatgagaacacatggacacaggaaggggaacatcacactctggggactgttgtggggtggggggatgggggagggatagcattaggagatatagctaatgctagatgacgagttaatggatgcagcacaccagcatggcacatgtatacatatgtaactaacctgcacattgtgcacatgtaccctaaaacttaaagtataataataataaaattaaaaaaaattttattttttttgtgggtacatagtaggtgtatatatttatggggtacatgagatgttttaatacaggcatgcaatgtgaaataatcacatcatggaaaatgaggtctccatccccttgagcatttatcctttgtgttacaaacgatccaattatatattttttgttatttaaaaatgttcaattattgactatagtcacactgttgtgccatttattaaatggtaggtcttattcattcttcctattttttttttttttgtaatctggttatttcttgttctttggatttcagcctaccttcatggtgtgaacgtacttggttataatgcattgccttttgttacatttttctatttgatctgctcatattttgtggggcacttttgcatgtatgtttgcgaggaaggttggtctagagtttccttataatggcttcctctggttttggaatcagggtaatactatcctcataacatgaattgggaagtattgccttctgaacactagtttctgaaataatttgtgtaggactcttttttttttttccttaaatgttttatagagtgcagcagagaagacatctgggcctgaagtttactttgtgggagggttttaaactatgggttcaatttctttaattgatacagggttggtgaaggtttctatttctttttgaaaaagctttggtaatttgtatctttccaggaatttgtccatttcatctaggttgtcaaatttataggcataagggttttttaatccttttaatatcttaaagtctgtagtaatgcaccagactttatttctgatagtctcttttcttcttgatcagtctacctaggtttatcaattttgtttttttttttttttttttttaaagagaatcagctttgggtttcattagttttctctgttatttcttaattagcttctcagcctaaatgtcttctcagaaaggatgtttcctgaccattctacctaaggtggcttcacctttctcttgccttctcctctgattatttgttttctacctcaggtctatgtgtaattattttatgtgttatgtgctttttttgcttctatgttacttgcagatactgcagaatagtaataagtctgcctaacatggtaatgtgcttggtgaatttccaagaacatatatggtggtttccaagtatgctagcacagcagtatctatagtggttaagagactagggtctagagttggctcatctcagctttaaccccggctacatcgtacactaagtgtgtgaccctgaacacgtgtaaccgtgaacacaaattctgattccttctgagatgagggttgtgcaacatggcagctgtgatcaggaggcctggggtttgagttctggctctgttacctgtcagctgtgtgattcttgaggcaattacttctctgagacccaatgatatggtttggctgtgtccccactcaaatctcatcttgaattttaactcccacaattcccacatgttgtgggagggacccagtgggaggtaactgaatcatgggggtggatctttcttatgctgttctcacaatagtgaataaggtctcatgagatccaatggtttcaaaaagaggaattctcctgcacaagctctctgtctttgcctgctgccatccatgtaagacttgacttgcaccttcttgctttccaccatgattgtgaggccttcccagccatgtggtactgtaagtccattaaacctctttttcttcccagtttcagttatgtctttatcagcagcatgaaaatggactaatacactcaattttctcttctttaaaatgatttgatgcaaggagtacctaatcttgggattattgggaggaactggatgagacatacatgagtaggatctagcccagggttggccttttgcatatgaggcattccctcaaactgtactttcccagaacttcagctctccccaccagagggtaagcatcactgtagcaggcactttgcacgttttgtgcacctctgtacccccactgccttgatcagtgtggtcagacaggcactgaaaaatgcctgtgaaatggattcttctttttgttgcttatgaaatctgcaactgtgagttgagtgtcctgaagctcagcagggcaacgatggcttcaacaatctggcccttgcttgtctcaggtgagctgctcctttccctttcaggaatcttctaaactgctgggattcccagggggaggacgggacctttagggatcttgcaaaccccagcagaatatcagttttcttcacagaagcgtgtctaacttccttcagccctggtctgcaaattccagacatgaaactgtgctatttgctagcttggcctggcaggtatttattcaaaggctgcaggactccatgatagagagtagcaacagagccagcaggatcctgtaagtactcctcatgcaactacctgcagtggatttaaagtcagctcagggcagtttcaacaccagagttggaggaaagaggttgtgtgtacattgtcctctggggactgctgctgtttatgccttgtggtttcctttgggggagacagatccaccctgctttcctcatccatcttcctacatggatatatcttgttatctagtgctgaaatggcatggacacaggggctgggactagtgctgagatcttccgcttagctcttccaaatacagaaagaacttccctgtgtatggttaggattgaagtacatgtgcttggttcaacattccttcaatcagcaggaaatccagtcatcatcctagccctccatttcattctttgtcttgcttcatgatgtcccttaggggtaaagatttctgaattcaaagccagctgagctgggttcaaatctccacatgtccatttatgagatgaacatcatgtcttctgtctgattcatttgtcttagtttcttcctctgaaaatggaggtaatggcaatgtctattctggcatgttctcgggaggctgaaataacacccaggcttgctgcttattgcacagcccagcttccctgccttccttctctcccttcatgaatccctccatgtcctgctctacctgttgcctttctgttcataagagtattttgaattcctgccttattctccttttttctctagaagtgaaggagccaacttccccaaagtccgtggaatgccattttactttgttaggaaaaaaatcactttttcttatgtgcattctcatctatccattcaacagacgtcatcggagtgccttctgggggtcaggccacttccaggtaccagggattcagagacaaactagtcacgctccctatcttcaagggacttagaatcatccccagagaaggatgctgtgaacaacctcacgtgtgatggtgtggccactttggttgtactagagtggtgggatttgggaggtttttcttatttttatttatttattgtaaatttttttaaattaaaacaattttaaatagagacagggtctcaatatattgcccaggttggtctcgaattcctggtctcaagcagtcctccctctcagtctcccaaagtgctaggattacagaagtgagccactgtgccagaccactttttcttatgtgtaaattaaaaaagaatttgaacaggaatgaaagataaaaagaaaaaaaaaaacacttccccaaacaaaaaaaaaaaactctttcacttataagaatggtcatcatcttggctatttcagatggggaagtacgcatgcctcatcttatccaagtttctcacagttctataagtcttttttcacacacagttccatacacaaaaggtggctttgcaaaaaacttcttttaacatagctggcaggctatactgtacatatatctatacacatgtatgcatgtatgtgcatatacatatacctttgcatatatatgtttatgcatacattttattttgctttatttagaattattatttttggagatagagtcttgccttgtcaccgaggctggcgtgcagtggcacgatcttagctgtctgcaacccccacctcctgggttcaagccattctcctgcctcagcctcccaagtagctgggattacgtgtgcgcaccaccatgcccagctaatttttgtatttttagcagagatggggtttcaccgtgttggccaggctgatctcaaactcctaacctcaggagatctgcccacctcaactcagcctccttaagcgctggaattacaagcatgaaccaccatgcccagccttatttagaatttcatagggaattcttatgttattaaaactaagggttataagggcttccaaatcgctgtcatatggctggtctcaaatgcatttaaacaccccctcccccattgattttttttttttacatggttttcttatgtttgaaaatttgtagtttctctattaaacattgggtcagctgattctactgcccaggagacccaggcaacacctcaaaagtccacaactctcttggccagatgtgactgttctatttcccagctcatttttctgtgtctgcagaaagacacagtgcaaactgttaaatttggaggtttttggcagcttcattaaagggcaaggattttcctctttgggggtgggcttcatgttttaatggtcgtggtcagcattgctgggtgaggatccttaggctttttgtcaggggttcagggccttctggcttccccaggcttctccaggcttctccaggcttccatctctagagaagactcgggatgaactctgaattcttctagaccccagctaccagttcggctccagacccagagtggcactgctttaatctcggcaaagaagactaaagacttttttgtgtaacgaattaaaagtttgcttcaggcttcttttattttatgcctctgctgcactctcgtaacatttagcacctccccctgttgtcatatcatttatcatatcgtggagtttcaggtgtcttattttggttttcctgtcaatcttcctcctacactctgcgctcacaagggacatggaaacctgtcctgtttctcctcataccctgccgtcgactgcggcccctgcacacagtggggtctacgatgttcatgggagccaagggattgttgtactgattttttaaggctggatatttatttttcggtatgctttgcactttttgcctagggaatcaggactcagtacagaaacttgtctctgtcatgtgcgcaccctggagaatccaatcattggaaaaaataaaaatacacatagagaacaccattccttcccataaccacgtaaaattgtgctcgtgcaagctttccatatgcaagagtgcttttgatctaatcagatggaaagccagaagcagaggggaatgaatgtaacttacatactgattattaagtcattcattctagtagtatttattggactcctatgatattctttcttcaaactggtcctcctccagggcatggcaccaccatcctcccagatgcccaggctcaacttcttgctgccaccatttccctcacacccctcgccctgtgactacaccttctacatagtgttcatatccatccacttttctcttttctctcctggccagaatcctctaatcttttaccttgaaaggttcaataacagatgaatgaacagatgacagaatgaatacgtcgaatagtttcttcaaactggtttgtgttaagagaaatagcatttatatttttatttagtcctagagaaaaaataacaaccctttgcctctgcctactcttgttttcacagtcccttcacaaatattgtatcttcggttatgctcatgtgtgagttctgtattttaagaaggacattgataaactgagcttgttaaaaggaacatgactaagggaggtacaggctgctggaagtggttcctgaataacatcaacaaaaggataaatgtttgcatttctgagagtggagagaaatgaggaagtgagaggggtgagtagattgctatacccaattatttgaagggctttcatcttgaacatagagcagatacattccatggtgctctagaatctaagggaagaagtagagcccatagagacaaaatctacctccaaaaagtatgtggaagagctatgagctggctaattaagtctagagttctgtcactggaggtagtcagcagagtaaacatgtcaggggcagggattccggcatacatatggactctcttgttttgtagattttctgaggttattaggacttctggcgatattcttatctatagataggtattgcttcagctgcctaaacccatatctccctgtacccccaaaacactcaagagccatagccataaaacttcaagaagatgaaatattttgggggttagtaatacccttgatggttagagttatatgtggctgagattcttcttgtatctattctggtctcatttaagatggctgaaatgattgatcactgcccttcagagactcatatattttctgctctgcaaaatgtctgcaaattgcatcccagcttgtgcaaggagagccactcccccatccccaagtgtgttgtttctttcagtgatggtgattcagaggctgtgatacatcagcttagctgttttgggtttcagctttctcatgactagatgtatgtctttggacaagtttacattttcccatatttactttctttgtccttaaaaaaaaagttgctgttgctgctgatagtatctattcctcatagttgcgagtgggtctcctattagagaaaataaaaggaattgctatattagtatctttccagctagtctttgagcttcttgatgtcaaggatcattcattcttttcgtcccagtgcctaccataggggatggcacagagcagacaatagatgcttgttaaatgatgcagcaaccgaggcatccactccatgtctgtgagtgggatacgtctctcagagcaagagtgccccagtgcaagagtgatctagaacagtggaggaagggaggataaatgtagtctttgattttggagagacctaagtttgaatcctagctctacctcttgctagctctgtggtcttagacaagttacctaacctctctgagcccatgttagtccattcttgtgttgctataaagaaacacccaaggcagcctggcatggtggtgcatgcctgtaatcccagctacttgggaggctgaggcacaagaattgcttgaacctaggaggcgaaggttgcagtgagcagagatcacaacactgcactacagcctgggcaatagagtgagactctgtcccccccaataaaaaagaaaagaaaaaaaagaaaaaaagaagaaagaaatacccaacattaggtaatttgtaaagaagagaggtttaattggctcacggttctgcaggctatacaggaagcatggtgctggcttcagcttggcttctggtgaggcctcaggaggcttccaatcatggtggaaggtgaaaggggggtagcatatcgcatggtgaaagacagagcaagagagaaaggggatcagtgccacactcttttaaacaaccaaatctcatgtgaactaagagcgagagctcactcattaccagggttatggtgctaggctgttcatgagggatctgcccccatgatctaatggcctcccgccaggccctacctccaacactggaggtgacatttcaacatgagtttggagggaacaaacacccaaaccatatcagaacctctgtgtccttattgaaatagttggtgaaaatagcaccaatgtctaggagttcgtgtgatgattagatgagctgattctgtaaaaaatacccctctcaatctacaaacatactcattgctccataaatactgctattactattatctctaggattaccaccatgttttcagcttttcctgtcacccttgcctacacaaaagtggctcgatgttctagaaattgagactaaactaaactttgaatagattttcccaaacctgccaaaatatcccccaaattatagcaataaccattccctcctagagtggggctatctctccagcggaagatctgaaggttgtgtgagggatgctttttctcttgtctccctctactttcttgtagcctgagatatatagcaatttccaaggcagggattggtaaagtagactgacagcccaggttttccttgctgggagattaggctcttgtcccaagtttataattggtatcccaaataatggattgagaggtgttggccagaggggagaagaactggcaacatcaccacctaaatgaccccagggattctggccaaaagcagagagcaatctttctcgaagccccaacatctgctgttgctcagaaagcttcctggcagtttgagccaacttaatcagactgttctcttccacggcgctcggaggttttcatcctttgggacaagagatagctctgagttacttaacttacctggttcttgtatacgcttcatgttgtggcttttagtttctgttctctccaaggtgagccagttggatcttccaggaaacagatgctgagatggagttaggggcacaagaagtttattgagagggcataagtacctgggaaaaaataaaatagggaaggcaggaagtagaattgtgcaagggagagcttcagaccaccatgcagaccagacagtctctgccaacctaacagaaagctttggagaagaggttgcccatgaaaggagccccatgttgggcagaagttgccgggccccatgtccccctcatgccctgtcactggctgaggactgctctggcagaatgtgacctcagctcaaaagcggaagtgaatcctgagggctctgaagccagaggatgtcagtaacctgcacccccagtggctgaatgacacattcttttttgaaggcagatcggatccaagtgtctcctccatggaagtcacacctggagaatcacaccttgaaaaacattggccagcacgtctgtgatggattaactccagtggttagggagcctggctgagtgccaccatctgggccattcaaatcagttttctccacaaatatttacttacactttctgggcgctaatcatcctggtgggagaactgattgttataaagtgaatccagcaggggggcactatgccttcaaataacataaagctgcacagatggagtgaacagtgtggacagacaatcatttaaaaagatgtgaactgaaaagcatcttacaagagttacaaagatcatcactataacaacgactatcgtttattgaatcatcaggatgtgccaggtgctttctacatgccatctcatttcactgggaggtgagtgggcttattactcccagtttacagatgaggaaatggaggtgcagaaagaagtaacttgaccaacatcagtcgaaatacatctccccatttccatcagcagctctgtgatccaacactcaacatctcttgccaggactaccaaaggtcttcgaattactctcctttgcacaagcatctttgcttcttgctcaaaatctatcctctctactgaagccagtgggatctttcaaaatgcaaacccgatcatgttgtttctctgctgaaaacggtttcatggcttcccgttgctatggtgataggaataaaatttgtctctgtggccttccaagcacttcatggctgacctcggctacctctggagccccacgtctcacctgctccttgcaaaagtaatattggccttcttgcagttgccctcatgtccccccttcacctgtctgacatgggccctttgcacctgctgttcattctgctgatacttcttgactagtaaattgttttcatgtacttaaatagcactcgctacaatttgtgatgttgctttacttttgtgattattgactaactcctgcctccctgagctccctcaatgaagctccgtaagaatggagaattatccatcttcactgttatatccccagcactcggcacctcaggaacttcacggaatgagcagacgtttcagtactggtgtttggaataacaaacattctgacttcaataccatgttgaaaaagcagagttccttctatttgggagtgaaggagggtcctgaaggtatcttctaggaagtagcatttgaatctagcctttgaagtgagttacctttattctgtttctgactccagtaaacaagccagcaaatcaaacccttagagatggcaagactaccttaacagagcaggtgcagatctcttctgacccgtcctactctcagaggacagcagctccagatagtatcatccttgtgaaaaaccaccaacttccacattttctttgagccaggggaacactagttagctgaggaagggggtgcaagggagggagacaggatggcattctctttccttctctcagttatttgcttctcccagtgctgaatctaggcactccagagacagggccctgaattctgagctctggtgatttgcatttaattactaagaatgttttatttttctcttgtaaaattgtaatgctgcttgcagcattaaaaggagtttcttctggaatgaaaacaccaagcttttgagtaagtatcttttatgctgaacatggggagtcatccaaaatagggagttgattttcataatggttttgcagttactcataatgatgccctttgtaagcctttaaggtcaaggaaaaaaatcataggtcagatgcacaaggtatggggaatgttagaaatttctttgctgtgatctaaattcctctagatgagtggtttttttgagcattttctaaattatttttaacaactatttggagaacacaaactgaaataacccaaatcaatactagttttatttatttatttttccttttctaaaatttccataggttttttttgggggggggaggggggacagtaggtatttggttacatgagtagttcagtgatgatttctgagattttggtgcacccatcacccgagcagtatacatttaatccaatttgtagtcttttattcctcaccaccctttcccctgaatttccagcgtccattgtgtcattcttatgcctttgcattctcatagcttagctctcacttacaagtgagaacatacaatgtttggttctccattcctgagttactttacttagaataatagtcttcagttccattcaggttggtgcagatgccattaattcattcctttttaaggctgagttttattccatcgtgtatatatacataccacaatttgtttagccacttgtcgattaatgggcatttgggctgattccatatttttgcatttgtgaattgtgctgctgtaaacatgtgtgtgcaaatgtctttttggtataatgacttcttttcctctgggtagatacccagtagtgggattgctgtgccaaatggtagttctccttttagttatttaagctatctccacactgttttccatagtggttgtactagtttacattcccaccagcagtgcggaagtgtttccttttcaccacatccatgccaatgtctatttttttaattttttgattatggccattcttgcaggaataaagtggtattgcattgtggtttgatttgcatttccctgatcattactgatgttgagcatttgttcatatgtttgttggccatttgtacgtcttcttttgagaactatctgttcatgcccttagcccacttttgtttgggcttgctaatttgtttgctaattgtttttttttcttgctaatttgtttgagttccttgtagattctagatattagtcctttggatgtatggttgtgaagattttctcacactctgtgggttgtgtatttagtctgctgactgttcttttggctgtgcagaagctctttagtttaattaagtaccgcctatttgtctttgtttttgttgcatttgctttgggttcttggtcatgaaatctttgcctaatccaatgtctagaagggattttcccgtgttaccttctagaatttttatggttttaggtcttagatttaagtccttgatccaccttgagttgatttttgcttaaggtgagagatgaggatccactttagttctcctacatgttagatgaagggtcttaagaaagaaagtgcaggagggtcggatgcagtttagggatctgcccacatttatcagccatccctgtccccaccactgcccacctctggctcactaggatctaggatatgccaatagctgcagatttggttaggatccctttccagtccctgggtttcaggaaggcttagggaccaggaggaagagcaaaagtgttctctgccagcccctctaatgaaactgctgatccaatctcactggagactccattcctttcctgttgcttcatagatgagatcatggtaggatgcagtctccaagacaccaaaatgatatatgtagggtgaagatttcacagggaagaagcccgggtcctcattctctgttttccaacttcaaacatctctacgattatttgtttagtgtgtgctttaaaccacttgcattttaatttaagcacatttatttttaaaaagcaacttggcatcacagccagaaatggaaaaccagtatcacttcccacaaatagaaagtaagttgcaaaaatatataccacgaagaccaaacagctcagagactgctgcctaaggctcagagcctgaggcctgatctcgctgttaaaaagggagattagcgagtgttgtagggtgtttgggactttttccctgatgttttcagaagagttgaaacagacttgaaagggagcaacttttgcaccatgtgacttgatgttatttaattcagtctccttgtaccacctaaaaattatcacagctaacacccgtgctatagcctcacacctgggaaagggatctggtctttttcagtaaattgttaattccacattggttcttagtctcctgggcaggctcagagaatgtggcttgagagtgatggagaggacaggttagtctcaaggagttagttgtggttgtagcaggtctatgtgtgggggactgaccagtaggggaagtacaaggagaatggggtatgtggcacaggtaaggaggagggcagggaaatgagaccaccagcaagaaagaactgatagttagaacagtggagtaaaatccacactttcactgttgtgtctggactttgccccttggaagacatttgggaaaggtgatgtggggctggaagtctatgctgaccggccaagagagtaaagtgtgtgtgtgtgtgtgtgtgtgtgtgtgtgtgttttaccacaatttaaaaaaaattgaaaaagaagaacactattagttacctgagaatcaatatagaccatggttctcacactttagtgaacatcagaaaccccgagatgcctgattaaagcacaggttgccggtacaccaccgaagtgtcagattcagtaggtctgggtgaggcccaagaatctgcatttgttacaagtctccgggtggttaggtgctgctgctggttgggaactgctgtaaaccatttactttggtacccacaggtccagagaatgtcagaatgtcactatcctctgagtcccgtaggggctgtcaacctaggaggcacattagaatcacccaaggagcctaaaaaacaaacatagaaacaaaaacatggatgcctgggccctaaacccccagtgaatctgattttattagtctggggtggggcttgggctcatatgttttttaaactgtatatgcatttagatatattttctttttttaactttttatttcaggggtacatgtgcaggtttgttacacaggtaaacttgtgtcatgagtagatatattttcaagcttacagaaaagttgaaagaatagtagaaagaactcctatattctctttattcagattcaccagttgcttacattttgccctatttctttcacactttttttttgtaggaatatcactgaagtgatattgtgtccttcttggtgcattgtatcaagagatgatgtccgttggtcttgatattggtgatattaattttgactccgtggttaaggtagtatctgcagtctctactgtaaagttgctatttcctctttgtaattaacaagtaacttgtagggagttctgatgctgggttctgatgcttcctgcttagaaacctgcactaggaagacgggatacactttcaatgtagctcctatattattaggcagatacattgagactatataaatatcctattccttatcatgtttttactcaccagctttagcatccattgatgttttctaactccatcattccttctctttactagtgttctgctataaggaagaacatttatttttacttttatactttatattagcatgggctcaagattcttaattttacagtgggttataatccattactgtcgttatttatatttatgcttaaattgtctcagattttatcggtcagcacctcaacctggctcttgtattcttttgacacattcttgtcttagtgagctcaggcttccatgacaaaatatcatagactgggtgtcttaaacaacaaaaatttatttttttcatggttctaaaagctggaagtccaagatcagggagctggcgtggttgggtttgagtaagggctctcttactggtttgcagacagctgtcttctctctgtgtgctcatatggccttttctcagtgcatgctggtggagagagagagagagagaaatctctcttcttcctctacttacaagttcaccagtcctatcaacctggggtcctactcttatgacctcatttaaccttagttacctcctaaaagccctatctccaaatatagtcaatggcaggttaaggcttcaatatatgaatttgtaggggacaaaattccatccctagaagtcctcattttttttttttttttttttttggtgcacattcccttactttctggaacaataagatgctcttggttcattttatacttttcctgcttcaaccctggaatcagcaatcagtcatttctccaagggtctgggttcctcttttaaaaaatgctttctgggccaggcacagtggctcatgcctataatcccagcactttgggaggttgaggcgggcagatcactggaggtaaggagtttgagaccagcctggccaacgtggtgaaaccctgtctctactaaaaatacaaaaatcagccaggcattgtggtgggtgcctgtactcccagctactcaggaggctgaggcaggagaatcgcttgaacccaagaggtggaggttgcagtgagctgagattgtgccattgcaccccagcctgggcaataagagcgagattccatctcaaaaaaaaaaaactgttttcttggtgagaataatatgcagtcagaactgagaactagagttctaaaaaaatcccctcatgtatacccacattctatagatgaagaagctgttattaagagatagggaatgaccagctcaaagtcacacagcaggcgagtggcagaactgagcctgtaactctcacctttcctcagtccagcactttttaaaaattacagcctcctgagccctcaccattttgtttgcaagtgtcttgttgattcactccattacagatttaggacattataaccagggacccagtcattttccttattggtatctcctctgtacacgtggcttagtgctgagcagagagtaactgctccatgaaaccttggggcctcagattatttttctgacagccaggttctgatgcttcctgtttagaaacctggagtaggaggacaggagacatgggtttcactgtagctcctatattcactcactgggtgatgcatcagttctctttgggtttcattctcattgatacaaggagagaaaccacactacgtgggctctctggtgatgtcttgggcagagtttcccagacaatctcttccctacggtcttagacaccctgggcaaaagccaaaaccggcacactggcacgtctccctcacgtaattggccaaactaagtcacgtgatcaaactcaaagtcaagaggtgaggaactgtatcctggttcttaagtggcagggaccacagaatcacgtgacagtgacatgtttccagtaagagatgaagaattgggccagttgtgcaatcatgcaatctactgcaaaaggttttttgtttttttttttcactttgttgcccgggtattccctaaaacacccagagactctagctcttaaatataaggctgattaaagctgatcgatgccacctgactataatactgtcacttgagtgaaggtgccaatgctacgcagcaaatgtaggagagatgctgtagattaactgtatgtttttagaagctatggaggcccagcccctcctacaagtcagggctgaacctagtggtctagtaagatggggaggcctgatgagaagcaggacacacacctgggatgtgcctatgatgattgagatcttctgacagaggctgctccttttggagctaggcaagataaaatgacacaatttcctttgggacctgcaggctgcaagagcaatggtacctaccccatctgttattatgacatacggaccctgcctgcagtgctgagcaactgtgactctgagccccacttgctcttctttcttctgggtttcagaaaggttggccgggcgtggggctcatgcctgtaatcagagcactttgggaggctgaggcgggtggatcacttgagccaggagtttgaggccagcctggccaacatggcgaaaccccacctctactaaaaatacaaaaaattagccaggcatggtggtgggtgcctgtaatcccagctacttgggaggctgaggcaggagaattgcttgaacccaggaggcagaggctgcagtgagccaagattgtggcattgcactccagcctgttaaaaaaaaaaaaaaaaagcaacttttcatgctgccttttaccttatcttttatgtataccttgagatttaatgcctctgagtacatgagatggagggcttaagagaagggacttgagttaccgtttagtttgaatcccgtctctactagcttgctgtgtgatcttggacaagtcacttaacccatctgtgctctagtttacttatttgttaaaagggataaaatagaactgacctcatagagttgttatgagcattaaattagttaatatattttatatgtttgaaacagggcatgtcacatagtaaggagtctataagagttacttattataaaaggcaaaatcattgagagaaaaaaataatgcttaattttccttctattcttgagaagagagaaattcaaactcttgaagacaccctgatctctttccactgcaccctcagacctctggaggcaaaggaggtgatgctgtcccctgtattccgactgctaacgtgggaagacctcacacaacattgcatgtctgctgaaatgttaatttataattcagtgtagagactgattttccttggactgtaagaagactccttttctagaacagaaaagatgaaaagtatgtgcatgtaattatggtgtttatgccactctaaaaaaattattcctaaatattgtttgggtagaattatttagagaatgaggctagaaccattccaatcccaaagactcctcatttgactaaactcttctattctttgttgaaaggactagactggaggtatatcaaggcatgcagatgactaaactattgtgtgggctgttagaggattaattattttaatacctttattgatatataatttacttatcataaaatgcactcattgtaaatacataatccaatgatttttaaagtaaagttacagattttgcaaccatcaccccaaataaattttagaacattttcaccagccctaaaaaaattatctcaggcctgtcaatcattgctcctaaccccagccccaagcaagcactgatccactttctgtctctatagattttccttttctggaaatttaatgtaaatggaatcatacaatatatagtctcttgagtctggcttctttcacttagcataatgtctttgaggttaattcatgttgtcacatgtatcagtgttttctacatttctatttccaaataacattccattatctggatatataacattttgtttattttttatttttttgagatggggcctattccccaggctgtggctcactgcagcctctgcctccgaggctcaagcaatcctcccacctcagcctcacgagtagctgggactacaggtatacactaccacacccagctaattttgtgtgtttgtgtgtgtgtgtgtgtgtgtgtgtgtgtgtgtgtatacacacacatacatacgtatttggtagagatggggtttccatgttgcccaggttgatctcaaactcctggctcaagtgatcacctacctcagcctccaaagttatagatgtgatccactgcgcccagccaacattttgtttatttaccagctcatgggtatttgggttatttctacttcttgtctgttagggataatactcctgtgaatatctatatgccagtctgtgtggatgtatatcttaatttctcttgggttgatacctataagtggaattgctgggccatatagtaactttacgttttaagtttttaaaaaattgccaaactgttttcacaggtagttgcaccatatcacattgccatcagcaatgtacaagggtttcagtttctgtgaatccttgccaacacttggtgttgtccatattttccattatagtcattctagtgtgtatatggaagtggaatctcattgtggttttaatgttcatttccataatgactaatgatgtttaactccttttcatttcttattggccatgtgtatttcatctttgatgaaataactattgagtatagagttttttagctcatcttatttttgagctgtttgttttattattgagttgtaggagttctttatatatttttgatacagttctttatcatatgtatgatttgcaaatgttttctcctagtctggcttgtctttttattcttaatggtgtctttggagtgcaaaagttttaaattttaatggagatgaatttgcctattttttcatttatgtctagtaaaagaataatgaatggttttgtgtctaagagctttccgcttaacccaaggacatgatggttttctctaatttttttttcaaggagccttatagttttagttgttatatttaggtctaagatctattttgagttaatttttgtgtggtttggagataaggatttaagttcactttttcacatattgatatcaaattttcccagcatcatgtgttgaaaagactatctttttcctatcaaattatcctgtcatgtttgtcaaaaatcaattgacagtgtcagagcttatttctaaacgttcagttttgttccagtgatttgtctctttcccttaataccacactctcttgatttctgtagctttgtaatatgtttgaaatgagggtaatgtaagtccttcaccattgtttttctatttcaaaattattttgcctgggtctattttttttttggctactggaaacccctccctcttgggtctgacagggttggagatagatatggtaaaatagagtataggggacagagaccagtagactgtgtcttggtcaccgttgtgtctttagcacctcatataatgcctggtaggtcctaaatactaaaaaagctgtaaaataaatggataaatgtatcttaagatttttttttatcacatggtatcatctatgtcttgggattagggaaaatttccatgtcaaactaaagagtaaaaattcaccaaggttttgatatgctctgatatgatcactactacttgagcctccccctcatcggttttatttcccacccatcatagctcctggaggaggatggaattaatttcaaggggatttgggaagtaattgtcttgttgttagttataaatttttgagagatgatggaaccttatcaagacagcttgctgttgaaatcttatagtttcccgtttagacctctgttattattatctgattatttgattattattatcaagggttttatatgtctaacagtgttagatattgagaggaccttcctacatgttgcctcttctgtctgaaacagagcccctcaaccctcccggaaagaagcacacataccccaaactctctcataattcttagacattctccagacctcaacctcatcattactccttagaaaaatcgttcctaaaccataacctgtatcaactgccctcctggaacccaccatatgcttctcgttggtaacacttatggtggttacatatttaacattcattgttgtgcttattttataaagctttgaggtatagttgacatacaaaaaattgcacatatttactgtaaacgtttcaatgaatctagacatatgcatacatctgtgataccatcaccaaaatcaaggagtactgaatatatctttaacctccagggtatgtgattaatgtatatttctcctcggggatcatcagcttcgtaggggcaggaactgtattagttttcactcaccgttttgtccctattgattactacagtagttgacaaagtacaactaacattttaccgagcacttactttgtgccaggcattatttaaatgctatggatatattaatatacttaataactacagtggcctcttgggttgttcttattgtcatcccattttttagataaaaaaactgaggcatgaggagagacattatgtaacttgctcaacgtcatacagacaatatgtaatggggcatagagaagggtgtcaataattatttgttaaacaaatgaatggatgaataagagaaagaaagggtgaatgaagctcttcccttgatcctagttggaagcatgtcctctacaagagtgctgacttatcttttcttgcgagatggatgggaatacaaggctatggggatgcccaggagactgttttggactccagtgctgctgactctggagagaggaaaaggtgggggttgggatagtctaggaaatgctggcttcgcacaacacagccgagtgggtgggagccaaaaatagccagtcctttgagtagaaactcctctagggaggaaacatttctttgaaattggacacacaaattagctaatgatatccagacactaaagaactgcatgttccccagacagcccgcggccccaggatcagacgctgatcttgtggagcacagattaagagatgccgcaggtctagggtgggtatagattgttgtgtctgccatcctcactcacagccctgagcacagaggtgaggacgcagccaggggccagcactctccttccatgtgtgccaatccctgcctccctgtatgtcctgggctgtttgtccaggatggaaagtggcactgtggcatttttacctgtttgtgctcagtgacagttgacatgacacagagtctatgttggcagtatttccaggccgaagcttaggaaatcgactttaggatgaatttttcaatctgggagactctaacagaggctctgagcctgggatgtgcaaactacctgcacttatcttcaaaattgtgtccaaatgtgcgtttctcaagggagagggtccaaaggtttcatgagtaaacaacaacaaaagctttcaacaaggtatgggatgtctccaaaagggtgagaacccatgatgatgatactgataatagcaataataaagtaacttttctgagtgcttagaatttgctaaggccaggcgtggtggctcacacctgtaatcctagcactttgggaggccgaggtgggcagattgcttgagcccagagttcgagaccagcctgggcaacgtggtgaaaccctgtctcaaaaaaaaaaaaaaaaaaaaattagctgggcatggtggtgcatgcctatagtcccagctacttggaaagctgaggtgggaggatcacttgagccccgatggaggctgcaatgagctgagatcatgctactgcactccagcctgggtcacagagtaagaccctgttccccaaccctgcccaaaaataaataaaaaagaaaatgccagatatgcattaagtctcttatatagatgatataatttaactgttgtatcagtcagtttaagcaggttcatgctacagtaataagctactgagattttggagttgtttatgaaagttgatttcttgttccagttatatgaggttagttgcagctctgcttcatgtcttagatgcaagagtcagactgacggagggctcctttctaggtcattgctaatctcatggaagagggaaaagagaaggatgtagatgaagagatggatcttaaagattctcctggaagtggcactgtcactcccacttacattccgctggctcccagcccaacattggcgaggattccaattgtccagtagggaggagtcctgtagagaggagggacagcagatatttgaacaataacataatctattacattccttataaaaaccaatgcggtagatatagtagtgattattatcattgtccctttcttacagatgtggaaactgaggctcagagaggttaactttctccccagtgctgtgtatttattaagtgagaggttcaagatttgcatggacttggtcagactctcgagcctacagctttagccactgcattcatcgacttccattgttatagcaggagcttctcctccactccttgttcctcctccccaattcatggtaatccacacacaccagttttcttaaaacttcattcatgctcaagagaaaaccatgtccctatctggatcctgtgtttgcatagtccccagcctctgggctcattctggatcatccagctaggtaggcatttgtttggcaggattcctgcccactaagagcttaccatgagtgtcatggtgggaatgagctgggtatttttagagcttggcagcctagcactgcggcttgctcttccccgaggtctgtggattagcctaggggtagcatatgcctacgctttgcttgcctggtcctggtacatggtcctgtgtactgttaagaaaacagattgtcccaggtagatatgtagccagatatttttttctctgtttcctttttttttttttttttttttggagctgctccaccccctggtatggtgcagcttctcctggggctcctctgtaattttacagcagcttctgagctagtgaagaaggcgggatttgctcacttgcagttaagtctggccagacagctgttagttgttgccacaaacatcttatgtgtttgcaatcttgcctgtcctcctgggtaggcagaatgcacaatctctcctcaggggaagtgagaagatctagaaggcccaaggaacaattatttttggcatcattgctcctccatactcattatccacatctgttgagcattcctgtggcccagaagctgatggcagtgtcactgtggcaccctagctttgatgtacttattgtcagaagctctggatagggaccaccaacaatgcactttgctgcataggtgctgtgagtctccatgggaaggaaagctggagatttgcataaaaaagtatttagaatgtccagaagcacaaactcaggtgtcatccaattcaacaaacactttctgagtgcctactgtgtgcaggacataggattttgcttcatgtagaggttataacattcaagaggacacccgtggagcacacaggcacatcccccaatatggccccaggcattacagaatgtgacagacgtgacattttttgtttgttaattaactaattcattctagtgttgtggttaagcgcataaactttggggccagactggttggtttgaatcctagaaataaaaataaaatcctaaaccaccccaactaattaaatggaaccccttcttggccagggggatcccagagaaaccttgaaaactgagttcctagccataaccagacaggagctcagacttaccacattatatcctctcccttgctaaccatcatttggctttctttcctaagggttaaacagaaacaggccatctcaaaagacttgttccatcactgtttccaaccaaccacctgactctgcccctcgctttatacaggtttgacacggccaaccaagcaacattccttcctgataagatttgcacacccagaactagcttctgtttgcatgaagtggttctggtcagtttacgggggctgcacactgagtgccttcatgtcctctaattcaccttttgacacatggggccaaattatagtatacttaaatgttatgttttcaccccaaaatgaacatggcatgtatatgacattcatattaatttactgtgcatttgcgtgcccttcttttgtgaatattcatagctcctcctataacttgagtatgtatacttagccattctgttagcataaattcctgtctcaccttgcctcctttgaagtgcctgcctctggtttctgctggatgctacactccccagcctgcgagatggtcagcttacaggctgcaaccccttataagaaataaagctctcctttctagatgcatgaacctcgtgtttcttcagttgacaaatccttactctgtaactcactggctatataactgaacaagtgaccaaaactctccctgccaagcttctttcttcccaatatgggaatgacaacagtacctagctcagggagttgttgcagggattatatgagttaatatacataaggcccttggaatggttcctggtgcataggaaattgtatcaaagtgttggctgctactaacactattatcatttatgcaatagatatttattgatctatgtgtcagtagactgttgtctactatgtatcaggcactgacctaggtcccagttgtggaacattaagctcactccatatccttttacccttacggagcttgcatttcagaggttggaggcagaaaataaataaataaataaataaataaagtgtcaggtggtgattaagacatgaatgaaaaatcatactagaaaagtcagatgagggagattaattcctaattgagcaaagatgatgaaaaacttccccagaggagatgacaccagctgagaagaggcatggtagtaagaggcaggcacccaacatgcaattccaaaatgagattttgctagagaatgggaatatccttcttgggggtcatattgttacatctttctttttcttgccgcctatgaacaggaattctaaataaggtcagagactggggttgtcttttggtcttagtggccttggtgttggaccccaggttccaggaagtcttttatcccagcagcagtttttcggagagaagactcacttatatgcaagactgacatgaaaaggggtttgctctgtatgaggctgtgagctcagccccatgcttaaagtgctgagtgggaaaaagggcagagactatgcctgttttgtattcaaggggctggcacaacatttggttcttagtaggtgctcagtaaagaatataaatagtcattgagtgtttactgtgtgctgaagacatgtcaccaggttctaagcctttgatatttgtcaacttatttaatttttacaactgaatgccttttgttgttgttgttagacagggtctcactctgttgtccaggctggagtgcagtggcatgatctcggctcactgctgccttgacctcctgggtccaggcgaccctccttcttcaacccccaagtagctgggattataggcatgtgccccatgcctggctcatatttgtatttttttgtagagacagggtttcaccatgttggccaggctgatcttaaactcctgagctttagtgatccacctgccttggcctcccaaagttctgggactacaggcatgagccaccacactcagccctgaatgcctatttttgtccctgttgaaaagatgaggaaactgagcacaggccatgctggggctatctaaggactcttcatagaaagaattcaagaagacttcttagagaaggtgactttataaagcatgtcttgaaagataaattcgtcaggtaggagagtagggatcgggggtgaggtgcagaaaagaacattgtaaagagaagcagctctatgagcgtgtttggtaagttcagtccaggatgcagacaggagtagcaggggaagagggtagagagaggtcagggtgaaagcacgtgggcctcataggccttactcagtgatttagatctttatcttgactgcatcaggtagctatacaagtaattcctgaaaaggaaatgtcctgagatcaaactggctttactcaaaggtcaccatttaaacccagccatgcacagtttagcacttcattaaatattgtgtcctaatggttgctcccttctcccaggggccacacacgtcttctcatgtacataagcactcgtggagtctgcggttggaagaaatcacgcaaggactggttgtgccttgcacacctgtcacagatttgcacacccagaactagctcctgtttgcattgtctctactgtagcttctgcaaatgacaaatgtgggggtttcttcttggatgaagtggtttgaggtttgaggtttgagacttggatgttttctttgaaaattttttatttttttatgtttttgcaaagagaaacttgttcctcttcctatgctcactgagtcctcttttccctaacttctagaggaagtgcatttaatcatgctgtgatcaagtcagccctgggtacccatgttggcttttaattttaaaaaagaatgacaggaaaagaaaatgggccagttaggttttgaagatttttctattttattattattaaaggaagcccatgtgggagaatgtctggtgctagtttctcatctcggcactgacatcatcactatcttgactgctgtaggtattatttgttcttggcttgtgtatcagctatctattgctgtgtaacaaccgaccaccaacttagcaggtgacacccatttattatctcatgggaaatgaggaggccactcaaagaggcctccttcttcaaaaccagtgatggagagtggaggagggctctgctgcttccagtctctgagcacagggaaggtttaagccttcttttaaagggctcatctgatgaggccaggcccaccttgggtaatctcccttttgattaactcaaagtcagctgattagggaacttaatgatatcttcaaaatcttgtcacttttaccatatgatgtaacataatcacagaagcgatgtcctatcatattcacaggttcacctgtactcaaggggaggagatcacacaaggacatgggtcattggtggtcatcttagaattttgcctactgtggctggtaatccaaaccaaatattcttcctgtggattaagactatcactttgggaacatcttagaattctgcctgctgtggctggtaatccaaatcaaatattcttcctgatctttgtgttaagactaccacttttggaacagccattttccaaagctctctcataattccatcgtaggcagagatggagtgtggccatacaatgttttggaggctccaaatctaggtaaagtggaaccactggagacagagtgccatcttgtttctggagtcaggcaaagacactgtgtccaggtgggatttgcttggagctgatttctctgttggataaaatagaccagtggcttcataaccctatgaaaaaataagggttctataagttgacacattttggaagtggagctaaacccaaggctgactccaggactacaactatttctacttggagcccttgagcttatttttccagtacataggtctcagcttaccaatctgaaaatggagagtagggacatagggccttggaggttcctacttattttaatcagttccatagcctgaccctggtccagtgagcatcagatttggagactgtgccatttatgaaacaggcaggtattggagagactccaaaaagcttgtctcatgtgtgcttccctgcaaaaacagccagttccagctagaaactttatcttcatgaaaggaaacctctaggcagagagaagttctatttgtttttacaactatccccagttgtatttgaagatggcaaaatgttgggcttaaggcctgccctgggttcatggagctagctttcttaatgcctcaatcatacttttaatcagaaaaaatttagagcattaatcttcagtgcttgttcttgccatttccagccactagacactttttcataaacaaagtgacagtttgattgaatgtggtttttaattaagctgccttcacttggaacaactttctgggggcatatgtaaggagcagaacttagaagcacaagctgagactgacttcgcaatagcttcatctccaggcagagtttgagaacaaaggaaaccaggcaagtggaattaaccaggcaccttaatccagggcatcagctcccactccatcctagctggctgtcccttagaataagtgtgggaaggcgtagcagtgagtgcagttgcctcatgctaacctcaggacgaagcatgtaagagcctcggaaattgccccatggtagatatttatattaacgacatttgacctgtttatggcatgtcactctcttctgcagttgggactctgcaaacacaaaaggcaaaaagaccactctgattctgccctcaggtacaactcagaattgtatgagcaacagtggattctgcagtacaagatctcagagtctaacagggaggcgaagatattcactggggcagaacatttgagacgggaatgaaggaatgggctacctgagcttggagggtggagatgtggctgggaaacactttgaaagcccttcaaaggctgttcaagtataatggggacagtcatatgacagggctgggcctccttgaggtgggtgtttggatggtaagagggtcccaggcattgtcatctggctgcaatacaaggatctgcaatacaaggtgagggtgatattgctttaagtagcgctcatctgtactccatcgctccctttgtgttctgtggtgtatagatctaccctgataaatagctgctgccgtggagaaatccatcaagccttcagcctctgcatgactcatttccctgtggcaggcgtgttgctcggcttccaagaatagcctagcctgagggatccaagctcggaatcccttccaactttctgggctctgaagtttggcacccacagaggtctatgcttaggtaacggggtgcagatggcttgtcgtttgcagagacagtggctaataaccatctcccttccaccttcgctttctgcaaaagcccagggcctggcagagtcacattgcttgcaaaggaagcctaatcataaaaaggtgccttttggtggcttaaagataaggtaatcaggaaacccattcattgatttatttgctcattcaacaaatatttgatgactgccttgggagtgagaaccacagcaagaaacttaacaggggaccttacagaggcaaatcagatctcagtgctaagccctgaatatactctgctgttgtggcaaccaggcagggagatgataagaacagtaattggcatttattaagcacttactgtatgtggtgtattaagtactttacatgaatcaatttgattaatatgcacaaaagtgccatcaattcagttccatgatcattcttatttgctcgctgagagcagcattgcacagagggtaacttgctcattctcatacaaagtgctcatgcaattcttcatacaggaattgcacccagggttctctgatacaaacacataaaaatcacactgattacaccattgcgttatcatagcaaccttctttctgtcacttcttcccagcctgtgccaagctctttcctgctttcttagtctgtttgggctgctatagcaaaatgtcataaactgggtagcttgtaagcaacaaacatctatttcttatagttctgtaggctgcttaagtccagggtcaaggcaccagaagattcatgtctggtgagggcctgcttcctttttcatagatggctgtcatcattttgttttgttcttcattggtaatggaaggggccgttgatctctctggagcctcttttatcagggcatgaatatcatttatgagggcttggccctcatgacctaatcacctcccaagggccctacctcctaacaccatcacattgaggattaggttttaacatctgaattttggagggatacagacattcagaccatagtgcctaccccatgggcttagcgttttcctctgcctgaaacatggctgcattgtctccatctcattcttcaggtctccccttaaaggccaactccttaagaggccttccctgactacccagtcagttctctcctattattctctagcttgcactttatttctttcacagcctttatcatactgtgacattaccattttttttggttgttattatccatatgcccctctcctccagtccctactagaaattaagctcccaaaggcacaggccttgtgtatcttatttgtgctaagatggtgcctgacacctagtgagtcctcagtgagtgtggtatgggtggttggaggaaggagctcggaccttcagtcctcacagatgcacaacaaatctcaggtgttgttgcatggctgtttgaatgaatggagctatgagcataaggctgtattgttattgttgtcactgtcatgatcatggctggtgaaaaacagaaagacactggggattcagaatgcacaacagtgtttgcaattgcaatgcagagacggtgatgtggcaggcagtcagtcagccagtcagtcagcatgctccctttccgggatctgccagtggagtgcactgtgccccatggatgggcttcggagggggtagtggtgacatcagctccccagcagcttctcacctctcttggcctgaagggggctgtgccctttgtttcactgcagctgctgcagacagagaaaggaggagattcccagcctcgaggttgcctcgcagggcagtagcaaccgagggcagagcacagaggagcagctgcattctccatggggacatgactacgtggcctggcttctcctgcccccaggggctgggggcctgccaggtgctctgaggattccctattgctcttatctccttccctcctgcatctcaatttgcctcccccctggactctgcttttccccccttgtcttgcctaatctgccacaaggacatgctggaaagaggactttctgtgttctagaacattctacatgtgtggctcctgagtctcactttgtccacctgtgaagtgggcattatacccaccgagagtgtggtcacgaggaacagacgaggctgtcatttccccagcacggttccaggcacttggctggtaaagctctgtggtgtttgttcatcacactggaccacagagcaacagtgtctcacatgttatgaagatgtttcaatccgtggactaagcacttcattattgttgttgtcattattattactaacattttctaatttaacagctttattgaggcattgacatgcaataaaccgcacagctggatgagtgctgatgtaggcatatacctgtggaaccatcaccacaatggtattcagcccttaccacaaccgcattttgcagatgaggaaaaagaggcttagagagagaaataccttatcctggttcacgtggatggctaaaagcagagctgtctgatccaggcctgagtttaccttggagacaagaaacgtcagagataaggctgcagtcttaaatatgatgccacggaaggtatcaccaaaaaaaatggtatttggataaagaccctaaagaggcttcaaagggagtgggctacgcagaagagcattccaaggagagaaaatagcatatgcaaaggccctgaggtgggggtgttttccagtgtgtttcagaagcatttaagaggccaagctggcttggggatggaaggagatgagggcagaaaggtaaccggaggccaaactctaaagggccttgtaggactgtgcaaggtcttgcctgaaacaccattgcagggtttggggcagataataaacatggactaatggggccattctggcttcactgttgatactggattgtaagagggcacaggtggaaacagaagtcatccaggtgagaggtggcatggaccaaacttgtagtggcagtggtgagagtgtgggatgtactgggtttactgatggatttgtgcagaatgagagaaagaggagagttggagatgccaccaaaatgtttggcctcagcaacgaagtcaggggctaatgtggctgagatggatgatagacttgagatgcctgttacacatcctattagtattttttccctttgctgctataacaaattacacacagtggcttaaagcacatcaatttataatcctactggtcacccacatctcactgggctaaaatcaaggtgcagtgctgtgttctttctggaggctgcaggggagaatccatttactgggctttccagcttttagaggctgcctgtaccctttggcttgtggtcgcttcctccatctccagtgccagcaacattgcattcctctgtgcctttcttctgaagtcacatctctttctacccaaagccaggaaaggttctgcacttgtgaccctggtgatgatattggccccacgcaggtcatccaggataaattcccctctgaagatctttaactgaatcacatttgccaagtcccctttgctgtgtaaggtaacatgctcacaggttccaggaattagggtgtggaccttgttggggaccagtgctctgcctactacacacatatcctggtggagatgcaaggagagactttgatgtttgagtctggcttttcagaagtgtaggtagctgcagatggaatgttcacagtgctctcgactcttccatatttactttctgcatttgttcagtcgtcatagctctttctcctccagactatgagctgcttgaggtagaacttgggtcttttcctccttgtgtgtctcagagccacaccccagagagtgctctggattgtctgtgacaagaatacagtttgagttcaaatttaaaccaaactcatctcttagatgaggagcatcatacagatcctagtgcgtgggagggccacggacatgtgtctccaccctgccttgcctggtaagagttcatggcagaccctaaccctgctgagctcttgttttagcttttaggtccccaccgtcgccactctggatacaaacttggcattgtggctaggggttttgtgggatggatgcagcagttgttgcctcgtcaacattctcctgtggatggtttttgggtcaaggcccactggatcctgttgtgagttaatttgcaaagcttagctgtacctaatgcaggaaagagggtaaacaaacacaagcagcaggacagactttgcaccagtgactcagaggaaggcctatggggatgggatcctcaacccactttgcttcctgatgtcccaggtgctgggctgggagaatggtctggttagccctatgtccgatcctaaggaacattcacattttgccatgctttttacaggtagcacaatgggcgcatttttcactcttgcagatgggtctcggaatgaacttccttgcattgaaaaagggagtggtttggattttctcactgtctagaagcatagtggctaagggaatttctggagtccctctgtctgggttcagagcccagagttataaacactagttgtaggattttattttttaatttttaattttttagcatattaattatatttaattctctattttggatatttagagcagctagaggcattattttagatattgacgagatgaatgtccttctaacacttgtctgattattttcttatgagaaattcctagtacagaatgtgttagtcaaagggcttatttttaagactttgatatgtgtcatcaaggtgccctgtagggtgactgtcctggatgacactcattttgatggactggttcctttttattgtggtagaatatatataacctaaaatttactattctaaccatttttaagttcagtggcgttaagtacattcacattgttgtgcaatcatcatcagtatccatctccagaacttttccatcgttccaaatcgagtctctgtacttacttgcaatcactctccattccgccccgctgcttggtccctggtaactactattctactttctgtctctataaatttgcctattttaggtatcccatataagtagaggcatacaaatttatctttttgtgatacgggactttagacaagtcacgtcatttctctagggctcagtttcctaatctgatttagtatgactgtgaaactctcaaactcaggatgaaagggaaggagggaggaggacctttaagtgatcaaccaaaatttactaggtgctgactacgcgccaggtactggataccattatattccccgacatgcagatgaggaaactgcataggagaggacccatgcaaagtcccagcaagttcagggctgagattttaacccatgtggcctggcgtcagaaccacattctcaatgcctacactgggctgtcctttgataataatggaaactccttcattggaggattctttgaaggattgagccagaaattttatctatgtataatagcacttaggccagcaaggagaaattggtcaataagtgatacctagtcttacgtttaaatgtttttgagatataattcacataaaatttatcatgttaaagttcacagtccaatgctttttagtatattgactatattgtgcaaccatcaccactccctaattctagaacagttccaaaaccacaaaaagaaacctcatatttttagccgtcactctgtctccctttgtccccagccctagaaaccatggatctactttttgtctctatggatttgcctattctggaaatttcatgtaaatggaattgtataatacatggccttttgcgtctggtttccttcacttagcataatgtcttcaatgcccatccatgttgtagaaggtatcagtacttcattcctttttatgggtgtataacattccattgaatggccatatcatatcttgtttatcccttcattgattgtaggatgtttagattgtttccagtttttggctgctatcagtaatgctgctatgaacacttacatacaagttattgtttgaacatctgttttcagttctcttgggtatatacatacctagaaatggaattgctggatcatataggagttctatgtgtagctttttgaagaactgtcgtactgttttccatagcagctgtaccattttacattctcacaatcagtgtacggggtttcttatttctccacatcctggtcaacatttgttatttccattcttctgaatttagccatcctggtgagtgtgaagtgctatctgattgtgattttgatttgcatttctctaatcactgtttgtattgagcatatttttatgtgcttagtggctgtttgtatgccatcttgtaagaaatgtctattgagaccctttgccttttttaaaaacggagtcgcctttctattgttgagttgtgagtgttctctatgtaccctggatactagacttttatgagatatataatttgcaaatattttctgtgtgtcgtgttttcacttcgttttttttttttttgtgacgggggtctcactctgtcacacagattggagtgcagtggcacgatctcagctcactcactgcaacctccgcctcccaggctcaagtgattctcctgcctcagcctcctgagtagctgggattacaggcacgtgctactgttgcccggctaattttttttttttttctggatttttagtagagatgcggtttcaccatgttggccaggctggtcgtattttcacttcttaatagtgccctttgatgaataaaagtttttaattttgacaaagggtgaaggatgtctaatattttgtctatgatccatttttcacctctaggcccacttttttgaccctcacacatcacggtagattaggaatttcttaatgctgtactggttttggaggtaaggaagatgggactagcccactttgctttgtcaggctgagagggaagaagtgattccattgagccaggacttcagtggccaaaactacctcccctggcttcagaatcccttccccagaccaaccctgcgtgatatcagcatgtggtaaaacactcctgtgtctttagagactgcagtctataaatgatttttctgtcttccatgggccttgcctgcaagcactttccatctttccctaggtttcaggaatgctcaagaattacgggatcttgactgggcacggtggctcacacctgtaatcccagcattttggtaggccaaggcaagtgaatcatttgaggtcaggagtttgagaccagcttggccaacatggtgaaaccccatctctactaacaatacaaaaactagccagacgtggcggtgggtgcctgtaatcccagctacttgggaggctgagggaggggaatctcttgaactagggaggaggaggttgcagtaagccgagcttgggccactgtactccagcctgggcctgggcaacgaaaagagactctgtctcaaaaaaaaaaaaaaaaaaaaagggggtcttgtcactgagtttcctcatcttgcctctgcctctgagcacatttttccttctgcttctccaccataatgaaaaccagccataggctttgactactctctattctctagtgtcccaaacttcagtgagcacagacaatcacccagataacttgttaaatatgtggattcctgggatattccccagaaatactgaatctaaatttagggatagagcctaggatgcacatgtttaagcagattcccaggtgattctgatgtcagggggtccacagaccacgtctttagaggcactgccttattctagaagcctacccacccaaacttattctgagatcccaagagaggctaagtccagtggttctcaaacttgactgcatactataatcacctaggagaactttacaacttccctccatcctagggcacagtgcagacaaatcaaaacagaaactcagggcatgggaccccagcttcagtagtttttaaagctccttgggtacttccaaattgcagccaaagctgagaggcatcggagccataaaattgtaggtacttgtttctctttgctaagtcctttaacccacacaggtcagctggatttggaagttgatgcttcactcttataaacacatttcaacttgttgtttattctcatgctgcaaatggaaggtacagaattgcaagggatggaatgtgcacgtacctccaatttccctaccagcagggaatgcaacagcctcatgatgcttaaccacaaagggcatcacttgagacatctttgctcactctcacgatggtgaaagattgtcctgggctcattgaaggagctatggatgtttccaagtccccagatagaggtatcatcactttctgatcatgaacctatggtaccaaggtcattctggtgaagaatcttttatgtagtggccaagagtgtgggctttggaatcaggctgcctggtttgaattttagctctatcacttaggtgggcaacctacccacctttctgtgcctccatttccttctctgtgaaatggagataaacaaaagtactgtacctatagggttgtcttaaaaattaaacaagatgatgcatataaacaatttaacccctgcctggtgtcggctcccgtccacttctcctcttgggttgcctttcaagaagtgatagtggcaggcagggctggtgcttgggaccatactggtgatagaagcagcagccaggtactgtgcccaaaatgctctcaagagtacaggctcagtacatccctttcatttaccacctgagccctgtctggtgagactcatcatttgtcctctatacaatgccttcccaaactccactccaatccctttctataggcacagcttttgttaacaaggtatagcttcatcctgggggcataatgcacttgaagtttttctcaatacagtgttattagggtgaagaagggacttacataatcaggacaaccagaagagatacatgcccaaattcttaacaagattcatggctcgtcccgtaagactccttgactctattattgcagttttaagagtacagactctttgtggttttccccttacttcaactggatctgtcagtaattccaattactgacaatgacacattcttctagaaccaataagcttcctacattgcatttctgctaatagaatgttccgaatatttccaggtatatgtgtctgcatgattctacctttataaagcctctaactagaaatcccaaatttccatgcaacagtattcaacattcagccatgtgctaggcatggttcttttatgtaggtattacttaagctggtttatcaattttaacacactagatttccccttctgatcaatactgcctatcggatggcatgaggagagttttggagaaatggtagtcattactctggtgagggcatggactttccatgctctcaggtgaccaaggcactccaagagttgttgggttaatctgactgctctctcaacaaagagaaatagggagaggaggagaggaaaagaggaaagtaggcttcttagagggcaaagtacccatgagaaaagcagacaaaggaaagagggtacttggaacatgtcttctctataagcggtccagatggtctgcgtgtgaggcagtctgcagaactggctaatccaaccgctgaacaattcatagccagtttgcaaaacctgaaaaaggcagcccagaggtccacacaggagtagagggggaagaagggcctgctaaaaacttatcatctggaaaatctgatgatgagaggagtgctcagagaatacgaagggaaaccttataaatatctcagtgtcactaggatctcgggcttcaagcagcccttgaagtttaagaacaaatcatcccaggccacgctggtagcatttttttttaactgtaattacaaataactgacatatggcaatgttgtagatggctggcttctgagctgtggaccagtgattctcaaactttaacacgcatgcacaaatcacctgggatttggttaaaatgcagattccagttcagcaagtctgggctggagcctgagactctgcacttctaagaagctcctgggagatgctgatgctgctggcccatggaccccactgtgagtagcgaggctagaggcgtgcttggtaaacaaagtcaggaggcctaaatggaggtgcttcgaggtggtgcaggagcacctggggcacctagaaaacattgctggcatctcggggacccatgtccagggaagggctccaggacttccccgagttgaggatgaagactcagacttcctggctaccactcaggtagagaagagcagacgttgccactgaagtcccaggtatgaatgaattctagagctgctggagtggggaacattgtcattgagcttagagaaacagaagtaggagggaggggtggataggcaagagggaacccacaggtactgagcatttcttgattgtcttcctcttgctccccacccttaactgttccttcccaggtctttctctctttagtaattgcactcaccatccacctaactgcctaagcccaagacgtgggatctatccttcactgcattgggaaaggtggtcatgcacagcttgctggaccctgtatggctgtatgagtggccttgggcctgaaacatttccttaacaagagatgaagagccctcccagcctgggctgggcatatctctttgcctggaaatatctttccctgttctgggcttgatgtactttgttctgctcaagtgtgtgcatctaatggcccctggccaaacctgctactatatctgtccctggtggaaagggatctgggtccttctactgcagcacgaggtgggtgtgtgcagctgcactgcctgggttgactgcagagcagatccactggctgtgggggactgacgcattgcaagggactgcatcttgtgtagtctgtctcctcttgctctaccacttgagcctggtgtgtgtgttgtctgttctcagcaacctcaaatcgtgtgatggtctcttccctggatgacacttagccttttaaccttggctgcccagcctgaccacccagtgaatggtggaacattctctttctctcatccccaccagagtctagtgcaatgtataattattctccttcaaatgtatatctcagatccttcctcatctccagtgctaccaccatcatcaccatctggagctgtagatgaagcagcctccactggtctccctgcttctacctctactcctcccctacttcatcctttcctttgcagccagggtaaattggatcaggtcacttctcttctgaatagcctttaagggcttctcatgacatcttggtggctagaacctaggtgccttctcatgaactgcggggtccttacccacctgtcttatccctctcctcttgccacctgctccccaccacgcacctgtgctctgtcagttgtcacctgtgctctctgtcagttttgaacataccctgttttctttccttcttagagtctttgtgtatttggttctctctgtctggaaccagcaccaatccccaaaactctgccatccttcaggtctctgcttcaatgtcgcttccccagagacagattccctgatcaccctagattgggtgttagtctctggcctctgtcctttactctcatggcactaaccttagtttggtttgtacattatctattatctgcctctcccaatacattagatgatccatgggggaattgataaggtttggatgtcttgcccaaatcttacgttgaattgtaatctccagtgttggaggtggggcctggtgggaagtgtttggatcatggaggtggatcccttgtgaatggcttgggccacactcttggtactgagtgaactcttgctccgagttactttgagatctggtcatttaaaagtgtatagcacttccccccaagacttactctctcctgctctggccatgtgatgtgcctgctcccccttcaccttccaccatgactgtaagcttcctgaggcctccccagaagccaggcagatgccagtaccatgtttcctgtaaagcctgcagaactgtgagccaattaaacgtcttttctttataaattacccagtctgaggtatttctttatagcaatgcaagaacagactagtacagggtctctgcctttcttatctgttgttgaatatccagcacccagctccaggctcagagtagacactcaatacatgttggttaaagaactgagtgaattagtaaataaatacgctttgggaaagcagaggaccacaaggagagcataaaagggattagcattcatggaaacagctgctatgtgcattgcacatctgccatctcatctcatctatcccacagatggctttcagccatcttgtagcctagagagtttaattaacctgcccaagttccacagccactgagtagcagagctgatctgtactctgcttcatcttagcctggagttgttttagctttggcatcatgacatttgggaccacatcattctttgctgtggggtggagggggtggatataatacgcattgcaggacatgtagcctctacccatgccatgctagtagcaccccctgcccaatttatgacaaccctcatgcatccagacattgccaatgtcccttggggtgggggtgggaatgtgtccccagtatagaaccactggcttagcctgtgggtaatctcagcctcccatctgcttctactccaatccctgcccaccccactcctctcagctgctgtttttctcctggactctttctcaccctgtcttcacgcagtcctccctgggtgtccctccgggcatgcaacacacagatggcaatgttccgagtgttgcaatacacatttgtgtttctggttactttaatatcagccccatgtcctgatgttcgtgtcattggcatggatgctaacaggctgtctagaaaatgtgcaatatattttttattttgcctaaatagcacatctaattgttcagcatgagataaaccagtatgtttacggggagataacttgtcaaaacagacttttgtggctccaccgttggaaaaacctagcctcctcattcagagatggagtgtgaatttttcgtgggtattttatgtggatttaaagcaaattatttcctgctgttttgtggacagaaaaaaatgagggaaaaaacggcttcagaaaaagccccagatgcaagtgtcttttaaagcataggggatgaagaaagagaatagaacagaaaagaggagaaagaaacagcaaaaaagagggaatttgctagagaaaaaatgtgagagagttcacagctgggggatccagttagaggtagggtgctctttttttgctcattcatttattcatccacttaaaatatcgtgagctagggagtgtgctggtgtagcatgtatccgaatgtcctttgtttttgaacgctggctaatatttaattgtatgtatttacattttgtttacctgttcttctgtcaatggacatttgggttgttcccacctttggctattgtgaataatgctgctatgatgggctggtcttacatatcagtgttaaaggtgacatttcccaagtgcctactgctgagctgggcaccatgctggcctctgcacacgtggtatctcatttaaccttctcaatctcctgggaggttaaccctctgccatgacatttagcaaacactgggaggggcagcttaagatgcttcagtcactcatcctaaggtctcagagtgatagatcctgggtggaaacatgggtctctttgtaggtcatcatttttataatcagaataagtgattgtgagtgaggtcttactcagtgaggaacatgaaatagcccatagttttgtccctgttgactttgacgccctcttgcatttgtatggaactgctattttgcagcatacatctgtcttcaggtaccatttttactctgcaaacattggttaaccttgaaactctctgctgctccttcctcctctccttttatgacagagataaataagttggtgatgtttccagaaggacacgatgagacagacaggattagactccaggaaggagcccagcggccacttcgtgagctagtgttcaggcaaccctccccagatgtgcagtgtagcagaagtaaaggcccctgagaggcacagagaggaagacgcatcccaaacttcaaaggctggcagcctcccactccaacaccgggggatatgaaattctgccgtgatgaagagcatcgtctgctttctaaagtctgaagaatatttctagtcagttcctaagatgtgctgggggtgagatggactatggaagtgtcaggaggacagataaatgatctcttagttgttggattcatgatgtctaaatccatttccgaaagccctctctcaaggaacactctttaaggtatgggtaggtgactttcagctctctattcgtaagagacccatgtttccacccagtatctatcaccctgagaccgtgggaggaatgaccaaaccatgttaagcgccccccctcccaatgtttgtccaatgtcatgacagagggtcaacctcccatgaaattgagagggttatagtcttggcttgagatggggttggagtaaataatgtatccaatcctcttccagcttagcattcacttggtggccaatgagctcttccataattattaacactactgagcacacgctacaagtcaagaactatgctagatgcccttcatccatgctgtcactgaattcttttaaaaaccttatgaggtaggagctatgattagccctattttagagataagaaaattgaggttcaataacttgcctgaagtcacacagtgagcaaatgacagagatttaaacatgcattaaaacaactttatgaaaggatgaattctgaagatctgaccttagagagatgggtgtaattaacctgaagttgagagactcctgtggcatatgtattgtgctagatagagaaagaaaatcgtggttgtaacaaggaggccgaaatagaatgtcacaagagtagatgctctgggttgcaggtgcattcttttgctaacaagttttttctcacgtgagtaactccacacagcatgctcttggctgggtggcagcaggctaccattttagtgacagttaatcatttaatgatggttaataattctcccaactgatgccaggcaggcgaggtaccttaaaataaagtacagaacttactggcatgtatgaatgcccaattgcatcagagattaattttctgtttgtgttgaatgctgtgtggagagtctatgttatcaccagactttgctaaatttccctgtaattttttgcatggtcctgactctcctctttcatttatctgcatatggattctccacgttacggtgtattctgattttcttaggtaggtgacattgaaaaagtgtaacaattgatgaggcatggggattcgtccgtttggatgaatgcactgaccgtgtgaatgcttgccagccataaacaaccagctgaatatcaatcttgccctgaaacaatggagatttccccatagtctagtccatgggatcaaacagtaatttgcatttcactgaagcacatggagaagtcaaaacagactatgcaagtaagagtcagagaatagcatgtgaagcaaagatttgcacctggggttgttagtagcagggtctattgaactatgacatctcttgatatgttttagtcaccatattaatttctcttgccatttcaaatagcattagaggaaaatgtgaggttaaaaatgtttatcaaggagacctggatcataaaagcttgagaaacatcaatgtagaggcatgaacagtagaaacaagcataggtttgatggagtcgctgggttaacatggagtgaagctgtccatctttttcccgttgataaagtcctagttgaaaatgtttgaggatctctggtgcagggctttgggaatcaggcaagacctcagtccccagggagtgaagatgaggttagaccagtgacaacgttgttctgatgcaccaaaatgggcgaacgaagtgaggtgcctgggacgcatttaccagcattcaagtacctgttgatgcagggcccctgcatgttgctgtggctagttttgggggttgtttgaaaaatagaagagtcagcccctgattctgaaggaatatctgttctcgtggaagaaacaaaacactcaccaacaaagtcagttcaattctatagacatcgattgagaacctaccatgggtaagaaaagctctctgtttgagagtaacttaaggatcattgaaaaatgacacatcagtatgattcgaataaagcagaacagaacaatcctattgttctcaccatactgctgagacataaaatcccagaattctagaagggctctaattaggaaaggcttccaggagacggtgactgtggggtcatgaataaagtggcagcttcctcaggggagcctgggaagagggtatttgctccattatcagcccggcttttggcggtgcaagaaatgaaggctactgtacgtctagaagtttccaatattttcaccacctagtgttcttttttattattttgactcctatggacactgtttttaggaggattttatctactgataaaagtatattgaagcagtggttctgtactaatcaaacctacctgtaacatgtaatttagatcctctgatttgcttgagaattatttattcattcaacaaatattcacgggatactaaatcaattggattcagtttggtggtttatgacagaaaatccagattatcaatggcttaagtaagaattttatttccttctcatgttaaagaaggagagaatagatttttgggtgggaggcttatggttgctgtcataagcatctactagaagccaaataccaggttatgtactagaaatggctaggcggggctcatgcacagtgatttgctatgattctaacccatttttaaattataatttcaacttttattttagatccagtggatacatgtgctgggttgtttcatgggtatattctgtgatgctgaggatatgaatggtcccatcatccaagtagtgagcatagttcacaacaggtagtttttcagccttgctctcctcacacttatcatcatccccagtgtctattcccatttttatatccatgtatacccagtgtttagctctcacttataagtgagaacatgaagtatttgtttttctgttcctgtgttaatttgcttaggataatgtcctccagctccatccatgttgcggcaaataacatgattttgttcttttttatggctgtgtatattccatggtatatatgtgccaaattttctttatccaatccaccactgatgggcacctaggttgattccatgtcttcgttattgtgaatagtgctgcagcgaacatatgagtgcatgtgtctttttgctaacccaatgtttttcttttcttcttctttttttttttttgaaacagagtcttgctctgtcacccaggctggagtgcagtggcacaatctctgctcacagcaacctctgcctcccaggttcaagcaattcttctaccactgcctcccgagtagccgggattatagacatatgccatcacacgcaactaatttttgtgtttttagtagagatggagttttgccatgttggccaggttgatctcaaactcctgacctcaggtgatacacccacctcggcctcccaaaatgttgggtttacaggggattacaggtgtgagccactgtgcccggcgtgttaacccaatgtttttcaaactttagtgtgtgtcagtcacctggaaagcttgtgaaaacagatttccgaatgttatttctggagtttgtttcattaggtctggaggcaaagagactgacaatttgcatttctagaaaggtctggatgctgttggtctggtgaccagttgaacccagtgacataggtcagggcatggccatctacagcctacaggtcaaatccagctagctatttttgtacataaatttttattggaatgcagccatactttttttgttttctactgtctagggctgctttttactacaacagcaggggtgagtagttgtaatctgaagtgtttcctatttgaccttttacagagaaagcttatcaactcctgccttaggtagaagtggatactcgcaatccataaagaaggtatgtacatcagtggagaagtcagcaagtaccggacctgggtttccatctcatcccagttcagccattcattttttatgtgactttggtccggccattaccctatctgatcctcagttgcctcccctatgtaatggaggcactgagcaaatggtttcaaaaatcccttttagtacttctctgatttcagcagagaagctgacggaatggtttgttgccattgtacaaagtgacaggctctggctgaatacgtcccattttgctgctgagttcgattggcctttatgttctgtttatgaaggtgtcccctctgccacttttggagggaactccctttcttcacttttgattgatatgtgacatttactggagctggcattctttaattcctactctctgagccactttccaacatgttctattcatcactgtgacttttttgttgcctttgccactactaaccttctaagagttcggaaaagaggcacttagagtttataatgacatatataatatcacaccacctctctctgccccagactgacttcactgtgggtttgggagtctttttcagaagcaacaagggagaaaattttgcttttgatggcaccccatcaatcaaagtgagacacacagttgactgtatttaaatcagagtgaatgagtggaaatgagtatgtaaaggaatctcaggaatctctattcattggattttagtattcgggcaggtgcatatattggttaggaattgtgtttgccaataaataagcctggaaatgctaaaacaaaagagaagtttatttccttctcagattaaagcagcctggaggtaggtggttgagggttgccaaggtggcttcatggtgtcctcatagattaagcctcttcctgtatttctgttgtactcttaagcacatggtttgcatcattaaagttgcttcatgatccaagatggctgctggagctccaggcatcacattcacactcaaagcaggaaacaagaataaggaggagaagagcaaaaagggcacactctagctgtatgccccttcttcaagagctcagaaatcctaccccagcatttcagtctattgttggtcatctctgatagggaggaaggctggggaatagaatattttacctagaaacattgtttctgaattaaactggagttctaaaaaggaaaaggagaaccgacattgggtgggaaaccagcagtttctgctctgatgtctttcagaatgaatactttgatcaatatggtaggaagttagatttggggatggtttttggcttgcactgttgtgggtgtgttatgaatggaaggccatatagcttgcactcgtaaagaggaaacgcagctttcattagatatccctggctttgaatctgccatttactagctttgtgacttggggcaagatatttaacttttctgagtctcaatttcctcatctgtaagttgaaaataataatagtagcaaagatgatgataatgaagatggtgctaaaagtaatcatgactttcttgcaggaacaaatgatacattgaagatcaagcactaggaacagtttttagcatgcagttagcatttaatgaacagcagataatcctctttgaagaacaatggatatcagaggaaagactataaattttgggttcctccagacataggtttaggtgccagcttagccactggctagcggaggaaccctaagtaggtttctgaatcttgctgagccttaattttcttatctataagataggtcacagtaggggctaaacagataatgtgtgggacagaactgaggcaacatcagaaaacgtgaagcacagaccccggcatgtggttcgtgcctagtacctattgattttccttctctttctagtatagaggattgggctgtgaggactttgttcccgggtctgctccggtagcctgattgttctcaatcctttctctgacctttcccttctctgttctatatgcaaggacatattttatccaggctataggtgatttctccctcacttcctcttccttgggaatgtccccatctagctcttgatgggcagcctccagggtcccaattcctatcaggtggtccctgctgtgggatttgctactgccaagcgacccagcttctgaactttggtaatgtctcctgcatcccccttttcctccatccctaggatattaatggcttcctcttttccttttctctctgtgtcccagtggctcctatgtaaccaatttcctgtattatctctgttggaaacacctggagtggtttccgtttccctgactgggtcttaactcattcacgaatctaaaattgtataaacacataatgcccaaacattctcttcacttacctcttacctctcaccaccctctaaaaatcttgtttgtttttttttttttttttcggtcacgatggtgtgattttatttctttagttccatggcccttcattagctacaggagaaagtcaaaagtccttcctctgttgtttaagacgctctgttgtctgaggcatgggctcctttctaaagttattatttgcttctgaacttcagaaatttttagaacaaatttgattttacctccaaaatatatcatcaacctacccatttctaccaccagtcaaagccaggggtagctgaatcctgcacttgcatggccctgagaatgagttcttccttgaattctgtacccgtagatgcctcagtagccccagccctggatcaagtcaccactctcttacttggatgaatgcaatggcctctaaactggtctcttctatcaattatctttttctttacaatccattctctattcagtgtccaaagaaatcttttaaaacaatataatgtagatctgttattcccctgcatacactgcttccatggctacccactgcacttaaggcacaactaaaacctattcccatagtctgtggggcccagcacatctgcagctgctccatctttgtcgccatttcctctgtctcctattgctatgttcactccagcaacatggactgtcctcctgttcttctgatgcccaagttcttctcctgttacagggcctttgtctgaatccctcttccatgtattatgattccccatcctgctgcataatgtgttcatcatgggtaccaacaccaggtgaacctcccctttccccatatcactctgttgattctttttcacaatctattgttatcacagcctataactatcttgtttatctgcttattgactgtctctgcccactagaatataagctcattagggaagacaccacatctgtctttttggccttgtatattgctagcactaaccatattgtcaggaatgtcagaaacattcagaatttgggggatgaatgagcgagtaaatgaatggacaaatacataaatacctaaacatataaatcacataaacgggcccctaaggggtctgtggatggaactcagtggtctgtaaacttggatggggaaaaattgcttatttttacttacctctaacaaaagttttcattcttttcattttgaattgtagcaagaaatcacagtaatagcagctgtctgattttttttcaccaagagaaattacatatttcttatcacattatcattgttgtagatatttcagaattatttacttttgccaaattattttgaaatcattgtagttagtagacacagcacagatcttgtgatttagcatgttaataccgacataaacataacacaagtttgttttaaaacatcattatgactgtattttgatataatttgttttctttgtaatctagcggtttttttgtttctttgttttttgttttttgtttttttgttttttggtttttttgttttttggttttttttgagacagtgtctagctcttttcaccaggctggagtgcaaggcttgatcatggctcactgcaacctctgcctcccgggttcaagcaattctcccgcctcagcctcccaagtaactagaattacaggtctgcaccaccacgcccagctgatttttgtatttttagtagagacagggtttcaacacgttggtcaggcttgtctcaaactcctgacctcgagtgatccaccctccttggcttcccagagtgttgggattacaggcatgagccaccacacccggccacgtattttattttacttatttgacagctctgttctgagaaggaatttgaaggcttcaccagcctgccaaagtggtcgttggcacataaaagtcaagatctcttaaaatgaacgagtgatgtctgcgcttttgtttattgaggaccacgctaaaaataggtatccctcccattacttaactgtcatttatccttcagtatccaggcagacttttcttcaagaaagctttgcagtcttcagtggactccctgtcctctgagagtgtgtagcacttacccaaagcccaatacttccctgatcgtgtaagcctctttgggaagtgattttttttttttaactacttatgagtttgttttgtttttccaccttacagaggctttctgttactccctaatcataattagtgccctgtcccctgcacccttgttattttctttgtagagctgtatttttttccttcatagaattcaacaaaattgataaatatatatttacttgtatgatttatttattgtctatatatccatttgggaagaggccttggatattttgctcctcatctagtggaggccccagaacatttatattggaagggcctaagtgccaccaacatagttacaagtggcaggaatacctagggaacttaccttgaagttcagtttgcatagcaagcccattgtatttacttagattgtatttattcttgaggtctggtgatattagtggggttattagcatatgtcagaggaagaacccataatatcgtgctactactgttgtcgccattgtacacttagcacacagaacaacacttggcacatagaccctaaataaagtatgtgtgaatggatgaatgatggatggatgggtggatagatggatgcatggttggatggaatgaatggggaattgggtggatggctggatggatgggtggagggatggatgggtagaaggctggaggggtggagggttgtatagttgagaagattactggctgggggttggagagatggagtagttggtaggggaggtggtgtattagtttcctagggctgctcaacaaagtcctgcaaacttcgtggctcaaaaccacaggaatttattatatcacagttctagaggctagatgttcaaaatcaaggttctggcattactgttctctttccaaggatgctaagggaagaccctcccctgcatcttctaacttctggtggttgccatcaacccttggcgttctttggcttgtaggtacatcattctagtctctgtttccatatttatgtggccttctccttgtgtgtgttcctgtgttttctcctcttcaggacaccagtcattggactggggtccaaattcagtatgacctcatattaatttagttgataacatctacaaaggccttcttttcaaatatggtcatattattaggttctgagtgagcatgaatttttgaaggatgctgctcaacccaatacaggtggttagagggttgaagagatggatgtatgaagcaatggaaggtggcttaatgggtaggtgtagaatgggaagggaggaccagcctggctggaaggggaagaggatggattggtaaaggagttgttgtataaagagaagggtgaatgattatttgaatggatgagtggaaagatgtagggttgaatggatcaagggtggaaaggtggatgagtgaaagggtaaatgggtggagggatgaatggttggttgcttggatatatgtatgggtgaatcaattatattattaatttcttcagagtagaaattctggtacatgtatttatcttctctgttattagtatgacactgcatttaggaaatgctcattaagtatttgttgcctggttttctctgcattcagaaatgctgttaactggaatgactgctaccagctgtccagggatatgaacttctagtgggtgagggagtgtatgtgtgaattcatttggtgcaatatccagcctggagctgtctctagcctggagtatgcttagtgaaaccctgagaaagaacttaaatgttgggtataattcctgctgtttagggagtgacaaaaatgtacatgtatagacaccactatttcatatttcaattattatttatttaacattttaaacctgatggcagaaaaatatgcctcagacaggcacaattgcttttattgtttcagattggatgggtaaatgtagcgtgggtgatcctaaatttgggctacattggtttctgttgaagcttttatcttatttgcctaaggaagggcttagttgaatttaaaagcacctattctgatgttgtctattgaagtgactgagtttgccagtgcactgttaatagggagtttgcagcttggtgccagatggattcacttcatcagatgtgacaaaggtcttcccagatgttttgtctgctcagagtatcctttttacattgatctggatatctgcagtgaactaaggagtctcagagaagtcatcctattattgtgtttaaatcttttctttttctctttcaaaaccaggatttatcaatggtggaatatttcagacatgctgataagtacagagaataaaataacaaacaaccatgtactgacaattcagatttaacaaatgttaatatttttgtcacatttatttcagattttaaaaatataaagatgctgctgaagcctgccaccctcatttcattcccttatctccttcctcagaggaaaccactaacctaaagctgataaatgtgtttttctatatgtacatgcaaacctagggtataatggtattagtatgttttatgctttttataaacagtactatatttttccaactactgttttttttttcttttttctttctttctttcttttttcttttttttttttttttttttttttttttttttttttttgagatagagtctcgctctgttgcctgggctggagtgcaatggcgtgatctcagctcactgcaacctccgcctcctgggttcaagcgattctcctgcctccagcttcctgagtagttgggactacagacgcgtgccaccatgtccggctaattttttgtgttcttagtagagatggggttttaccatattagccaggatggtcttgatctcctgacctcatgatccgcccacctcggcctcccaaaatggtaggcttacaggcgtaagccactgcgcctggcccaaattactcttttttactcagtattatgttattgagatttatctgtgtttataaatgtagctttagtggatttattttaactatttatattttaaatatccaccctatggatgtataaaaattttacttatccatgaactgaatgatgggcactttgtcattaaatcaacgaaacacagaacatctttgcacagatgagaaattttcttaatgatatatgcctgtaagtaaaatttctgggtcataggatgtgggcatcttcaacatcaccagagattgccaatttgttctgcaaaaggattgagcctgtttatgttcccacagcaaggaatgaaaagttgcaaccttcttatatctctttaaatctttgtattagtcctgttcatttttgcttatatgatagatgtaaaacggaatctaaccatggtcttcaatttgcatttatcttattaagaagttgaacatattttcacatttattggccatttgggttttcttttctttggtttgtttttcttgaacagtcatgtcagaagattcatttaatgtttttcctctgaagatcagcttatagttttatttggcttcttttttttcgcttggtttacttttggtttctgctttatccacgtaggatattttcctttttttagctttgtttctttattctgttcggttttttaaaattaaattttaacttcttattgtcactccatattcaaatatatccatttatggatgtattagattggtgcaaaagtatttgtggtccttgccattacaaaccacgattacttttgcaccaactaataatacagctcttgtgtggaggtttctgctttatccacgtaggatcttttcctttctttggctttgtttctttattctgttcagttttttaaaattaaattttaacttcttattgtcattccatattcaaatatatccatttatggatgtattagattggtgcaaaagtatttgcggttcttgccattacaaaccacgattacttttgcaccaactaatacagctcttttactgcatttcatgagtgaccctgacaacagaaggacgttgtaacagcaggtggcaggatgtagactaggcaaagtggtctaatcctggctccattttctccccagggcaatccaccttagtgcaacatttgccctcctaaaactcctatgaacttgtcaccacctgctcaaaagataccagtgactctgcttcattcgtcactcacagtccttaagagagacggtgtgtagtggaataattatgggcttcagagaggcacacatttcaggtttaagctccagctcttctcttgctagctggctgactttgggtaatttaaagtgggaatattcatagagggttgttgtgaagaatagacaagattagattctgatctgtggtagatgttcaacaaaatatattatcttccttttagcctgacatttaaggtcctgtagatcaaaccaccttttccataggatcctctgctagtcaactacagaaatcttctgtctcagtcatttgattttcttgctgaatttggaaagtttcagttaaaagctttctgtctccatcctactcttctccattcactgttgtggccctgaacagtggcagaattactagtggggcttgttcaaagttcagattcccaagttttactcagactcactgtctgtattttttttttttttttgagatggagtcttgctctgttgcccaggctggagtgcaatggcgtgatctctgctcactgcaacctctgtctcccaggatcaagccattctcctgcctcagcctccagagtacctgggactacaggagtgtgccactgtgcctgggtaattgttgtatttttagtagagatgaggtttcaccatgttggccaggctggactcgaactcttgatctcaggtgatctgcccaccttggccttccaaagtgctgggattacaggtgtaagccaccatgcctggcctcactctctgtattctaaggatagggctcaggatctccatttaggagaagctcccagtttgggtggaatttgctctagtgattgaagcttcctgcctcaacagatcttttctttatatccagcacaggacctacattttccgggaggtctttaccgccagccagccctggtcacacttaccctcccagcaacctgaaggcggaatatcttagcccacccctctccctggctagaagcatcattcatgtcccctggggcagatggcgattccttaaggacagggcctaggtcttggggacttgaccgttcctgttggaagttcagtgcatgatatgtaaaaggacttagggtgagcatgggaaggagcacaggctttgtagctgcccaagttcaaacaccagctctgcaaaactggcccacggggctcagtctccttaactgtgaagtgatgatagcacatccaacccacaggtctttaaaggaagattaaatgtgatcagctctttggaaagtcatttgtttttctcttattccagatggagaagagcttgaattatcatgagaatacatctgtcattgggatcatctttgtgttaatttcctcctacagtagaatttaatgacctcttgaatttcctgatgacaatgttttgggcatgtgtgccattgtctactggccactatccttgtctttcagagacatttccttccaggccattataattctgtagtttcccccttgaagtcttcagtaaaagaggtagtttgagatctctcagcacaaacaagactttttagtatgtgacagtgatctgacaaatgaaaatgcattgttatggtgcccacgtaacagtgcaagtgtagtctttacaaaatacctacctaatcccattacccttctgcttaaatgtctgagctggctcctgtggctgacaggagcaggccagcctggcagagaaggcagggtctggccagtctctctgccccatcttctgtaccacctgcacagtattgcactcaccctggcatgctctggtgaccgttcctggtattttctacctccttgctcttgtacatgcagttctctctccctggaataccctttctctttgccaagttgtgtgaattcggcaatattcaattcgaatggtccagtccctgatacaccccctcagacacacacatgcaaggcagaattaattccttccagctttgtatacttggagcactttaaaaactactttgagttactactcattcattcactcaacaaatatttattaagtgcctactatgagtcagccattgatcttggctctggggatactcctgtgaaaaggcaatgccctgcacccatggagtttttcttcccaatgttttattactactcacttacgactgccctttccatcagactctgagacccatgcaggaggtgtcttgttcctgtctgtgcacttttacaactgactgcagttatttgagcttagaattccatggagaggaaaaacagtcccaaagtacagagtgggtgctgaagagattgcagggtggaatagtcatgaccttatagcaccaaaatcccaggaactgagtgttgcacacagtgtttcttattgtttgatcaactcccttgactttgtacagaggacaagaggaagagtgtggagttaagctgactgcacttacatctacatcatcctaccacctaactacatggggggcctgggacatgctctcgagtcttagcttcatcatctgaataatgggtctcttactttcctattgctgccataacaaattaccatgaacttcttagcttaaagtggcacatatttattatataaattatatgttttggaggactgaagtccaaaatgggtttcactgggttaaaatcaaggtttgtgaaagcagggctgtgctcctctgtaaactctcagattatgattcactgtctctacagcagtggtcctcaatctttttggcaccagggaccagtttcgtggaagacagtttttccacagaccggggttgggctgatggttttggaatgattcaagtgcattccatttattgtgtactttatttctattattacattataatatataatgaaataatgatacaactcatcataatgtagaatcagtgggagccctgaacttgttttcctgcaactagatggtcccatctggggttgatgggaggtagtgatagatcaacaggcattagattctcataaggagcatgccatctagatccctcgtatgtgcagttcacaatagggttggtgctcctatgagattctaatgctgccacttatctgacaggaggtggagctcaggtggtaatgcaagcaatggggagcagctataaatacagataaagcttcacttgctcacctgccgctcacctcctgctgtgtggcccagttcctaataggtcatggactggtactggtccgtggcttggggtttggggatccctactccagaggtcacctgtatttgttccttggctcctggcttcttccttcatcttcaaggctagaagtgtagcatcttcaagtccttgtctccctctgccctttctacctccctcttagaagaatacttctgattacattgggccaaaccagggacttcaggataatctccccatatcaagatcctcaatcacttctgtgaagtcttctcggccatgtaagttaacatattcacaggttcttggtatcgggacatagacatctattgggagacctttattcttcctatcaggtaggatggtatgggtatgagtataaatatgggagtgatgataacagtggcttttccactgggttatcagaaagattccaggagattcatttattcatcctttcagtcagcaaatattaattgaaagcttcctatgagctgggcactgctcacaaaaaaattgcacaaaatgttctgccattatagagcttccatcttaatcaggagagacagacaaacaattcattatataatgtattggagggtgctaagtataatggaaaaaaatcaggagggaagaggactgcggagtcccaggcaagttgtgggctggtcgcggtgactcatgcctgtaatcccagcactttgggaggccaaggcgggtggatcacctgatgtcaggagttcgagaccagcctgggcaacatggtgaaaccctgtctctactaaaaatacaaaaaattaggtgggcgtagttgtgggtgcttgtaaccccagctactcaggaggctgaggcaggagaatcgcttgaacctgggaggcggaggttacagtgagccgagatcgcaccactgcactccaacctggtcaacagagcaagactctgtctcgaaaaaaaaaaatagtaaaaaatcaataaataaggtggtaatgctgtgacaacttgagaaggtagcatttgagataatgagtctaaaatgcttagcacagtgcctgagatagagtaaacacagagcatttaaatgtaaattaaaaataaatttaaataaataggcaatccatctcttcattgtcatctcaccatccataaaacaaaactctgttctttctgggtggtatcattcattgaaattcactgggcttttgccaagcggaactctgatctttggaagggtaatttcagtatggagtgtgtcatatcaggaaattaaaatactgttatagattttcctcccctctggctctcttttggaatagcaacgactgggaggtaaatagcttagaatagagacagcaagtttctgatgcatgaatgggcaggggctggggccagagagatctctccctcggctccttcctccacgtcagcaggaaggaggcttgtagaacttggccctggagcttgcactgatcccagctgccatgtagaatagcattaggaacagaaaccctccaaggttgagatggagagaggaaatggggagagaagtcttttatgggttgagacattttgagcccctgtggcaccagcccaagggaggccaagtgtggggtattactgtctttcagaatggaatactgcttagccattcaacagcccgaggaatgctcatttctggagggcacagacctgggctatgttagtgtttggagacactaatatctctagtcttcttcccaggccaggagagattattgagcaaatgcagacttattcaggcatatttcctgaatgttaattcaagtggaggaatccaagcagtttgcaggcaacatgtccccacatatgtcttcactaacaaagtctggaattatcctttgggcaaatagaagttttctttttgctgttgactgtttttgaaaattagattcttaaataattcctgatatgttggcttgaggtagtaggcagttctcccaagtcctagaaacttgactctggctgccaaggagactaggattgattacgaaggaattaaaaggaataattgcttacatagggcttactaagtgccaatcacgattttaagtattagacaaatattaactcatttagcccttataataaccttgtgaagtgagtattattatctgcattttacataaagaaaactgagtcataggtgaaataacttgcccatggctacaaaattaatacatgtttgaaaagggattctaatcaggaaatataactattgagtctgaactcttaatcattaaagtaaagggatagtgttttagttgggtccctcagaaacagattgtgattaaatattgaatgtacctagtttatctgggacatgtaggggggtcacaggcaggggagacaggaggtgataaaaggagagggagcccaccagtgagacatatgttagtaagccagataccaaggtggtgaactgaaagttaaccctgcaggtaagctctgagatcaatgtaaaatgcacacctgagaattattcctgccaaggagtggaggagctgaggtatttatactcctgtgcccattagtcatctttcaaaggctattccagggcagaaaaggatatattaactctcagacacttctgacccaccatgcatgctggcaatgtggggtccaatattcagaggggtttctctcctacaaagatgaaggtgctggctattgggattcagggtggctttgcagaaatggtaagaagatctgaggcagttcaggtggagcaccaacatctatatcaggtatgggactcaagtctgtaagttcatagaacaaagtaaagaagattaacaggaactgaggtcctaattcctaaaagcagacaataatctttaaaccaagaacacaatagtatgcaaagctaacatttattgggtactaattgtttgccaggcactttgttaggtgttttgcagtccttattttactgaattctgaaaatgatctagagaggtagactttatcaccccgattttctggatgaagaaactgagatcgagacagtaacatccacaagctagcggagagtgggacctagatctatctgctaccaaataatggttgtggttgttttatgttataaaataaatgatcatttatagaaggatataaattacttgagggcaggaaacaaatctttttatctgtatgtcaccagggtgtacaccaatggttttcaatgtgaagtaattttatccttcagggacaaatgttctctgtttggcaatgtgtggagacagctttggttgtcatgagtgaaggtgagtactactggcatctggagggtagagtccaggggtgcttctacacatcctacagtgcacagaacagcttccttccacacagaattaaccagctccaactgtcaacagcactaaggtagagcaactgatatacacagcacttaacatatagttaggcttaataaacgttagctgaagtctgagtgttgggtggtgaatatgtagacgtgccaccctctgaagggggtggtagggactgaaaatgtaatgatacccacaaagcacttggagtttattatgcattttcatacacactatctcatttgaccattacacaatctcaaaagggtgcagaatttatggtgttatcaacatggaagaaatgaaggaaattaagagctgtgtgtgtgtgtgtagctgctgctcaaacttagctgtttgcctcagactccagggctctttaaaccatcctatacggcattgggatgcattgaaaggtgatgttttgactactaataagcgagagaagcaaagtaggtttgttatggaaaagatgggaaggtgtttatattgggatgcttttggctgcaagtaacaaaaccccaactcaaatttatgccgtcagtaatgaaatgaatttcatttattatgtagtgaagagtcttaaggtatggtgaccctaaagttgcttaggttaactgaggagccatggctttaagaaaaaaaaaaaaacaatttaaaaatgtatttcatccttttttattggctgcatcctcagggtggtgataagatgtgatctagatatgccagcaaccagaaagagacactttcagttttgtagcttcttaagagtgagagaacatttctcaaaaggcctcaatatgacttcctctcatgccacattggtcagaactggatcacgtgctcacccctaaaaccatcactggctaaggcaatggggctatcatattggcttagagcagtggttttcaactggggacaattttgtctttccctccccgaagggtaatagtctggcgatatttttggtgttcacaggtaggtgtttgtcgggagatgctactaatatcagcatgtagggaccagggatgctgtaaaatatcttacaatgtacaggacagcccacccagcaaagaaacacgatctggtcagtagtgcagaggttgagaaaccctggcatagggcaaaagagatttaatcctgagcctcctgtaggcaagtaagcacttgaacaaaatgaggactccatcagcttggaaaagggtggcatggaagttgggtggggcaccccaagatgatctgcttcaggaggactttgcacatttttgatgactgatgtcataggagacaaatacagctcttttctgcaaaacgtttctggatgcctctgtcagacagtgccatggccagaatgggccattggtctgacccagtctggcatttcttatcttcatcaggctcactgccaaaccccgaggataggttgtcacctctggcagaagatcagtcaggattaactgatggtgaagctgtgtcccactttgaacctctctctcacgtagccagagcagtgcagattcggagtcttaggagcagaacattcgggagccagtgcaaaaaaaaaaaatttgcaagaggcctgagagagagcctgctgtacaaaaggatgtaaaccagccagagacccttggtaaacataagaaggaagaacatatttaccttgcttctatttagggaaagaaaataatactttcctgaaggaggccatctgtgttattaacaatagtgcttggcagttttgagctcgtgggatacattttcctggccagatcttaccagaaatccttgaatcatgtctgcaccctggtgatggaaggcaccaaggaagacttcggccaattggcaaggaactgtcaccaacttgaagaagcctatgacatcaactaaagatcctccccatcaaacattttcaaaagaatattttgaacaggcacaggttttttttctttgccaggtgataatgtacggtaaatgttttattcaaaagcagtgtctttgaattgctcaataattccctggtcattgattagggaatagtaacacatttaacccttgactaaatagatcacagttgtcacacatttatctacaaatatttgaatgctcgccttgtaccctgtgatttatgttagagataagaatggtgaaaaaatcaatttcttgcccttggtaacttacagtctaaaagaggaatcagattcgaacacatgattggaatgtcgtgggatgagagctgtcataactgttgtaggaacacagcagacgtaggctatcctttgaatgataaacgtgtgcatccctttcataacatttattgagcatctagtatgaaccagacattggtgcttagggaatttttaacacatctgattgtctaaaaacttttcaaaagcaaataatcataaagcaataggatgtatattaaagatatgtatagaacacaatgacagcctagatgaagaatgacttaatttgggagttagggagtggcattaggaaagacttcataaggactcagcaaagacatcaacagaggaaagaaaaagcataaaggagggcaggcaagtcaaacttttctgtgcagcaaaaagccatgtacacatgattttaaaaatgatattgtaggccgggtgtgaaaaaatattgcaggccaggtgtggtggctcacacccgtaatcccagcactttgggaggccgaggtgggtggatcacgaggtcaggacttcaagaccagcctggccaacattgtgaaaccccatatttactaaaaatacaaaaattagctgggcatggtggcgagacggaggcgggagaattgcttgaaccgggacctgggaggcagaggttgcagtgagccgagattgcgccaccgtattcctgcctgggctacagagtgaggcactctctgtctctgtctctgtctctgtctctgtctctctctctctctctctctctctatatatatatatatacacacacacacacacacgtatgtgtatatatatatgtgtgtgtgtatatatatacatatatatgtgtgtatatatacacacatatttatacgtgtatatatatgtgtgtatatatatatgtgtgtgtatgtatatgtatattgcagcccccttccattgatcaagcagtgggcaagtgtatattaagcatcaaatgctgtaatatctaggctcaggggctgaacaaaaggagtatttggcacaggagtttgaccttaagaaggaggtagcttggctgatgggggcaggttaagatgcttgaaacaatttgaaaacccttcagcactaagctgtgtggttctggttatcagtacagtgggggttcagagcagggagccttgactgtgggctagaatggttgcagaagcttccctagctgagataattgaaagttggtggcatctttgtaggatactgagaaacaataccatatatagtgagaagtggaaaatcacatcaagacctgtcctgctttggaaggcatcatggcagaggataatgtttagctccacaaaaagataaggaggtagcgagtgagcatttaaagtttgggcttgctgctgatgtgatcccggctgcctttctgagcaaatcctggggtgctttcttagcgtgccactttgatcatcagcctggtgggttggaacgaatgtcaactttgagttcaaaggcctgtactgaatcctagcggtgcctctcactagctatgtgacctaggaaaagttacttaacggcatcaagcctcagtttcctcatctgtaaagtaggggtgataatatctaaattgtaggatactagagagattagaaagaatctgtaaaaagtgtctaagatactaccaaatgtaaaatgcagagagcccattacaagtagctccttgaatgagttggggtatgtttagctgcaagtaattatgagaaccttgactcaaagtagattatacgatgtataaacttattatttcacatgaccagaaactctgacgtagatcaaagttggggactgatggattcagtggcccagtggtatcaacaagaatccaccttcttcccttccgtctgttctaccatccttagtgttgagtctactcataggctggttccaaaagggttcctgaagtttgaggcattgcatacagacacaaatgtggcagaagagagattttatcttcctatggcccccttaggtgtgagttagtaaatgtttccccatgccgcctccatcccaaccccagcagattcctcttaatatatcattgtccgggattgggtcagcatcagaactatgtactgatggctgtgttgtgtattagttagctattggtgcataacaaatcatcccaaaacttagaagtttgaagcaacaagcatttattatcttactgattatgtggatcatattcgggagcaacttagttgggggattcttgcctagggtctcttgtgaggctgtggtcagtacattggccagaggtgcagtgatctaaaggctggactgaggctggaggactggctggcatggatggcttgtttccgaggctgctggcagggggcctcatttattgattttgagaacctctccgtggggctgcttgaagtccctcatgtcatggcagccaacttcctcagagtgagtgatccaaaagagagaaggcaaccacattgcctttgttgatgtcatctcagaaatcacactgtcttttgtcccccactccattcatgagaagagagttgccaagcacacagggaggattaagctttaccttttgaaggaggggagtattgaaaaatttgcagacatattttaaaactaccttatgtgtggtacaacagaaattccattgttatctggtggtcagggggtggagtgctttttttggagccacctacaaggtctaccacactattgctattaatcacctaaggaacatttatggagcccctactgtgtgcaatcattgcacaaggaggactcagacatgagtcttgctaattatggtgtaaagggagtgtaagatgcaccgggactatattgcgatatacaaagctgaatgtggaaaggaacaaataaagtaccagggggtgactgcagattgcagaaggaggtggtttacttccaattagcatattcatggaaagacttcactgagaaggtgggctttgaactgagctcagcggagtaggttggatttatacactcaaggatgggtatctgggttggtcaaaagcatggtcataccaaagttatcagctagcaattattgagcacctagtctgtaccagacactgaacatatattatctttaactcttattgcatccctgggagacaggcaatattactcccattttacagatgaagaaacaagcccggagacattaaatgaccccgtgagaccatgtagctaggaagaggccccactcagagcccttacctaagagatacttgtgttttaaagaactgaggggacaccaccttgccttaaggaacttccctagcttgttcaaagtaaggcttttatataacaatttagcttcagggagtaggtacagcagaatgagtaatctctttacaaaagaatttgtcattttattgaacctttacagaagattctccttaattatcaagcccacaccccacccaatacattgaaaatatgattcaaaatttattaagatttactttgcacatctttccccctggaattcctactctgcgttataccttttgtaggctgggttgttggaagaattagctggtaaaaatgagcttacgaaaatgggaaggtctcatggaagaagtgaagtcttacacattcccttcacttttttatgataaaggtgataagattcattaaagtaaaaagacattaattgctgctgattaacatctggcactctacccactcagaccaccacctgtgtattggaggtgagggggtgccttaacctgggttactttgccagggggctttgatgtcaggtggaggcagagaaggaagggcttaggataagcacagagaaagccacctcttccagcctgcggcagaggggagtgttcctggctggggccgctttcgcagagcatagatacgacggctcatcggcacagctctgacctgccagcctcccccacagctgcctccagcctccagagcggcttattcaggaacagaggcagatgcagtgtcggagcgcagctgcgtgagggttgcgtgggtgtgtctccatgggagtgtgtgcagtgtgcctatggtgtgtgtatgtgtggtgtgaatgtgtaggtttgtgtgtgcacatgtgagtgtgtgtgtatttgtgtgtgtatgctatgtgtatttatgtgtgcgtagttgtgaatgtggtgtggatgtgtgttttgtgtgtgtgtgtgtgtgaatatgtgggtttgtatgtctgctgtgagtgtgcagcattatgtggtgtggatgtgtgtttgtggtgtggatgtgtggtgtgaatgtgtgttcatgtatttgtgtgtggcgtggatttatatttgtgactgtgttcatgtatttgtgagtgtgtgtggtggtgtgtttgtgggtgtatttgtggtgtggatgtatgtgttgtgtgtttgtacattgtgagtccagggttgtgagtgcatgtttgtgtggtgtggatgtgtgttgtgtatttggatgtgcatgacgtggatgtgtttatgtatctgtgtgtgtggtgtggatgtgtgtgtggtgtgaatgtgtgtgtagtgtatttgcatgatgtggatgtgtgtgttcggtgtatttgtgggcgtatgcatgtgcactgagtgaagttgcgagtgtgtatgtgtggtgtgaatgtgtgtagtgtgtgcggtgtggatgtgtgtagtgtatttgtgtgtgtggtgtgtggatgtgtgtagtgtatttatggtggtgtgtggatgtgtgtagtatatttgtgtgtggtgtgtggatgtgtgtgttgtgtatttgtgcagtgtggaggtgtattgtgtgtttttgtgggttgtgctgtttgtgggttgtgtgtgtttgcatgtgcgctgtgagtgtgctggattgcgagtgtgtacctggtgagtgtgtggctgccgcacccctcctctgagcggtgtggaccaggactcctctctctctctctctctctctttctcccccccctccccctccccctccccctccccctccctctccctcccttgcacatttgctcaggctcctcattgctgagggagggagggggcttctgcccagcacctggtccttcgaaaggcccctcccaggagtagagcgagcagccgcccccgctcccgggtgcggaccctccccgcgcagaccctccccgcgcccaacgccaccggtccctcccgctgctgcgcagtcctcgctgccctctgttctgtaggtggcagccttggtaagccttgctcccatcctgcccctagggagaggagcttcagcaaaagacttagagtttagcgtctcgattttcaaacaaacaactctatcttttacagtttaaaaatgaaaacagaagatccagagaatgcgcttttaaacaaagccacatttacctgagaccctggggatagagagcaggtttttggtgcaggtttggagtgcagttcatccctgcccccgctacgaatgcacattcgcattcgcctttgagtcgtgagcaagagagcatctgagaaaacacgctagatgcagccaaacctctttaaaccctggcaccaaggaacaagagtgggtcccccctctgcctttcttttccactcactgtctatcatctagttgatcaacagacatcagtggggacattggggggtgggaggggatgtctgctccctgccgggcgggcactgtgctagcgtcaggggcacaaaatagaagcagacctggtttcagtctgatgtgggaaagagctaaagtaaacacgcagtgaatttgctgctgtttgggggatgagggggccagggggcttcctggaggaggtgacactgccctgatttttgaaggactagttgcaattatctaggccaggggacatttggcaatatctagggtgggtttttgttttttttgttttgttttgttttttgttttttttttgagaaggagtctcattctgtcgcccaggctggagtgcagtggcgcgatctcggctcactgcaagctccgcctcctgggttcacgtgattgtcctgcctcagccaccctagtagctgagactacaggcgcctgctgccatgcccgggtaattttttttgtgttttttatagtagagacagggtttcaccatgttagccaggatgatctctatctcctgacctcgtgatctgcccgcctcggcctcccaaagtgctgggattacaggcgtgagccaccgcgcctggccggcaatatctaggtttttctgttgtccaaactggggataaggtggagttgctactggcatctagtaggtggaggacagggatgcttgtaaataacctacagtgtgtgcaggacagccccctccaatgcagagttatccagccccaaatgttcgcagtgctggggttaagaaacacaggtctagacaagaggaggaaaagtgctgtggtttgaatgttagcgtccccctagaattcatatgttgaaatcttgatctccaaagtgataggctgaggtggggtggagcctttgggaggtgattaagtcatgaatgggattagggcaagccaggcaaggcaaaaatctctagacccttccactgtgaggacacagtgagaaggcagtgcctgtaatccaggaagctgaccgtcaccagacaccgaatatgctggcaccttgatcttggacttcccaacctctggaactgagagaaataaagtctgttgtttttacgcgcagtttatgtgttttgttacagcagcctgaacagactaaggcagaaaagcattccaggggattatgatgtagactgggaggagctgcagacagctgggtttgtctggaaggactgctgggtgtgggagagggcttagaaatgggagtagagccaggcacaatgattcatgcctgtaatctcaacaatttgggaggctgagacaagaggattgcttgaatccaggagttggagagtagcctgggcaacatagcaagaccctgtcactgtaatacaaaaattagctgggtgtggtggcatgcgcctgtctcagatactcaggaggctgaggtgggaggatcacctgagtccaggaggtagaggctgcagtgaactctgatcactccgctgcacaccagcctgggtgacagtgcaagaccctgtctctaaaaaataaaaaccaataataaaagaaataggagtagagaagctgtcagatggagatgaatgaagacccttgaatatcatgctaaggggtttagactttatcttagggaaggggaaacattaaagtgttttaagcaggttttaagtaacttagtccaatatactttttagaatgatcactctggataatgcatgtcgggtgcggtggagggtggcagggctgcacacggcggggagaggcttcaaatgcgggctgttagtgcatgcaagcggagaagtgatcaccatgtttccacaaaagaacttagaattggtttagttaatgcagtgcaatggaatgcagttatacaacagggtcgtttttatatttcaagaagaagaaagcaatgggaagaaaagcattagggagatagagttttgcatggctgccgtgccctttcatttaaatgaccgaccaggtcagcatgttgcataaggacacgggcaaattacttctgctaaccgaggcggaactctctggtagcccaaattccagtgctccatccatccagggaggtgtctatgagatgacaggtcatcaaggcaaataatgagttgtttgtctccacggcatggatcctcctgggatcagaggtgtcatctgacaaggcatcatgggctgtatcccccaccaaaacaaaatatatgttgaagtcctaaccctcagtacctcaggatgtgaccttatttggagagagggtctttacagaggtaatcaagttaaaaggaggtcattagtgtgagccctaatctgataagactggtgtccttataaaaaggggaaaattggacacagaaacagacatgcagagaggagagatggtatgaagatgcatacaatcttaaaaaaaataatactggccaggcacggtggctcacgcctgtagtcccagcattttgggaggccgaggtgggcggatcacgaggtcaggagatggagaccatcctggctaacacagtgaaacgccatctctactaaaaatacaaaaaaaaaaaattagccgggcgttgtggcgggtgcctgtagtcccagctactccagaggatgaggcaggagaatggcgtttgcaatgagccgagattgcgccactgcactccagcctgggtgacagagtgagaatccatctcaaaaaaaaaaaaaaaaaaaaaaaaaaagaaaaaaaaaaagtaagtactaatatttttattatggcataaatagaacaccatctatgagccaaggaatgcctgaggctaccagaagctggaagaaaggcatgaaatagattgtccttcagagactccagagggaaccaccgacaccttgatcttacactttcagcctccagaactatgagagaaaaaaattatattgttcaagccaccaagtttgcagtactttgccacagcagttctagagaactaatgctaataccaatcacacaaagtgattgaaaaggggagaagtcctggtgaatttcagaaaaacccctgatctcagttatgcaagtgagatcatcaggggaatctgaatcattcatcgtttttacctgaaagcagtaggcagaaaggaaattaaattccatagaaatccattaatcgtgctgggcatggtggcttacgcctgtaatcccaccactttgggaggcccaggcaggcggatcacttgaggtcaggagttcgagaccagcctggccaacatggtgaaaccccgtctctgctaaaaatacaaaaattagccaggcatggtggcaagcacctgtagtcctagctactgggaaggctgaggtatgagaattgcttgaacccaggaggcagagtttgcagtgagccaagatcataccactgcactccagcctgggtgacagagtgagaccctatctcaaaaaaaaaaaaaaaaaaatcgatcatccagtgcagtggttctcaaagtgtggtccctggaccagcagcatcagcatcacttgggaatgcagattcttgggcttcccctgagatctcctggtcggtgactccagtgggtgatgcccatgcacactcaagtttgaaagcccctggcctagggtctgtgagaccctggagaagtcaggcagagcttcacaggggaggtgacacatgagatgtgccttgagggataggtaagggctttgaaaggagccagggaaggacatttgaaatggagcagaggcagggagatatagatgtgtgagacttcttcagaggagcagtacagtttggagggtatatggagaggagggtgagagaaaggaagtacagacacatggtgggcagtgaggatgggtggggagtggtggctcacatctgtaatctcagcattttgagaggccaaggcaggaggatcacttgagtcttgacatttaagaccagagtgagcaatatagcaagaccctgtctctacaaaaaatacaaaaattagccaggtgtggtgacgtgtgcctgtagtcccagctactcaagaggttgaggcaggaggttcactggagcccaagagttcaaggctgtagtgagttgtgatggtgccactgcactccagcctgggtgacagaacgagaccctgtctctaaacacgttaaaagaaagtgaagatgaagtcaaagatgttgtcatgttgtaaaggatttgtgagccaggatgagtttatatttaatgggggccgctgaagagttttagaaagattactgtaggctaaagtatcaatgtgtaatttgggtatatgtgtgatattcaaattagctgacctattaggactgtctcagccaacaaatcactgaatgcagacagtcaaccatgctttctgaaaatgcaaagtcctagtggttcttgagatgagtggaggggtcacaccaatgtcaggagaactctagatttggggaatctttaagaaagccaaggaccagtaagtctcctgaatagatagaccagttttcttccacctgggactattaaagatgagtgacacctttacctcttgaccttaatcattcattagccagcaagtcaacatccttctcaaagtgtggctccatcagttctgagccagtttttttttttttttttttttttttttttgcttttttttgacgtggggtctcactcttatcgtccagcctggggtgcagtgacacgatcttggctcactgcaacctccgcctcctgggttcaagcacttctcctgcctcagcctcccgagtagcagggactataggcatgtgctaacattccggctaattttttggatttttagtagagatagggtttcaccatattggccaagatggtctcgcacttctggtctcaagtgatcagccttcctcagcctcccgaagtgctaggattacaggcatgagccaccatgcccggccctgagccagttttgccccaagttgctaagcttccctgatcactgaccagtctgaaggcagataaacacaaagcctttgtctatgggacacttatgatttggttgcagagaaggtggaccttcacactgccaatctcagttctcacggccgcctggcatcaggaaggcattaatctctgccaaggctctgtcctcttcacctttcagcaggtgttccttgctggttgtttggcccggttgataggaaaaaaagaagagagagtgggcccgtgtgcctctgtctcctctttgctcaatgacccaagaaggcaggagaaggaaggcacttctcagctgcctttcctatggttggctgctgggctgggatggagctggggaacttacctcttgtgacgaacgatgaagaagcagggatttcatgcagcatcagcatacgcacaaggctgtgttgggaagaacaaggacagggctccagagaggactgactgcagctgcccctttaatgctggtcgcacatgcttgcttctctctggctcccctcccggactgcatggatagctttgttcacacctgaatgcctggtgcctgggttccagaaaggcatagctttcatttctgagcattttatatgtgccttgagattaaccatcaccatgaacagatttggaaacaggtttggagggattacgagacttgcccaaacacatttagcttgatggggagaagatcatggccctgttctaacccctcactctcagttttgtttcatcacatcatcctgtttattttcatcgtagcttgtatcacaattgccaattttcttgcttgttgttgtgtttagtgtctgtctacccctccaggctctgggtttctgatagcggcacctgtgtttcctgggtttaccttggtatcctgagttggtaacacaggcccatcatacagccaaagctctacagtgtttgttaacaaaatgaatgaatgaatgatttgaacccagacctatttggccaaagcctcactctgtaacctctgctcactgcagagttccatgtggtacaatcttgcttggcaaatgttgatggaattataacagttcacggttggtaggtgggggtgtcagatacatgcatctgggaaagtcacagaaattcaccccaatataggtataatcacgtgcccaggaatgcagggcaaactttgcccacaggtgcaaaccagctggggcacctgtggtatcctaggagcctggtgtgcttaaaagcatggtgtagtcatgggttcgagaaactctccactgggtaaggacactggatatatggacacaagaaactctccattggttaaggacaatgataaggaaactctccattgggtgaggacactgaactctttcacatgagcagagacttatgttaggagttgcagctgggagtcaggcagaagctatgatgaaagctctctgggcctcagtttccccatttgttgtttggtgtgtgttccaccactgttgtttaatggctcagagtggagaccggcattaaactgtgttcgttcaaccctgaatccaccactttctaggggtgtgcctactggaaagttttcattttccttggtgcctcagttcctcgtctgtgaaatggggataatgatagtatttacctttgaaggtgggttgcaagggctgaaagttaatttatataaagcacttggaacacatggtaaatgtctggctgttttgatgagaagattcaatgagatactgacttttcataatgcaaaaggcgctaaaagaaactcagcagaggtggcatttagatcaaggtatctctgtggaaggtatcaaattagatgaaaggcttagaggtgggtagacccacatttaaaaaaaatcacttaatttgtacagtgtgcgccaattgttgtttataaaatatcatccattttatgtcattgaagtctcccatgtctctctggcatagccatcgttacccaaggctcaacaagcttgaagtagcttgtttgaaggtcacagctctttagttatttgttcatggatttcttgaaagcctactatatgctaggctcagcataaaatggggtccaaaaccaggtgctgtttctgctcatgtgaatctgacagtctagagaaggagggacatatttcaaaaaagtatcatgcaagtaaatacgatgcgctgtaataagtactgtgtgacccacccaggaaggtcagagaaggttccctgaggacatgggctgaaactgagatgtgaagactagggtgggtgacagagggaagggaaaagcattgcaggaagtggaaagagactgggcataggccctgtggccggagggatcatagcaaatgtctggtctgaaaaaaattgcctgagaagaccctggtgcttggagggtaagagtgaaggaggtcagagcagaaccgtgctgagaccctcaggccacatttgggtgttgcatctttgctataagagcagaaagaaaccactaaagattttaaagccagggtggatggtggtgaacatgagatttaccttccagaagcatcctctggtggccacgtggagaactggctgcaggggagaggagtgcaggcagtaagttacagttgctaagaaacattcaccattccatgggtaattattgtgcaccactgtctacgggctctctgctgggtgccaggaacgcagcactgaccacgacaaagcccctgccttagagagatgacgtttctgtataaggacagagacggcaaatggacaagcaagtgaatgaatgtggcaggaagcagtgtggctgggaagaaatacttaaaagcagggcgagagactagagcatattggctgccatttaggcaggaaaaacctcttgtgctgacatttgaagtgaagggacacccatgtgagtatctgggggaagggctttccagggggcagcacagcaatggcaaagaccctgaggtgggaacaggctcagggtattggaagaccatcatagaagtcattgtggctgcagagaaggattaaaagaggcagattgtaaaggccacattgaggatttacgtattttatttagagggtgagaagaggccattggaagccagatctgggaagtgacgtgaactaagtgcgattccagcgtaggcttcttctcttctcaaattctggcccccacaccactttcccgagttcagatttctccctggcctcatgatagtagtatttttaacaagtcagcagccagtatggcagagcctaccccctagatggtgcatgagacataccaaagaagcttcacttttcacttttttagggcaacaaataatacatctatttattgctttttccactagaatgtgggcactttgacagcaattttgctcactgctgtatctctgaagccttaaatagtatctgagattgtagctgtcgataactatttgctgagttaatagatgatcaccctgcacttaagtttctatgtaatgactcctggccagagagcagagattcagcaaagaagaaggtaaaaagaagggaaagatgagagagacccctttataactcatcaatgtaaaaaacacaaaataaaaagtcttgagcttaagagagaatgcagtagaaaacatcaacaagaaaacctttctgtctgaaaacgcctgatccttgtgtgagacctttccaggatatgtgggttttcaggtagcatcttcacccccagggcaacagtaagtgcaggcaggagaccaaaaccaatacccttgccctcatccccatagcaggggtgaagtctgagcacgtgactggacacagcagccacacgcctttggtgtcttccaaggaggcagtgtctcacctgtgcacatgctattcatacaaacacaacatgatctggagcagagaagggcataggaaactcagcaggggtatattatattttctgccagaactgacagtaatattgaatgatgagagaaatgcagtaatattgaaggacgagagaaatgagagttgtataacatttaatgatttttttttaaaaaatcacccaagaacgtgaagatgatttgaaacgcctctgaaaatgatcccttcctgtccataggcagcccagcttgcacatagcccgtgcttgctttacacaatcagtgataaactttgaagatgctgcagcctccattgagtttctttttgtatatatatacttttatttatttatttatttttttggagacagagtctcactctgtggcccaggctagagtgcagtagtgcaatctcagctcactgcaacctctgcctcccgggttcaagcaattctcctgtctcagcctcctgagtagctgggattacaggcatgcagcaccacacctggctaatttttgtatttttagtagagacggggttttaccatgttggccaggctggtctcgaactccagacctcaggtgatctacacccccttcggcctcccaaagtgctgggattacaggcgtgagcattgtgccaggtctgagtttctactttaattggctgccttacgcaaaccatgaagaagcccctgcatgaataaggcaggaaactttttagtcccagactaggtgagacatatgccgtatccccaaaataaatgttggggcattaacttttaattgctgcattatgttttactgtttactgttttatacagcattcttgttcttttttttaaaatactgtttttcttttgagtctacgtgactgcagcctttacgcctctaatcccagcacttcgggaggccgaggcgggaggatcacctgacctaaggggtttgaggccagcctgaccaacatggagaaaccctctctgctaaaaatacaaaaatttgccacgtgtgggtggtgcatgcctgtaattccagctacttgggaggctgaggcaggagaatcccttgaacctggaaggcggaggttgcggtgagccaagattgtgccattgcactccagcctgggcaacaagagcgaaactctgtctgaaaagaaaaaaaaaaaagtgtgtgcaattggggtggggaggtatagtgctcttcttgtagactctctctcccaattttccatagataaatggattcagtggggacagaaagagggccactccagctctggggagaaatgagagagttgggaaagtgagatccctctgcatttggttgtggattattaggagactaagaaggaaaccaaagaggactccccctttcctatattacttgattaacattagctataataacaaataattcctgcaaaattttaatgccttagcacaagatttgacaagctgtggttctccagcccaatttgggcccttgtttgtttttgtgaataaagttttattggaacacagccacacccatttgtttacagatcatctaaggaagcttttatgctatgataacagagttgagccattgtgagagagactgcatggcctgcaaagctcaaaatatttactctctagctctttacagaaaagtttgctgacctctggcttaacaataaagcttactttttgctaacctgatggtccaatggtgggtattcctggggtcagcaggcagcttctcttcatgtggggatttaagaagtcagtctccactatcttgtggctctgccatcttctaataacttaggattttctgcaagcagccagaaaatccaggaagcaggaaggagagaagaaagggtgtcctatctctccaaaactctggcccacatcctgttggatgaacgagtcacatggctacacccagatgcagaggtgctgggaagtgtccatggctgggcagctgcctcccagcgacagtgccacactgtgtaaatgggagcacacattcattttggacctgtagccatcaccaccatgctctttccctactatgccagatacctgcatttgaatcatggctgtgccacttactgactgtgaaacttgggggaatttaacaaaacactctgtgtgtcccaggttgctcgtctttgaaatgggcacaatcacagttcctgcctcatagagttgctgcaagcagtaagtgacatattatttactgctcaacacagacctggcgtggggcatatgtagaacatgtgtcactgatcaaggatgatgtcggcattttcagtgactagacaaaaaccagaggcactcggcaacatccttcagagcactttgtaataagtccccaacctcccgcactgttctgtgagaagccaggtggatgtaggagaggttccctggagagattagtccaggctaaggcagtggggacagctcgagggtggaaagggaactctgcccaaaagacaagggtgcttttcggaatgccttggacgagggaggagagaggaggagcacgcagggcagaggaagcacttggttggtgggtgcagcatcatctctggtttagtcctttactgcatcaacattgccttgcttgtgacgagtaagggtagggacagcttgtggatgggaagtcgcagaggcaccaggccagcccatgctgaaagctcaccaactccagcactcaccagcgaggactcctcatgtctcactgggttccccttccatcatcagaagccaaggatgtttccaaaatattccatcgatgtccagagcagcactggaaggtagtaagagcaggatttgtcatcttattttgcatatggctagatggaatcactgagagacacaccaacctcactcagctagtaaatgcagacccaggatgggcagccaggctcctatgacgctgtggctgtggatgttgcttctgaaacaaggcaggatgaacgttccttggagcactggcagggggggacattcactatattctaacgttaatacttgggttgtcttgatagctgagatgctaaactttgctgtgagagcttggaaaagtctgttctctctgagcctcagtttcctcatctgtaatatgggcaactcctttataagatcccttacactttatgtggatgctaggtgttggggagggctataaacaacttattttctcatgtaacaaatgctacttgagccttcaatgggctgtgcatgctggagatacagcagtcaacaaacctgtcttctttgtgtgaggagaggccaacagaaacataacaaatatttaatgtgtcagctgataataagcactaggcaaaaagtggattagggaaaggcaaaaggaagcccttgggtggtggtgcgatggggttttgatttgaaatagagccatcttcacgggagggtccacttgagaacaggcaggtggaataggagagaacttgatcgtttctgtgattgagaaagagaggggactggaagtgcagttcttcctgaggttcgttcacctgaatctgaaagcacctgatttcaagttctgcattgttttggggtgggaggaagtgagagaaaagcagacctggttcttgtttggcgtgtttctcactgagtggagctactaggctttcctggggccattgttaagagctgccatggcccatgtctgctggtggtggtcttctttccttgttctctgcagtgccccccagcttgactgtgcagtgaatggagcagatccatgttcttcagttgacagaaagggagagttagagatgaacctaatgccctgcttaaatcagagggcgaagtgatatgaagtttaaatttaggaaggactttcttttttctctctctaatggcctggagatatcctacaggctatgctgggtactttgcatagactaccttcaagatgcagagaaaggaaatgcatctaatgctgttagtaacaataataaataatagcaatagattccctgtacatgctggacagtgcaccaagcattttattttatttttcacaataataccatgaggaagctactttttattactcttgttatacagaggagcaaactgaggcttaggaaggtgacgtgacttgccccaactcatccaattagtgagaacctaagttgggatttgaatttggctctcaatctccaagcagtcatgtgtcaaagtggttgccactgggtgggggattctggaagtcctttctgtgtcctcatgctctagatatttttttatttttttctgtagtgagcatacagagattctatggccaggaggaaggttgggctgagaacagtgatgatgtagccagacagtattgtgtgagtcaaagaggctgccttgaggttggctccaggaccctggctacgaagctcgctgtgcctgacttcctcaagccacttgcctcccattttttctttagaggaaacttccactgcctcggatacataaggtcattgcaatcctgtctaaagtctggcctccagggtttgcagtaagatttctctgaagcaaggctgcatctctacccatgagattttgcatcccctagcctgcctgtctctgccagccgatatagggaggcaggggatggctcacatcagtatccttgagtggaccccgctctggtgtctttattttcatctctgggaaaaagttatattttccctggagtcaaatgaggtggtattccagcctccttgcttaaatatatctcaaaggttctgctgtgtcaggcatggtgattcacgcctataattccagcacttagggaggccgaggcaggaggatcacttaagcctaggagttcaagaccagcctggggaacacagggagaccctgtccctccaaaaaaaagaaaaaatagtcagatgtggtggcataggcctatagtcccagctacttggaaggctgaggcaggaggatgcctgagcccaggaggtcgaggctgctgtgagttgtaattacaccactgcactccagcctggatgacaaaacaagaccccatctcaaaaaaaaaaaaaaaaaaaaaaaaaagaccctgctgcgtccctgatctggcaaattaaaaatataaaacctttcgttaaaccccagagccacgagtttcctataagcatgatagttttatgattcagctgcaccattagtaatctccagtcttcttagcccctcccatctctctgccacctctttcaattttcttctttactcattcctctcttctttcctcctctcttttcctctccatctcctctcatctctcgattcctctctccatcatcctctcttccctcttcctcccttccctcttcttttctctcctctctgactcttccatgacttatctccatttcaactatgctttttttaaaaaattcatttaaattttggattattttgtgggaggctctgttttgaatttagtgcttattttatttgctcaaaaaatgagcagccagccaaccaaatagccattctgtgtctacttgtggtctctcatgccatccaacagctcttacttgatataattgctaagcagtgagaaagctattgtgcctacctcttcagtgaggagtgagtgggaagttatggctgaacgtgggctttctctatgttgtttaggcttctcatcttgacactacactaaatccatggcttgaatgggtctgcaaaatgagagtctctaaaagccagacccatcttggcatatcttgtgatctctaagcggcaatgggagacagagaagacgtggtaatgacatagtttagctgagactgaaacatagttttgcttaaaactgtgcgtgacattggctgggcacgttggctcacgcctgtaattccagcactttgggaggccaagacgggtggatcatgaggttgggagtttgagaccagcttggctaacatggtgaaaccccatctctactaaaaataaaattagctgggtgtggtggcacacacctgtaatcccagctactcaggaggctgaggcagaagaattgcttgacccaggaggtggaggctgcagtgagccaagatggtgccactgcactccagcctgggtgacagagcgaggctccgtctcaaacaaacaaacaaacaaacatgcataccattaatgagaccacttgtgcatcattagtctgcaatgagccaaaaatccaaatgaactggtagatagctgatagaagcctcatgggctcgatttgagcccttgtgtgtcctagggagaggtgaatgccatggttcttaagaacatgtctttggattcgaattctggctctgaggacaagctatatgacctcggatgagtcatttaacctctctaagccccaacctgttcttctgaacaagaggcacaatgacagtttatggggtggattaaatggcataatgtgtgatgtacctggcctaaggtttatgcttaataaatatgtgtcatcactgcaatgttttgggatgttttctctgtatgtaaaatggtgcccatgtccacctccctgggctattgggggattaactgagacactgcatgacaaaactctttggaagtccagtgcaaatgagtggacttgtgacctctcacattatttctgtttgtaggttcaactggcaagccaatcatgctcatttatagcgacacgcactgaaaacttttttctcacaagaggttattgaaccaagatgagaggaaataccaaggctctttttggtgttttaattccttcacatctatttctttcatcaccagttaatgaggacttagtactcacatcagcagtaagagtagaaaatgggctcatattggtgttcgaatcctgatgtgttctcttactggttttaagatttgtgccaggttactaatcaaatcttaaaccttagttttctcacatataaagttgtaattataatacccacttcgaagggtcattgtaaaaaccacacctgaatgtacccacatatatacagacacaaccactaaagaaaatagattatgtaatatttattcaatgtattttacttgtctgttgtttatagagccctgcctcagttggatgagttatttcagatttggaagtgtctcgttctctagcttgggaatgcagctgaacattgggggcagctgtggccctctttttgtttgttgccaactcggtctaagatcagcctgagtggactcagtcggaatctaccatctcaataccaggtggttaatttctcattggtagagccctctttttacaggcttgggaagtctggctgatcatctcgggttgtttaagcaagaaagttaagctatatccccctgattagtaggattttctcctttagattcctgtgttaatctacaaactgagcagtttatccctggtagacattggaataccaggtgtggtagtcatactgattatgcatgtgtagtactttctagtggtgccgttcttagaccacattttcagttcttgagaacagtgtcattgttggcatttttctcccaaagagctggcataatactcaaaagaaacggggtcttattaagtggttgttcattgactgataggaagagaactgtgggaatatatatttatggaaaaacagttccaaggtattcattcactcattcagtcactaaatacttatttatcatcctcaaaatgtcaactgtgtgctaagtgttcagactggagagaagaataagacctgctatggggaagcactcagtctgaggtgagggaagagagggtgggaaatagactatggtgcagcactgatgtatgttttatttttgtttatgaaatgttgtagggatgtagaggaaaatgaaactagcatcagtgctggactttaaagcgaggctaaacctccacaggtgaaggagatggggaagacattctagacagaaggaagagatttgtagacatgtcaaggtgggacatggaggaacagcaagatgttctgtgtggctgggatggtacacgtatgtgcgtgcttgcgtgtgtgcgtgtgtgtgtgaatatgtgcatgcacatatgcatgtgtgtgactctgtgcatgcatgtgtatgtgtgtgtaaggctgagctggaaatcaaggcttgcattctattctgctagggagtttgtattcacttattcaacacatatttatcaagcacctgctatatgttggatgctgtggtattttgatgtgtgcctcataatcacagtaaaacctccacaggtgaaggggatagggaaagacattctagacagagggaagagatttctagaggtgtcaaggtgggacatggaggaacagcaaggtgttctgtatgaggtattatgagataggtattatgaccattactctcattttactaatgagaaaactgaggctcagagaggtgaagcgacttgcccaaggtaacacagcatgatgatccccatcactgggggcagagagtccactgagaagagaagttaggcagatggggcagaatgcagcctaaggtcactcagagtgtcctgaacgggcttgatggacattgactttggcagcctcctcatttgctccagccccactgaccctgtctcccctgacaggggagacaaccccaaggtctcccctgctttggggcatttgcatatgcttttctttccacctggaatgctcttcccctcattccctcccttggctggctatttctcatcattatgcatcatctcctgagaaagggcttgcttccgctcctgtcaatcccctcctgcctatctttgctgtcaatgtggatttcagcttccttttttatttcctttttcaaagtctaccattggtaactgggggaatgtatcacagttcactgagtggcgaagagcttggagtctgcggtagactgctgaggtgagaattctggctccaacacttaccagctgctgggatattgggcaagcccttcacctttctgggcgtcattttcctctgctataaaatgggaacaatagtagattcccctcacagggccatccaggagggattccaggagggcagagtctgacacaacatagatgttcaataaatatgtgttgaatagagccgtcattgaccagtccattcattcactacctaggtctcatggctgccttagagctgggaaggtacaggctgcttaggggacccagctgtggtcttccctctcccacccacccagtgactgctctccaaaggctgtgggcttgcttctggggattctgccagtcacctgccccctgaaaggacttctgctgaattgcagccaattagggctgattagatgttaatgagtctgaagctgcttggtaagcggtttagcacaaacttggaggtgagagggagaagtttggggaagtggtgacatcatgcacaggctggagaagtgcaagggcctgaccaagacgtacagcatctcagttgtctgtccagactgtcctgtggctctttatgttggagctggtacaggtaggacccctgctaaacctggcaggggagtagcaatgataataatgatgatcataattatagtaaaataatgctttttattgagctcttaacatgggccaagcactatgcttggtgctttatatgtacttacttttatcttgtccttacaacatcataggtggcaccatgattatttatcctcattttgcagctgagaatcagaacaattaaccttgtatcgtatagctagtatgactctcttgaatccagagttcatgttctccttagtttttcagaaactcaatgtggaaaattctaattctatatttattgcacacacagctgcagcctgctgcactaaactcccacctcgtattgaaataataacgtgcagaactcccttttatatttattgatcatctacattgtgaaaggtggttttttatgcaattgacttctgaacatcttggaaaaataatggaaaaataatgtaggttaggtatgagaattcccattctccagatgaagaaactgagcccaaagagtttcaatgagcctctcaagtagctgggactacaggcacctgccccacgccccatgccctgctaattttgtatttttagtagagatggggttttaccaggttggccaggctggtcttgaactcctgacctcgtcatccacccatctcagcctcccaaagtgctgggattacaggcgtgagccactgcacctggcccatcttttcatttctttggtatactgtttttttccttccagctttattgaggtttaactgacaaataaagtggtttgtattcaaggtgtacaatgtgatgttttgatgagtgtgtagactgtgaaatgatcaccaccatcgaattaattaacacatctttcacgactgttggttaccattttgggtgtctgtgtatgtggtgtgagtataattaagatctaatcgcttcacaaatttcaagtgtataatatgatattactaactgtagtcaccatcctcagaacttattcattcaccttataatggagagttggtaccctttggtcaacatatctacattatggccatttctaagtcagccaggaagtcagtgtaagatgaatccaggatcactccttctgactccggtagtcctgaaccctcgctgagctgacacagacctggctgcaatcttagaagaaagcatttgccaaacaaatgagtagtaaagaggcattgggggtacccggcagggttgatttaatctacttgagggcataccgttttctagccttgggtagataaattgtttatgtacaaggaatgctgctaactagaaatgtgttttatcttgtcattaaaatgggtccacaaatttctgcttagaaatacaattttagcttccctctttgaaatgcttacagattaaacatttcctccttgctatccttgtgacaatatcttccatttattgtgcctctgctgtatgccagactgtgatagatgctttccatgcataatctaattctaatttttacaacttaataatagtgataattataaaacaatgataaacagtagctttcatgtatcaaatgcttgtcacatgccagacactgtgtcaaatgtttatatcttattttatccttatactcgccacacatgaaggtactgttagtgtccttattttactaatgaagtgttagcagtgaggtgacttccctctttttattaatggggcaactgaggcacagatcctgcaatttgctcaaggtcacaaacttacgttgggattcagttttttttttttttggagatcaacacttccttggacttattgggaaatggatgatcattgttaaaaacacgttttccaaaaaaaatattttttcttgaggtttgggggaacttgggagaaaaagtggggtctgagctgctggcatggtccaaagtcactgaaggcaggccacagccagtgctcagattgggaaggtggagctgtaactctggggcattcttgcttatgacaatgaggatttccaaggtgtctgcaactcagagattctgggacctagagaatcagagcaacctcgggttgggagatgagttttctttcctgctcatcttcatggtgaaagcggagctggggtgcacggtgtgtggggagtgactggcagtgcaggcatgcccagctgtgagtgccgtggcaccaggacaatcacctccctggatagagtttccctcgtgcagcatcagcaataggtggaccagaggttcacccctctctcagcagaagtatcattagtgttgacagcgtgaaatagcctctagggttctctcagccatctataagaaggtcaggctagaattgagctgagagccacacccccttagcacgcagctgctggactcccctttcacgttttggtgaactcttctccaggggcttctgtcacatcaactgcagtggtattgctgcctccagtttgtgtcttctggtgctagcacagaaaccccaccttcttctcttatgtttctggaaaacaccagcctcctcttaccttactgagatcagaattcttataacacccaccactgtttcatcttagggtcctttttcacatacagtcttatggttttctatttgaaatggcccacgtgcatctgctttgcctcctaaacgaagctaaatgtcttctgatcacgtctccttttaataactcatctctttaaaaaagtcatatcatttgattcttctaaatgtaaaagtaactactctcatcgtagaaaattggaaagccacgtatcagggccaggacaaggaagaagagattaagaatccctccttggatgcaaaatttaaaagggtgccaaacaattaagttatcaaggtaaataccatttcagtgcaatattttagagaatagaaattaatgccaagaattccatgattaacataataatagaggatccagcagggctgagactaaggttgggcaagtacagtcggatcttgtctttatttaaattttgatttgttttgcatcattttttttgcattggtttttatttgtaaaaatatcatattaaaatattacttatcttgactgatgagtcatttatcaccctcttaaatgttgcacccaaaggaagtgcttcattggccttgctgtacttgcagtcctggttatgatgaccaatgtatactgagtactcacagtgtctcaggctcattcttatgcttttcttatgttatgcttgttcttttgtacaacccccacaacaactcacaatagctgggaactgttactgttcatatttctcagagcacttagagaccctcagagagtagtgacttgcaattaacatagctcgaaataagccgaacaaaccaagatgcaaccaaggctgtttggctctagaacatgcactcagtctactgtaacctgtgcagaaatgatttcccctcctgccttctttcatgatccccagcccccaggtagtcttctctgactgccgccccaccaagactcatcaagtgccctatcatgctgccattgtagcacttaacaacgtgtaatgattatctattaatcgtgtaatgattatcttaatgtgtaatgattatctgtttctttgtctgtattcctcataaggttccttttaaaaaaatggcagtgtctctatgttcctatggtgtttttgtggtcagaagatgaggggcttgtaggccatttcacttggggcttgatcacctgctcattgtcggctctggactcaaactcatttgccccagtagcagcatgctcttcagaggacagaaagaggcccataggctctgatcccttagttggtaaacaatcatttctctagatctgtgttcatccatcatggcccattaagcagcagtggcctggggccattttccagtgtgactgatgatatttgaagatttggcagaggaggtgtaggaggcttgtcttctgtgccagctccatcctgctgctcatgtgagtgatgatagtggggttggggtggctctggtctgcactgattggaagtatgaggggtagtgggatggtgcccttgtgcgagtccaggccgggaggcccagagagcaggtaagagagatgtgagctcactttgccctaatgtggagaagcagtgcatgaataatcacccagtgggggagagaaactattgcaaaaacacaactacaataaattcttcgtctctccgttgttatccatttatcctatggacaattactaggcacccaccaggtgtgggatgctatgccagataggaggcacagggctccctgccctcacaaagctcatgatttaatgctaccctttgcattgtccactgagatgggtctgtggttggcaagaggctgcagccccttagcaatactagatgcagtgaatctgtggggcaatagtccttcttttctttcccatgcatgtgtggaaatccagtgtgtatgaagtggagatctgaccccatcttgtttgagctgtgtgctgattgttggatggggtgacagatgaaacatgtaccatgagaagtccacaggctacatgggaaaccaaacaacgctcaggtatccaaagtgtctttcctgactgtcccccactccactgcaccattgcaggctgaattagggggcctcttctctgcgcctcttacattaccctgggtttcccgtgctcaggccatgcctaccactttttttttttttttttttttttttgagatggagtttcactcttgtcacccaggctggagtgcaatggcatgatcttggctcactgcaacctccacctcctgggttcaagcaattctcctgtctcagcctcctgagtagctgagattacaggcacttgccatcacacccaaccaatttttgtatttttagtagagacggggttttatcatgttggccaggctgacctcaggtgatcctcccacctcgacctcccaaagagctgggattacagtgtgagccactatgcccagctaccctaccacatggtttaatgaggttctgtgtggctgtccatttcccacactgatggtgaattgcctcattgcaggggctgagttgttgcacctccctgtcccctgcagttgccatcacctcgtaaatagtatgttcccaataaatgtttgctgggggaatgcagccaatgggtgatgaagcaggtgaaaatgcttagaagaaagcttacactgcaatgttatatacatgcaaatgaatctagtgcaaactgcctatcttgcaaaatgattttccaaatgtaagtatgttcagaaatttaaagcgcattcggaatcagggagtctttttttgaaaaaaatatttttgttattattttgcctgagtgaactagttgttgtgtcactgagttaaaataagtcacctggaagtaggtctccaaaggtaggccacaggtctctgtacttagatctgttttatagacattgtggatctttcaagtctttttcttcctctctattctttcctcctacccttagtaagattctagttatttcttttttttcttttcctttcctttctttttctttttttttttctttttttttttttttttttgagatgaagtcttgctctgttgcccaggctggagtgcggtggtgcgatctcagctcactgcgacctccgcctcccggttcaagtgattcttctgcctcagcctcccgagtagctgggattataggcatgtgccaccatgcccagctaatttttgtacttttagtagagatgagatttcactatgttggccaggctggtcccgaactcctgatctcaggtaatctgcccaccttggcctcccaaagtgctgggattacaggcatgagccaccacacctgtccagttatttcttatttaaatgattataacaaccttctaatgtcctcctgcttttctattcactcatcctcctgtagatgctaaatttttttttctgaaatataaatgtcatgttcctattaataacccattacttgttgataaagtccatattgcttaactcactgcataagtctctttgttcatggccttctaggcttgtctctctccactctgacctatgtttaaatgacttaaaacggttgtcacttcttgagacaccctcatttcttggtaatgagtttccctttgtctgggactcctgtgccatcctcatctcgttaactcctacttacaccacagaacccaactttctttataatggcattcaacacttggtttcagagtggtccatttatgcctctgtctgtcctgctagactgagtaatctaagggtggggctcatgctttgtttacctatttatcttcagctaccctctgagcctggctcatagtagccactcaagacatgtttgtagaatgaatgaagacccgagttttctaagaaatgtgtacatttataaggccaggagaaaagaacatatagtggccaatgaaatcaagcttcaaatatggtttactaaactagaatgcagggtaaagttgtcaaggtatcctttaagagacatacatactggtcttgcatttaggttataaaatttattctacaagtgccaggttgagaaggggaaggtatccagccatatgaaaatgaccaaaaactggagttttcatttgttctgataataaagcagaatattgacaagtcagactcccctacacattcactcacaactcaccacctacccatttattagctgggctaggctatacaggcttgcactctgctctcacagagcttatcaatctagacggggacacaggcatcaaataacgaagtcacagtaactgtgtgtaattacagacagagctgaatgttctaaaggaaaatatcattcaacagaggagcttgacccagactggtagctggtctgagacggcttcgttgaggaagtgacgcttgagcaagagattacaggcatgagtagaagctgaatcaatagctggatttctaggaagaggaaggaggccagagagagaggtgtgggtcaaaccactttaagcaatttttctcttcaccaaagaaaatctctttgcctggaaaaagattgaataattttaaggagagtttagatgatttgtagttaaaaagaaacacttcagtggtcatggtttcgctgtccttgctcctgacccaggaggatgctggttggtaccaatctttgcgttttagaagggtcagacagaatgagcacagagagaagagctatgattccaggaaggtctcaggaagaaaggcagagggcatgagagagcagtcttcaaacatacgaagggctgtcctgtggaggagaaacaagagccactagttactgtcccgcagggaagagtaggacctgtgggcaaaagctataagggagagagaaattagctgtgcttgagagcagaccctttgaaatattaaagctctcacttattgggatgatgattaggaaggcagtcagctgccatcatgtggatgcttaaggctggatggccattcttcaggataaagcaaggggaaggctttcgtgggagaggaacagaggaaaaagggcagcctatgggctgaatccagcccatagatacaccctggacctcagaggctgtaaaaatccaatgagtattcacgaaaatatctagggatggatctctttttaaaatccagatttttgaaacttttattttaggtttgggggtacatgcgaaggtttgttacataggtaaacacgtgtcactggggtttgttgtacagattatttcctctcccaggtattaatctcagtactcaaaagttatcttttctgctcctctaccgcctcccacccaagaactggtaaattgggccagctttctagaactgcaacaattgtttgcagttgatacatggtgtattagttgcctattgctgaaataaattaccgcaaacttactggcttaaaataatacaaatttattatcctacagttctgcaggtcagaaagctgaaatgggtctcatggagctaaaatcaaggtgttagtagggctgaactctttctggaggctctaggggaagaagctgctttttccttgcctgatttccttggctcaaggccccttcctcatcttccaaggcagcaccagggcatcttcaaatatctttctcagactctactttcaaatgtcctttctccccatctcaagatctttaccttaatcacatctgcaaagtcccttttgccatgtaaggtaacatattcacaggttccagggattaggacatggacacctttgggggccattgttctgcctgtcccacatggccacccttttagaatcgattgaacaaggtttacattattttctttacctgcttctccatgctagatgttgcatttgtgattcttgagttaaagggctggtctggataaccatttttcctgtggttatcctataattagaaatgaaatttagcatatgagggttaaatgcattaatacaaccctttgaggggctggagatcaggtataaaaggtgtgagaaggaactttaagttctttaaaagtgatgcttttattgtttgcaggatgtcacataatcagttcaattcaacattgaatctgtgctctgttctgtacaggattaaagaatatgtaagacaaagcataacacattaaaaactttttccatttcgctcccactcaagaaaacatttcagattgtaaatgagtaagaatgatgttattatagaaatgaccttgaatgtgctgtagcttacaaaaaaagccaaaatcatttccaagtatcactgattggactgggatcctaactaattagtgcatcacacctcacagctgctcatgatccattagttttgaggacctcttatctatgctatggtctccagcctccagaaaagcttttgtctgtctgcagagacaagagttatagggtgaaactatgagcagcttggtgtagcatgtgattaagtacttacatgtgtggtacagacactaggtgctcaggggtttggacaggcatcatggtgaaccagccctgaacgatgcttggtgaacgtcatcccgccacaaagcagattcccactttctgattctgcagtagggcagcaggtagatgaaaccaacactgggtaacttagattaaaaaaaaataattaattagcatgtttcaagggtgctctgcaaaaagcgtgcatctgcaatgaataaggagagcctctctagggatccatgaaggaggatctgacaggcagttacttcagcacacagcagtcagtgaatcggccctgaccttgtgtttttcctcctgtgttggaaatgtttggagaatgagtggttgatttgggtcccgccttggccctgggagagtagacacgtagactgatggacccaccaaggcaaaaggaaatagaatattgctacttacagaagaatggttggatgctgatgtcagttgtaactttttacttgcaatgtcttaagagtcacaactcaggcaatcccacaggtaccttagcaccttactaaatattcaggggtgaacttgtctccacttatctccaaatctagaattctttctaatgtaaacacctgggaagataatcttagcattaaaaacttagtttaacatacatctgtaattactgataagagccatcttcaaaatgcaggcacaactattaccgtgtaatttcaaactgattcataaataagaaagagtggggaaggtagataagtattcttcccagttgtttgtggggttactgatgctaaagaagagtctggcattggtggctgggaactttggatgtcaccatgaaaagttggactgggatatagaacaaatgttacaggaataacccagcaagcctgaacgtttagcacatggggacaccatgttccacaacttcaggtgaagggtggggtggaggactatgctcacaggatataatatgattgctgccccctggagttgtgcagcatagcagtcctggtgaagagaccagtgcagtataaatacatggcctccctggagagacaaggtaagaattctggaggagcaaggggagatattcctttttcagcacgtacctgggggtggaggcatgaaccttcagtagcctctcctctcctcctctctgagctgagtcctagtcatcacttgttaatgctgcaaatccatagtattcacagtgcaataataacggtgggaagcatttatgaacctatgaagtacctataaagtactatgaagtatattaaacagttcctatacatgatcttatttaattttacaacatttttacaggtaggtactattgctaatgctctccaggttccaaatgttatccttttaaaacttttatattaagttcgagggttcatgtgcaagtttgttatacaggtaaactgatatcccaagggtttgtagtaaagattatttcagcgcccaggtattaagcctagtacccattagttatttttcctgtctgtggaataaggttctcttgaaaactctggaggactaagaaaaataaggctgtggaaactcacctaggtgaggattcttcttgtattagtgtacaaagtaaaagctagatatatgtgctgaaatgaacagcttgataataataaaataaggaaagaaccaggtaggccttgctgttctctacccttatcagaaaggagaaaggaactgagatgttcatctatgtgcctgagggcacagtactagggagtagaaagcaggaattcaaacagaattcacagtcgtgcttgtttctttgggccttgctcctcactcgtagagtagaggggactgtgctttggtctggcccaagacaagtgactgtgcaacgctgtgccagcatctttaggaacctcagttccagtttcattgtgcatttggccatcatccggcctgtctctgcctcttgttcattgtggtcccacgtgacttctttctgtctggtttgtctccggtcatgtgacttagctgcctggactcttctgttctatgcaggaacagagctagttttcatttactgcaggaaagaccagattggcaggttgattttttttttttctttctcatttgagcaaggcactgggaacactgagggtgataaagggaaggcttagttttgcaatctgtgcttatatcactgagctccctgcaagcaagacccttgaggaacatgtggggtgggtgcccaggtgagctcaggcacagactctattgcaacccccatcctgtccaggtctccctgtttgttaccactgcctttcctggtctgagtctaggggttgtgccgtccttgggaattgagccgaatcacaaataaaagggcacttatggtttcgagtggcgcatactctattacagtatgtcgctctcacctgcctacttttgcattgaaaaaattcacctcttcttagctcctaatcctcacttcatccttacctaccttctacctctctgtgtgtcaactctattgtgtttctatgattacatttttaaaaatatttatttgttttgaataggcaatacccacatgggattacaaaaattaaatcagcatctgtatgtgtctagcaagtattttttcttctaagcttccttcctggaggaattgctgtttcttgtacatcattttgtctgagtatgtatttggctaagcctttcaaaatcaccttctttatggatcaaagtggtcacttaccagcaaattgacatgattcacccaaattccagcataaatacgggactttatcagcacttgacatataacgtattttcatctgtattagtgtattgcctgtctctctccatcagagtgtaagctaaatggagccagggcttgttttgtttactgctaaatctccaatgtctggcaccaaaaagacccaacaaataaatatactactttttattcacaaatggtagccaactctgtgctctgttctacaccttgctttcttcatttactgccatgtttttcaaattattatttgttggtacctgtaaatcagttttgttttctaacagttgcatggaatgtgcatccatggtgaaaatgtaccctaatggatgtgaccaattcccttctgatggacacctagcttgttcctaatctcttgacattacatgcaaaaaatgccttgaacatccttgcacagatctctgcctaaaagtgtgagtacctataggaagttacctatgtgtggaactgctgcttctgagattatgttgctgttttgggtaaacattgcctagttggtttattgtatgctcagggaagaatcacagtgctcatgggtccggtctttggtcctttgattgttattgttggaaacaactccacccacttcttatgctctacaaaacaacagcagtaggggagtgactgcacgctgttcaagcttcttaaagttagtcttactactccctgtggtcaacagcagtccattctttgtatgctaatctgttacatttgtattagaagatggatatctcagcatgacacaaccaaattagttttgctgttggaagccaccatggggtactagttggggcacagctgttgcatagccatgggatatccaaataaggggattggggaaggcactgtcataagatcatgacctctcttagaagcaggagccgtcaaggctcaagaggacagatctccaataccttcattccctgcctcctctctgtggtgttattacttccccccaagatgttcaagttcagctcatgttcatagagtgcctactgtatgccatgtactttctgtccaagatcgaatttaactttcttaagagccctgtgaaaaaaagaatactacttgtatcttatagaggatgtaccagaggctcaaagaggtagaatgacttgtcagagtaagcttttttaaagatacaaataagactgtccttcctgcttaggaccttccattctaaagtcctcctgtgttcttatctgcccatgtcagtgtctccaagtcaatcatattttcttcctttcaaatctgtctccagctacacagcctcttgtcacttacatctatgtgttcattcctgtcaaaggccatttgcttttctatttccctttaccgagaacttttagccccctaaattaaaatttacgtggaccccgacagcacaggcaaccaaagcaaaatgggcaaatgggatcacatcaggttaaaaaacttctgcacagcaaacggtcaagaaagcgaagagacaacccaaagaatggcagaaaatatttaaaaactatccatctggcaagggattaataaccagaatatttaaggagctcaaacaactcaatgggaaaaagatctaataatccaattaaaaaaattggcaaaagatctgaatagatatttctcaaaagaagacatacaaatggcaaagaggtctatgaaaacatgatcaacatcactaatggtcagaaaaataaaattcaaaactacaataagttatctcactccagctaaaatgacttttttacaaaagacaggcaatgatgaatgctggggaggatgtggaggaaggggaaccctgtacttttttggtagaaatgtaaattaatacagccactatggataacagtatggaggttcctcaaaaattaaaaatagaactaccatatgatccagcaattccgctgtcaactatatacccaaagaaggggaaatcagtatattgaagagatatctgcactcccatgtttattacagcactattcataatagccaacatttggaagcaacctaagtgttcatcaacagattaatgcataaagaaaatgtggtacatatacacaatggagtactatttagccataaaaagaatgagatcctgtcatttgcaacaacatggatgaaactgaaggtcactatgttaagtgaaataagccaggcatagaaagacaaactttgcatgttttttacttctttgtgggagctgaaaattaaaacaattgaacacagaagagagtagaaggatggttactagagtctgggaagggtagttgtgagagagggtgctgggaaatagggagggttaatgggtaaaaaatatagttaagatggaatgcgtaagatctagtgtttgatagcataacagggtgactgtagtcagcaataatttgtcgtacattttagaataactgagggagtacaataggaacgttgaaagaaatgatgaatgcttgaggtgatggaaacctcattttaccctgatgcgattattatgcattaaatgcctgtaccaaaatatctcatgtactccataaatatatacacccactatgtacccataacattttttaagaaataaaatgaaatttacatgattgggttcttctagccacagccagaatgtcatctctttaggagtgatagatcctccttgaccgctcccccttagcactctctatctcatggcccattttgtcttgcacacagctcttctcactgtctaaaaaagtcgttttggttgttcacgtggtttatttattgatgcagatgttgaagttgcattgtaaaaaaactgggtttaaaaatctgggtgcatgcacctttgcctgagacgatttcattgcagtcctgaccaagggccaggagagcacagttggtgacttctacgactgcagttaggatggtgtccaggttcctgggacaattgtgcttagattgaccactgaggctaatcacattgtatttgggagcttattttctcttatatgaagtaggttattattacaacagcctacatccttacatagatcttcactgaaaggaaaacagtctttgctcagtgctggccaaagctgtaatattgaggtaaaaagctatcccttaagaacttatggtttcaaaggtagtttattcatacactcagaggtttgtgtaaatgtgtgtgtcactgtgtatatgtggttgcattagaaataaattcaacacaaatgtgatcatgtcatttcactggatgaaaacttcccctttttgtcttaggtttaaaaagtgaaaagtacttaatagaatttataatggaatttgcaaagtgacaggccacaggatgaatgagttttattcagcccacatggtgctttgacttagtctccaacatttacaaatcaggagatgttacatgaaattctggatatttgacttctcttaaagatttaaaagctccagtgatactgtctgttgaaatggcagtattcagatggaagtgagtaatatctttttctccaggtagggcgtggacccccccagtttacctctttacgtatctggaccacttcactcactcatggtacacacttggcccctataaaatttggttttgtgaccatcgctctgaaatttctccttcattttcctttggattgaaaaatagcagttaatgtgagtaataaaaaatgttatactcatgtttgttagtttgtggaattgcacaagcttacaaatataaacagcagttgtctgagagaaagcaggagagaaatcaacttttaagggtacattggcccagaatataagtagcttctgatatctaaatcttcgctgtcactttttatatcaatagttatttaaaataagtgctggcaaagaagtaatttcttaaactaattactttgatgcatgttgctagatgcaattttttcaaatgattattttatttgattcatgcttgtaacctacatacttaccagtgccccatatattctagcctcaaaactttgtaaattcagagaaacacagagcttttataaaaataaattttcgttttacttttgtcttttcaataaaattcatgggcatctaatttataatgcactttaagtaacaattcttaaaattgtctttcctttccacttctactctctcttgccccgtgtagtaggctgaataaagggccctcaaaatgcttatattctaattccttgaccttgtgagtatgttaccttacatgacaaaaggggctttgccaatgtgattaagttaagcatcttgatatggggagattttcctgtattatccaagtggacccaacaatataatcacaagtgtcctcatcagggaaagacagggagattctactaccagggaagatgacagtttgatgaccaaaggaaaatgctgtgcttcttgctttgaagatggaggaaggggccatgaaccaaggaatgctgggattacaattctaggaactggggaaggcaaggaattggattcttccctagagtgtccacagagaatacacccctgctgacaccttgattttagcccagtgcaactgatttgggaattctgacatccatgactctaaggaataaatgtacactgttttaaaccacctggtttgtagtaatttgttacagcagccgtaagaaacatcccataattgtccttttttttttttgagatggagtctcgctctgtcacccaggctggagtgcagtggtgtgatctcggctcactgtaacctctgcctcccgggttcaagcgattctcctgcctcagcctcctgagtagctgggactacaggtgcgcaccatcatgcccagctgatttttgtatttttagtagagatggggtttcaccatattggccaggctggtctcaaactcctgacttcgtgatgtgcccgcctcagcctcccaaaatgctgggattacaggtgtgagccaccatgccgggcctaattgtcctctttatttgtgagttctcaaccctctccgtgaaactttcccagcccccttttgattccctttcatgggtaatagtgagaggcagcacacacagggaaccaggacagtaaacaaccttcttacccttttccaagatttcttcccaggagagacacagtaaaatagagcaggtgaggcaatgcggacgtgtgactgcatgatccattacctgaaataacttgaccaaaatcagtgggagaaccaacaagtctgtggaacccacagtctttctcaagcacttattcctcttactcatagctcagtgtctttgctttaatgacctcattctttgctgcataagcccactcagactattccctagatattctgccgacatggcctcatctagactccatgtggctctgcctctaattactgtgtgcttcatttgcataaggttttactcattctcatgtcattcgtataaagtgggagtctcattgctaaggcaaccagaagtgggagtgtgcacaatttcagccttgtccaagaactcagctctacttggtatactcccactgtgttcttggtttcctgccttccatatccaaaataatgcaaacaataccatggtcatctctgttcgttttttctctttttattaatcttttagcaggcctatccagctttttcctgaattcactaactttgttctttaattatccctagctaatcttgatgtcttttccttttcctgcataatagatatcttatctggaatcctttatggtaattactgctgtgaacactttccacatgggtttttctctttcttctaccacccttttgaccattccatgcctctcccattggaatcagaatccaggatttctgtttctgctcttcatctggacagggccactcaaaaatagatgaaggatcagggactccatactccccatgtaggaagacagatggaggcctctaagaaatgtggttctaattttaaactgattgcctcgtattcgcttcccatgcatcaagagctagtttgagttctactgtccataattgtcagttgctacacactcactcagcagcaatatggcagatttttctgctagttaatgcttaaaagtttattccattttacaaagtactgatgaatttcgacaagaataaaaggccttatggtttccagtaggaaaattgcctttctcctaaaggccatgaaatgcctttctccaaagtccattgggtgactctcgttcacaaatgtgtcctacacaaaatcttaaatgtgcatggtttaccaactgttaaaataggaagattttaacacaaaatcctgaattctggattgtcttgaaatactgaaagagctggcaacatcaagttgtattcttctatggccacagaccacagaagctggagttgtgtagtcattgccccttgggataaggtggtaacccttcgctcatctcacactctacacaccctactttgctcaattttgttgcctgcgtgctttctgtaggcatctcagtttccaacttctctcatggagttccaggcttactgtgaggaaggtacctatagatgactacactgacttccttctcttacccacctaatccgtgaaaccggtcattcagcctccagagatgaatttctcattgccttcctgaatagccattccatctgtggtcagctctccctaggggaatgtattccacagattaggtgtttcatctattatgtcttcttgtcccttagttggagatctattggcaataacccattttgattattctgtttctccaaaacttgatttccattgtatttccaagggctcagaggaactatcagttcaccatttgcactgagctgatgttaaagcattaaggaacctgatgcctcctcatcttgtaccttgttttatctgattattttatgccatttgcaagctctagtgtgatacatgaggccatctcagagatttctcaaggttcacctggtaagagccaaaggaagctgtgttagtttctatagctttttctctagtggtaatggtgctgataataatgatgatattagtagctacattttattagaaaaatgctgccagggtaaactaaatgccagaatgaatgattgataaatatccctgcatctaatcctaattaaaggtaggtgttatcctggtttatcaatgagtaaactgaaactaagagaagttaaatatattctcaaaggccgttgtggtggacattttatttgtctctcctcaaatttgctcttttttcttatggtaactgccataatttcccgttggatatccgtgcctaccccatgaatttcatgtcctttggtaaaagcaggccatgtgactcaggcttaagccaatccatgcaattctgattcactggccatggtgactggctcattgattagcatgaatcatagttaagaacgatgagatgggagattttattggagggcttctgagaaccttctaaagatacaagagcatgcatggaagcacttgtggaatgttggcaggttcccatgttgtgttcacgatggggcatcagccataagatagtttcagcagagggtatgtagggcagagagttggaaggagcaaaatcttgatgacatcattggtctactgacttgaaaactcctgaagccatctttgccactggtcattccagtcacagaagcttatgtatctctattgtttaagatggtttgaattttctgtcacttgcaaccaggtgaatcctacctgatagatgcacccaggtagtagataatagagccacaatttaaacccaggacttcatggttccaatattggtgccatttcttctcctctgttcttggtttggataaacactctttgtatagactcatagaatctcagagtttgaagagacccacaagatcatcctgctcagcctctgatgttacagataaggaaactgaggcgaagaaaggaaaagtaacttgcccaggacaattggggcccacgggtaaggtaggctgacctcagtatgctgcttttcttccccatatcacaacacctttatttatttttctgtttatcatcctagttaaattaatgggtctcagggatggagagtcattgcctacagattatggccatggtaagcaggacaaacttcctgggcccaggaggagtctagagttcatttgtgaaatctgccctttgagtataaccaagactaggaccaaagtaatgggagtacaaaactgaagaagctgaagatatgcagtattgcacccatttctggagaaatagaaaaataaataaatgaagacagcagcggaagagaagaaaaaggagaaagaggaaaatgatatttacaaggtgctgtccaaaaccaaagaagcatgatggatagggaagaatctttgtttttttgtcttccttaatacaatgaaatcagtgtagatccggtaggccaaggtacccagaacactgttctctctcctctgtttcctcccttattccatgctaaagtaccttaaaggactctatagactattaatagtgctttagaacataactcactgcttaggacttccaacaagtggcccactggtggaagaaaagcaatatattaagtaattttagaggaatttcaaggaatgagggtataggtttttaccctttctcttgatagctgagacatgactgctacttattttccttttaggaggagaaaaaaaaactttctttctctgtaatagtaggagtagtgtagaaatagccgcagtggttaacacatgcatgttcttcacatgtggtacgagaaggactcaccaaatgtgtccatgccctaatgcttggaaccagtggatgtgttgcctaatttggcaaaagagattttacaactgtgattaagttaaggctcttgaaatggggagattatcctggactattcaggtcaacccagtgtaataatactgggtccttataagggaagaaaggaggcaggagggagagagtcagaggaggagatgtatagtgaaggtagaggaaacagaggtggaataatgagggtgctcaggggaggaatgcaggaactccctggaacctggaaaggcaaagacatggaatctttcctagagttctggaggaacacagctttgtccatactttgatttttagcctagtgagcccatttagaatttatgacctcagaattgcagaataataattgtgtgttattctaagtcgttgtgcttgtggaatttgttacaacagcaaatggaaactaataccccctgtgtgagagcctgtgatcagtgattagcctccgtatcttgcttgattcttttcttttttatatatatactttcagttctggggtacatgtgcagaatgtgcagttttgttaaagaggtatgcccatgtgatggtggtctgctgcgctcatcaacctgtcacctacattaggtgtttctcctaatgctatccctcccctagcccccaacccctgacaggcccagtgtgtgatgttcccctttctgtgtccatgtgttctaattgttcaactcccacttatgagtgagaacatgcagtgtttggttttctgttcttgtgttagtttgctgagaatgatggtttctagcttcatccatgtccctacaaaagacatgaactcatccttttttatggctgcatagtattccatagtgtatatgtgccacattttctttatccagtctcattgatggacagcttgattcttatcaatccttcattttagagattacaaaatgctgtttagagtggtaagtttaatatgccaaggtcacttcttgagttaagcagttgagtcaggatttgaacccaggcagtctgataccagaacttggattcttaaccactgactctactacctctctaatatagctggaaactctttgacataagaacatccttcttgggccagcaggtgcctgggaagctgctttcagtgtaagtttctgtgctgtttggaggaaaatactacacttgtataataggaattgtgagttgttggaacctctaatttaatattgtttgttctgctgatgtaatgcttccattggctctgagctgactaaagaaataaggattctttgtatattccacaccccctacccgcacccctaggatgtttatgtccctcagcaagccatccaggaagtcctgaaggagaaagcaatgcatgtaattgaaactgatacatgacctgaaaagtttttgcaggagggggaggaggagtatttgtgactattgtcagaactgttagagagttggagaggaaggcaagggggagagaaaaggagggagggagaaggagagagagagagaagagtgagactgattctgaaattagttgagaaagatacatagagatatatacagtaatacaaaaacataaagggagtaagattttgcaaggcaatttgccaatttttataaaaatttaaagagcatactttgtgatctggcagttctatgttttttattgcagtaaagtgcccataacatagagtttactattttaaccattttaaagagtacaattcagtgacattaagtacattcacaatgttgtgcaaggaccttcgatctctacttccaaaacattttcatgactccaaatgaaaattctgtatctattaagtattcacacaacatgccccatccttccagctccctggcaaccaataatctaatttctgtctctatggatttgcctattctggacattttatgtgaatggaatcatacagtgttatgcctggctcctgtcgtttatcatgacgttttcgaggttcatgccactcttatataacaacagatatggactaaatatcaatcgcagtgccatggctaacccatgacacatgagcaccatgggaaagattcatctagtagaataaagtagagcctcatactggtatggagaggtctccaagacatgtttttgggtaaaaacagacagttatagaacaaaaagcataacctattatttgtgtaaaaagttatggaatgaggtgttataattctataaataaatgtagtaggtacatgtattagtctattttcatactgctatgaagaaatacccaagactgggtaatttacaaagaaaaagaggtttaatggactcacatttccacatggctggggaggcctcacaatcatggtggaaggtaaagcaggaacaaaggcatgtcttacatggtggcaggcaagagagcatgtgcaagggaactgccctttataaaaccatcagatcttgtgagacttattcactatcatgagaatagcacaggaaaaacccacctccatgattcacttacctcccactgggtccctcccatgacatgtgggattatgggagctatgattcaagatgaaatttgggtggggacacagccagaccatattagcacatcaatgcatagacagaggtttgagtggatacacaacaaacatgtaacacaagaatggtcgatgttggggatgagttgagattagggatggcagtcaagagggctttagctttgtctcttaatgtttggatttatcaaaggagaatatattcatatgtgtatataaatgaatcaaattgaaagaaaacatgaaaagaaaggaaaaacagaaggagatcaatgataccaagaaaaagtgtagggggaaggctacacacaggaagagatcccccgggatagaatctggatggacctatcatcacaccattactgtaccatttggagtgggaacattgggagtggggagtgttgaatggtgagagcttttagactcagccttttccctgttgtcataagctgacttcaattatagcatctccaacactagtgattactggtttgttccagtgttagaaagtctacaggccagttcaggacagagctcctgttttgagttttaactcagcaatcagtgtttcgattttggaggaaattttccaagattaatcaagttgttttttcttctgtgttgtcaggatgatacatttttgggctggtgatgatgaaaaaaatcatggtttccttaaaggaacgaaagagcatgacttaagttgtgtaaaggttggcgtttttttgtttgaaatgtcatagcaattagctacttaatatgtgagagataattttatgatttaaaaaaacacctggtgttagaggaatcagaccagaaaaatgaacattttatttttattctgttttctttgttaagaactgtgagtcctggtttgaaatccccacccctattcatctctccatcattgagaatttttgatgagtgattagtctatgtgctaggtgctgtagtgttaaaaaataggtatagcctcttcccattggtggagcttatggtgtattgggaaagacagaaactccataaaaaccacaacagctatgtgtatatgattataaatcctgacaagggaaattatgtgtagacaaatgaagttggaatattacttacaggtgtgcccaccacaatctgctcagggacaggtcacttgggaggagatgtctagttggatttcgacactctggcctcaggcaattaattttctcccttaacgattacagtgatgggtaggagcaggtcttctggagttcagtttgcatttagctgaactcaattttcatgcgtgcctgagtctgaaagaatagctgctcaggggagcccagggagcctgcatcgtgggagggagtgtcagcagtggtttcacgcaatgcaatgtggtagaagagaatgaggtctgctccctctggaaggtgaaagaggcaggttatgatgcaggttggggtaattgttggagatgcccttccaccctacgtaactctgtcattttcttggttggctcgcatcttctctttctgacattcaacttatcccattcttttattattttatttccatacttctttctccttagtttctttactttccaaatcctcctttctctgtttccttctgttctcttccctcttacttctttctttcttttttttttttttttttttttttttttgccaccctctgcctgctttctttttattcctcctattccttttcttccttgatctattgttttacctctttgctcactcttggtcaatgcccttctagctctcctagtttatttctctacctccctgcaaatccctctgttattatcttagactcattgatgatcccacatagatcccataagccttacttctctatcccctctttaaatggaagctagtgttaagggggtcatttatcccttgcattgaaaaagcatactgaggatatagggggacccactcaaaggaaaggggatgagggctttggaaaatgtaagtgcaagaatcacaaacattataagcatagcatacactgggagatcagaggtgttattagatgactgggaccttgggtgatttatgtgtttggggaagtttcattatgactgggagtgaatagactggtttggacccctccttcctttgctcacttgtacccaagccctccttggaagttgtgttactgtagcctgaaagggctggtcttcttcacaatatcttgaccaaaacaccaccaccaccaccaacgacaacaacagcaacaaccttcttgtctttattaaacctgaggggattaatgcttagaaatccatttaaaaatcctaattcgtcatctatcccctccatgaacctgcttaaaaatgtctcttcttttgtttgtcccccagattctcttgaccacatctggcttgtgctgtttgacctctttgtgtcttagatgggcttagccttgctttccctcttcccttttccaaaccctctgcagtctccagggggctgatttcttataattcaggcctcagctcagatgctgcttcctcagagtggccttctctaaccattctctcttgcagatactcttaaccttaaggggatgataggaggaaatacattgaagaatttgatgaaaccaaggaccaacagtcttcctttctcccagtctcaggggattcttcagctcgtccctggacttttcaggtgtctgtttgaccgagtcagtctccaagagcccctcccctcccttgtcataccctatcaccttagcttgcatttatttgcttgttaacccttaaaaccagatgaaatgaggttgtatgtttgtttgcttattcaccatcatcaagatcccagccaggaatacctctaattaccatagcaacaggagacactggaaaaagcactttcagggtaaaggagttccaatggagatggtgagccaagaattctcccttacgtttttccatgctgtggtgacgcaggtacctctgacctgaaacttagttcagaagctcccaatgctatgcctggtggtttccatttgtattcaaacccttccctgcccatggtcttctcttctatttgcttcttgtctgttttgatacaaatcaataatttccctcatcttgctcctgcatttagaaaagtgaaccaactgtccagtttccctgcttcattgacacacagaggttaacatctcggggacgtcaatcctcagggcagaacttagtgaagagaatgctttcctcctaattgatgggatcccattgctgagactctctcatttcacctcccacctggggacgaggagggctccacattctctggaacaatgacagtttactttattgccttagagagaaggagctacaaggcctgagtacagagaagatgggggaagtaacccaggtcaccccttgaaatagctgaaagaaactatccaggaactgacaaatgggctttgcattctgacaggtgcagggccctcttcagcagttcgcgttggaaattggaaaaatgagcctattgttgaagatctagatcattcattccatttttaagtgagaaaggaggtatttcacactattacctttacttccgagcgtttgtgccaaagatgtaagatgataacatggagggtgatattccatgtgatggatttcttcttcccttgcctcactacagaatgttcaaaaataaactttccatctgcaattcctgtagaatatcagactactctttgcaagtaagaagacatgatggtgcaacagaagaccagaggattacaatgatgtgtccgaaatctgagccaggagcaaaaacaaagaatgcatccttttccccacatgagccgcctgtcctgactcatgatggacctgggatctcttgcctctgttgacttggagactggggtctttacgaatgggggttggagttaggggcagatttaggttttagtctgagttctctctctgacagagtttttgggtgactttgggcaagccacccatttcctctgtgtctttgtttcccaacctgcaatgtaggagggaagcatgcccattgcacaggagagatttaaaatggaagagcctcaatttttagggaaaacaaaataaaacagatttatttattatttattttattttagtgatgggttctcacttcgtgtcacccaggctggagtgcagtgtcatgatcgtagcttactgcagccttgagttcctgggctacagtgatcctcctgcctctgccttccaagtaggtaggattacaggtgcaggccaccatactctgctatttctttttaaaaatttttttgtagagatggggtttcactatgttgcctagactagtctcgaactcctggcttcaaataatcctcctgcctcagcctcccaaaacagtgtgatttcaggcatgaacccccatatccaaccttattttatttatttttacttatttatttatttttgagacagagtcttgctgtgtagccgaggctggagtgcagtggagagatctcggctcactgcaacctctgcctctagggttcaaatgattcttgggcctcagcctcccgaggagtagctgggactacagacgtgcaccaccatacctggctaattttttggggtttttttttgtatttttggtagagatgaggttttgccatgtttgccaggttggtcttgaactcctgacctcaagtgatccatccaccttggcctcccaaagcgctgggattacaggcgtgagccaccgccaccggccttattttatcttattttttagatatgagagtttatcattattatggcaggaacgggtagtgttggaagcaagactgagaaggagataatttcagtcccaggtagtatgcacattgtgctttatgttatgcaccgatttacatagccgagtattgtctctctgtgtcagatttgtccactgtccacacttccatgtgaactgtattttgcacagctgccttgatttctctgcatcctgatttattagccctggttgatgcaaagtgagcctctgcataaattcaagaacaatttataacctgccccatcagcaaatatccagagcattcgtttcagaaaacatgttagttggtcctgttccttgcctccggtggaaggagctaaaacgaggcgggttattttcaccacggacaccttctccttaactttgggaactgagaaatatattggcctgtttcttttctttgatggtacaaagaaatagggcagaaacaatttgctgtttgtgaacaactggctgagagtgaagttggccttttctgctgagcaaatagaatctgtcttccctgttccatcttcacatgggaacatcagcttgagagacaatagacttataaagcctcctctttacctcatccagcttcctctataaactagcttatcctctgagaaggcttcttattaagaaccaggattgcaacttggattgattccctatcttttcaagtgtccatgaacggatcattggataaagaaaatgatataaacataccatggaatactactgagccataaaaggtaattacatcatgtctttcgaagcaacatggagggaacttgacgtccttatcttttttgtttttaattattatactttaagttctgggatacatgtgcagaacgtgcagttttgttacataggtatacatgtgccatggtggtttgctgcacccatcaacccatcatctaggttttaagccccgcatgcattaggcatttgtcctaatgctatccctccccttgcccactaccccctgacaggccctggtgtgtgatcttcccctcactgtgtccatgtattctcattgttcaactcccacttatgagtaagaacatgtggtgtttggctttatgttcctatgttagtttgctgagaatgatggtttccagcttcatccatgtctctgcgaaggacatgaacttgttcttttttatggctgcatagtattccatggtgtatatgtgttgaggcccttaagtgcagcaactccaaaacagtcaaatgtgacatgttctcacttataagtgggagctaaataatgtatacacatggacacagagggtggcataatagacactggagactcgaaggtgaggggaatgggaggaggtgaagaatgagaagttatttaatgggtacaatagacacttttgagtgacagctacactaaaagccaagacttcaccactacacaatatatccatataacaaaaatgcagttgtatcccttaaatctatttttaaaagaaccatgattgcaacttgaaatcatatcatttattttacctgtaggaccacttactaattcagagctgaaccctggagccagaggaccaagattgaactggttctccaccttggggatgccatttcctctatctaggacttggatcccttctttgcaaatggagttaataatactacctgatattaagtcgttggaagcattaaatctgataactcctataatgtgctgagtgtagtgtttcattaagaaataccaggcatttgcctttttccattttccttttaatgaggacatcggcatcttagaattatcaagttatttctttttttttctttttttgagacagagtctcaccctgtcacccaggctggagtgtagtggcgtgatctcagctcactgcaacctctgcctcccaggctcaagccattctcctgcctcagcctcctgagtagctgggattacaggtacccgcaaccatgcctggctaacttttgtatttttagtagagaggaggtttcaccatgttggccaggctggtctcaaactcctgacttcaggtgatccacctgcctcggcctcccaaagtgcttggattacaggcgtgagccaccgcacctagcccaagttatttcttaaaataagaaaatagtattatccaaaacctaccttacaaactctgttaggcgaaatttctcctgctcttgaccttttgagaaggagacaggtgaaaaaaaaaaatgccaatgtaagaacatagttgagactgttgagtcagtatctagaggcagcattcattttccatcaaccgtgtgtgtgtgtgtgtgtgtgtgtgtgtgtgtgtgcgcgcgcgcgcgcgcgcgtgtagagagagagattcagggggtgcgtgtgcaggtttgttacatagacatattatgtaatgctgaagtttgagcctctaatgttcctgttgcccaagtagtgtagtgaatgcactacctgataggtagtttttcaacccttgaccccctccctccctcctcccttttgggatccccaatgtctattgttcccatctttatgtccatgagcacccaattttagttcctacttattagtgagaacatgtgttacttggatttctgttcccttgttaacccacttaggataatggccttcagctgcatccatactgctggaaaggacatgatttcactcttttttatggctgtgtagcattccatagtgtatatatatcacattttctttatccattccattgttgatgggcatgtgggttgatgctatgtctttgctattgtaaatagtgctgtgataaacatatgagtgcaggggatttttggtggaaccatttattttcctttgggcatatacccagtgatgggattgctgggtagaatggtaattctatttttagttctttgagaaatctccaaactactttccactggggctgaactaatttatattcccaccagcagtgtataaatatcccttttctctgcaaccttgccaacatttgttatttctgattctttaataatagccattctgactggagtgagatggtatctcactgtagttttgatttgcttttctcttatgattaatgatgctgagcattttttcatgtttgctgaccactgtatgtatgtcttcttttgagaagtgtctgctcatgtcctttgcctgattttaatggagttatttgttttttttcttgatttaagttccttatagcttctgaatattagccctttgttggatacctagtttgcaaatattttcccccattctgtaggttgtctatttagtgtattgatagtttcttttgcagtgcagaagacctttagtttaactagattccgattgtcaatttttttttgttgcatttgcttttgaggacttagtcataaattatttgcctaggctaatgtccagaacagtatttcctaggtttcttctaggatttttttatagtttgaggtcttacatttaagtctttaatccatcttgggttaatttttgtatatagtaaaagataggggtccagatttagccttttgcatatggatagccagttttcccagcaccatttattggatgggggttctttcctcattgcttatttttgttgactttgtcaaagatcagttggttgtaggtgtgcagctttattttagggggtctgtattctgtttcattggtctatgtgtcttttaccagtaccatgctgtttgggttactgtagcattgtagtatagtttgaagttaggtaatgtgatggctttggctttattctttttgcttaggattgccttgcccattcatcaaccctatattttttattttgaggcaaagaagatggatgttcagagagcaccaaagtcttatcaggtcacgtatcaagattcaacattgtttcctttccttatttggacagaataatggaccaagatatcaagtcttcaatattggcttgaagggaaaatgagagttagttgtaggaccctcctcctgtctggttatcatggttctgttctgggggatcttgggctacattccatcaaaagtgggagcatggagggacctgcagtattgtggaaagaacctgggccgatagttagtcttatttgagattaatcatatcttggcttggttctaaccatctcaacctggggaagttatttaaattccctgttcctcataatggagataataatggcttcttgagagggttgttgtgaagatgatattgtttaaggcacctatcactcagcctggcatatggaagatgctctttgaatattcattgtctttgctaaaaatgtgtgtttgtgttagagagagagagagagagagattaattggtacacacagagaaggagagagatggctggacaaccatggtggggatttgatatagacttgggggagctggaggaaggtttctggtgttctgtatcttgaagcttgattttggaaaatggttgtatggatgtgttcaaattgtagaaaattgagtggtataatttgtccactgtttttatgtattaaaaatttaaaaatgtgtgtttgtaagacctctttctgtgtcacacacacacacacacacacacacgcacacacacacacacccctatggatctctttccttcagtgttcaggagagacacactccccagacatcttgacatctccttttcttcactcttgattcctgcccctgacatcaactgtagtgatgcaggctcctacttctcttgagatctggtattcttctattgcgtctaagtggtaggttggtgttgtggaagccatatgggctttggaggcagaaaaaccagggtttgcatcttgggcttattttttacaagctgcagatttcttgtctgcaaaatggttgctgtgagaattagagatgattcaggtaaaccactgagcatgatgctagacacgtccaagtattagctgtacagtctttggatttatctcctgggtagagagaacctcctgccccaagtctggaaagatgttggcttttgtagagtaaactctcgaaatgtattaaattgactccatgcttgggaattttctccatttagaatgggtgtttctacctggttcagatctgagttcaacctagatcctcctaaaactatttaagaccattacctctgacataggctgtgcagagtaaacagatctcacatgaatgagaccttctccatctttctttgcttttatttaagccaaatatacagaatttgaatgtctaataattttcttctattggggtcattggtttaatttccttagcttaagggagagctgactagatattttttgtatgctactcttgaaatatgttttggcgtatttgtttgctttcttatgccctcatttattttactgcatttggataactggatgttatcaggtagctactattcttagtgaataggtggaattccacttctgtgcctaacagtatacaaagaaaacaacattattctagctgcattttttttgcttccatagtttctgagttataaatgggagtgagttggctttcatatgcacctacaaaattaatgttttataaaaggaagaaatataaaaagtctttaggccatctgtattggcctaatgcctaaaatcatttagcgaggtctgggccatgttagggttagggttagattctgttttttcataattagtaatctggttgcagggaccagacatgctctgcaataacaaacagccataccagtaagtatcaaattatgtgctcagtgaaaagtggagtccctaatacaatgtctcttactggagtctatggacctcctgcatcaatgatgccaagtatgctggttcagaatatagattcctgggtaccatatccagagattctgattcagtggtgctggaaggaaactcgggtatatgcacactgaaaagctcattagggtgattttgatgctaagttattgaattactagcactctacacaattggaggacagaaaatacctatgtgaggttgtagtatttatggaagaaggaaaaggtgatatctagatcttgaaagataaaatactgacaaaataaacattttcttcttttttttttttttttttttgagacagcgtcttgcactgttgcctgggttggagtgcaatggcgtgatctcagctcattgcaacctccgtctcctgagtttaagtgattctcttgcctcagcctcccaagtagctgggattacaggcacccgccagcacgcctggctaattttttgtattttttagtagagacggggtttcactatgttgaccagactggtctcgaactcctgacctcatgatccgcccaccttggcccctcaaggtgctgggattacaggtgtgagccaccgcactcggcccattttatttctttaaaagagccttttggttattgtacattgttaaaacagaaatacactataaaataaaatcgacaaagatcacttgtaatttcaccacaactgtaactctttggtgaagtttttcaatcttattattttacaaatatttttatgattggcttgtatatacattttgttttcacttttattattcacctaacgtcataatttcagttcatcatgttatgacaacttctccataagcactttttcttggtagtagcatatttcttttccttggttgtaggattttctacagatttcctttcttatctcggtacccagccagaaggaacaatgctgttgatttctgtttccaaaggaggttgggtaattgtcttttcctttaaagttgtgtgatcattccattgtatatgtatataaaaacatcatattgtacctatgaatttatataattataaaatatcagttaaaaatgttttttatttctaatttttgtgagtataaagtaggcatatgtatttctggggtacatgagatacttcgatacaagcatacaatgcatgatagtcacatcagagtagatggggtatccatcacctcaagcatttaccctttctttgtgttacaatccaattatactctgttactctttaatgtacaataaattgttgactgtagtcaccctgttgtgctattaaatattagatcttactctatctaactatatttttgtactcattaaccatcactacctcataccatcccccaactacccttcctagcctctggtaaccatcactctactctctacctccatgagttcaattgttttaatttttttttttttagctctcacaaataagtgggaatatgaagcttggctttctgtgcctggcttatttcatttaacatactaacctccagttccatccatattgttgcaaatgacaggatctcattctttttcatggctgtacagtactccattgtgtatatgtaccacattttctttatccatttgtctgttgacatttaggttgattccaaatcttggctattgtgagtagtgctgcaacaaatatgggagtgcagatgtctccttgatattttcctcttaattcactgactaataaacatcacttcctaatgataaaggcaggtaaaaaccaaaataataaattaaaatttcattctattctaaatgcgggaccatataaaatgaacatataaataattggccccatatctggatgttgtaataacatcattaggtttgttcttactgatgacaaggaagttaacatctttaggtttgggcccaacgtaactgagaagcacacctagagagttgggcacatcaggaaacttttgtcaatagtttagtttctggcagagtctcatggagaatcaagttactcggtgtgtgtgtgtgtgcacgcatgcatgcatgagtgtgtgtccacatgtgagtgtgtctgtgagagaaggagaacatactggtatgtgtgtgtttgtagctgaaggagtgtcatatcgcagatacgtttattagggaaatctggaagatagcagcagagtttttgatatctttgaacccactcctcaaaaaacagacaaactaacaaaagtaataaaaaaccaaaaactaatggataatagctacaaaaaattatgagacaggatgcccccatgaattctaaaatgagcatgtagataaaaatcacaactataaatcccatgtggtgttagaaactgcgtgtgagaaagtaaagacaagaccaagttactcgtgatgcctctgagagtttgggaagttcaagatcatcatcaggtactactggaaaatgaggcagaccattctgaggacaacagctacagcagaaatggtgcttggaaaagtggatattcatatgcagaaggatgaaactaggcatctatctctcaccatatacaaaatacactcaaaatgggttaaagactgacgtgtaaaacctaaaactgtgaaactgctagaagaaaacagggtaaactccagggcattggtctgcaaaaagatttttatagagaagacctcaaaagcacaggtaacatcagcaaaaatagacaaatgtaaaagcttctgctcagcaaaggaaaaaatcagagtgaagagacaacctgcagaatgagagaaaatatttgcaaactactcaactgacaagggattaatatgcagaatatacaaggaactcaacagcaaaaaaaaaatccgattaaaaatgggcaaatgagttaaataaacatctcttaaagatatgcaaatggacaagtttatgaaaaaaatacttgacatcactaatcatgaggaaaatgcaaatcgaaaccacagtgagatataatctcagctcagaaaagatattatcaaaaatacaaaaagtaaatactggcaaggatgtggagaaagagaactagtatacattgctggtgggaatttagaacagccattatgaaaaacggtatggagtttcctcatactaaaagtagaacttctgtatgatccagcaaccccattactgggtaaatattcaaaggaaaggaaatcagtatgttgaagagatattctttacccactgccatgtttattgcagcactattcacaggggccaagacattgaatcaaccactgaattaacagatgaagaaaatgtggtatgtatacacaatggaatactattcagccattaaaataacaacatcttggctgggcgcggtggctcacacctgtaatcccagcactttgggaggccaaggcgggtggatcacaaggtgaggagatagagactatcctggctaacgcagtgaaactccgtctctactaaaaatacaaaaaattagctgggtatagtggcgggtgcctgtagtcctagctactcgggaggctgaggcaggagaatggtgtgaacccgggaggcgaagcttgcagtgagctgagatcacgccactgcactccagcctgggtgacaaagcgagactccatctcaaaaaaaaaaaaaaagaataaataacaacatcttgtcattcgtggcaacatggatgagcttggaggacactatgttaaatgaaataagccaggcacaaaaaaccaaatatcacgtgttttcacttcatgtggaagctcaaagcattgatctcatggaagtagaaagtagattagtggttactagaggccaggaagggtgtagccacaggttggttaaaggatacaaaattacgctagacaggaagcataggttctagtattctatcacactgtaggatgaccatagttaaaaatatattgtgtatttttaaatagctagaaaagcagactttttaatgttctaaatacaagaaatgacaagtttgaggtgatggataagctaattaccttgccttgatcattacacattgtatacatgtattgaagtatcacaccgtaccccataaatattaatatacaatgtcaatttaaaaagtatcagtatgaacttatgatgtatttttacttaaaatacatatatcctagaacagtaaccaacctagtaaaactaagtactcctccacttagagtttggtttttaaattattttccactgagggagaccactgggaaagtgggtgattcaaggtgtagggtggaaatgaacaagataaaccttcctagagtgtcttgtcactgcaatgagcaaagcagttaccaaagactacaggtcaaagggactcagaagccaatctgaaatcaactggccaaagatggaacagcttgggcatcaatgaagatactaattgcagggcattgaaatacataaaatccgtgagtttgtaataataagatattttaaaagataactaattggtaacccttggaggatgctagggaaccaattcattgttctgaaaacatacatgggggaagaagcatgcgtttactgtattctgcccttcttgtatcagttcttcctcaggccaaatagctgacaaaggaagatttctctttttggcgtagttccgggtaataaatgaagaaggaatagtagaattggaatatccctacattgcaaacgttaatgaactaatggatccaggcaattattgtcaatgcctgctaatgttacaaaagacaaccagaaaatttattttttaaagaaagtacacacatcacttatgaagtattcctggcaaaataagtgagatctgcatctacctctggcctgaactgccagcaaatatgggagggggcataagcctgttagatgacatcatgggcatgtcatcagcaaaatccagactattggaaactgcaacaaaagacccagtttttaaaaccaaaaatgcaatgaaataaaaagagtctcaagagtcatattaattacactggctgcggggctcacacctgtaatcccagcactttgggaggctgaggtgggcagatcacttgaggccaggagttccagacctgcctggacaacatggcgaaacccccgtctctactaaaaatacaaaaattagctaggcatggtggcacatgtctgtaatcccagctactgaggaggctgaggtaggagaatcatttgagcacaggagtcagaggttgcagtgagcagagatcacacccctgcactccagcctgggcaaaagagcaagactgtctcaaaaataaatacataaataaataccatattaatcatatagaccttgtgtgtattctaagtcaaaagaatacgatttttctaaaagtatatagaacaatcagcgaaatatgaacacagaccagacacttgataatattaaggattaaggtaaattttgagtgtgatgatggtattgtgatgatatttgtaaaaaggagtccttgacttttagagatgtatactgaaatatttacagatgaatgatatgatatctggagttcacttcaaaataatgcattggaaggagaacattggtaagaatatggacaaaacaagatcagtcacgaattgaaaatagttaaaattgagtggaggatacatgggggtttgttatactattttttctgttttctatgtttgacatttcccatgatgacaagtttaaaaagaatataaagtgacccaagtttatgtgaacctttctggaaatgacctaatgggatcataactaagctttgcagataggtaaacatctaccagcccaattaccttgagacatgattggaggcgctgagcagcatggcagtgctgccttgagatcatagaaggaatcctcctggtcagtaagtgaacaacaaacagcatggatggcattttcagtttttattctaatggtaatttgtgcatttcctgtcttgtagttctttagcacctttagcccaggcctgctttttttcctcctctaaggactttacagggtgaaactattctctctctctctctcttttttttttcctaatataatattttatttatttattttatttttattttttattattatactttaagttttagggtacatgtgcacaacgtgcaggtttgttacatatgtgtacatgtgccatgttggtgtgctgcacccattaactcatcatttagcattaggtgtatctcctaatgctgtccctcccccctccccccaccccacaacagtccctggtgtgtgatgttccccttcctgtgtccatgtgttctcattgttcagttcccacctatgagtgagaacatgtggtgtttggccttttgtccttgtgataatttgctgagaatgatggtttccagccttcatccatgtccctacaaaggacatgaactcatcctgttttatggctgcatagtattccatggtgtatatgtgccacattttcttaatctagtctatcattgttggacatttgggttggttccaagtctttgctattgtgaatagtaccgcagtaaacatacatgtgcatgtgtctttatagcagcatgatttataatcctttgggtatatacccagtaatgggatggctgggtcaaatggtatttctagttgtagatccctgaggaattgccacaccgacttccacaatggttgaactagtttacagtcccaccaacagtgtaaaagtgttcctatttctccacatcctctccagcacctgttgtttcctgactttttaatgatcgccattctaactggtatgagatggtatcactctctttttttttttttgagacagtctctgttgtccaggctggagtgcagtcgtgtgatctcggctcactgcaacctctgcctcttgggttcaagcaattctcgtgcctcagcctcctaagtagctgtgactgcaggcgtgcaccaccatgcccagctaatttttctttttctgttttttttgttagtagagatgggggtttcaccatgttggccaggctggtcttgaactcctggcatcaagtgatctgcctgccttggcttcccaaaatgctggaattacaggactgagctaccatgtctggactattccctagttatataggggaattttccaatatcaccagagtctatagtttcattttcaatataatataaatatcttgggtatatatacttttatctcatacacacacacacacacacacacacacacacagaatataagtcctagataaatacatacatatacatatatatatatatatatatatatatagtcccatagtcccttatatgtatataggactgtatagcctccaagcgttttctagtacagtcattcattctgtgaatattaaatgcttaaatgcctggcattgtactagagaatgaggatacagtcttttcatgtccagattctagtatagggagacatcaatacacaggtgaaaaaactaattacagattttggacagtgttatgggggaggtaataagcagagctgtggtgaagactgatggacaaagaccctgctctagcaagaaaaggcctctcagagcatgagacgtttaagctgaaatctgaaggataaaaaggaggtcctgatgatgggaacagcggaggaaaaagcattccaggtatagggaacagacagtgcgaagacactgaggagggaaaaagctggtgacaggaaactgtcaaggtctattgtagagcaaaatgagaaagatggagagtggcccaagggataggagctgatctcgtcttcagaataaccatgtggcactgtcttccttgttccttagatttcacagataaggcaactgaggcaaccctctgtgtcattgctagtaagtcacagaatgagagcttgaatcttcttcaccagactccagatctagtgttccttttgagtagataaaataaacctgttagaatcttagtctcctcttggcttactttctcacaaccagaggggtcagtttaagctgtgcttggcataaccagagtgagggacccgcattgtaagagaggcaagatcccacatgctcctgaaatcaacgtcaggatttcttcacaggtttcgttgtgggagtcggaaatgtgggcactactttttaatgtcttagaagtgtctgtgggtacatagcagaatttactgtcacatccatctgcttctctccctctgtcttgctgagtaacctgccatttcagacgagaagcccgtgccacgttatgtcatcagggtccattaagagattactctgattccagaggaacatccgttccgaatacagaggaacttgctttcatcttccaagggatgccaattgttgattccttgctcctcttcaaagggaaatgtgataaaaatccttctggaggaattttcctactggcagtgatcattttcatagtgaacttgagccaggtcatggagtggaagaaatgtaatgttcttacagagggaagatcttgcttcattaaggaggagtaagaggaggatggggaggaaagggaggaggagaaagaggaggaagtagaggaggaaggggaaggagaggaatgagaggaggaagaggatagggaggaggaggagaaggactaaggagcagacaaagtactaaccaccttccatactcatgttaatcatcacaataaaccagcaaggctgggaattatcacctttctcgaaatgagcaaactgagggtaagcaaggtgaaaagacttgcccaagttcacacagataggaagaggctgagccaggtccctgtaactgcatttgcctgagtcacatagcttctccgtggatactttgaaaagtgagtggcccttgctttctagaccaaatcacacacaactctaacttgcattgggaactgacaacccattgctttttctttatcagttggtgctttcgttatgctgtagcattgtcatgtttagaagtataacatccaactgcctcattttgcatggaagaaaaggctcagaaaggtgaagaatgtgtccaaaatcatccagtgaatatatggcacagccagcatccaagttctaactccaagtctagtgccttcttctcaaaccacagctgtcttgttcttgcccaagatctttttcttcatcttcgttgttaagctgcagggttgacctaattaaaaagttttatttttttatttttatttttttgtgaattagtagagattttcaatttgcttggagctgagattgagctaagagaggtatttactcaccaaagtctactccccaaggaaaagccgaccgaattgaagtgtgtgtgtatgtgtgtgtgtgcacatgtgagtacatgcacacatgggtgtgcacgtgtgcatatgggatatgaggaggagagtgggacacttttatatatgtactggttaaaatttagtggcaaagctgcctgaacgtgtgctgtggttaatgattgcttgagctctgccttccactctcagctttggagtgggtggtacgctgtatacagagcacctagcgtgcgcacagaactctcctttcatttctacacataaagggcttaacatagtatctggcagatggcatgcaatgaaattaactttaattataattatctcatttagggtgaggtaatactattttttcagttttacagattaggaaatggagacttcaaggcttaaataacttcctaaaatcactcaattagcaaatgataaacccaggattcaaactccggtcagtcctccctccctccccccttcctcccttgctccaagagtattgctctgttgcccaggctggagtgcagtgacacagtcatggctcactgcagccttggattcctgggctcaagcgatcctcctgcctcagcctcccaagtagctgggattacaggcatgtgtccccacacctggcttgtttaatttttgaaaatggtgtcttgcatgccagctttagattgagcaggactatgtaataaactggctggtgagagattaatcactatgatcagttagagaaggtggagagtcaactctttctttgttgtcggaatcagaaccaaaattattttgggccctcctgtttcaggtctccagtgaatcttatttacagcagtgaactgaacacatgcagaaaactattttgtattccactcatgtggcagcctttgcctggtacgacttggttctcagatgtcatttgtcacgcgatgtggtgtcaggctggccaccggatggatagtggcttccctcggagggatatatctacaagtgacgccagctgaatggcttcagaggacatgcatcatttgtgaggctcctaaaggtgggagctgtgcgcctgtgatttcattactggaattagagtgccggctttcatttttctattaattccactgatggtattagtcgtgttaaaaagacagcacaaacttggctctaagtgttcttggatgctgaatgccaccagcacttctgagtctcagttggttcagggtcctggagcttgcagttttctgttgggtttcaaacgccaactttaaagaggaggcttgggttccactcttaatgctaataaaagactcacagaacagaggaaggaacgttcaacaaaggatcagaacaccgggatctggcagcaacttgtttggttacaggagaccagttagtgtcctgtcctcctttggacatgtgagagagttaggttacataagtgtttcccagaatatggggctgcatatcacctcaggtaaatgagatggctttaggtggtacacagccccagttaaagaacacagactcacatagtagtcatgccatggtgtctggccaggatttaatgatatggtttgctttatgttcaaggtgattatttatgtaagtgacacgaggctccccatttatgtaagctataaaatttcctttagaatagcttaattacattttaaaaagttggtttatagactaataataaataatgggaaatatctgtgatggaagttgaagagaaactgtgattgtggagttgtctatttttccttttagttccattctgtatttttgggggttctgttattaagttcatacacatttatggttattatatctttctgatgaattgacccttttctcattatgaaatgcccctccgggaatactgtcttgaagtctgttttatctgatgctaataaagatggtccattcttctaacattttctggttgtgtgttgtatctttttccattaatttactttgaatctgtctgcgtctttacattgaaagtacatctcttgtaggtagagaatagttggtcttgtttttgtttgatccattctgagagtcttcaacttttagtccacagtcatttaatgcagttatcgatgtgtttgggtttggcatgtttattgttgtttctgtatttcccctctgtttttcatgtctctcttctccctttcctgctctgttagttttctgttgctgctgtgacgaatgattcacaaaccgaagagttgtggaactgaggttcccatttatttgcagtctgtggatggcaggctggtctttgctcctagagacttctttctcatgctttccatgtagctcctccagcaatggtgaatgaagatcttctgacactttgagtctctctgacttcttctctgctacttctctgactccagctggagaaagttctctgtttttcaggggacttgtgagtaggatccatggaataaaccaggataatctctccgtttttaggtccataatcacttttttcatgtaacataacacattcagaggttccagggttaaaggtgtggacatctttgggggatccattttgcccattatatctgcctttttatggatttttagagtatttacacactttgttttaacttatttattggcttttaatctatacctctcatctcaatagatgcagaattatcttaatagatgcagaaaattatttaaaaattttaatactttaattcctataaaatttaaactatttccttctataaccagttttctgagtgttttcatgatagaagtatatccaataaaggtcaaatacaacaagcccacaacaaacaccatactcagtggtgaaaattgagagcttttcctctatgatcaggaacaagacaaagatgttcaatctcaccacttctattcagcatagtactggaagtcctagccagagcaattaggccagaaaaagaaataaaaggcttccaaattggaaaggaagaagtgaaattatctctatttgcatttttaaagtgattgctctagggatcacatgaaacatctttagcttttcacaggctacttagggttggtattgcattgcttcacatacaatgtagaaacttttcagtatagggcctactcattccccttgtagcaggacgagccgcagacaaaactcctcagacacggagttaaagaaggaagaggtttattcggccgcgagcatcggcaagactcctgtctcaagagttgagctccccgactgagcaattcctgtcccttttaagggctcacaactctaagggggtccacgtgagagggtcgtgatcgattgagcaagcagggagtatgtgactgggggctgcatgcaccggtaatcagaacgaaacagaacaggacagggattttcacagtgcttttccatacaatgtctggaatctatagataacataaccggttaggtcaggggtcgatctttaactaccaggcttaggtcaggcaggcccaggcctgatttcgggtctggttccttggttttgggtctggttcctaggcaccaggctaactgcctttagtttcgcttctctttctttttctgagtataaaaccgtataaaacaatgtgagagggcctgtctctcttcttccaccctcaccatcctgtatgctatagtgttatatgcattgcatctgtacattaataccctaagaggcaatgtaaggatttgtgctttaaatagtcacatgcatatgtatttttttaattaaaagaagagtcttttatgcttatccagatatttatgcttctaatgctcttcattaattcctgaaggaattagagttttcttctggtattattttctcttgtatcagcttgaataacttcctttagcatttcttgaagggctggtctgctggaaatgaattctcttagttttattttatctgaaaagtctttaattctttttcattcttgaagggcattttcactaattatagaatttgttttttttccccccagcacttataaagacattattccactgtcttctggactctgtagtttctaatcttaagtctgtgaaaaatttgaatcattgttctctatatataatgtgctatttttctcttgctaattttgagattttctttcttttgattttcatcagtttgactgtgatgtgcctagcatggttttctccacatttgtcctatttggggttctttgagtttcttgaatttgtaagtttatgtctttcaccaaatttctttttggccattattcttcaatattttttccccttctccattctctttcttgtaggaacttttgaaaccacctttgcaaaaattataactgagaaatcatggcagtgaaagagatctgacttaagtgacttcatcttgcttctaacctccaagttgtccttgtttttcctgggcggaggtgtaggccaaaataaccttcagagaaacttagtttatagtttaactttgaaacaaagagatattagccctttcccaaaacaaacacccttcctgcctggggattgcctaaagccagaggatgagaaattatggtttaggagtcatgcagttgaaggctgcaagactctaaacctccccaaattgctcctggggataacatcactattgtaaaacctaagatcggtacttgagatattttgcagacccttcatctgatggatcagttagcaccacccagattgataaactggctcatctggccttgtggcccccacccaggaacggactcacagcaggaggacaattttaacgccctgtgatttcatctccagacagccaatcagaactcctgaatcactggccctctacccaccaaattatccttaaaaactctgatccctgtattcttggggaaactgattttgagtcataataaaactctggtctcctgcacagctggctgtgtgtgaattactctttctctattgcaattcccctgtcttgataaatcggctctgtctagacagtggcaaggtgatcttgggtggttacactttaatcacatgtatgttagatctcactctgtcaatttataaaagcccctctgcttaagtcatttctattgatctatcttcaagctctctgactcctgcctatgtcatcttcattctcatgttagttctatccagtaaattctttatttcagatattttgtttttcatttctaaatgttcttttttttattttcctcttctgaggcttcctacctttttctttgtgatgagcatattttcctttacctcattaagtgtattgttagaatagctgctttaacacctggatcatattgggattggcctctgttgattgtcttctttccttgagaatgggtcagatttccctatttcttatatgtaaagtaagtcttttttgcttgagaatgggtcagatttccctacttcttatatgtaaagtaattttgaattgtactagcactttgtgaatgctatattgtgggttatatttccttaaagagtattcatatttgtgtcttagcaggtaactaacctggttatacttacatttccatatctgtctctcaggtggaggcttagttctcagtcctgttgggtttaaatgcaaactactttgagccttgtctactcaccctttgttcaaggactggccagaggcttgggcagagtttacatatacatgccaagaattcccttctctaagtctcctctttctggggtttttatattctgctggccgtggacttccaggtctctaacttccacctcctcaggccagaaagaggttggctcttccactagatgttgagccacccggtgccattttgggacagcagcatgctgtcagacctaggtggcaaaaatgtagaactctatgatgagcccttcttccatgtttcaatgtccctgtgaaatctactggctatttttactctacagagccttcaggtatattttttttttccttctagctttaattttttacctgtttgggtgtgggagggaatctgttaagagatttcctaccataccagaagcagaactctggctatcttctgctgttttcttaaacttctacactgctggaactatttttcagataaactagatcagataatttttatggtaaagttagactgacatgtcatcatcttcagccatctcattttcttacccgacattggcagttttacattcttatatattcttgctacaagatacaggagctagaaacaagaatcattttattgtcagtcacagttctgtgggttgactgggctctactaggtggtttttctgctgcatgtaataacagctgaggctacagttccctgagagcacagttgggctgaaatgtatgagatggctcatgacatggctaagtggatggagctggctattggcttgggggcgtagctcactgcctaatgtaacctttttatgtggcttggatttcacaaagcatggtggttgagttttgagttgacatacccaagggaaattgttatatcagggaagaagtggaagcttctgttttactgaaaattaggcttttctattggtcacatagtcactgtgctggtcagattcaagaggagaataaagcaatccacctgtcaatgggaagaataacagaaaacagtgtgggcatccttaattcaccccacctcatactgtctgctcttatttgtcacccatagcctttgttcatgccttgatcatctctttatagaattcctgaaatagccttctagcctctccccttccccccagtcttgcctctcaaatgactatctacacaactctttgtcttctccagaaaggcttcctttatttcccagggtgaataagcctctcatctctccattattccatagcattctgtaatactttaacatttactacattgttctgaaatcataaaatctatttgtctgtctcaccaaccagtctgcgtttctcaggggaaggaactatatttgatatatccaatatttctcctgttgagagtttaccagcctgtaattttcttaaggtaggggactctgcctgctttatttattttatcttcagtacctaactttgtgtctagctcatcagagatccttaatacatatttcttgaaccaaaatgattttttttaaattcacagtcagttaaggcagagcaagaactcgattccagatttatttcccctctaatttacttctttctagggccctccagcagccaagtgaatctaaacaatcctcaaggcctcttttccttagcagatctatcgtatctttatctccatatctcaaaagcactttctttcatatgttttaaaatataaactgagcttaataagatgaaaaggtttcaggattttcctgcattggtctctactccagtctctctagtgggcaatgcaccaaaacactgctctatttcctagctttaaacttgaagaaataatctccaagctccagggctaagaaaaggattgtacattaaagacttgttgctttggactatgaaccttacaggtcaatttttttctggaatagtgctaataaagagaaaacaagttaaattattcacctggaggcctagcaggttgtatcctgaaggctgaagtcaagtgcttactcaaacattgaatttgagctgcttttttctgtattagggatcccaatgcttggtgcagaacaagaactcgagatttctttgacgtcaaggttggctctacctagagtgtgattcttgaactgtagtgtgtataagattcacacggagagtgtgttaaaacaccaaccccaggccccacttcagagaattctaattcagtaggtctaagatggcgtgcgggagtaggcgtgcctgtgagtctcctgtgagctgctgatgcagctaaggctttaaggcagagttgttcagcagtggaattcttgacattttgggctagataattatttgtgaatagggagctttcctgtgcattgtaggatgtttagcagcaaccctggtctttacccactgggtgccagtcataccctgcctcctagctgtgacagctaaatgcatctccaggcatagcgaaatatcccctggtggagcacagtcattgcatgttgagaaccactggtctagggtatctggatggctgtggattgaggtatcactgagtaagtttgggtggtggatgacaaggtcagttttagagtctgctgagcttaactggcttatggggcaccatgaacatccagttctttaaatatcaaagcccagtggaatgatctggatttggaaggcattggcatatatttaaaaccatgaaggatggataaaatgtccaagtaaatgatgtacccagtgaggaacaatggatgcaacacagagccttggggaacactaactcattaagtggcgagtgaagaaagtgtgcatctaagaaggaatgatagggggatataagagaaggacaaggagaaaaagatgtttcaggcagcaatggaggagagtgtgtcaaggagaaaagggaggtgatgtcagtagaggaaagattcggtaacaccaagttcaaaaaaggaccatgggacgaggagatcaccttgaccacagaaacctgttttgtgcaacaggatggccattgactccctgtgtctactgagcatttgaagtgtggctagtgtgacctgaaatgtgctatatgtgttaaattcactctgaatttcagacttgctgtgaaaaaaaagaatgtgaaatatctcattaataataatttttatattgattgcacattaaaatgataatatagtgagttgaataagatacattattaatattaatttcaactttttctttttactttaatatatgtggtttgagggcagggcgcagtggctcacacctgtaattaccagcactttggaaggctgaggcgggcggatcacctgaggttgggagtttgagaccagcctgaccaacatggagaaaccccatctctactaaaattacaaaattagctgggtgtggtggtgcccacctataatcccagctacttgggagactgaagcaggagactctcttgaacccgggagtcaggggttgcagtgagccgagatcacgccaccgcactcccgcctgggtaacaagagcaaaactctgtcaaaaaaataaatacgaccaggtatggtggctcatgcctgtaattccagcactttgggaggccgaggtgggtggatcacctgaggtcaggagttcgagaccatcctggccaacatggtgaaaccccaaatctactaaaaatacaaaattagccaggtgtggtggcgcatgcctgtaattccagctacttgggaggctgaggcaggagaattgcttgaacccgggaggcggaagttgcagtgagccaagatcgtaccattgcactccagcctgggtaataagagcgaaactccatctctaaatacatacatacgtacatgtatacatacatacatacatacatacatacatacatacatacatacaagtcaatagaggcaaagaaatgatagatgcaggggagagaagaaggaaggaagcaatacaaagcctagagagattgtcattgaatggatagggggagtgtcggggagattaacttgtatctattttcaacctctttcagcctcctccttttttcctgcaaaatgggagtaagaatcacgttgcaataataacgcctacccactgggttgtctggaggtttacgtgagataatagatggggactacctttggaaataatgaaacactgtatgaattccaaccgcagtcataagtgtctttctttctgacatttcactgtctttgcctcctaatgcattaataattcatactgttttaaaatttttttaatttctatttcaatagtttttggggtacaggtgcttttggttacagggataagttgtttagtggtcatttctgagattttggtgcacccatcacctaagactactaactattgtagtcttttatccctcaccccctcccaaactttccctacccctaagtccccaaagtccattatgtaattttttttttgagatggagtctcgctctgtcgcccaggatgcagtgcaatggtgcgatcttggctcactgaaacctccaccttccaggttcaagcgattctactgcctcagcctccccaagtagctgagactacaggcgcacgccagcacgcccggctaatttttgtatttttagtagacacgggtttcgccacgttagccaggctggtctcaaactcctgacctcaagtgatccacccgccttggcctcccaaagtgcggggattacaggcgtgagtcactgtgcccggcccattgtatcattcttatacctttgcatcgtcatagcttagctcccacttataagtgagaacataacgatatttggttttccattcccgagttacttcgcttcgaataatggcttccagcttcatctaagttgctgcaagacatcattttgttcctttttatgactgaatagtattccgtggtgtatatctaccacattttcttgatccactcattggctgatgggcacttaggtttgttccatatctttgcaattgtaagcataattcatattctttattaccacagagtcgcaggaagaattcaccccaaatttcaaaatgtgggacctgctgaacacagaatctaccactgaagtgtcgaacatgagtcacttaatagtgctgaactaatagtgagaatttcatcgtgagaacttaacagtgactcatgtttcactactgctgaaggctgaagtgtggaaaatgagtcactattaaacaaggaagggcactgggtaacctttgtgctgtggttctcaaagtgtggtttctggaccagcatcatcactatcacttgagatagggccaaaatatgcacattctcaggcccatatgcatcctactgaatcagaaagtgaggggcagggattgtcagtctgtgttttaacaagccttttgggtgattctgatcgaggcttatacactgttggtgggagtgtagattagtgcagctgttgtggaagacaatgtggcaatttctcgaagacctaaagacagaaatattcaacccagcaatcccgtttccaggtatataccgaaaggaatatagatcgttctattataaggacacgggcatgtgtatgttcttgcaggactgttcacaatagcaaacatatggaatcaacctaaatatttgcccatcagtgatagagtggatcaagaaaatgtggtacacatactccacagaatactatgcagccataagaaaaggatgagatcatgtcctgtgcagggacatggatggagctggaggccattatccttaggaaactaacacaggaacagataaccaaatatcatatattattacttaaaagtgggagctaaatgatgagaacacatggacacatagagtggaaaaacacacaatggggccttgcagagggtggagggtgggaggaggaagagagtcgggaaagtaactaataggcactaggcttaatacctgggtgatgaaataacctgtacaacaaacccccatggcacaagtttacctgtgtaacaaatctgcatgtgtatccttgaacttaaaagtaaaagaaaagttgagaaccctgccctcgtgcttgtcaaatcagatcaattctctataagtgcaaggattctcgaaccttgggaaactagttaaaattcagattctgggcttaaggtgctgcatatttaaaagatcccaagattattttgataagctaccagaaagtattgtaaagcagcaattggcaagtgttttatttaaaagcccagatagtcaatattttaggcttggcaaaccaagaggccacacattctgctgctatagcacaaaggcagccacagacaatacaggaaagggcttggctgtgttttggggctatataaaagaggctgtggggaggatttggtccacaagccatggattgtcaacccctgctttagaatgtaaatatcacccttgattgtgatcctgggtgatttcctctccattcatttattccttaattccacacattttattttattgggtctcagctgtgtgctagacatggactggacatcagagatggactgttggcttcctggcaggatccttgctctcatggagcctgccatctcttcaagtgtcgaggaaattattaagtggaatcaaaatcggttgtgatttctgcttaaaataggggaggtagagtttgttcactatcccaaaagtctcttattctatagctcagcccaacatgctttgtgttctatttcctggcttcctcactgcccaacttttaatgatattgaggcagctttggggggcatttttgttccatctccccagttgcctggaattttttgcaaatggttaacaaagttccgtttaccaccaggctgtagccatttgtgagtcagactagaccagctggttgatacggcacagagggttaggagaggaatctgttctagctgttggtatggagatgctgaaacaccctgcagtctttgttctgccagcgtgtgagtatgcaactgatagtatttagtgaagaagtcttactttattagaaccttttgcctaaatggaaactctaggtttgtacatcatttggagtagttccctgagacctgagtattcccaggatttacacctaacttggtttatatttgcatgcttattggtccagaggatttggcatttccttctcatactcttgaatcacatttaataatagtaatatagttcctgacaattattaagcacacactataagccagacgttgtgctaaataatttcacgtgtgataggaagaataatggcttccctaagatgtccatgctgtgaatatgttgcttatagtgtaaaggggactttgcagttgtgagattcagggtttagtaccttgagattcggatgatcctggattagcaaggtgggaccaacttaatcctgtgaatcctcaaaagtgaagagcttttccaggatgtggacagagaaagatgtgaagatggaagagtcagagagatgcagtggtgctggcttgaagatgaaggaaggagtcataagccgaggaatgtgggcagcctctgaaaggtggaaaagtcaaggaagtggattctcccctacggcctccggaaaggaaagcaatcctgctgacaccttgattttagtccagcgagacccatttcacatttcagaaccacagaagtataagacaataagtgaggattatttaagcccccgccaagttgatggtaatttgtcatagcagcaatagaaaatgaacgcaccatggctgatcccattaaattgtcacaagaacctcaattaagcactaacagtggtcacattttcaggaagaagaattcaaggctgagtaattgtgcaaggtcccatatttatcaagtggtagatgcaggattgggtcactggttccagggccacacttgtactgtaaattcatgtaagctccatggtatgaaactccatttggatatttgacgattcccttcaagtccatgcggcagtgcctttgcacacatgccttcaaggatgctgttgcctcctccaaagagtcacctgcaatctctgctgcttcatcctcaggctgtgttgtgttttcttgggagccctctccaaatttgcaatcaacccacgtggccccttcctgctgtgcatcaagacaccacatgccctatcacagcacttactgcatggtgcggtgtgactttgtgtctgtctgtccactagactgtgagttctttcattcctgcaccacaagcacttcctctcctccaccaggacatggcactatgtctggcacatagctctaaaatgcaagccccatgaggcagggagtttgtccatcattgctatactccagtgcctagaatagtacctggcacagagtagctatatagtaaatatctgttgaatggatgaattattgaatagcagattctcaataaatatacagaggctgaaggttaataaacctgtagtaattatctaaaagccttttgtttatgtttcagtggtactttatggaggcatagcttacatatagtataatgcatgaatcttaagtgtaaagctcaatgaatttttacacatatatacaattgtgaccacacagatcgagatgcagaacattttttaaaaaattgtttaacaccacatgttttcactcataagtggaagttgaacaatgagaatacatgaacatagggagaggaacatcacacactggggcctgtcaggggtggggggcaagaggagggagagcattaggacaaatacctaatgcatgcggggcttaaaatatagatgacagattgataggggcagccaaccaccatggcacgtgtatacctatgtaacaaacctgcacatgctacacatgtatcctggaacttagagtaaaatttttttttattatactttaagttttagggtacatgtgcacaatgtgcaggtttgttacatatgtatacatgtgccatgttggtgtgctgcacccattaactcgtcatttagcattaggtatatctcctaatgctatccctccccgccccccaccccacaacagtccccgatgtgtgatgttccctttcctgtgtccgtgtgttctcattgttcagttcccacctatgagtgagaacatgtggtgtttggttttttgtccttgcgatagtttgctgagagtgatggtttccagcttcatccatgcccctacaaaggacatgaactcatcctattttatggctgcatagtattccatggtgtatatgtgccacattttcttaaaccagtctatcattgttggacatttgggttggtttcaagtctttgctattgtgaatagtgccgcagtaaacatacgtgtgtatgtgtctttatggcagcatgatttataatcctttgggtatatactcagtaatgggatggctgggtcaaatggtatttctagttctagatccctgagcaatctaccgatttccacaccgacttccacaatggttgaactagtttacagtcccaccaacagtgtaaaaatgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttgttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtggtttcttttgctgtgcagaagctctttagtttaattagatcccatttgtgaattttggcttttgttgccattgcttttggtgttttagatatgaagtccttgaccatgcctatgtcctgaatggtattgcctaggttttcttctagggtttttatcgttttaggtctaacatataagtctttaatccatcttggattaatttttgtataaggtgtaaggaagggatccagtttcagctttctacatatggctaggcagttttcccagcaccatttattaaatagggaatcctttccccattgcttctttttgtcaggtttgtcaaagaccagatagttgtagatatgtggtattatttctgagggctctgttctgttctgttttggtaccagtaccatgctgttttggttactgtagccttgtagcatagtttgaagtcaggtagcgtgatgcctccagctttgttcttttggctgaggattaacttggcattgtgggctcttttttggttccatatgaactttaaagtagttttttccaattctgtgaagaaagtcattggtagcttgatggggatggcattgaatctataaattaccttgggcagtatggccgttttcacgaaaaatctcaaaaattttgtttaaatttaagaggtgcaagtgcagttttattacatagatacattgcaaagatatagaacatttctagttccctatgaagttcttatttgctcccttctcaccaaccccaagataaccattattctgaattcaatcatcatagattagttttgcttgttcttgaacttttataaaatttccattctgttctgttataaatgggcttgtatagcatgcctttgttttgtggctggcttcttttgcttcagcatgatgcttttgtggttcattcgttaggataagtgtagaaacctctttactcctgcactctcctagtgatcccccacccctgcacccccatatcattagatgagttccctgtctggagcatgtgaccttctattgggttgtagctgcgtatttccatcagagtggtaaccagagattcagacttggaatgtcttcctccgggaccacagcttcagtgagatagtagttcttggtacatggttgaggcttaataaagagccattaagtaaacgagtacgtgaataagtactgtacttttctaatagtcttttgggtgctaaagtcatacatatattgaatgcttgctatataccaagtactatagtgctgagtattttacatccattaaattgcacgtaaatgacaacaacaataacaaactcgcttgaatggtaaatgttattagctcaagtgtataactcaggaaattgagactaagaaaattacagctgggtgcggtggctcatgcctgtaatcccagcactttgggagactgaggcaggaggatcactttagtccaggagtttgagactagcctggacgacattggcaaaacctcatctctgccaaaaatacaaaaattatccaggtgtggtggaacacacctgtagtccctgctacttgggaggttgaggtgggaggatggtttgagcccaggaggcagaggttgcagggagctgagatcatgccattgcactccagcctgggtaacagagccagaccttgtctgaaataaatacataaataaaaataaagtgtataaaaaagaaaaattacacgttaggaacaagtgatacaattaataaaagatagtctggttgacttcacagcatatgctctccctacctacctaggctgcctcgttttccagttaatttttcatttataaaagaaacaggctaattatggaaaatttgaaaaatacagaaaagcagaagcaagaaaatgtaaaggcatccatatgctacaacccaagaacagtcgctcttagtattttggggtgtattatctttttgcattattttctgtgtatagttttttatctgtttatttaataaggttatgataaaagtatacatgcaaaattatatccaactttttcatgtaatctctacttaggttgttataaactctgtgtctgcaatctagttcattcagtatttattcaactgatatttatgaattacctactatgggacattgttgattgagcccctcctatatgcaaagctcatttttttccttttttactactaggttctactatctgttacctgggccagatagttgggtgtcaacctggaagccacatcatctctgcctttaatattgctcaattatgtggtttcagtgagtttctaggtttgctggtatgtgctatggtttttgtttgtttttttgagatgaaatctcgctctgtcaccgaggctggagtgcagtggcccgattttggctcaatgcaacctctgcctcccgggttcaagcgattctgttgcttcatcctctgagtagctgggatcacaggcatgcgccaccacgcccaggtagtttttgtatttttagtagagatggggtttcaccatgttggccaggctggtctcgaactcctgacctcaggtgatatacccacctcagcctcccaaagtgttaggattacaggcgtgagccgccatgcctggccaatgtttttaattagtacacgaataaaaccacaagaaaaccattggcaagccctctagttctttgggctccttgctttagcacagtggaaagcctgtgtactaagtcagaacggcgactcctggaataaatcatcccaggtgaagagttgatacgttgcacatcggtagcttgggtggcatatttaaatactaaccaggctcactctgcaaatagattgaagtgattccaaaacctcggtgccataacttgattttcagaatcaggtggaacctacaagcctattatgagctcctatggggagacatgcagggcatgaggaatagaaataggaggaggagacagaacatcataatttcgctctaggtttagggatggaagctggttggtgggtcaggggtgggaaaatgagtgaggctttttatctcttaggagattggagatgttttcaagagggctgtgaatcatttgaggctgatttcagggcactgtgacagatgagtgcaaatccagcctatttctctggtccaaatgaatacttgtccttgtaacactgaaaaccaaatatttgaataggaatgagtattctggggtattctggggtagcatggctcagaggctcctagcagttgttcagtgacttaaaagggagatggttgtaaaaatttggggcataagctgaacatttgtctgattcaacataaattagcaccaattctgctcattttgtgccttttccctaccaactcctctgtatttattcattaattcatttatctaacaaatattcactggcaccttctgtacagccagcacaagggatgtatcagtgaacaagcccatgcttgtatcgattttctagtctgttaaggcagtttatgctttagtgtttatttagcacatactatatgtggcttggagacaggtggaggtaaggtatgaagctattcaggttctaatttctgccctctgcttgcaatctggtatgcaaacgaatatatgcaactgaaacctaatacacagcaagcattctttccccagctctctgtaattcctgatagttcactttggcaaagtgcttccatcccatggggtctgtcctagtaccaatttgcagactatttgcttcagaatctacttaaaaatacggatttctgggtcacacctcagacatactgtgccagataaaatccgtgggaacagagccccaggagaccattgctaaagatatggaagtggggttgaacctgtgtgtgtgtgtgcatgtgtctgtgtggtcattgatgggcatgaggagtagtaaatttggcaattcacggtctggtttgccaagaaagatgatctcagaagaccaacattgcccacatcagcaagagggagccatggctttgtggcaagtcagcattcaaggaggatggatttagtagtaagttcaggtcaggctggatgttattaatggcaattatgataacaactaaatgtattggaagttaattgcatgccagatgcttttacatcaattgccaattttaatcctcacagtcgcttatgcagaagttatagttatcttcatttatggaggaagaaggcaggcacagagaagctaagcaacttcctcatagtcacccagcttggagatagcagagctgtgattctaaagcagtttatcactatctctctttcctggtataactgagaggaaagactagagaagcatgcacaatcaacatggaaaacaagccaaccgtgttctttggggaagcccttcatatcagtggccaagtgttgctcatgggggcaaccaatgtgaaaaccctgctgaaaaccaacaggcagaggcccaggtgatgttcacctgcccaagtctatagaagagttctcaggtgaggttcaaagaggtccaggaaatgcgagaaaccaagcccttcagagtcatcgaggggcatctttcggttgttaaatttcccaattaaggaagagttgagatagccccattttgacgtgctttgctgtggttggtaattctggccctattgctaattatgatgcgatgacatcatttgggtaatctcccttcctattagaagctgcctcttaggttttatatttgctttatttccactactctggccacccagtgcatgcagagaacaactgtggattgtgatattgttactggtaatgtctttcaaagtgaattggggtttcacatgggaaggcatgaaaaaagtttattaaaggtaccacagtatcaggacccaaatactgaagagtgctcgcagaagtgaaagagcttgttcttccttgggtggtccatgagatagggagtggctgtgtcccacagtgagagcagccctgtgtttggagctcaatcctatatccactgtgtgtgtcctgaacatgggcagctcccttaaataatcttccctgagtaaaattaggggctggcaccagatgagtgccaggctggtccccctggctgagaacaagccctagggagatagcacacagggccagagtgaaagccaagggcattcccagggtggaggaagttaggagcattttgtgatcacagagaggcagaggtatgctaataagggaattaacaccttttctctgattagcagccagggaattattgaaagggattagatagaaactgtgaaaagattcttgggcaactgagaggtcagaggaaggtaatagcctcttctttaggtacaaaggaatacaaatacattttattagcagagaaccagtctctttcaccctcaccccaatggctatcttaaagaccctcacacttgcctcctatctgggtacctttgcatatgaagcaccttctttgcaagaggcattctgtcctctcctctttgcctagataacccctactccagcatctcctgtttggagaagtcttcaaccatctaaattgttctgtttcccccattgtgcattcttaatgcaccataagcttttcttacaaaatgtgaatttcaatggcaattttacacgtgtgtagttgtttaattaatatttgtcttttccatctggatcataagctctttgagcgcaggtttcatggctgtttttgttcactactggattctcagccttcagcactgtacctggtccagagatgaataaataataggttaaatgaatgaattaattaaagacacagttaagtgataattgacatctggctcactgtgcagttctagaagttggtaagattcatactatttgtcattcctgtgaagagactgaagctctaaagatcagtgaaatgaagtgagtttcctgagacacacggctcatacgtgataaaccaggacttgcatagatcccctgagaatctgaatttttattcacctttgctttttaagtatgggtattatgtggcttataggtagaggtttaaaattttttaagttaaaacatgaaaataacagaaacaaaaacagaaaacacaagaaagcccacaggacagtggattctttccaaacatctcacttcagtggcagctacatttgaagaaagtctacttgttgcatttaaattacctgtcacaaatcacagtgttcacccagtagcagctaggaggggctgattcaagcccctgagaattgttttgtgtcttgatcatgagtccgaacaacagaactttacaaggatgttgcaagccgctttaaggggtgatggaaccaatgataggaaccagcacctaacacctggcagagactttgtcagcgtgatgcccaagcccctggggatttctgcccaaaggtgatacagcctgatgggtttcctggtttgttgaagctggcggtgagagagagtttgaaagaaatgacttactcgatgctgtgtgacacagggagctcattcgccttgatgcacttaggcaagctgcctaacctcattcaaaacaagccagtaaactagtaaaccaaaacaaaaccaaaaatggaattaggcttctacagtgctggagatatagtgattagtaagacaaaataaaacagcacacatagcccctgcctttctggacaatttgtttaaatggtggacacatacattcatgaaagcagtctataaatcaatgttgattaacagccacattaagtactatgaaaatattaggttggtgcaaaagtaattgctgtttttgccattaaaggtaggggcagtaacagtaatttacttttgcactaacctaatacaagaaagagcatggaagagcggaaatttgcctaatccgtgagggtatggaagacatcccttaggaaatgatgatctagaaatgaatgaaggaagaataggagttggacagagaaggtaagaacagttcaaggaacctggaacaagacaagcaaagtctctgtggtggacacaaggtggccgagaggtcattgcatccagagaggagaaagcaaggtggggaggctgtgatctgtgacaagactacatatcccattggtatccacaggccatgtggtgatttgtggtatttgtcctcagtgacatttgacactgaatggtcagcactgcagtagtggtaagctcaggctgttgagagagtgaaaccctcgccttgactcaggcaaatggctgcaaggatttattgactgcccatggggatgacaccaaactcatccccaacttcagacagtctgtagaataagtacagtctgatcccaggtgatggaaaccacatcatcacagtcactatgtgcataataactgtggagtaagcctaacgccacttggtacaaacttaccactcaacataatgaacataaaggacgctggcctggagaaaggaggactttgactcatattgaattctggattcatcccactgcatgacttgctttgtcgatgcatttcatttaagtctggagaggacttgagtgccgggtagagagatttatttagaggcagaaggctcattaaaatcccaacctttttgttttgttttgttttaagccaggggtacctctaatttgtggcctgaaaattttgctcggcaagggattgaaaaatggagagatgggtttgtatgccaggactgtctaatcaccatcttgtgtgagctttagaaaaggactcattctgcaggctattaatgaggtgagtgtttaatggccccttgatgctcccccatcagatatagtgtcttgagtttttaataagctctgttctgggtcctttacaaatcagagtgttggaacaaatccttgaggagacatcaacagcaagatgatgcaatgtgtgtgagctggaaagagcagccgtcttaactccagagagtgtctaggaatctgtctatctcaatctgccgaccatgtgcacatctaattttcacttcctttttgttctctggggaacaagacacacttagattttacgttttctctgtaaggaaaaggtgatgtccggggtgaaaaactaaggaatcttgttcttcaacattgaaggtatatcgcaagcatgattttggaattaaaaaggaaaaatgttcacttcgttttcctttagcatgtagggagttattttaggatatcctgtgttttctggcacaagtttctctgtctaggacagaaggattgacttagaggacattggggaatggggaaaaaagaaagcaggaggaggagccccctgaccccagtttgaatcccagtattcagagaaattcttctctatacctctaaaatactgttgtgtttgagaagaagcatggggcagttggaaagtgttggaacgtcctccactgtcccctttactacttctgcctccttcactcctctggaccactctgaggttgtgcttctacctactccacttgccttaaagtcccaggtgaacatctcactgcaccacacagcagtacctttcagcctttgtcttcctggacactagacacctttcacccctgccttcgtcttcaagctctctactcccgtggcttctaagttatcgcattccccggctttctcctcgtacctctcctacattccttctctgcctcttttccacacacactctccttcttttgttaggggatgccatgcacagctgtcaacaactaccgcccccagcagatagacaacttctaaatctcaagcctcagccctgacccctttctcatcttcagacctgcctatccaccttcttggtggactccctgcagggaggtttcaaaagcagctaacctaaacctgaattccatatgcatttctctgtccccctacctatactcacttccacccttgctcactcattcattcaaaaaacatttacagagtggctactgtatgtcaggtacaaggctaggtgctggagctacaattgtgaggaagaaagcagggtccctaacctgttctccacttttgtaagtgacatcaccattcacttggcaatcctctttcactccccaatctccctgccaatccgatccatgagttgccaagaccagttgaatgtacctcctaaacatctcttgaacctctcttttgtgtatctgtattgcagcaatcctagttcagatctttctctcttttctggagttgctttagtgagatttctctgggcctgcttttctgccttcattcattccctcctccaagcccttcctcatactcaagctcaagtggtccttcccgaagataaaaacttgctcatgtcacaccgctgctaaaaaattctttcatggattcttctcgtcaaccccagaaagcattaactccttgtctctttttttcactccctgtctgtgtctctccatccttcctcctttccatgctctttcttcctccctctttttcttcctttttccctttttctctcactttcttgttgcctgactttctctctttcattcaataattatttgaatgtctttaatccaatcccacagatataagcattgagttcctctctgtggcaggctctgtcacgtgtacttgggatcaatgaacaaacagaatatacctgacttcatggagcttatattctatcaaataggacattgaacagacagaaaatattaataataagcattgtaagtaaatcatatgagttatatggaacgtaaaggtgacagataactatggaaccagattcaaaggtatttctcattgtgagccagagaggcatggacctaccctcgggccctgcctcttcccctagccacacacttctctggctcttttttctttttttttgcatgtgtttcttcagcactaagctgctcacattcccagtgggtgccatgttcttcattctgtgtgtctctgcacactgtctttgtacactgtcctctctgtactctgtctccagacctttccagcctgtgccaagttgccctccatctacaaggacctcaggggtcactgggaaccctttcaccctctcttgctgggttgggtgggtccccttcctctgcattcccttggtgccctgagctttctttggccacaactctcactactggagcatgctgagggtgggttgagctctgtggctccatgactttctttctgggtgaggcttggaggccagtgaaccctccacacttccagccttaattttctcaggtacaaagtgtgaaggagagccttctatttatttctcgtggttgctacaaagtttgcagcaaatatgaaatacccaagggtgagcggtatcgttgggggctgggaggtcactgggcagtgagtgtcagggcttctctgtcctctgagccctgaggaaggagtgccttctgtgttcatcaacactggagaagacaaacttacctgaggttgaagaacacatgggctgacttgggctctcgcctgcaaccagctctgagtgtgatgggagccaggaagccctggggctcagcatgaacacaaatggaccttatttgattgtgtttttctcctttcaaatagtaatttggacacttttcagaggctgacattcaatttctttttctatgtcacttcggagaaaaaaacaaaccatcatttttttctgttaaaatctctcccttttccaccccttgtttatgctcctaattccatttgtgctcagagtttaattgtaatggtgagctctggtcatattagttcatcctcttcttttgagctgcaagtgggtcttggacaggctgcccagcttagtacttgctgaagagaacaaacagatattagctttttgacatgcacgcctgtgcgcacatacacaaacacaaacacaaatgcacccatgagaatttagcgttgctctgttaaaggggcagatgatattctgtatttggtctgctggtctccaaagcaatgagaggtgaataaatcggatgcccataagatgcttatttacataagttaaaggatgctctgtattgtgttagcttcagtggggggagtgatttgcgagcagaatattatgctccaggaaaacagtgcagattaggttgctaaatctcctggcattagttcagggtgcattcttctgctgtggatgcattgcttccagaggaagaagctggtgatggaggaagcactgtgctggggaagggttgatcttcagatggtatctgaatatatgggagaatgaccaggtaaaggaaagggagctcacaggttaagcaccgataaggagggaggtgcacgttgtcagtggtgaagagcaagggttttggaatccagtaaaatttaaattaattagttttgacattagacattaatactaccttcttcatggggtttcgttaaagactgaatgagataatgtggaagaaatgatcggaatgcaataaataatcagtaaacagctactgtacatgagctcatctgatctatgaagttggtggaaattgcttttcctgttttacagcctaggacacggaggcttaaggggttgagccagtttctcaaggcaacacgggtagcctgtggaagaactgaggtttggacctagatgtgtcttattccaaaatccttgcgccttccactgcactaagccatctcccatgatttggctgggactctgctcctgcaaagcaattatagctgtcctgtttgctatctgcttagtagcctcattagagaaggctgtcattgtagcctattcaagttgtagggctctgcaaagtgagaggggtgaaaatgatgcttgcaaagcttcctgggagctttggatacctagaaggagcaataagatgtgggtctccaggtacccacatctgatgggtggtgacctcctccctcctagacccttggtagtttcttttttctaccttggctagggcctcaagtaaccatgaggtccaagggctccctagggatcctctcacaccacctgcaagactaaagatacctaggaaaagctttaggtgaggatatgtagctgggagaggagaacacataaaggggcttgggagtgggctagagattaggggagggaaacagtctgtccctgtgctcacaagagccctcagtcatctctgacagcagcaaggacatgggctctttttggaatcaattcctttcctgggttttgatagagaaggaatccactttgcctgaatctgtttggttcctgaatcctagagagcaagtaacaagggttcagacagtgaagaatgccagcccaaccctcctcagaattgtttattactttcctgccttcagattgtgagagtttgggtagcaatggattctcacactgcagacactcagttctacctctgagccccctcatttcacaccccctgttcatccagctctcacttataccctgccctctctaacccatcactgtgctactaactcagccactgcctttctcactggatgttcgtttatttcttcaatctcttatacccacaactcatgtcacatccacccatccgtccatctgttcatctgtccatccatccatccatccacccacccacccatccatccatttatctgtccgtccatccatccaaccacccatccatttatctgtccatccatccatctgtccatccatctgtccatctgtttatcccatctctccattcatccatccacccacccgtctacccatccatccatctgtccgtctatccattcatccatccattcattcattcattcatcctcccaaccatccatccatctgttcatttttctcttccgtcatccatccatctaccctatccatctatccactcatctgtccattcatctgcccacccatccattcatccacccacccatccatccacctgtccatccatttgtcctatttgaccatccatccatccatctgtccatccattcatccatctatccatccaatctattcatccgtccgtccatccatccatgcattcgtctgtccatccattcacctgcttacttataccttcactgaatgtgttctcagctccccatgtactgggagctgggctgtgtgctattactgtacagatgaattagcattaatctggttgcatggagacagctatttaaatagacacctaaaatacctggtgacgattgacaatagagacctggacagtgtgttctgggagcaccgtggaggtggaggggagagaggaggcggcagctgtttcctatttcctcagtgagctcccacattagtcccctacctttcagttcatggagctcttgctcattaccctgttacagataccccagctcccctccaggtaattagaaaactgccaggtccattttatagatgaaaaaaatggaggctcagggagacccagccacttgcgtacatttgtgagctgcagcgctggcatgcagagaagggtggctatgcataccctggggtcattttctttgcttggcagatggccatgggcaccataggactgaccggtgcttccttctctctctgtgctcttctcgttcctggatggcttcagttctctcccaggagtgaggcggttcaccccagggtggcccctcttcctttactcccatgcagtatgttctgactcataactgaaagtgttttgctggataagacgatggggactgacaggcatgacatacctgtgatatacctgaaggaaacacacggtggtgagaatgttagacatcagacactgtcttatgtcattgcctagtcctccctgggatggacagaggtcacctggcaccaggacccctgggtcagaaccatcactctgagagatgcttgcagcatgatattgggcatgccatgtgacttgacctctagaactttgctactgaaagcttggtccatggactagcagcaactgatgccactcgggagcttgcttgcaatgccccagcccccacccgctgtgttttaacaagatccaaggtgattcttatgctcattggagtttgagaactgcctctctctaagccccaacttccttaactgtagaatgggaatagaaatattccctgaaacattagtgtgaggattaaataaatgcacttgaagatctctgtgtgatcgactgattgtcctgatttgtccaggactgaaagggttcctgcaaagcggaacattcaggtttaacattgggatgggttgtcaacctgctttcacctcagtgcttggcacgcgataagagctcctttgccatggtgctgcaaagttgtgtcatttagaagacgtggaaaaaagccacaggggagctgtttgtatttgcattagtgctgtgtttgtgggttgtagtgttttgggttttgttgctgtcattgtggttgattctttcttgattacaacagccaccataatcacagctctcattaatggagctctcggtatgtgctcagagtaatacatgcattatcccaatcacaacaacctctttaaggtagggaataaaattccctccatttaaaaaaaaaaatgagaaaatggagcctcagagctagtaaggattttgtccaaggcccagacaccagtaagagaaagagctgaaatttgaaccctctatttggtaccagtgtctgtgcctttgataacaggaacatacagactcccaaagggagaagaagcaatttcttctggaacttgagcattcagagctgtttggagacatttctttgagaacactgggatatttttgaaatggacatttcgacgataatgtttaccaccagggcctgcccctagcaagtgttatgggaaagcccaagacactcctttttattgcagaaataaagctgcttccttcagttcagcagcagctcctctatgtatgatagccggagacgaaaacttaatgaacgggactggtttgctttttctctttgctggaacagcttaatgataagcgattattattggtggcaacttgtcatgtcttaagtcttggtcttggctgttgtggctgtcagagtctttgagaagaaaccaatctcagcacatattagagaaaaacaaaaaacaatgaggaaagatgaagagctcatgcagggaaaagtgagatttgtgaagagaggtgggtgtcccaggaaaaagggaagaatgatgaagaaaaagagaagaatggtaagaaaagggaaggatgatgaagagagatgcactaccctgtagtttgaattattctgattcaagttcaggaagatgagttaaacatgttacattatttttttcctagccaaagtggcatcagtaatctttgattgcaagtgacagaaaagctaatcaaattggcttaagcaaaatgaggtaattaattgggacatggaattgacaacaagagaatttgtcttcaggtgtggcttgaacaaggtgttcaacatggatatcagaacttggtaactctcgatcttacagcttaaactttgggtctgatagctttcttcttaggatggtatatagtggttgggtggctgccagaaattctggtagaacatccatccaagttcaagtctaacagtaaaagaagctgtcttttcctagtccctttcttcataaatccagaaagccactctgattagatcagattaggaaatgttccacccccgaattaattactggcactatgggccaattggcttgactgagagagaggaaaatgagggctctcagggggaattcactattaccagtaaaggaagaacagatgctcagtggtcagaataaaaaatatccaccaggtggctcagggaggcccatgcttcatgaaaaaaaagggatctgaagaaaatagtttcagaggcacagagaaggccaggggcccagtcacagttgggacttgcaaaataaagctgtttccttgtgcttaagtttatcagctcctcagagacccaaccccatggtctctggtccagtaggatttccctctggctttagtgggaatcaggcttgctttctgtgtgagattagctggacctagccccagacaatccataattgctaatgaccctgtttggaagcgtggagtcagatgctcacctgcatgttgacagagcaccaggtaaagccagcttgggtctttgctgtttccttgcataacaataagggtctgaatctcagcagggcctccttttggccagccctgctaatgatctagaaagcagggctgagttcaagagcaatgatcattgtgtggtcctaattaatgtacagtatattgggctgtcctaaatcagctgcaacgagaatcaagaaatacatttctccatgcatttatgtgttctttcctctggcattgtggacttgatagtgggaaacttggctctgggtggtaaactgggacaaggtctgaaattcccaggaaaacatggaagttctagccacaatatttgaagttagagtaccagttgactaaatgatatagcaaacgaaagatgctggctgcatctttcaagtcataacctagcaagtgttatgggaaagcctgaaagactcctttttattccagaaataaagctgcttccttcagttcagcagcaacccctctatgtatgacagcccttctatgttagtcaatgtaggcttacctattggcacagatcagaattccagagggaagaacagggttatcttacacaaaatcccccaaattccaggtttctcccaggttccctattgggagacactggtggcacatttagcagaggagttgtttgcaatacagttgacctaggaattagatacagactccctatcctgactacagggcattcattgtgtgatgtggcctttgcttcctgtcctaactcatgtctcaccactctctcttgctccttaaacttcagctgttctgactttccttctgttccctgaacttgacgaaccctcgcttaccttggcatatgtgtcttctgctggaatggctctccctactctcatctcgcccctaatctttgcctggatgactccttcttcatatcattttgatcagctccaatgtagcagatcagatgacctagagtggggctcctctctccaccccactcctgaactatgacatcatttgatttccttgaaattattctattttgttttattcaaatttttaaaatttgagatgggtcttactctggggttggccagactggtttcaaactcctggcctcaagctatccttcttccttggcctcccaaagtgctgggattacaggcatgagccaccatacccggccaattgttctatttattgatgtccttctttgtttgtctcctcccctaagaatgtaaaattcatggaatcagggtccttcactttggtagcctccttccctagattcactttcctggaacaatgcctggtacagagctggagtttgttaaatttgttgaatgaatgaaagacaatccacggatgaatgtctctttctagagtggtaggtctggcaggtctgcttaagtacatagagcatgggatcctttcctgcccacgggcagtcttgcactctaggggggatgcttgtgccagtttccttctcaaagaagtggtccagcagtctgcaaggtgctgagcagaagtcaggagggcacggtgccctaccctcaagaattgtcagtctgaaggacatgcaagattcacacctctccgcaactaggcaaccacatacgatccagattaaaatctttaatgcagggataataataagacatcccactgtatgctatatagagctacatattggatatgcccaagagagatattggctatgatgatggtcatgatgatgatggtgaggaggaggaggatggatgtgatgatgatggaggatgatgatgacagaggaagggggagggaggtgggtggtggtggagtagttgttttccagtgtgaccaattcagcttatgtgcacgtgagaatgctatccatctgaatcctcaggcttaccaggcttatttgatgtttttacttttcctctcacccctggaaattgaaataaaatatgttgaaatgctcagttgatacactatgagagtaacagaaagcacatcagggcttaccagggctcacaagggcagtcctcaacaggagaatgcaaattccccaggagtctctctggatcgttgctgagttacctccattatttccttttcttggcagacagcaggaaaataagttgtggaaatgggtgtggggttgacaatagtgaccaattctctcatgcttcttgggtgtaagcctcctgcccctctcatccttccccaagtacttatcaggcccctagtgtgtgtcagacattgtacttggctttaaagatactaacttgaatacctacttctcaaccatactgctgttgagaagagacagaggaaaaactaataaatcagctttaaagttcagatactcaggccacagagattccctttcaatcagacttgcatggggcacaatgcataggttattctttgataactcttcaagggattcatatgtgcagccaggaatgagagccactgatgtgagcaagggaaaactggatgcatctcacgatgactgagctgccatcaccatggggccatgtagatctcagggaagtcatttaacctctcatcctgtgtctttaggagaaatgccatccatgagtgttatgccacttgcgttatctcttgagtagttaggatcaaagagataatgggtgtggatgggctttgtaacctttatgaatgggtaaatggaatgtaagttgctattatgctctaggaaacaccaggctttggtacccatggagtcaggtgtcaccctggggaccgagcaagctctggaacattctggaacaggattgaatgctctagacctgattgaatgagtcctcagttatgatggtactgaaacacagagtctagagcagacacccagaatcccacaccctcctgcctccctcgctctgtgtttaaaacagtttgttctgtcttccgcagagcagtgagcatggggagagaagtgcttttgcttcagaaccaaagtgggtgtatgaaatctgttcctctcccccagctgcacattctaaggaagccgagtgccagaggtggtcagaggctgatatgtagaatccgaaaaatacaggctgagccatggcaggaggaggtaagtgcaggagaggtggcctctaccatcaagacagggagtggaaaggatgttcaggggctttgggctatttggcatattggacgccaggccctgggagtgtggccagattccccatcatgtcctgccagttcataaaatcaccttaggaaatcccaaagttaaatgtgagcctcttcattgctctgctatgcaattatattttgcaaataggcccttgcttctgtccctccaaggggtagatgatgcttttggtccatggtggtttttgggttgaattttaagataccaatagaaatgacagtagtacagggtaactgcatgatgcccaggaaggacattagggatggtttctctccaaagcatggattcattgctgtatggaaaggcagtttcttctttgcattatacaggctccttgggctcagaatgaatgagctggtttgcatggggtggtggggatttgaaaccagcatgtcagtggacctggagaggccagttcttgaaataggatgaggaccctcttaggtttctgacgatgtctgtgtggtctgtaggaccgaggatgtggagacaagcacccaaactgtcaaagtcaggcgtggacagatgagtctcccacttctaccttttcatcccattctcacagcagacccatgtgatggaagggtcattattcctatcttataggtaaagaaactcaggcccagaaagattaagcactttttcaaagccacggggctggctaggttagccacagtccctcagaggcaggacttgaatttaggttcaatagaccctagagctcatggtatttcaactataaagctggtgcacatagatgggtaggctagggagtctgaacttaacatggtaggcctatgggagctattgatgactatagagcagggcagtggcatggttaaaggggtgctttaagagtttcaaccaggcagctctgaacagggtgagttgttgagatgctccaagtccagagtgtggattacctcttgcaaaagatagcatgatctcctgatgtgaaatatttgctgaatacttcatacttgatgggcactacactgggtgttttgatacaagagaatcatttaattcctacaacttaatgaggaagcaccattattggcaacagcagagtgcagaggtaaaaactcgagaccctgagggcaggcaaacctgattttctacctgtacgaacctggaaaaatcaccctacttctgggtcttttttcatttgtaaaatgggcatactattagtgccaacttaataaggtggttgggggtggcattaaatgagatagcacctagaaagtgaggagcaacgtgactctcatagagtaagtatttctagcatgtttactatgatcattattaccatagccacacccattttatagatgagaaaactgagacttagaaaggctgagtgttttttttcccccccatccaaggccacataatgaggattggagctgggtagtccaaccccagaggttctagtattctccattttctgcagagaggctgcgaatggggatcagcatagtgggtaatgggagagattcagcttgggctgaagtttggcatgacagggggtggagacagcacaaagcaagggtttttgcacctactctttcacagatggcctgtgccgagctggctctgggccaattaactgctgtccctccaattatctttctcctgaggaagttcacagtgcagccatgccttcctctctacatgtagagaaccagataagatgcgtgtgcttacagctttgctctgtgcacagaccttttcatgggtaccctggtcatgtctagctcagagtacatagagcaagggtgttggaggatcccacattccatcaccatctggcatgtctgacctccacctctccaccagtaccaatcttcccaaggaagtgtctcatagaccctttttattaggttccaatggtgcctttagcgtgtgtcttgttgagagctttctgtattccttgtgtacttagtgcaagatgctgatccaccaccttttgcagtcagaaggtaactctggtgactggcttcctttgaggcatcatttacatgggagctatcacatttcttttgtaatttagaacatttttgccccatcccaagaggcgtctcacagtgtgtgaggttggcgaatataattgcctttagactctacttctgtgttgtcttctgttggtggttttttttatcttgttgccctattttggcattaatgaagttctgtggacaactgctgaggtttataggtcttctatattctcctctttatcaataaaggatacattgagatataggttgggtattggatggttgggtagttcctcagggtaggaaggtgtaggtgatgatcttgaaggttttgttttgttttgttttggacacaatattcagaatccacacaaaatacaatctcagatactgaattcccattctttccatttctggtcttaaccaaggacagtcctttaggcttcattcacatcttcattcccttgtcatccacttatgggtgtgccaagacttctgccaggttctggggacataaagatgaaaacaacaaaaatctctgcccttgaggagctcacagtcttgttgagatgtgatttaaaatggttaatcaattcaagaatattagatttctgcaaaagctactgtagggaaaacaataattatccaaagtctttaaatctattacccactttaattaatttaattaggtaaaattcatggaactgcaatgttggaaggggcccagaagacatttattcttgtttcttctctgccttcaggccatgcttcactcaaattatcccccaaacccatgcatttcagaaaagagcagtatttcgaagaactatagcttttggcccattctgatagaacttttagtgagcacccacagggaaagtgatgtaaacttgttgaaggaattgacatgcacagctacaaagtattgttctgaaaaacatgaatggaacatccacctttcacacacacacacacacacacacactctctctctctctctctctttctctctctctctctctctctctcagtggaatccccataagttatcttgttgaggttgtgttcaatactcatggtaaatacagaacgcaaaataaaaacatggctgtaatatgatgaggaccttttgataattctttcagttccctgaaagaaatacatctcagcacttctcaaatcctgttttgctctaacacagaggcataccttctgtttagttggcatttttgcaccatgtccacaagtcaacaacgtggtttaagcatctgttccatacagatcttcagtgatcccaggaagactgtgattgagtgtcagaaagggggcaggatgcagagtcatggcactgaggtacagatgtctacttgctctgtgactgttttgagcctcgttttccctgccagcaataccaactttgtaggatcattatggggatttgatgagttagggggtatgaaggcagtttgtatattgtaccactgtatgcatcacctgccttttctaaatggaaatttgttctcacaatcgtagatgggtggagatgttagggctaatagaggccctttaacctgacataagttaccatgccactttctagggtgagagcattcagtgactctcccttatgctctgaataggccctatgtgcttggatttctgccaagctcttcaacatcgtatcgtccgcctcctttcggtgccatgatgcattcatctacagcttctgagatagtcgcagtgcatcctcgggattcctctgactgtaacatccatgcacttctcctcttcctcacctggattctccttcagcacttcatatacctcttttagctcttagtttgtagaagttgtcttccacttaattcttattaagaacacttaataaggtgttcgataaatatttgttgattgaaaaggtagatgtccacatggtatttatgatactctgtattatgtgggagccgtatgttcaagtgacagaaaccctactcaaactccttaaatgaacatagaaactcactggcttgtataacaaaggggtccaggagaaatggcttcatacttggcagactctaggggctccaaatatatcgttagaaaactgtctttgctgatgctgttttatttccgtggcttgattttccggtcatgagctggggtgggggtcagatagagtttgttctgttagaaccatatagactcaaaggaggaaggggcaggacgaactagaggaaaatgagaagaatagatgataagcaagcaataattacagacatccttccaggacctggctatgagctcctgagtacaggggcttctgtcctctctgtatttgcaggatctgttctggagtctgggatatagtagatgctcaggaatgtctgcaaatgattgatgtgtgatttactttccttacttctaggacgcagtttgtgcttctatataaaccacctcctgcctcatcctctgttttactttcttttcactggcaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccgtaagaaagggcttgttgtctcccaaagtgggatcagagttttgctgttgtcattgtttgcttgcttacatactcattgttggaaatacgcactgaaaatgcagaatgttatgtgtttacttacgggacttttattttgctctcctctctctttctttcatctcctttgtaagaaaagtcacattagactttgtttcctgcaacttaacttttttttctactcaacaatatatcttggaaacctacacctgggattgatcgatctgtctgtctgtctatggctgtatctcaagtgtatctatattttttgtaactcataaagatttgaacccagataagtctaacctcatagccctcatcacattcttcactatgatatcatggtatcatgatttagttatccagtctgcataatggtaggaatttacgagttaattttcttttatttaaaaaaattttgtgggtacatagtaggtatatatatttatggggtacatgagatgttttgacacaggcgtgcagtgtgaaataagcacgtcatggagaatggggtatccatcccctaagcatttattctttcagttacaaacaattcaattatattctttatgttaaaatacacaagtcatttattattgactatagtcaccctattatgctatcgtatagtaggtcttattcattctttctatgtttttttttaccctattgatcatccccacctcccgccccaacccccaatacaaaaatgtgtttatttatgggataagtgaagtattttggtacaggcatacaatgtttgataatcacatcagggtaaatggggttttcatcacctcaagaattcatcatttgtcttataaacatttaatttagggattttgaagcttcctattagaagctaaacagctgtgataatctttatacatgtctaagcacatgtgcaagtgttttttctagggttgattctaagatataggatttttgggtcctaattcatgtgcatttttaaatggaagcatctattgccagattgtcctgcaaagtaacaacaccaatttatagtcacaacaacagtttgtgaaactacccagtttcccacatcctcaccaacatgttacgctttggggaaacttcccacactagtgctcctggtctctgtttgattttgcatttgattttttcccttcttatattctaagtatttttgtaggccattggaaatcttggcaaacattactcacagaaccgcattatattccattatgtgaatgtatcataatttatttagctactcccatcttggcgaacatttaagttaaattttaggtttctgagaagtgtcattgttccttgtggcccatcattatggttcagctgttgagatttagaatgatcactcctatcccaattttgcatggttttgcctgatgttcactgatttaatccacgctttattcctcagataatgagcagtgtagaactgtgattaagggcctcaactctggagttagacttgtctgggttcaaagcttgtctcgtccactttctgtatgacttgcacatcattttacttttctgggcctcaggtgtttattgcaaagtgatgataatagcacctaatttctaggcagtggttctcaagcctcagcaggcatcagaatctctgggaggacttgttaagacacaaattactgggcctcaatctcagagtttctaatgtaatagaaaatatggggtgagcccagagaatttgcaatttctttcaagtttttgggtgatgttgatgttcttggtctaggggctgtgctttgaggaccaatgttctagagattgtcatattcattgaggtgccgcatgaaaagtactgtttagcacggtatttaccacatagtaatactaaataacttccagagtgatcagtgaagtttttggtcatcagaaattacagtcagcaggctgggtgtggtagctcatgcctgtaatcctagcactttgggaggccgaggtgggtggatcgctggaggccaggagtttgagaccagcctggtcaacatggtgaaaccctgtctatactaaaaatacaaatgttagccaggtgtggtagagcatgcctgtgatcccagctactcatgaggctgaggcaggagaatcacttgaacccaagagggagaggcagaggttgcagtgagctgagatcgcaccactgcacttcagcctgggtgacagagtgagattccatctcaaaaaaataataataataaaagggaaatacagtcaacaaaccatgttggtttattaccagcagggtactatgtcactctgaaatatttctggaaggctttaggactttgaatctgctacagttcagaggttatctctgaactggggctggaggagtgtgtgtgtgtgtgtgtgtgtgtgtgtgtgtgtgtgtgtgtgtgtgatgaagtagacagaatatacttcttacaattaacataaatctgaaaaatgaaccttgaattaagaaatcatgctcctttgacatttctccgtcctctgtccttttactctctttagtaatcctgtttctacactgccactttcagcattttaaataattgtccagatatcaggaaggaactcagataaatcagcatgagacatgggagtctcttacagaggcaggattgctgccagcccaaagacacaaacgaggctaatgaattctcacttccatcataatatgtgccctgcagctggaatattcagaaacatataattttgatggaaacataaatcaattttagggcaattgaaatataacatatacaggaaaaggaattctagaaggataattggcaagacatttagatccctttccagtgaccaccctggattctatgctttttttaaaaaattctgctgctgtgaaatgctgttgcgcaatttcccaaagttacgcctttaaacacagtaattttgtaaatggtatttcagccccagagaagcaatgcatcaagcgtggtaagtcgccatccactgcttggtgtttaatgaaacatctctccatccatgcagggctggtggtgtccacccagtgtgtaagtttggataaggcacaagcagtctctccttcccacactctcccacggtccctgacgcccaccccagggaatagtggaaacctgccaggctgcccttgacagggagctagagaaaggccaaagaaagcatttaaaaacaaaaaaacaaaaaggattatatctcctttttttttttttttttttttttttttagacagagtctcgctctgtctcccagactggagtgctgtggcacaatctcggctcactacaacctctgcctcctggattaagcaattctcccgccccaccctcctaagtaactgggactacaggtgcgcactaccacatttggctaatttttgtatttttagtagagacgaggtttcaccatgttgtctaggctggtctcaaactggtgacctcaggtgatccacccgccttggcctcccaaagtgctgggattacaggcatgagccaccacacctggtcaaggcactatattctatcctctgtctatcattgcttccaaccaacagactctgtgctagcccctgggatacatagatgaattaagatataatttctctcctcaaacaccatacagtctgatcaaggtgggggaaatttatctaaagacaaacttaggaataagaattctttttttaatattgaaaaaagaatagtacagaaaacaacagaatctgataaaatactcaacccgatattcatcatagggaacaaagctaaacctgccaaaggttaatgtttgtttcaacattttgaaagcaataaaacattaatgataatgtagaagttctgattctatctgtttccctgtcccagttttctcctgttctctccatagaagggaaaacatgataatcagtttggtttacatccaaatccatgtacatgtgttcgtactttcaatacacatacatgtgcaaccgtattcccaatgcatacttctgtctaacgtacaaaaatggtgtctaatgtgttagaacttcctttacctcaaccttatgttttcaaaatccctctatgaagataattcaattgcatttattttattgatgatattctgttgtataagtgttccatctttacacttacataattcctctttgatggacatttaggtttttttatagtaagatatttttcagtctggatagctgaaagcagagaacagacctatctgtagcctgtgttagatctaccagcttgttcaatagaagcccaggactctggagttaggagttcttcacttcaagcttaaaaattacatttgcagctggattaaggtcttactctgcaaagcatctgataaacaaatagctctcactattcctcctatgtagcagggaggttgcaaatagctccagaagaagttcagatgaggtcatacctgatatcttcgtggtgagttactgaggggatctgggatccagatttgactggttgagaacaaagtcatggggccagctagacatgccacttggtggtcctcatggactttatttataatctcaggcaaagagctggtgcagttaggatattgttgctcatgggctgggcgtggtaccaggggctgcttgcaagggaaggtatgttcatgaccttacacccaaccgtttctgtacatagagtttcaggcaaaaaaaagtacaggaaagggggacattttcttcatgtttaatattcctgattttacagaagacactttgaaaagagcagtcagcattttccaaagtttaaaaatagctcagccatgttatataacctccttgctactgcacagttattaaacatctgttccttcaccaagcacagaccatgtcactgttaactcccaaaattgtgaaggtaaaccatgacctgtttggctggtggaatcccggctgttgtgtccggttccatcacaagaatctgtccagttcaggagtggccagggccccctgggaggcagtggcatcacggttaagagcatgggcactggggccaggttgcatgggttcgaacctaatctgtacttttttagacttcggaccttgggtgagtcactgaactccacgtcggctccctcaggtgtaatatggggacaagaaaagcatttgcatcttagaccagtgtgtggcgtatggaaaagcagtctgtaaatggttactactatggatgaaacttgtagatctaaagttattaggccgggcgtggtggctcatacttgtaatcccagcactttgggaggctgaggcaggcagatcacttgaggtcaggagttcgaccagcctggccaacacatggtaaaaccctatctctactaaaaaaaaaaaatacaaactttagctgggtgtggtggtgcacgcctgtagtcccagctacttgggaagctgaggcaggagaatcacttgaacctgggaggtggaggttgcagtgagctgagatcacgtcactgcattccagcctgggcgacagagcaagacccagtctctcaaaaaaaataaaataaaataaaaatgaaataaagttatgagtgaagtaagtgtctcttcatgccatagcccatgatattaccatttgttcattcaaaaaatgtctttggtgtcttacataagctaagcaccaattattcatagttggagagacacaaaaaggccatcatgtgattatcaggcggggcagggctgtcattcatctattgtttgctctgaggtttgggggccagtggaatattccatagtagaggcccagcctcccaagttggaggtataggagaaagaaaaatgtccttatgctaaagcacagcacctaacaagaggagtaggatctgggtgactcaatgctctgtgattattttccaagctgctttttggtagcttttatttatttcctctggtgcttaaagctctagccactaatgcctatttggggcttggttcaagcatatagacccaggtgaaattcatatcacattttagcctgtggttttatgaaatgcaaagcattaagtttgtgctgtgagtgctgtgtgtttgtgaatgtctacaggtgtttttgcacacatatatgtacatgggtatgtatatacacacatgtgcacacgtttacctgcatttttgtgtgcgtgtgtgtgtgtctttctctctgcatgcatatatgtgtttcttattccacagcggaggggacacattttacacttactgaagaggaggtcatagaagggagagggtggatgtttttcagaccaaaaccctcttaccaaaggattaccttgggagaaatatggccattgggaagagggcagtgtggcatcaagaaaacttcatggtctaggtagtatgacagacttgactatgaatttaccacatatttaccaagtataagttattaacaactgtgaacccaggagttttcctaaagagggtgcgtgtgtaagatagacatctcttcttcttgtaacatcttaaagtatatacatttagcatggtgccaggcatggagaaggcattttacaaataactatcaggtcattattataattttatttttcttattattgtggtcatcatcatcattattataactttatacttgttacactgcaagctctgagtaagctaggaaagcaagcaatggaagtgcatttcagttctattctttaattactgaattacaactgtatgttctgtgtggttcccattttagttagggaagtaggacatggagaagttactgcactggaaatcaagtagaagagctcaagtagatctatagcacaaatgagggggcaaaaaaagtcttatcccaggagagttatgaattagtattgaagggaagttatttggccttcattgatgacacctggcatgaccatttatgtgttttggattgacttcttgagttatgaagtcaggcttcagctttaaaaaccaacaacattgtaaattattacccctgcagaaagggaaatagaaggaagatatatatgtgagaaagagttttattcatgtctaagttacattgatactactttaaatcttcatttctaaaataacataggaaaaattcttggtttaatgacccattaagagactgtgctaaacctggttgacatatttttatttagtaatcagaatgatcactgttggttttttgtaatgccaatagaaatgcctgctcagttaattctctgagcttgaccagagttaaaacttccctaggtgaatgtgattaactctttgcaaatatttatctgggagatcaccatatgctcaacaaacacttctcgcagtgaaatcaggcacctcagaggccaagctgtcctgtgggcctttgctgtacatctgattgggactctgaactcagaagtgggaaaaacagctgagtctcaaagtaaatcagcaagagatacgaggtgagagaatccagaggaacacaaatcatttttcccaaagctatgtgactttgtggaatgtagacttagacagtgctgtgttcaaaccctcttattatctgggttattctgggagagttccttaacttctttgagcctccatttccttgattgtaaacagagaaaattccaagaatagggaggatgataccacttaaatgcaggtattgtgcttagtcaagcatctaggatatagtcggcactctacaggtgttaattctcctcctctcctggactagaggcacagcttgatctaggcctgatggacccatgagagtgggctgagcttgctgggtgttcagcctgagcactaagtcaacagcctctcttcagcatcatctctgtttgtggcatctctcctggaacacagccctcccttttatggctggaagtcaaaagaaccgtatgccagccctgcaatgcaagtcaatcatttccaattggcacccaatgaatagctcgacaaatggtagaaacctgatgctggcagcttgggaggaccagaagttggccgtgcctttaccttgagggaaaggtggtttgggttgttttggggtcacacataaagcacaaatattgttcacatttgccttaggccagatgtaagtcttaggattttggaaccagaatgccgaacaaaaaggcacattgatctatttcctccagggatgaatactagagaagttttcattttgaaatttagtaatttggtgacatgtgctaattatttgttgccactctcttttgtgaaaaaacaaagcaaattaagccccatctctattactctgatgcctgctaacagagtgtatactggggctgggaggctttaatgtgtagaaacataggctggttgggagatcatagcacaggtctaggaaagaggaagtggtgacttgcattacagtaatagctgtggattcagagagaagtgggcaggcttaatgcatatttgggctataaaattgacaagacttgacagatgaatatgaggtgttaaaagagctataataataattttcctcttgtatagctgagtagatggtggtgtcttttactaaacagaagaaatgaggaaagaaatgttggggaacagagagtcagggacatccaattttagacatgttaaattagacatacttttgagatatccaagtggaaatctcagtaggcaatcagagagaagagtctgagtacaaaccgaaaatgcaatacacaggatttgagcttattgatggcagtcaaagccctacgactgggcaaggtcttgcaggggagaatgatgactcaggagggcctgggtttaaaccatgaggaactttaacattaattggtaaataatcctccaagggaaaggagaatgttggagagaaagagttacgctgtaaattccaggtgctcttcccacatggagactctgttcccaatgttgattttgttttgatgcctggtgggcgtctgcacagtgtttgctccatgatagacatcgtagtaggccttccaaaaatgtgtaatctatggctatggtgaatatatctgggttgggtgcatccttgcagagttaatcctaccggcagttttatttaatcagtacattgagaaagtatggcaagtcaagttttggctttggagagataaggaagtgatgaagctttgggtctcgacggatgagggaggtgatgggtggtggagcattgggtctggagagataagaaggtaatggaactttagatctggacagatgaggaggtgatggggctttgagtctggagagatgaggaggtgatagagctttggtctggacagatgagtaagtgacgagtgatggaactttggatctggagagatgaggaggcgatggagcttttggggtctggagagatgagggagtgatagttcaggcagggggaaaacctctgtttttgtttcattctggacacgatttgggcaacatctgatattgtacaaaaagacaaagttaaaaatcctttctaccaaaagggagaagcatgcagcaaagtataaaggggcaggtgctcacgaccgattaacttatgagctatcgttggtttgctttcctgaaagagtatctgtctatgcacctctatctatatataggccaaaagctctcctgatcatcccttccaggtgggagcaagagaggcagaacgggcctctccacctgttctctgcctttgtctccttgcttctttgcttctctcacctcttgcttccatgtggatgctgcctgcctgcaggtgtgaatgagcccccgtccaggttcctggtgcctcaaatcctggcatgaatcttagggatggaggagtcacggtccagcgtgatggtgctagctgtgttctgcgtgggcatgggaggccagccacatttctacatgggcctcaaagttgggtaaatgaactggcagatctgctggtgtctggtgtaccattgtccaaatccccacagtcagcttcctgaggatctgcttcatttggttaagtcctggccaaacacaaagagtaaatccacactgcccagttttccatgtgatagaaaatagctctcctgagaaatgtgctcatttccttttcatttccatcactattaataagaggaagtttaaacaatttaatttaatcaacgcatcattatgtatgtgagggtgagtggggaaacttcaagtttcataggttatattatctaagcatatatatttttaaacgtgaaagtactctaagggtaagacctaccatgtattgacttcctcctatgtgtcaatctgtttaaatatattatctttcatccttagatgtgagttaggatgtttttactgcaggtagcaatcaagttaactcaaagttatgtgattgaattagttcccgtaacaaaaattccagaagaagtttggacttcaggtgcaatataatcaagcttctagttcttttctctatgatctcttgactctgctttttgggcagtgtgattttttttctctaactgacttcctcgttacctcaagtttgctggtaacacctgggaagacttctttgtggccaaattaggtcatgtacccatcttgggccaataatggtgattttgaaaatgccaggtactgactggcttaactccaaactcctgacccagtcacagagaaggcaaataggttaaatcaaaccagacctactcctggagctgggaatggggtaaacttcccttgagttccatagattcttacaggaggcatgaagtctcaataaaatttgagttctgttaacaatgagaaagaggtaaatgaatgctagagtaccagcaggtcaattaaaaatcatgattcatattacagataagtaaacaggactagagaagttatagaacttgaaaagagccacacaggtaatgtaaaatggagccagaagttaaatccagtttcctttggttccaaaccccacgttacgactttcagaggctgcaaattgacctgtgttgtgtgcatgttttttttttttaaacttagagtgtttttcctgtttccaaaagtaaagtcccaatgtttaaacactatcatcagatttcacaaaaattatattttttgtttaccatgaaaaagatggagttagtgataataatcccatatcctgacctgctaatgatcaactggaagctggaagtgactgtcatctctgcgcagtacaccttagtccccacctgggttggtttatttatccatgttacctccagggctttttaaagtattttatcccaggttgtcttgtactcatttttattatttttatcataatcatcattatgtgtatttatttccaaaacaagaacttgatgattattaagattggcagatattagaatgagcaataacagggagttttgatagctcacctccagagatcttcatacctgagttagcacaactggaagtgtgtacaacataggtctctcttatcctatatgcttacagcattactggtcaaacattcttacttaaagctgcaggtgaaatcatataaagcactgctgggatatgattttccatgactagaggcttcccaagattggagaggcgcctctaatcttttgcccacattttctcaaaacaaagtaaaatgaacttggctttcaaaattacagctgggtgtgtctggtacatagtcatctgcgactaagtgatcatttcatgtagctgtagatcataaacctccttcttggttcaacttacaggtgagaatttgagttgtttgtgcctagagtgccttacccaaaggcaaaaacttcctgaattacccaaggagagttccccttgacagactgaattaatttgtagatgttattttaaggttggaagaaaatatttgctctggtggggtgtgcagtggcgttatgacatttgtcaagtgaatggcaaatgatggagccggatggaacccgtattacttgcttaagaaattgtcttgaaaatttccaatgtgtcatttaacgtagtaaagtatttggttccaatctgctttctttttcttagtcatactgggggtttcaatatttgctttaaaaataaatttggggtttgtaaattctaactacttggagatatgtttgagagatttaatggtcttatttaccttcaatgaattccattctattgactgctacttcagaccaagatggactgtaatatcccctacagactgaaacaaccaaaatggacaaaaaatttgaaatgattgtttttaagaccctgaatattggggaaaagaagatagaaactaaaataagtgagtttaccacattttatttatggctccactcaccaccttgagagagtttccaggctgcaacttaaggataggggattcaagtgtggcagactccctgaatggcagagacaaagttgaatctaggaaacaaaagcagctggatttcataggagagagtacctgagaaaagtgatccgcgtaaatggagatctgcctaaggcccaccttagtgttgagctgaatactgctcaacataagggtgaggacactacctaaagccaaagaaagaagcctcccaaagattgaaaataacagagcccaggactcacgtggagtgagggttagccgctagtcagactagaaaacccagttattcatgggcactgagttgagtacacagaagggggttgtctcaataatggagaaataattagctgtagactatgaattgctctcactctgcctaacaaatatcaaaagcaaaatttgaaaagatcaaactgtttccaagtaacttagtcactctagaacagagctcagtgatatttatagtaatacaaaaatatcagcacgaaaaaagttaaaatttataatttcttccatcccatcaaaagttaccaggcatgcaaagcagcagggaaatataatccataatgaaaaaatatcatgtaacaacttacccagatttaaatgaatgttggaattggcacatggggctattactatagagagtaactctaactctcaacttcataggttcaaaaattcaagtggagacatagagaatgttttttaaagaaccatatcaaactactagatataaaatctacaatgcatgagataaaaactacactggatggattaatggcaggtttgacattgaagaagaaaaaaatcagtgaacttgaaaacaaagtaatttccccaaatgaaactcttagagaaaacacaattgaactatgcattgagcacgactgaggattttaatatatgtttaatttgaatccctgaagtaaaagggggcaggaagaattttggaaaaataatggaatgaaaaattttcaaatttaatgaaaactataaaccctcagttcaaaaaacttaaatcctgagaatgagaaatatgaagacatagcataatcaaatttctcaaaatcagttttaaagatatatcagctaaaaagatataccacagttgaaagctgtcagagtgaaaaaagatgtcagccgacttctcgtcggaaacaatacaggttagaaaagaatgcagaaagatattttgtactgaaagaaaacaatgtaaacttagaattctttgcacagtaataatatctttccacagtgaaaatgaaatactttttagaatagaataactggaagaattagcagcagatctgcattacaaaaaaatattaaatgaagttcttcagggagaaagaaagtaataccaaacagaatatggatcatcacaaaagaatgaaaagcaattaaacaaaaactagattgttaaacgcatgaggtttttgtttttttttttttttttttttttttttttgagaccaagtctcactctgctgcccaggctggagtgcagtggtgcaatctcggctcactacaacctccaccttctcctgcctcagcctcctgagtagctgggattacaggcacatgccaccaagcccggctaatttttgtatttttagtagagatgaggtctcaccatgttggccaggctggtctcgaactcctggcctcaagtgatccacccaccttggcctcccaaagtgctgggattacagacgtgagccaccatgcccagcctcacatgaggatttttaaacaatgaaatcattttaaaagataaattacttttaaaacaaaaatactaacaatgtagcatgaggttaataggttgttaaaagtaaatatgacaacaatagcacaaagattagcagggaaatcaaagtatactatttgaaggtcttatggtatacttacgtagtatagtggtataacatcacttgaagataaccatgataaatttaaaatatatactataaactctaaacaaaccactaacattaaaaaaaccccaatgctctggctaataagccacaaaggaaataaaacagaatgataaaaaatattcaacttatcaaaagaaggtaagtagaaaggaaaaagagaacaaagattagatagaacaaatagcaagatgataggtttaaacctactgtattaataatcacattacatgtaaatagtataaacatcacaaagcaagaaccaactctaaggtgcccataagaaacccactttaaatataaaagcataaataggttgaaagttgaaatatggaaaaatatgtacacactaatactaattttaaaaaactggactggctgtattaataagacactaagtagatttcagatcatgaagatttttggcattaaatattgccatttcattatgataaatgagtcaattcatcaaaaagatcaaactatgcatctagtatagcttcaaaataatgaagcaaaactgatgcaactgcaaggggaaataaattcataattatagtaggagatttcaatactcttaataattgctagaacgagcaaagttagtaaagatacagatgattttaacaatgtcacaaccaagttgacctaatatttgcttgtggaacactccacccaacaacagaacacacatttttcaaatgtatacagaaaatttatgaggatatatcatattctaggccataaaacaagttttagtatatttaaaaggattcactaacacaaagtatttctgtgaccactttgaaattaattagaatctaataactgaaagatctccagaaattccccaaatgtttgcacactaaataacaaacttctaaataacctatgggtaaaagaataaataaaaacgactctttactcaagttgtcccttggcagaaatccaagcctctttgggaaactgttcttcactcaggcatgcggtccatcttcagttaaccaagtcacagggacatttggctctttgcttggttagttgctgctcagaacagtcaggaattgatgtctacagagaggtttgtgggtatgagggcatgaagaatgtgtttcctaataaaaataatagaaaactgggtccagatgggcgtggatgtaattctcaggcaagccacattccctgccttcatccgagtttttatgaggtagtggaaataggacccaaactaagatttaagacattgggttttaatcctagcttgctcctgcatatggttgtaatctttgttaagattcttaacttttctgattctccttttttttttttaaatctgcagattgatggtgttggttacaataatctggaattgtatttcatgatgtcagagcaggcagggatgctggagatcacttaggccattaacttgtaattatttttctcctttgtacaaagcaggcttctgggtgcttttgcaatatcatcacactccctaggatgtaagtggtagctccaacccttttcttccacttaagaaagattagacggcaaatgagtgatgataatgagtctgctttaaattagatcaaagtctaatttctcttttttatgtttttaataatttataaaatttgcctcaaaatgataaaatatattattagttgtaacaacgtattttcaactggttttacaaaatcaaaataaattacttctctgtgttatgttacagatgaggaaattgaggccccaaagagacagggttaatgttttgctgtctggctcatggcaaaggcatgacagaagcacagtttttctttctcccacacctaggtgcattgcttccactacaccttctaggttctttgtggttattaataataaggtgatcatgattgatgaagatgatgatgaattccaggaaccttgtccattttacttttgtgcaccagcacccagcatagtgtagacacttaataaatatatattgaataagtcaataatgataattgctaccacagcacttattctgatctaggtggtatgttaaggattttcacatgcaccatcttatattattgtcacaacatctctgtgaaataagtagtagtgttatttctattttcacatgagaaaaagatttcagagagaagaatgaccttccgaggctcagttagtggtaggatcagtatcaagatgacctctctggctttagcacccgatcttctgattctctggcttctcaggggaaagaaaaggggtcagttgtgttttcatgcggtccgaggacgtcttccaatgctgcgaagctggtacaaagatctctcccttgtgggtaggagacatttgcttgtctttagagttaattcatcatgaaagtgtgactgatggaaattaattttataaactacaaaacctttctgaaaatgttaatgttgtcatcaatactaattattattattgtcattagcacagggatctatgtttggcattgccaataataaaacaggcagaagaataaaggggagaagctagtctttcctgggaaaatgtttataagaatcgtcaaaagctcaaatgcagaaccatcaactccctctaaattagttctggaatgagtcccttgagacatcgtgcacccctgaggaggacccatacatattaactctacagaggattgagcaaaatccccagcaagggaatcttagtaattctgactaggcagaaggaaggaaataaaaggtagaaagaaagaaggaaaccaagatttaattgtgatactgggtgcaaaccagtctataatgggcttgtctgcctggattttaaaagtttgggaggccgaggcagggggatcacgaggtcagctttctggccaacatggtgaaaccccatctactaaaatacaaaaaaattagccgggagtggtggcgtgcacctgtagtcccagctacggcaggaggctgaggcaggggaatcgtttgaacctgggaggcgaggttgcagtgagccgagatcttgtcactgcactccagcttggtgacagagcaagcaagactccatctgaaaaaaaaaaaaaaattcaattcacatatatgcagggaggccaagacactggtaaatattttccattcagtgtaaaagatgacagcaggaggagggatccatcatacttcttagctatttacttgagtttaaattttatcttgactttaataaatctttcaaaagagagcatttcttagaactctgaatgcaggactgggagagggtgtttgtcttcagccgatgaggtgaaagcaaaacaaaacaaaacacacagaataaaaacagtcccctggcatctgttacccatgttcacctagcaatttcctggaattctttcattcgttcattcattcatgcattcacccgttttcattcatttgtcttttcatgtatccatttaccctcaacagtcagctattgtgcacttgctatgggtgagaccttatagtaagtatgagacacacacagtcacgcacaaaacagaaaaaagcatgctgctcaaagctcctattctagtgagaagagagaaaataaatgaatacaggcaatgtcaatttgctattgatatgggatgggaagagaaacggagcagagagtaaagggatggagactgaaggatggttattttagacagaatggttgggaaggtgaaatttggcagatacctggatgaagtgaatgagaaagtaatatgacagtctgaggaaagagcgttttggattggggactgccaagggcaaagacctggaactgggaaattgcttggagggtctgaggagcagcatgatggtcagaacggcaggagccagaggagcatgcatttggagagaggagccaagttctctaggtcctcagagaccacgatgagagtttggaattttgtttcaagtattatgaaaagtctttggagagttttagcggggaagtaaggtactgcagtgacctctgagcttgcccaagttgtatctggagcctcattcactttttcttttccctgtgacaattcatctcctgttagacaccagcttttcctagggtggtacaaaatgtacttgcctttccagattccatttctcttctccttaccatgcaggccttggtgggtcctatttgaccacagctaatcagaataatcccatgcatctcactacagtgcttggttcaggaatgggcacactatctaatttggtctaatattaaaaatttctgagctatatgatatatggcaagtgtgtaaatgtgagacttggaatttctgctgccatttttccaccatgaaataaaccaggctgatgataaaggcaatttatacatgaggaagaactaagagaagcatggtatgaagaatgagtcagagccatgatctgactttatctgaaatctaccctatcgctgatcttttcagagagatatatatgtatttttttgagatggagtctcactgtgtcactcaggctggagtgcaggggcgtgatccaggctcactgcaacctccgcctcccgggttcaagcaattctcctgcctcggcctcctgaggagctgggattacaggcgcacaccaccacgcctggctaacttttgtatttttagtagagaccaggtttcatcatgttggtcaggatagtttcaaactcctgaccacaagtaatctgcccgttttggcttcccaaaacgctgggattacaggcatgagccaccgcgccgctccaatttcagacattaaccactaaacgcccgtagtggtttaattttgtttaagttagtttttttttttttcattgcaaccaaaagaactttggttgcataatttacagtgaatgtataatattatgttaattagttgatgtattataccctttaatttacatggttacatttaacaaagctgaatgttaacaaagtgacattttaagtaagaatttgagaaacacttttgcacaagatactttggactttaatttcagacagaaaacttctcaatggacataatttgtgcttcgtatatgttagtcgcttttgaatgactcgaacctatacagtagtcccctcttatccttggtttttctttctgtgattccagttacccatagtctgaaaatattatatacaatacagtattttaagagagagaccacatttatatatcatttattctagcatattgttataattgttctattttattaataattgttgttaatctcctacagtgcctaattcatgaactttatcataggtatgtatgtctgtgtaagaagaaacatgatacatacacagttctgtactatctgcagtttcaggcatccactggggatcttggaacatattccctgtggatagggagatactgcagtacatccacaggctttggaatcaaatttcagctttttctgccacttattagctgtgagactttgagcaagcaactaaatatatctgagcttcatttttgtcatcagtaaaatagaaataatgctggtccccactcacagtgggggagtttgtgagaattaaataaagcatgtaaaacatttagctcagtacctggcccacagtaagtgatctatgaatgctggctcttatataataatataattctcggaataaccaaggaaaatagaacaaaaaatgccacctagatggcaggattgctttgcatagcttaattaagtatgtttcattattccaactccctggggcttttgagaataaaatttttaaaaatgtacaacgacagtctcattaagagagtgcagaaggagcaatctctaggcggggagtgagagggaggacgtgttgaaattgtggagcagaacgcacgagtactggtgtaaacttggtccttaaacagtaaatacacacatccaaccacacaaccatgtctttccaaaggaagtttttaaaaagttagaagaacttgggtcctgtataagagtgagatgttaacatattttatttgactgaagagtctagctattataagatctttatttcaaaaaagttaaagtgcaaaagatgtgcattttggaaccgatgcagtagaacagtggtgcattccatgtccagttttccaagtagctgtgaggtaggcgatattatcctcctttgagatgtaagaacattgaggcttaggaaagtcaagtgcctttttcaaggtcacattgttagtggacagcagtcacaattgcattcatccattcatctgaagaatttacctagtgttcagtgccaaaccccacaggggatacaccagtgaaaacaacagagcatgacccctggggttataatctcatagggaatttaaacaaaaatgagtaaggaatcaaatacataaaataattgcactatattatggctcctgtgaagggcagatatggggtactgagatggaaaacgtgaaggatggaaggaacacacctcttgcctctttgcagaagtgatgtttctactgaaagctgaagggtgaagaatcagatatgaaaagagccggagaaaagtcattccagccaaagggagcagagtgcgcaaagtccctgagatgggaaatattttagtgtttataaggtaataaaaacacttattctcatggtagactcagtttcgggtctttctcacttcagagtgtctgctatgaaccactaggcaacgctacctctgcaaaagggaaagttgggtgtttgaaggccaagagacaccatggagcagtagctgccaaaaggatgctcatcacttcctcacatcacttacttaactccccagaagaaaattcctttcatatgttaaatgaccaactccatctctgccttgtaaaagctggaggagatatttgaagggcttctgttaatatatgggatgtgggtggcggggaggaactggtggaaaagaggtcatgccttgaaaggttggaaaagggaggatggtggaaaaagagctaggagtggaccgttgactcctagtgaagaaggctgcatcaccagccacctccgaggtggaataccaggtgtctgttaatccgcagcaggatactattagaaagcccatttcacttgtcactgtatcgctgtggctctgagagttgtgccttttggttccaaattgttttcatttcagtaccttccttcccaataagtggtattgaaaatgagggaagaatgagaagacctcgatttatacgtgccggcagattcagggtgtatgaaaagctcctactcacaatttctggttctcttgagaagttgggtgatgtttaatgcaactttctcttctttttttccaaggactcatgtcatgaagcttttgactgttgggaggatctgtggggtcatgggatcattttgctttattaccctcctaattagacataattaataattattacaataatgttatatagtgttttagactcatatacaaaatcttgaatcctcataacaattctttgagttgcatgggattattccaattttacagataatgttcacagaggtgacatcatataaccaagattacacaaagagattgacctaactcttatgcctccaactccagaagacaaagttggcaaataattggcagatgagaaattgttgcagcactctcaataatcccaggaaggaagtacagatgttgattaattaacaacaaccaaaggtattatcacatctacagtaattagcatttatcaagtgcctagagtgtgtctggcatactgtgctaaattctatttattaatcaatctaattctcacaacaaacctgtcatgtaggtgccattagtatctccatttaacagatgaaaaaacggaggctcaaagaggtgaaataacaactagtttatataagtagcaagttgcagagacagttcacaaacccaaataatttaactccagagtcagtgcttgtcaccaccacctaaactacctccattgatggtgtacttctaatattaataacaatgacatcaattacatcaattcattggacagagcaactgtgagttgtgagtcccatctcttaccattggttaaaaaaacatacaagttttaggagcaggattccattacactgtctctgttcaaataagtagaaacaagtaattggggcaatggccttgataaataatcttaccataaagctgctttcacagaaaaatacttgtttgtatgtattttctacctttattagaacatttggatagttgtgtaggtctgtgctgttcttaaggaaggtggctattattaagggtggtggacttgattcaagtcctcccagttttgatgtgttccttgaccagttgattcttatttccctgacttgtaaattgccgtcagcttcagcttgccttattaagaattctgtatagttggccgggagtggtggctcacgcctgtaatcccagcactttcggaggctgaggcgggcggatcatgaggtcaggagatcaagaccatcctagctaacatggtgaaaccccatctctactaaaaatacaaaaaattagccgggtgcagtggcagttgcctgtagtcccagctactagggaggctgaggcaggagaatggcgtgaacccgggaggcggagcttgcagtgagacgagatcgcgccactgcactccagcctggatgaaagagtgagattccgtctcattaaaaaaaaaaaaaaaaaaaaaaaaaaaaaaaaaaaaaaaaaaaaaagctgcataatcaataggctgtaaataaatggaaacatatgccccttcccacatgtggggaatgttgctgttggctcttctgccccttagctgtcttgtagcacaatgcttcagctttcagttgagtctctttgtggcttgtctaactgctgctatcatatccaggtgattaagctgttatagccttaatggcaagtttcaattcactgtcgtcttcctcagctttgggtctgggagccccttacgttcccactttgttctctctgggaccatctttccatcttcaataagcctaacttctgagccacagcaaaacaaatgcgtatgcgttgaagatagtttcagaacttgtgcattgggaaattttctgtggtttaacacggtgagaagaactggaatagcctgtgctgttcagaagccagaactgatactgaaagcaggtgcaggcctgtcagccacacagctggttgagttaactctattagacactattggacaattttgttatctgaaatagaaaccagtatggtggcaggctgtccctttgccaaatgatgcccctgctaggctggtttaggtctgcctttcttgttggtgcatctgctgggttttgctgccagcatgttgaaaactggcagttctgtaaagttttattgtcttcctaggtgtttttgtccaggaaagaaatactaagatttgccgtttttttaaatgatgacttggcattttgactcttggctgtactttagctggaagaaattagtgtctgattttattctaatactggaactgcatcttttttttttttttaaccaagaatgattttctagttctctccaaatcaaacattcttgggagcctctattctaaattgtttttcacactcagttctaatgccttcacgtaatggattttgtaattttgttcttttctttttttcttttgaaaatcagcaacaagtaaaaagaacccctgtgggtgaaatacaatatccctcccaaaggagaaatggaaaaaaaaatgttatttcaaacttcaagcccaaacgttatctgccttctacattttaagcaggctcagagccttgaggattgagtcaaagaatgcaaaacatgacctctcaaaggcaaaagctaaaaaaaaagttggacctagaacatcaaatagctcttaccaaagagtgttttgatgagtgaagtgtaaatgaagcgtagaatatagctcttttccaggatacaaggcccaatttccgaaacatgcaaacactctctcaattgaatgcattagctgcttagttccagagctgctgaagtataaaatgcgataacttatgttaaacacccagcactgtgcctagccgatgttggaccctcaatttaatattattattaattatttctatatagaggggaaacataaagaaacttgtttcaattacttatttgacctaaaatacaaggttgcacaatgcgttgtagcaaatgtctataaatctttacataaaggtccctggaatagaatctcattctgcaaattcaagatcctgtctggagaaaaagagtgaagactctatatgtatatttttgaatgaaatagagcacccatatctactatgtgtcttatgagaaatgtttccctagaggagactcataaggagtgacccaagaactggcttcagagttttaaaggactgccatccggaaattgtagtagaattagtctcctttgcttacagtagagaactagagctagtgggttgaagcttcaaggaaataactgtggttcagtgaaaggaaactcttgctgacactttaagctatcagtggaagggaccctccaaagaagtggagagaaatcatgtggacactggaatcttctggcaggaagactgggaagagtttctgcaatgtatggcgaggccaagggcagagggagcagttctgttggtttagatagataaccttaaaactcttctatgtggagactatttgggtccagctgaattatctgccttggaatcctcccatccacttttgctgaacagcacagctattactgccttttagatatgaaattcaatagcatttgttccttggctcagatcattcacctttaattgtgcccattaataccagtgataactaatgtttattcttcagttactatgttccaggctctctacaaagtgttttgtgcatattgcccttttaatacgcagagatactccatatgagtatttttattatccccattatgcagattttaaacatgaatcccagttggcacaattaaagaggcagactcataactagcaatactgagatacaaagcaaggactcttaagtccaaagcttctgttcttaaccacttctttgtactaccctccccccaccccacccacttactctgaattttaagaagagtgctttatcttttcattattccttttgcagcttcataaagcttttatatgcatttcatcaggggctacgttctgaaaatggtgtttctggaaccatggttctggaaagggcagagactaaatgatgccgacattggtatcatcgtcatcatcatcaacatcacatcattgccatcaccatttatagcatcatctccataatcactaccaccattgctatcaacatcacaccatcaccaacatcattatctatcatcattgccatcatcatcattgccataattaccaacatcttcttcctttttttccccattcttcttcttccttctccttttcctttatcgtcatcgtcattaccatcaccaccatcatcaccatcaccaccatcaccatcatcctcatcatagttaacacatattttgtgctcactgtgtgccagcacattacaggtactaactcatttaatcctcccaccaacactatgaggtagggatattaaccccatcttacagttgagaaaactaagatgcagagtgaatagcttgcccagtcatgctcttaagcacaataccttaatgcctctcaccctttaggagctgcttttcagcttgactaagggtgggaatcatcacttaaataagtcatagaaacttcccaaaagtgtaaaagtgttcactcaacctttatactcaggtttttttctgtagaattatttaaaattttctagacattataatcatgtgcttctccctgttacatgatgggtaaatggccatcacaggttaggagacagacctttgtagagctatgtttttccaaatgcacttccttgttcctaagttggagggcattgttaacattcatgggctaatattaatgagagccactggatacagggattgggatggtgctcaggactctcgatgaattctcattttatactcatgacaaacctatggcatggctgctatgattatgcccattttactgatcaagaaacaggctacggatagttaaataacttgcccaagatcgctaacactaggaactagctgagttagcatataaatttaaggttttctggctccagagctagtgcatgtaatcactgtgtttcactgttcctttcattcattttatgaccattttgtttgtttattttagagacgagcatctctctatgttacccaagctggtctcaaactcctggcctcaagtgattctcccaccttggcctcccagaatgctgtgattacaagtgtgagccaccacactcagcttatggtcattttggaaacttctctacacgggctgacctccgctaactctttgctgtcactcctatttaaggctgctgttagctcctgtgctgttagccaggcacatagtaggaatacattattttggataattctggggactataggataaaatgtgaaaattacaagatggattttttttttttagttaaagtaaagaagacctttctaaaatgtgtatctatacaccaatgatactggttgttttggagaggtactgaggtctttactccatggaagcaggcaagcagaaaaataggcccacctatctgccagaggtattgtagaaatgattcaggggcagaagattgaatcaaaagaactctaaggctgggtgcagtggctcatgcctgtaatcccagcactttgggaggccaaggcaggcagatggtctgaggtcaggagtttgaggccagactggccaacatggtgaaactccatttctactaaaaatacaaaaattagccaggtgtagtggtgggcacctgtagtcccagctactcaggaggctgaggcaggagaatcacttaaacctgggaggcagaggttgcagtgagccgagatcgcaccactgcactccagcctgggcaacggcaagactccgtctcaaaaaaaaaaaaaaaaaaaagaactctgagacttcatatgagactcaaatatgagtttaaatctcatatctcagctatgactgcttttcaactacttattgtatccttgaattagctcagttctattcagccatctgcttgctttctttgttactttcatttaaaatgattctttgttgtggaaaaatacagaaaacaaaaaatttgccattttaacaatttaaactgtataattcagtggcattaagtgcattcacaatgttgtacaaccatcaccactatctagtttcagaaccacctcattaccctacccctaaaagattctacttctagttagatacctccccaaattaaaaataggtattcaaacaaaaactgaaaaacttgtactagaatgttcctagaagcactgttcatagtaacccaaagtgtaaacctagatgtccatcaacagacatttgatggatgaacttaatgtggttttgtccatactatagaatatgagccataaaggaatgaaatatgttttccaacattgatgaaccttgaaaacattaggctacgtgaaagaggccaggcacaaaaggccacatagtgtatgattccgtttacatgaaatacatgtattactttttgctagatctgtaagccctctgtggtattgttaacatagtactttttacctacattgacctaatcttttagagacataaaattccaccatagcgtcttcttaagcaacgatatatatgaaacagtgggtttgagatgctagttccatttttccaatatacatgaaaataataaaatctaattctaaaaataaagtttgcccatgtgccatctaaatgcatctgtgtaccatctcaaatacacttaaggcatttcagaaaacagccttttgggatcctcttggcaatcaatttctccttgaatgtgatccacacagctcttttctctgtacttaagctatctgatatgacagccagccactagccatatgtggctatttaaatggaaattaagtaaaataaaatggaaaattcatatcctcagtcacactatccacatttcagttgctcaatggcaacaggtgactagtggctgccatactggatgtgacagatatattgccattgtgctagaaagatctactggacagctcaacctagggctggctttcattctttctgttgtgctagggaagctccctgatatggtttggcattgtccccacccatatctcatcttgaattaccacatgttgtgggaaggacctggtgggaggtaattgaatcataggggcgggtttttcccatgcttttcttgtgatagtgaataagtctcatgagatctgatggttttaaaaaggtggagtttccctgcacaaactctttttgcctgctcccttccatgtaagacatgacttggtcctccttgccttccaccatgattgtgaggcctccccagccacatggaattataagtccattaaacctctttttcttcccagttcaggtatgtctttatcagcagtgtgaaaaacagactaataacactccctgtctcctagatcccatgcttaagtcaacctctcactcagcatctttaattcccaccacttgctcctggctgaccattcatcccccagccagctctgaaactgacctactttcccaatgtcaccagggagggcctggtgccaggccacggtgtggtgcatcccctcactgctcccttcctgtttgctgctcgcccagctctggacgcaatccatcttgccactctctcttgctctcatcgtactgacgtgaggatctcctcccacacagccctggccagctttcctgaagggctctgctgggcttcaaactccattttgtttcattatcaagtgtaagaaaacagcccttttccttttcccacacttctccctttactctcctgttggtctgtcttcttcttctccttcttcccctgggttttcttctctttgacttctcttcttttcctctttctcctcctttgttccctctttctcttcctcctactctccccacaattatttctctgtagttgtaagattaaccctttatagctatttgggaaaaaaaactggaagaaggactatagtaaaaagaaaaaaaagctatattctttttaccatttatacagaaaaacaaaacaaaacaaaacaaaactcctcctccacccagcagttcctttgccctttaggtggtaaacacatcattctcttctcccaccaagagggtgaccttgcaattatggatgaagatatgaatatcagagcagtgactgggacttgcagagcttagtcttttaggggacacatttccacaccagaaatccatgtccgggtgtgaaacattattactgctaatgtacatagtgctgtcaagtttcattatgaggcccggcagagttcagacctctatttaggccagaatacagtgaactctgtcctgatggttctcacatgccatccagcacaccgggacattctcaacgctgctcaggactccagctccggccagatgaaaatctgctcctgctcattcagcaaatggtcactgaccgcctaccacatgccagacactgtgcaggggtgagggcacgcagcgagggctcagacatgatccctgtttcccgggagcttaccctccagcaaagaagagaatgtatgtgtttgaaaaactctaaggtggaaatggagctgcagaggaagtgaggggagttttgaggagggagtggaggctggaagctcagtgagccttttgggaaaaggtggactctctgctcagttttggaggatttgaacatgtgaatatttaggcgagacagatctttgtatttaaatgagacttgtgattttgctttattttcttttattttttaatgaaaattttaaattttatttttaaaaataatatctagtaaaattgactgttggaggcatgactgtatgattcttggcacacagattcgtataatcatgactgcaatcaggattcagagccgttccatcacaccagcccccaaaatcccttacatgtctacttacagccacactttctgctctagtcacacaatcactgatctcttctctgtgtctgtagttttgggtttcggagaatgtcatataagatagaatcatacagtgtgtaaccttctgagggtcacttccgtcaatcagtagaatgcctctgcaattcattcaagctgttctgtgtttctataattcattgtttgtattcccatattgtatttcattgtttatccatacaacgatctcactcttaggtatttaacctatggtcacacaaaaacctgtgcacaaatgtttataatctcttttcataattgccccaaactgtaaaacacctaaatgtccttcgatggctgaatagaaaaacaagacttttgtggtcaggcatcgtgattcatgcctgtaatcccagcactttgggaggccaaggtgggcagattgctcgagtccaagggttcatgaccagcctgagcaatgtggtgaaaccctgtctacaagaaatacagaaattacctagctactaaggaggctgaggtaggaggatcacttgagccccggaggttgaggccgcagtgagctgtgattgtgccactgcactccagcctgggcaacacagcaagaccctatcttgaaaacaaaacaaaacaaaaacaaaaatttgtgattttcactgagagaaagtaaattcttgttaacttaggcacaaaaaagtgcaaaatgatttattggtccattcaactagaaaggatggacttgttatcttgcgtgtctagatccaggctcaaacggtgtcttcaggtcttcctctcctttccatatttctccctgttaaggtgagttgtttgcctccaggagatagggaatgaactcatctaaactaagtattgattcacatacttttttaatccagaaagacagtgatcccttctagttgcaataaaaaattcccagagaagaaatgtgtttgaatgagattgagtcacgtaccgatccctgaaccaatctctgtggccagagatgccctccagggttcgtgggggaagatctattatcaggaaatgaaagtaaccagaaacaacagctatgactgcatttccagtggagggaggtgtaggaacaaaagctaagaagtggaaaatcacaagactttactgggataccatgagtggtttgggtttgctccaatgcaggatactgttaagaacagttttaggatggaaggttggaaaaattaaagttgccaaggagcatggattttatttttggacagtggggatccatttcagggttttgagaagggtggcacatgatcagaactgaggtgtgggaacatttcatctggcaagtgggcttgatatgagtatggaggatgaaatgtaggaatctgaatagcagtacagatgttatagtgcaggtaggaacaaagtgaaagacattttggtagcaagcaacagaaataaagcctgattagcttaatttaattaaaaggtaatgaaggagaaacaatagaaaatattgtttggggctttactagaccttttaaaaatcaaagtataagttgagcaactaatcttggaaaggtcataaggtgaggcaacattcctcgacgaaggagagtcactattacattggtttagagccaacaattcctggtctgtgtgtcttacctatcaactttcaaattcctaggagacagaatctaattgatccgccatgggacaggtgcacccctcccccttgtatatatttttatggccagggaaacaaataagtgttctgatatacataagggaggactttttcgaagatccgggcttattgtatatccataggcacatcgctctgccccagaagggatgcagtcccgtgaactgtactggtatagaaggaagcctaggtttttgcgagaggaaggaacatgaatatttttcagttcgtttagaacagacagtccaaatgagcagccagtagatcggttttatttcatttacatttaaatgaatttgaatgcctttagctaagattttcaccactgttatcatcttgcacctggctcgttttactcattgatattatctgcccagttctgaaaagcatgagaaatttgtattctttctgataaatcaacttggtgtttgccctgaaaaaagcaagtagaaatggagtaatggaagattaaccagtattctgatgggtcaggtccccctcctaatgttcttacagcaacaggaacattagctgcagacatattgccatttattgtaattatttgcataggatctgcctttcccttaaactctaaatgattgcagagaaaggaccacacaatttttacttacctctttaattcctatactttgctagcataaagtagatgttcaatggatgtttattgaagtgatgtgtttactaagaagtagatttgaagcctttctatagctgtccttttggtatatttcttagtggatcaaactcttaatttgtggtccataatttatggttttggttttagcattgaaattttcatgccaaaggaaacacctcagtgctgggacaactgggatggttggtcacactactactggatgtcaatcaaaaacaatgtgcttatcataggaccccttctaactctcatgatgccaccatgaaacttcgcaacagtgctgtgtggttgttatggactgaaagtttatgttgaaaccctaatccccagagggatggtatctggaggtggggctttgggaggtaattagggttagatgatgtcatgagggtggggcccttgcaatggaactaatgcccttataaaaagaggaagagccaggcacggtggctcacccttgtaatcccagcactttgggaggctgaggtggacagatcacttgaggccaggagactgagagcagcctggcccacatagaaaaaccctgtcttcattaataatgcaaaaaattagctgggcttggtggtgcacacctgtaatcccagctactggggagacagagacatgagaattgcttgaacccgggaggtggaggttgcagtaagctgagatcacgctgctgcactccaggctgggtgacagagcaagactctgtctcaaaagaaaagaaaagaaaaagaaaaagaaaaagaggaggagacatgaagtagatctctctccaccatgtgagtacactttaggaagacagccttctgtaaacaggcaagagggctttcaccagacaccaaatctgctggtgccttgatcttgaactttccagcttccagaactgtgagatgcaaatgtttgttagttaagccacccacactgtgatagtttggtatagcagcctgaactggtgaaaacagcggccttacccccattgacacagaagtgagctgagtctggaataacttgatttccttaagggtataaacaccaacagttgtggatttaaaactgaacttcagtttgcctgtctctaaatccactctctctgcaactcacagtgctcccagagttcagggtactgagttatgaattcttatcctcagggagttgacagtctgggagaggtgataacattgttcaggctatgaattacacaagtccaggagcacccttcatatcagcttcatcaaacatttgtgttttattttgacagttgttttggcaaatggtagtaaagggtcttcagaaagaggtgtctttttaaaattagtcctgagtggttgggaccaacataaataaagaaggtgccctctaagtggtgtgtgccacatgaagaacaggggttgagagttggaagaggatgcgtctaacctgaaggagtcaagtaatactttgtggaagaggtattatttgagatgatcatgaggggtggccaataagcctgatgcagggaatgaacaggaattacagctgcagaaaaataatatggacaaagatttgtggcctggcttattgtccttgctcagccttccttgtgtttggtgtcaagtagggaaaaggtggtcctcgggtggagattaaggtatccctttttgaatcaagtcaataaatggtgaacatgctgtgctcaatggcaagtctgctggataaacataaatgacagaagggaagatctgacctttgctcctggtgggaccaaatgtgtgaaagtggaatcctcagagaatagcaggaggcaatgtattgctaagtgctgtcacatgaggaatggattaagaaaaccaagagaggccgggcacggtgactcacgcctgtaatcccagcactttgggaggccgaggtggcggatcatgaggtcaggagattgagaccatcctggctaacacagtgaaaccccgtctctactaaaaatacaaaaaaattagctgggcatggtggcacgcgattgtagtcccagctactagagaggctaaggcaggtgaatcgcttgaatccaggaggtgggggttgcaatgagccgagatcgtaccactgcactccagcctgggcaacagagtgagactccgtcacccccacccacccccccacccccccgccaaaaaaaaaaaaaaaaaaacagaaccaagagaaggaaagattattaggaaaccccacaatgaagaaacagcttgaaatcagccttgttaaaaacaaatactgggtttagactgaagaggatgaggcagaaaggcattctgggtgggaggaacagcatatactaagagatggggttaggaccaaatgcattgtgtattcatgggagtaggggaagatgaggagagaaaattaaatattgtagagttggaaaaataaagaagtgtgtggtaccacccccccatttttcagagagggcaactgaggtgtagggaggttaaatgagtgctggtgcaccttaattcaaagcctttgaaatctgaaagattttggttcaaataaccagttgactgcttaactcagctaaaattatttttttaaatggcagaaattctaaaacataaaagtagcttaaagaagataggcattgaattctttcttgtgcaaaggttgtctagggctggtgtggtattccacagtgtccgggacccaggctccttctaccctgtggctctgccaccctcagccagtggcttccacatcataattcaagatggctgctactgctccagccatcatatctgcattgcaactagaaggaaggaggaaggaacaaagacgggctcacctccttcttttacagtacttcctataagttatgcatatcataccttctgtcttcctattatccagaaaattgtcatagggtcatgcctagctactagggaagctagaaatgtaagctttattattggaggttctgtgcccctctaaaaatagaatttctgttactaaggcagaagaaaagaggatattgatgaacaaccagaagtctcttgacccgtatagcttttcacaccattataaaacccacctctgttttctctctgtaaaatgagaaaatctgcacttagttctttgggtgagaattcaggtaacatatggaaagtatctggcacaccattcaacatatattagaggctaaatacattttagtcccttatccttaagtgatcgctcttactcacatattcagggagacaggacaagattctaggtctcctgatttgaagaccagagttcttttgtagcagcatggatgagcaaatatcttaattgtcttctagtttatttgtttaattgattaatataaagatattttccctggtcaggcgtgggatgtggtggctcatgcctgtaatcccagcactttgggaggccgaggcagatggagcatttgaggtcaggagtttgagaccagcctgaccaaccccttctctactaaaaatacaaacaattagccaggtgtggtgttgcacacctgtaatctcagctactcgggaggctgaggcacgagaatcacttgaacccgggatgtggagtttgcagtgagccgaggtcgcaccattgcactccagctggggtgacagacaagactgtgtctcaaaaatatatatataatatgtattttccccaaataatatcgtataaaaaagaacaacatattaacgatgtaagtggagttaggaatgttagagtcccattggcatatcacccccgacctttcctctctgcctttgagttacctcactggatgtctagttgtaattcacagaaagcaggtagacacccactggacagagagacaaagtagggctcatcatcaaaaggaaaaacgaaagaaaacaaaaagacagagagttgagacttttgttcattccacaaatttgcattgagcatctactttataccaggtagtattctaggttcttcaagggagaaaaagcagcagaaggaaaaaccaggcaaaatccctgcttttatgaattctatattccagtatgtgaatatccagaaattctgaaataaaaatcgcaccttgaattgaatgtcaattgatccatatcatctcattctatagtttttggttggaagagcaacatgcacgcacatctgccacttggagatcttgaataatttggcagcataggcacaggtgattgagtgaacttggaaatgcacgccacgttacatacatttttttctgctcatttggattagaagctcattatgtgagctggttccactggctcttgtgccagctggttcaaagtggttaggtgatccttagtcatgagaggttaatggtgacgcatttggtgctattttaacagtgttataaatactacccagcatttccagattcctcaccccaggttccaagagcagcctgagattcgaagaaccactttattaatggtcattcagaattccaataactcccaataaagtagaattaggacatgcatcttagaccctactctatacaccctgcttctagttgaaatctttggccagttgggtcaaagtttcaggtatgctctgtggagttgggaggaggagagtcatatttacagaaaaaagctttgtcctaacctacctcaagttttagacatagcggttgtattacaaaagacagcatatagggtcctctccttaaggagtcacccttgactcaggtgtgctccctgaatagagttggatgcccagggtggcacatggattacaggctttgcaccatagaagcttcatctaccagtaagcccagtccagggggtgctgtgagctctgaacaatcaaatgagctcctcctctctccttggggtagggcctagacgagctctcattgcctcccttcggggactggaattagtagccaaaatgattctccagcatttaaaagaaagcttttgaccccaaattttaggaggaagaaagacaattatataaaaccatgacaactactgctacccctaccatagtttagcagacacccataatgtgccaagcactctgctggcctttatcacgttgtgtatctcattagacgtcatttagtgtgatccctataattacccagtgacatggctgttatgacctcacttttacagaaaaggaaacaaatactctgagaactgaggatacttacctgaggttgaaagccacaaaattgaattctaactcaggctatccaattcttgcaatattgcctcttggcagttgttgtactggaatcaaatatttagtgtgcaggatcctagagacctatgcctgctcattcattttttcatttattccacagttacttttaagctctggcttaaaagtcaggacacaccctcttctaggtgttttagagttgcagtgatcagaacaaagacccctgcccttaagaagatttctattttgtgtcctaaaatctttaaaattcagtattgctcagccaagacaactaacattatttttttaattgaccacaatagaatttgtgttgaaagaataaacaatacttttctccttataaaaatccttttcttctttctgtttctttatgttgtggtttctgagcccattttagagtatctctgtgttggagttattatttttctgtcttgacttttttttttttttttttttttttttgagacggagttttgctcttgttgcccaggctagagtgcaatggtgcgatctccactcaccacaacctccacctcctggattcaagtggttctcctgtctcagccacatgagtagctgggattatagatgcctgccactacgcttggctaatttttggtatttttagtagagatggagtttcaccatgttggccaggctggtctcaaactcctgacttcaggtgatccacctgccttggcatcccaaagtgctgggattacaggtgcgagccaccgcgcctggccttctctgccttgatgtttaagttctggctctgctgttaagactttttaattgttcacggggaacaggaaaccaccaatgagtactgtatatgaaattgagcaccagggcaaagaggaaggtgctgccgtcaaaagacagcgcaaggatattcagaggaagaagagaaggaggaggtggatgagttgggaattgaaaactggcaaaagtagagtgaagttgtactaaagagggatgaggattcatttgcgcccatgagggaatagttaatggaagatgagaaagcactaagatagacatcaaagttgaagggatttgcaaacaccaggagaatgcttgtaagagaaaaaaaaaaaacaaaaaaaaaacactctgtgaaaatgaaagtatcttgagaattgaaaagaggttaaagaaaactgactgtgttttcaaaaacatgtaaattaaatgacaaacgaagaaactgtgacacccaagcagttcaaggaggcatttaagggacactgtgatccaggaaacgtccctgggaacttcagaaatggcaaagtagatggaaaattaaccgaaaattgagaaacactaaatgggttatggtggcatttgtgaaacagtaagagaattaaagtctaagggggaaatagtgaataataaatatgtctagagaacatctcaaataattagattttggaagttaaaggagacttatgactataagacgaaagagataaaatagaaatctggaggaatgagatattttaagtcatagttaaagaagcttatgcagcccattatggttggctgttcacacaaggacagagggactctggaaatgagtatactaaatggcaaggggaagcatggctttaaaaagcattgcatttgtagtagggtgttagaaaatatgacagggtggaaaaagagtgaaaactgcatggaaaatttgcatcaatgttaactactatttattaatagctgtataccaggcactgtgctaggcattttatgcgaactatgaagttaggttaaaccatatgaaactgtcatggctagtctgtatggtttaacttaatccatttttgcaaaaaaaaaaaaaaaaaaaaaggaaatggaggctcagtagattttaaatacgctgcccaaggtgccaggtactgtctcactgtaaagcctattctctttcctcgatgtcatgaaacctcaacaacatagaagcagcaagttattcttttattcattctgcacatgttcagcaccagctctgtggcgcacaccctgtttagcactagaaatataatactaagcaaggcagatgaggtccctgcttccatgattacagtctaccagttaaaaacaaaagcaaaagcacaaagagagtctagaacagctgttcattagaaatataatgcaagtcacatgtaacttaaattttctggtagcccattaaaaaagtgaagagaagcagataaaattaattttaataatatattttatttaacccaacatgcctaaactactccaacatgaaatcaacctaaaattatttatgagaccttttactcttttgaaaaatacgaagtcttcaaaattctgtgtgtatttttacatggatggcacatttcaattcagactaaccacatttcaaatgctcaatagctacacgtggttggtggctggctatctaacgtgatagcaggcctagtgagaattggacaattctggccccgtttatattcaatcataatataggaaatataggaaatattgtctacctatttttcaatgttatctctgatcaccatgcatcaccattcatagagcacaaaacacaaggggaagaggaatgtttatttaacctggacttcagcttcatacacttaatactgtaaataccagaggaaatgtgtatatatatgtacgtattttatgtatttttttatatatataaaatatgtaaatatatatgtatttagtgttgtgactgtcactggcaataaaaaacaacttagcactttaccaccagtggatgacaacacagaagtcgtcttggcaaatcactagagtcttccccttctctatttgccagcatgcttctgtgtacttattgctcctgatggagatattgaagctgtaatttgaggcttagaagcagtcagaatttctgacattttatctgaccactaaagctttatgatcaattttgtagagataagcaaaacaatgacaagattttactgtttaatacaagtgcccagcaggtgttaatgggaactgatcaatgtggtgtaaaatggtatttccctaggtaaagaactctgctctggagcaagtttaaatgggaagaaagcccatggaaatatggattgtccttcctagaaattgggtgggggaattgaaggtaataggtacttgctccctgccaacttcataatgaaattactgttcagcagaaatttctgttagaggtttttttttcccccctcccaagggactgaagacttttaatagaaaaagacaatattaacattgagtatatggagtcattcacccagaatattgaatcttagaggaacacagaaaaatctgaagcatgaggatttctgcatagttattttcatataatctgaagaacagtgtttgcgtctcagtaatcactctgctaattccatctgattttactaccaaatggaagaaaagggaacaagtggagaacatggagatgggaaattaaagaaggagattttaagtaaatccaaagaaaggtgctcaactgcgtatgctaccttcttgattaaaacaatcactgttttggctgggcatggtggctcacgcctgtaatcccagcactttgggaggccaaggcaggtggatcatttgatgtcaggagttcaaaccagcctggccaacatggtgcaaccctgtctctactaaaaatataagaattagccgggagtggtggcaggtacctgtaatcccagctactagtgaggctgaagcaggataattgcttgaacctgggaggtgaaggttgcagtgagctgagattacaccactgcactccatcctgggtggcagagtgagaccctgtttccaaaaaaaaaaaaagttgctgtgacattcagttcatgttacgcaaccttgtgaatggctctccccaggagcaagtgtctttatcgaaaccaaaacatttgttccctgatccagcatttccaaacagataacaaactggatatttccaaatttcttgataatttactaaatttttcagttttcccacatttggggcgctaggtagactcaacctgaactacattcaccccaaagtgttggataattgaaacctggcttaagatctcattgtactcaataagaaacacctcagtgagttggccaccctaattatcaacttagggcagcaggtacagagtgactggtaacttattttcgctagctgaggtaaaggccattggtggtctttgtcggtagtttttgtactgaaattccattgcagttgcctgcctatctgtccaatctcttcattccacctgttgctttctttgaccgtcgtctctattccttgcttgcgttactacaaagcctcatctgtttgcccatctgcctcttacaaacttgcatttcaagcctccattccaaataaacacaagatgaagtctaaactcagtctatatagtacttgcttatctgactcctgcgtctgtctctagcgtcctctcccaagttactttcccacttgcccccaacttattgtgaactgacggcagctcattgaacacatcatgatgtttcagggttttctgccttggactttgcattttctccatgtgcatgagcaagagctgctcaacttttccttcctcttccttctcagcacaacccaaatccctttaactttgtttcctttttccagtcatggaatcaccatagaattagccactgcttctcttatgctttccaacaacttagtccatatctctatttttacacttattgttcttcgttatagttattttgtgtgtccctctccccaaccttgaaaaattaagtatttttggtcatttttgtatcattttcatggcatagttctggtacagggtgtgatacataggagatgctcaaacatgcctaatggatggaagaatggatgaacgtattaatgaatgtattgacggatagatggatggatggatggattaatggattgatgaatgtattgatagatggatgaatggacaggtaaatgtattgatggattgatggatagatgaatgactgcattgacagatgtttggaagggtagatatatagatggatgaatgtatggatgggtggatttccctttggtgatgatctgtcaacatacttgccaaacattaactgagcccccacagtatgccagacaatgtgacggggctaaaaataaccctgggaaatggaaccaaaatgtcagcttaaaaaataaaaacagcttaacttaggctcaattagttactttgaagtcctgctaataatgaggaatttgactccagttctccactaaacagtccatgcaaatatcttctttagagtctcaataagaggtgtgaggtggagcacacctagctgtgtgtatctggaccatgttcatttagttcatcaaactccagccaggaaacatcaaaggggagaaggaagagagaaaaaaaagtttcaattgtctagataatgaatggtttttaagccgtgaacaaaaatgttcaagtcccctcaagtgcagagaagcattttcacttctgcccctattggctgcaaatctgagtatatcactcctctacttaaaatctttcctggctcaccatgaccttctgaacaaatccaaacccttcagtgtgtccattatgatctggcttcagggatcctctgcagactcatcccactgcacataacataaccatctgccttactaagccgtttcctacttcctctagcgtgtgttactacctttgctgactctttacttaagatgatgcctctgcccagaatgctttctcctgcctcaaccccttcacccattaagattccctgggaagccctccccagattccccaggttgagttagggacccttttgtctgtgttgtctcaccttcttacatttactctccatcagtgaataagtggcattataggtactgtcattgtttatgtgtctatgccattgaattataagaatgtgggtaagaaagaagacaaacactgtgttttttatttctgtatctataagacttactataagccctgacctatataccaggcatacagtaaatatgctttctttgaccgtcgtctctataataaatagagtaattagttgttaaatcaagaaaatatccttccggcaggtgtggtggctcatgcctgtaatcccagcactttgggagccagaggcaggcggatcacctgaggtcaggagttcgggaccagcctggtcaacatggcaaaaccctgtatctactaaaaatacaaaaattagctgggcatagtggtgggcacctgtaaccctagctacttggaaggctgaggcaggagaatcatttgaacctgggaggcggaggttgcagtgagccaagattgtgccaatgcactacagcctgggctacagagtgagactccgtcttaaaaaaaataacaaaaataaaaacaaaaaacaaaaaacctttctaggaagtgataagagataccccaaataaaccagatagaatagtgattatcctttgttccttctagaatagcagtgttttagttttctgtttgttaaagtatttgattgcagagaacttgaagaatacaaagatacacacacaaaaaaatgaaaaatacccataacccttttagacatagacaagccctgtttttatcctcttttctgcttctttaacattaaatagtaagcattttctctgcatcattaatttgtcttcaaaaacatgattttcaatgacccgaatggtctgttgaataaatacacaatatttgctcttttccttttccccaatttcttcactttgtccttggaaaccagattctcccccacacaacacccccatcagtcgcttctgcaccatgctggtccagggatgtacatgtgacccattaggccagtgtctcttcttaaaatttcttgtagcctagttctcttcttcttcttcttctttttttttttttttttcactttttagcatctctggatgttaatggaatatgaagcaagtgacacagtatctttctggggaagtctttgaatgcttcaatccaccatattggatgtatcttgtgtctgctgagtggccaccaccatgttgtctcagatgtctttaacgacatcacatttttctcaagctgcaaggagagcggatcccttggggaacctctcacccgaaatctgggagatgaagtctgccttggctctctgagttcagcctgagtacaggccaaggtggctttgaggagtgatgagggtataaatgttgtaaggcagatagatgttacctgcaatgaaaacacctagaccaaaaattaagtttatacatgttatataaggtagattctaggagtcatcgttgatgcctctttctcccttcccctcatctaatctttcactaaatacctcctaaatatctctccactcggtcttgtttgctgttgctttttctcttcctccttctcttcttctttggccacaaccagagtcaaagccaccattatctttgacctggtttgtaagaatagcataagtagtccctctgtacccgctctggttcccctccaatctattctctacacagccttcaattgacatgatctattacctctttgatgtcaccctcgcttctatgtcttcccatagttttttttgtttgtttgtttttctgagacagggtttcacacttgttgcccaggctggagtgcaatggcacgatctcggctcaccgtgacttctgcttcccgggttcaagcaattctcctgcctcagccttctgagtagctgggaatacaggtttgcaccaccatgcccagctaatttttttgtatttttagtagagacggggtttctccatgttggtcaggctggtctcgaactcctgacttcaggtgattcccctacctcagcctcccaaagtgctgggattacaggtgtgagccaccatgcctgcaccttcccacggttttaagacagacatttaacatggtctctaaaatcctgcactttctgttcctattcatcttctcagcctcacctgatctcacattttcctgtctttctctgcttcagcctctctggtctgcattcagttcctggtatgcacaccacagagtctttgcacatgttgcctcttttgcctgtttgtgtcttttcttgcctagttaatgccaattgagccttcaggtcaagctgcacttcctcagccttgcctcacccctatttcactttcttatagcatactctcccgtcccttgtatcatttgtcataaatctgtgtttaatcaattcatgactatcctcccccttagactctaaacttcttgagggtgggaattatgttcattttcttatttaccctgaaccaactagctgagtcctgacatatagcaaatgcttcatatatattagttgaataaataatgaataatggaatgtcattttttcaacattgaatgccatgtggtttatgagcaagcagcttccttcagggaagtttgttagagtataatagaatgtgttttcagatcttcctgtaagaagatcatttgaatataggtctatgaatctggcaggacaaaaagcttacattccacgtgttaattacagtcaattactaaagcatggtcaactagcaatggttgcatggttattaatacttctgcagagaggcttcttgtgatgaatatagcattgtaagtttataatttttcagtattccattaatggtggcatccacttatttgttcgattgctctaattctttcctaaaaatttgtctttctctcttcccctttctagatttatggtcaatgttacatgggatggcaaagacttatccttcactgaggaaggctaccaggtgcaccccaggctggtggtgattgtgctgaacaaagaccgggaatgggaaaaggtgagcatccttctgtgtgctgaatgcaggggagggaagaaagcatgggcaataaaggggctcacagtgcttctttctcccacgcatttcctgttgagctgctctagatcccatctcacagccaagagcacgtctttcttgcaacaaggcagactaaatctgtaaggtgcaattggaatgctttctctgggtgaactgtggtaattgtgtggtgcgctgtatgtctgttctcaaatcccagtaggaaaggtctgaactaaggataatttaaagacagtgaagtctgggttgcagcattacactaataagtgttgactatgtagcaatgatcatagaagtttgcctaaacttcctaattgtgtaccatagtcattgccatatgaacgaaccctctgtattttcatgtactcagtcttttgctttaaataaactaattttaaaaacttaaatgtatcacttctgtaaatcatgagttagagagggaggttatttttcttataaagcatattttcaactacatgtatattagctattgaaaatacaaaaaatcgtttgcaaagaaaaaaatcatcatcttatgtaccatacatgtcatgacctgggtcagagaggagagatgtcacagggaatttacagatgatctcatacatacaatgacaatatctggttcagttgccctccctcctcctccataattaaatgcttaagttagtcgctacaatttcgtataaagagtagaataaaagggatcagaaagcctttgttgttacgttgttatcttatttttttgttatgttttttgacaagcaatgcatgacctctgaactactttagcatcttgaaatttatcttcacttagtacatcaaatggaggcctgagtgaccctagagggaaggaagatataggatgtgctgtgggagacataatgtaattgactgaaatcagggggaaatactatacaaacagaagcattgactctggggagacaatgacagattcctagaaaagaacagtgaggaggaagcttaggaaagttttgcatcctacacccagcaactataaaatgcacagcctttcgagtgcacatgggaaatccaccaaagtagactacattctggagcataaaacaaaagtctcaatgtgtttagaagaattgaaataatggagggtgcattctttgatcataacagcattaaaataaaaattagtaacaaaaatatatctagaaaatctccaaatatttggaaatggcaacacacttctaaacctataggtcaaagaagaaatcagaaagacattagaaaatactttagtcagaatgataatgaaaacacaaaatatcaaaatttgaggaataagattgaaggcacactaagaaattcatagctttaactgcttataataaaaaaggaaagtgtgaattcagtgtcaatgatttaagcttataaatttagaagttagaaaagagcaaagtgaacaaatgaagtagaagaaaaaaatcataaatacacaagtaaaaatcaacaaggtggaacacaagccatagaaaaaaatcaacaaagccaaaagctagttctttgaaatgactaataaaattcacagtcgctagcaataatgatcacacaaaagaaagaaaacacaaataagccaatattaaaaatgcaagagggactatcacttacagacactacagatcctacaggcattaaaagataaaaagaatattatgaaaaatttatgacaacaaattcaacgatatagataaaatgggcaaattctgaagaaacacaattttctacaactgagatgtaggtattgacgatctgaatagctcatatttgctgaaaaactgaaaatatacctaaaaactttcccattttaaaaagacaaaagagaaactcctggcctagatggcttcgtctatctataacaaacatttaaaagaaataacagcactctatacaaagtttttcaatatgttactaatcataatgtaataatatattttaaaaaggataatacatcatggataagtgggggctatctgaggaatgcaagattagtttaacatttaaaaattaaattaatttaccacattaacagagtaaagggggaaatatggtcatttcaatagatgcggaaaaagcatttgacaaaattcaatatccagttatgataaagatggtaaattcctcaatctgataaagggtatctatgaaaaacctataatatatatatcgatttatatatattatatgcacatacgcatatcatgagatgctttatttgacaatttttaagtttttctgtcttattctaagttagactacggtgcataaaatatatatattaaataagcttatatcttatttaatgatgaaataatgaaaatagatccacataggcacattcaaatgatttttgatcaatgattatgacaacagggaaaaggaaaatctttttaataaatggtattggataaacaggcaatctacatggaaaaaaaaaaccttgacccattgctcacattatgcatgcacacataattacctgaaatagattacaggcttaaatgtgaaagataaaactatctagaagaaaatgtaggagaatatttttgtgatctgtgagcctcagatttcttaaaccaaatatgaaaaaccattaagcagtaaataaactgtacttcatcaaaattaaaaacttttgctcatctaaagacactgttagccactgtgcccagccctcttttttattttctaacacttgtaattccaacactttgggaggccaaggcaggtggaccacctgaggtcaggagttcgagaccagcctgaccaatatggtgaaaccccgtctctactaaaaatacaaaaattagctgggcatggtggtgtgcacctgtagtcccagctgcttgggaggctgaggcacaagaatcacttgaatccgggaggtggaggttccggtgagccaagattgagctactgcactccagcctgggcgagagaacgagactccacctcagcccccctgagtagctgggattacaggcatgtgccaccacagaggctaattttttatatttttggtagagatagttgcaccatgttggccaggctggtctcagactcttgacctcaagtgatccacccgcctcagcctcccaaagtgctgagatcacaggcgtgagccacgcgcctggccaaaaactgtgtgtgtgttttttttgtttgttttttaataaacgtacacatacacacacaaatcttatccagcaattttactcctagttatttatcccaaagaaagataaacatatatccaaaaagtaatacttgtacaagaatgttcattgcaactttattcattatagcaaaacatcagaaataattcaatgtccatcaacaaggaaatgaatgaacaaattatggtatattaataaaacagaatggcctagtaatatgtacaacaacatggatgaattgaaaaacattatatggaatcaaagaaagacacgaaagattatattacgtgaagacatgaaagattatattgtgtgattccatttacataaagttcaagggaggcaaacgttccctatggggttagatatcagaatagtggttgcttctgtgggtgagtgcagttgacaggacaggggcacagggaattttctggagtgatggcagttatttcctatcttgaacatttgtcaaaaggcatcaaattatgacacaagatccattcattttgttgtatgtcattgtgcttagtttaaaaaaaaacctaaatccgggccgggcttggtggctcatgcctgtaatcctagcactttgggaggccaaggcagtcagattgcctgagctcaggagttcaagaccaacctgggcaacatgatgaaatctcgtctctactgaaatacaaaaaattagcccggcatggtggtggtgcctgtaatcccagctactcaggaggctgaggcaggagaatcacttgaacctgggaggcgagggttgcagtgagctgagatcgcaccactgcacttcaacctgggtgacagagcaaggttttgtctcaaaacaaaacaacaaaaccttaaatccttcagatcgggatacccagcacaattaactaacagttttcactgagctttcatatttaaccccctgacatgaataccaattataataacaatatccattgcttattgatcacctcttgtattgatccttcagttgatccaccggagccctgacttcatggttcgtctattcatttttttattcaacaaatagttattaagtgcctactgtgtaccaggccctatccttgatgcttggagtccatcataaacaagagaaaaaatattttctgtactcaagaaacttagatcttagtgtgtatatggagatggagtcggctgggattctatgggcttctgtcatgcttaaggaaagtgttagcatctagttaactgtccttggttttaacctcctttcttccctcttatacaccctgtagcccaccatgcaagtgatttgcaactccatgaatgtatatactgggttccttcatgcatttgggactttgaatatgcttttgttgttgttgttgcctataatattttcttatatcattactttctcttatccatctttcaaatcctgattttttttcctcttacacatgtaaagccaaaatgcaattcatgttttttttctaatcatccataggaggtagagagttggagcctttctgccttatgttgttgcattttggggttttcaaccttttgatgttacacaatctgcgattcacttttggagccaccaaatcattccctttggttggttttaaccagtcctggagcaggcttgactcacacctgtgaattttctgtgctaccttagaatctgactcatcttccagggagctggtacacaaggaggccactgcagtgcaggtgacagctgcccttgatacactccatttccagatacagaagatgccttttaatattttgtgggcctttcttcaaattcctgttgaaacatagcaatttcccataaaaggcagctttgggaattgctgctgagttgagcttagaatgcacaaatactgcctgtagttgctctatcctcttggcactcaggggatctagtgcttcagaaataactccgtgtgcttctgtctctaagaaagagaaagccagtggagcaggtaaataccagtcgtgttacccttaaagctgcccccccagcactacacgctggtacagcaggtcagcagaggggaaagactgctgaggagggagctgttattctgggactcggaggcgatttcttttcatctccgaggtcagccagtggcgtcactgaaagcagcagcatgtaatgagggtgtctgggaaaacacgacaagcccttagaggggcacttgcttttttccaggcctttgtaggtggctggtgtggattatacagacgccaaacaccaggcctgcctgtatactgcagacacagaactcagaatggagcagactttctctcacaaatcgggacttccatgccttttctctctcccttgttcttcagtgattttggtctgccttagagtttgatgagtccaaggcttcccagagatgctcaaaaacaaaaccctagatgcctcaacctcagcctcagaagaccctacagcctcaaattcctaggtgtaaggggtcttcctgccaattagcagtctaggctagtacaaccaatgccacgtgtatgccagctctgtggccagcagttcattaggtaccagggatgctacaaggatgtgtaggaaactatgtgtcttctcaagtagctcataatagagaattaagccaaccctggaacaaatggctataagtgctacataggcggagagaagggtgaacttgggccagtcaagaaattctctagccgggcacggtggctcacacctgtaatcccagcactttgggaggccgaggtgggtggatcacgaggtcaggagatggagaccatcctggctaacatgatgaaaccccgtctctactaaaaatacaaaaaaaaaattaggtgcctgtagtcccagctactctgaaggctgaggcaggagaatggcgtgaacccaggaggcggagcttgcagtgaacccagatcacaccactgcactccagcctgggccacagagtgagactccatctcaaaaaaaaaaaaaaaaagaaattctctaagtgagaatttctcacttagagaaattctttgtaaagctagaggtattggagttgagccttgagtaataaattggattgctctaggctgaactacttattctacctgaaaaaaaatgctttgagaataattctggttaccattttagggttatagtagctttgtttattttattatttatttatttatttcaagacagaatctcacactgtcacccaggctggagtacagtggcacgatctgggctcactgcaacctctgcctcccaggttcaagcaattctcctgtctcagcctcccgaatagctggcattacagacacgtgcagccactcctggctaacttttgtgtttttagtagagatgaagtttcaccatgttggccaggctggtcttgaacccctgacctcaggtgatccaccggcttcagcttcccaatgtgctgggattacaggcatgagccactgcgcctggccttacaatagctttaaaatgaaaatatatgtgtgtttatgcatacacctatatacacatacaggctagcttttaaaaatttgtttaagttaacaaataaaaattgtagatatttttagtgcacatgacgttttgatatatttgtacactgtggaaaagctaaactgaactaattagtgtatcctagacaaactttaaaagggatatatattgagaaagagagagataaataaagatttttgaagttttgactttaaatgtaaataggacaaaacacataaatattaaagtaaaacaagccttttattccccagagaagatccaattaaagatgataccgatgttccagaagacattagggagacccttccttgtgtcttcctgaaggaaatgtcccattctcgctctgatgggtctgtttttctttttgttttcaccactctgtttacatttggtttcaggtgcattttgcacagaaatacaaccagatctctccctccagcccagatctgtctcacggcctccagacttgcctacagcaccacacgtggctgacccacagacacccaatatcaccttgtccaaagtcaaactcatcatcttcctcccacggatatgtttattcgcccgtaccccaacacagaaagctttcttcttatccccggagtgtcccccaagccctagtattcagctgtcacctgctcctgatgttcctgccccttcaaacatttgtcctctttgctaaggacaccctttccattgattctatatctgggtagctcaaagtgggtctgcccttttccacttcattcctgcagacctgtatactaattcgtaagagtgttaacagcttgctttggcattgtttgcttgcctattcatcttcgcttagactagaatccccaagaggggaaggtctgttcctttcatctgtgttttttcagcttcaccacaagggtttgggcctagtgcacaaatggacccctctatgatctgttggtatcgacgacttcagctgccatttattaagagctactctgtaccaataactatgatgacaattttacattcattatctcatttagtcatctgagtaggtatttgtttaatagcacttctaaagtaggtattcttctccctgcttcagagatggaagttctggttcagagaaccagagtttctctctggttagtgaccagcttaagatctcccagctggtgtgtgatggaagaaggatgtaagtggaggtccgcctgcccccgaaggctgtgttcaccaccactacatcatgtggaacaactggcagcgggaaggaggtattctagaggagaaatttagggagttcctcctcctacccttagaaaggtgtctgcttcctttcctctcactggatgcaattgattctacctgaaaccagctaattagaactcagggtataggcatttattgcatctcccagaccttgtaatttttaacttttttttagagacatggtctcactctgttaccaggctggagtgcaggcacaatcatatcccactacagcctcaaattcctgggcttaaggggtcttcctgcctcaacctcccaagtagctggggacacaagtgcacaccaccttgcctggctaatttttatttcttttgcagacacaagttctcgatatgctgcccaggctggtctcaatctcctaacctcaaacagtcctcccatcttgacctcccagagtgctggaattacaggcatgaggcaccgcacccggccccttctattttttggtctacagtagtttcatcttccaatttgtctcattaagggaggggatgcaccccatatgttatgtcttgtgtgaaataaagtagattccagttataggattcctagtacagatatgataaaggagatcttacaaaagctatgattgctctcttgagtctgtggttctgactgtggtgtatcattgtgctatcaggtctagtgaggcatagtgatgcgtggggtgcaattattacatgatgtgatttgtaattatagaatgctatagctccctcctatctaaattattgtattttagctccctctccttgccatctctttcccatcactactaccacatttagcctagcagggcccagtgagtttcaagatctcaagaaaacatgcaggttgttagtgtcagtttgcttctgtgtgtgtttgtgtgtgtgtgtgtgtgttgtgtgtgtgtatgagatatcagtagtcttcaaaaaagttcatccagccagaggatggaagtatttatgcaaacattgttcttggcttctccgcacacatcccagtgaagattgtgtaaaagaaatcatggagaaaaattgcaattgtgaggacaccagtaaatgacaattgatagaacgattatgtggattgctaaaattgaagaacattgtgacacattctaccggcagggagaaacatattacaactctctttgcttagaaagacaatagcagcccattggtaaagccatgaattctggccacggctagcactgagagctcatggtgtgttttcagtctctcctttaccattatatctctggtattcaatagcagaggctcaataaggatttggagaatgaatggaaagactcttttccccattaacttccccaaatgaggagcatcttttagtatgggctttttatacgtgtagttccttgggctacctagattagaatcaccttgggaaagatgtaaaggccttagccctgcctcaagtctatggaatcagcatttctgattctgaatctgcatgttttataagcctccctagtgattctcatgcccattaaagatgtaaagctactgctttagggcatagacttactctgtgtaaccctgaaatggttttatttaggtcatcctgttatcaagattcttgcttcttagcttttgtgcttctttcttcctttggaatatactgctcagtagcaatgcttaggagaaactacagaggaaaaggaaagaaggaaattggaatcttgttgcatcttgaataacttctggcaaatgagagaataacaaggcaaataaaacgctgtttatagatgtagttcagtgcctgttacctagatttttctcaatagatattgttattaaatgatttttttgttaaaaatttgtcccatcaacagagataatagaacttagggtattatgtaatccatatttattcacacacttatttgtcaaagaaaatttcctgagcactcactatgtgcaagtcatatctgagggttgcaaggcagataagacatctggttttcaagagacttagagtctaacggggcactaagagatgctcgtaactgcaggagagcatgtgaggtgccataaagatgttttggcaactccaggtgtttagagaagagagatgttatagggaggcagaagaatcaagggcgtttgtatggaggatttctcgtttgaacaaggtctcacgagaataagcaagatttggatttctgaatatgtgtgaggaggccattccatgcagtgggaaaaagtcaggttcagaggcaagagtgcccaaggcccatctggagaagagttcaatgtgattggaacatagctgtgtggtatgcagaattcttagaatggtctccagtgacacttggccttttctaagcctctcccctgggagtatgtgacatgatgagctgtcactccttggttttattaggccacatggcagaaaggacttctcagttgactttgaattactcaacaaggagattattggggcgagcctcacccaatcacatgacccctttaaaagtagaaagttttgtgcagctattaggttggggcaaaagtaatcgtgggttttgccatttaaaaaaaacagcgaaaactgcaattagtttcacacaagcctaatagttgcagaaagaaatttggagtgtgagaatgcttagtctgacttctacatttgaggatcgagggggctccatgataaggaatgcaggggcctctaggcactgtcagtccctagctgacctcagacatataaccccaaggaggtgagcttgcccaacaatctgagtgagcttggaagtggattcttccaagatcctccagatatgagcccagcctgggtagtgccatgattttggccttgtgacaccctgagcaaaaacccagctgagcccgctgggacttctgacctgcagaactgtgagatcataaacaggtgttgtttcaaatgggtaagtttgaggtaatttgctacacaacaacagactagtacaaatcttttgaaggaaactttatgggggtaaaggactatgctagaatttaaatgataggttatggcacttaattcagtaatcttcagggcactattgaagagcttgagatgagagaacaacataaaaaataatcatcactcacatttgtttaacatttattaggttttaagcatacatttaatcctcatatcaggactgtaatacagatacaactattaccctcttttgcaaatggagggaatgaggctcagagaaattcaataacttgctcagagtcacagagctagtaaatttcaaagccaggatttggaacccaattgtctgcactcttagacatgagctacactgcttctttaaaaggaaaatggtgattgtcaagaatctgggaaattttttaagggcctatttacgtggcttgggttagagggaagagaggtatggggaggaatagtggccgcggaatctgagagaaatttcagaaacagaactgaaagccatggcattggctgcactgattctctggcagatgcatgacagaggggaattagatagattaaaaaaatttttttttaggtgtaagtctctaattaggtattttcagattaggtatttctggaagagctttgccatgcctgtaaatgacattgttcatctctcatccttccctgtcatcctccttcctttcttctcttcttttctttcttctcccaaatccatatttaaagtcaagttcctttttataaaatgggtttggtaatatcaaccttagcagagtctgtgtggaatttaatttgtttccttatataatgatcgttaagtttctcaaatgatgtgagccatagagagggaaaattgagccattataaaacatttaaaattatcatctgtgcatcaggatttagcaaaggtgaatataaataaaataaaataatcatctgacttccctagagtcacgcatagtgactattttaaatactcacacagtacaatatgttaggtcacagtgaggaaaatatagtagatctctagcaaattaacacattcaactgaaataagtgatgccatctcccaaagcatgtgtgtgtgcaactgtgtgtgcgtgtgtgtgtgtgtgtgtgtgtgtcttgcactggttcttttgttgttgctgttgttgttgttgttgttgcagttgtaacatcaacccaactccaaaaagaacagcagttgaacaggcgctctcctgcagagcaacattctgctgaaagtttttcagatttcagaacttaaaacaaaaaaaaatgcagttcatagaaaagacatctctatgggaacatacgttgatagggatactaatgataaagatgattgatgatgatggtgatgacggtgatgttcttgatggatgggatgatcatgagggcagcagctaccattagttgagttcccactgtgtgtcagacaccatgcagagtgttttcaatggataatcttgtttcagtctcccaacattctctgcattttctcatatctaaaagggaggccataatagtactgacctcctaggttgttaggataattaaacaaggtgatatatcaggtgcttagaacactgacacatagatgccagttctaagtataattatttctatcctcatgttataggagagaaattggaagcaacatgggttgaatgacttgtccaaggccatacagtggtaaaggcaggacttgagcccaagcagtattttaatagagccagagtcaaacattcggtcatatggaacattcttctccatcccagtcgcaaacccaaattgttaaggatctctctgagggtgatgggagcatgattaagctgacaggtggtataaatgtaagacaaaagctgcacccttgctagttttccattgccatcaattatgaaaatgagcaaatagattatttaaatgatctcagatgagtaaattattcaaagagcctctcagtcagaagtatttctagaaactcctgaatagaccaatgaaaaccattttggttttctgacagggtcatctgctcatctgtgttgtagagaaacgcaaagccctgaggaagcggggaaagcaggagagagagagttgggggagagggaggcagggagagggctagggagggatagcaggacagggaggggggatggggggagagggaaagagtaagggggagagtgagagcgggagggggagaaaagaggagagagggagaagagagggagaggcagagaggtgggagagggagtggaagagatagagagggcctgaagagggggaagagagaggggaagaaggggagagagaggggggagagggagagaggaagacggaactggggagaggaagggggagagagaagggggaagaggagacgagagagagagaacaaagtaacagtggactttaaggcaaattttcttttctaattatattcccttgaatgctgattcctttcagaacttagagtgccaccagggtctctgggtgggtagggggcttatgaggtaagacccaccttcaactggagatggcaaagcttcatctgattggtatgttatgttgaggttcaaagtgagcttccatttggggaaaaataaaatatttctaaaataagtttgaaagcaagtagaggaaggagattgactgtagtagttgtctgaatatgacgtaaataaatagtaagcatttgttgagcacctattctataccaaaccttacagtatggccttctgtacttattatttcactttagccgcataataaccctgtgaagtgagtctctgatttcatatttgagtcatgcaaacttagagatgttctatgatttttaaaaaattaatagctgagaaaggattcaaatttaggtcttgtgagtctccaagtttagtgcttgttccagtactttgcacagttcctaggatgaatgatggaaattttcatataggttgtggagattcacagggatggtatctgccttggaagttgagtggaagttgggggtatgacaatacctaggcttttgtgtggacttaactcgtattctttaggacaaagtaactatacactatgactgtctctgatgggattgaaccattttcccatccatttatccacccatgcacccagctagtcatccaaagattaatcatctaataaaccatccatccattcatcagcccatcagaccaaccgtaattcatccagccatatgggcatccattcactcttgaacccacccacttacccactattgatctgtttaccaagcattcactgattactgactcagtgccaggcctgtagtaggtacaggcgaagcagagatgactaataaaatatccccgggattttagggaatgttggggtgatcagacccaacaccaggctgtgggggctacaaaatccggcagagtcaaaggaatgggaaaagacaggttaagagtatataaggtgggtccaggaggccaacgctagtgtatggaggctgcaaaggccctgagctccggaagcccacactatttattggtgatcaaacaaagaagcaggtggtgaggacgtgcggatgtgggggtaaacaggtgaggacatgaggacgtaggggtagaaaggtagcagtgcatcaagcatagctgtgatggtttagcattttctttgacacatatgtaatatgctctgctacctgagataatggagaacatatttacaagcctgggagagtaagaagcaaggagccagcaagtctgtgcacattccagaggccattccagtgcaattccacaagggattttatgccctgagccttggattgtatccaagccacgaggggttttatgccctgggcttagattgtggtgtggcagggcagccttccaccctttggcacagagcttggtgttccaaaggccatgagggggtttagagcctgggcccaggacacgttccaagactcttttacattatgacagagaagctagtcctgcctcagctcttctaccaacagggaacttataatgtagtgggagggacagggaaatgcactgctagttacagcattgtgaaatgagcataaacaggagaggtgcacatggcacactgggacacctactccagcctgggcactggggaggtgaaaaaacttcctgaaagacctaagttaggaccaagtcctaaaggataaagaagagctatccaaagggtgacagtcatcttatccattctagtaactgaaccacaaacattatttttctttatttcacattgcatctgatagcagcagctagatttctcccctaccccacccacaattactggagctcagtggctgctgtctgggcctgcttctcactttctttccattgtctctgttctattatttccccatttgcctgctgatggaacagacaggaataacatctgtccctaagaaaatggacagaacagagagctgctccccccagcaatctgcttctggctacaagtggctctgtcagcctgcctctgtagctacagtttggtttcctcatctgtgccattggcagcagaagcttcccattccactaccctgtttttcttggcattggaacctggtttggaacagggggagaaatagagataaaaagaggttgcatattctcagcattggtctctaagctgtggaggatttaatgtgctttctagactctgaagaacttgtaccttgagataattacccatatgttataaaaaaaatatgatgatgattatggcctaggggctatagattcaccactttgattcccccacacacccttttttaagagacgagaggctgcagtgaggagccacctgtagtcccagctacttgtggggactgaggcaagataattgcttgagcccataggtcaaggccacagcgagccatgttcatgccgctgcactccctggagtggctcactgcaggcctcgacctcctgggcttgagcaattatccagcctctgcccctcaagtagctgggactacaggtgtgtgccaccacacctgcctaatttttttgtatgttttgtagagacagggttttgctagattgcccaggctggtctcaaattcctgagcccaggcaatctgcctgccttggcctcctgaagtgctgggattacaggcatgagctaccgtgcccagccttgatcctcttttaacagacattcaagatgagtatgatcactcctgccccctccctccagttacatatgaagaaactgaggctctaagatgattgctgatttgcctaaggttacaaagcaagtatatggcaaagtctagattctagctcaggtctgctagactgcaaagtccattttgtttctacagtaccttatggtagagatgggtggcgttcatatatcagtagtgaaggctgtcagtgctttaattataaaaactcatgttgggggtccccccatccctgcacagtggatgtgcccccagcgttggcaagaaggactattacaggtacaagattccctgctgaaccacatgtctgtttctgagctcggctcagagcatcccactgagatgtatgcaaatctgcctcctaatcagtctcttgcatttttgtgcaaaacgaatcagcattcctctgcacatctgaagctgtaaatcagtccccacccctgcagtaaactgttcctttattccttattactccaccgtatggtttgttatctagccattgtcttttgaaaacgtgctttaaaactcatcgaaatcatattcctggagtctatattccttccatttaaattataattctgcaaattagaaagactgagtgggcctgtttgagatgggaagagtagaggctgagccatcttgacttccctggatgtgaagaaagactccgttggaaatgcccatgagaaaaaaatctaaagttggggaaaaacaagagaatcaactcgtattcccttaaagggagttgtagaatgactcatagaaaccaatggcctctcacttacgttgtctttaactttaacattgaaacaaacaatttgaatcggaagaatcctaattcctgttgattcctaccgtgctggcctctatgtggtccagcagattatagctgatggcatatgttttctttccacaattaaagtgtgtttgaagaaactaggacaggcagatctaacataggaaagcagggcaacaattagttttgggtatcagatcctgacatccatgctgtatacagggaaagcagaaacatttacctgcttttaataggtgaagagactaagatttagagacgagacttgttcagccttcttctgcaagaatagtaaacatttcactccacttttttgttttgttttctctaagaccaggaaagattccacagatgtttcttttctgtttgtttgtttgttgttgttgttgttgttgttttttagagatggggggtgtctcactttgtttctcaggctggtctcaaactcctgagctcaagggattctcctgcctcagcctcccaaagtgctgggattacaggcatgagccactgcacccagtctcattccacttttggcattcaggttggtgacttgaatcaatacagcaagatttgggtttctttttttgtttgtttaaatgtatggggtatacaagtgtaattttgttacatgcatagattgtatagtggtgatgtcagggctttttgagtatccctctcacaaataacatacattgtatccattaagtagcttctcttcagcctcttccctcagcctcctccctcacacccacttgcctttctgagtctccattgtctatcattacacattctgcatctaactgtatgcattatttagctcccacttacaagtgagaacatgcagtatttgtccttatttctttttctttcattctttcttttttctaacacctgacacagggtcttgctttgttgcccaggctggagaatagtggtgcaatcatggctcattgcagcctcgaactcttgggctcaagtgatcttcccacctcagccccacaagtagctggaactataggcaagtgccaccatgcctggctagtttttttgtttttattttgttttgtttttgtagagatagggtttcgccatgttactcaggctagtctcaaactcctgagctcaggtgattcccccacccctccacttggcctctctaagtgctgggattaaaagcgtgagccaccacatctgtcctagtatttgtctctctgtgtctgagttgcttcacttatgatcatggcctccagttccatccatgttgctgcaaaagacgtgattggattcttttttatggctaaatagtatttcattgtgtatatataccacattttctttacccgaagatttgagtttcattaccaaaatgacatggaggctttgcattgaggcattgtcatctcactgaaaatggatgaggattcaaaaaatacagatgggacatctgtcaagttatactataaatcagtggggacaaaagctagaaacacagatgtgtctgatcagaagcccaaaatacaaaatcaatgccaagagatgaagtgactagtctacgtagacaaagagagaacagcatcatggtcaggaaaagtgggctggcgacttcctcccctgtttcactgagcatggcaccggttaggagctgagctgtttggggttagagagcgagtttgatcaacatttacgctgttgagtttggccaggggtaacatttgtgagactcccgctaattctggaaatctgtcattctttgtttccaacagcaaaatggagctaatgataatacccaccccttggggttcctgtgaggatattaaagctactatttattaaatgctttttgtgagtcagaactttagatgcatgatctctcttaactcatacaaaatcctgatgatattggcactattattgcccctattttataaatgagaagtctaaggaacagagaacaagttaatttccgctaacctgaaccgtattctgaaccccatttgtctgactccgaagcccatgctttgactactaacttctgctactttcttcaatcaaattctacaaagcaagtgcaattgtgccatgctgtgggagatagagaatttaagtgggaagcgaatggagcttagttttccttgcatcattccaaaaaaaaagtgcctaatagtttttaaactgtgattccatcacaggtcctgagccaaccactttatgtacattaccacattttatgttcactacaaccccaaatggtacatattattttatagatgagaaaaatgaggaccagagaagtgaattgattggaacatggtcacccagccacttcatagctcagaggcatcataaatgatatacatgccaagtatctagcatgaggcctggaacgtagttagaaagatcttaataaacaggaactattatgcatatacaaagtgcaatctagactctagacttctagacttttaaatggcacttttagggttgttttacctttttttttttttttcattttcagtggatttctaaaagtctattgacagtgttctcttttatcaaaggacctgggtccaaagttttagagacaagtgtcttcaaggagtcctttaagtcctgcatatgtatgaatatattgcaatacatacagttaagcaagtcctcatccaggagccagaaaactgtttctggttctttcacatatttgctgtaatttgtgaatgaggcttggtggttgacaggtgaggaagtggtggattgactcagagctgggtggaaggtggtgccaggtgggtgtgacaggaggacaagatgggagcaggaaaattgtgggcgtggcaggaaatctgttgctgtgataaagagatctgggctgtaatagggaaaaaatggaaagtcacgaatgagcagattgattgggagaaaatagaggggtccagagcccagaggccaaaatgacattggaaaagagacatgagaatagtccttaaatttgaaagttacttgagccaggcgtggtggctcatgcctataatcctagcacttagggaggccgaggagggtgaattgcctgagctcaggagttcgagaccaacctgggcaacacagtgaaaccctgtctctactaaaatacaaaaaattagccaggcatggcagtgtgtgcctgtagtttcagctactcaggaggctgaggcaggagaattgcttgaacctgggaagcggaggttgcggtgagccaagatcatgccactgcactccaccttgggcaacagagcgagactccatctctacaaaaaaagaaaaaaaaaaaaaaaagaaaaaaagttacttgaaggaacatcagtttaccgctctgaaaaattgtaataatatctctttcacatctatgtgactctgctgtgatggtcaagtgaaatgagaaaataaccagcaacttctagcccataaagagctatattaactctaggacttttgtattattatccacataatgacacgcagctttctggctaggatgtgtcttccagtgtgtctattatctgaaatttctatctttttttttctatttcttttcattttttccccaatacagcttcttagccaagtgaacactagcaagtgtatgcataaggtcacactgtttgacacaaggatccaagaaagcttgggttacatttatagttatgaaattaatggcatgcattaatcgtgcagaacctcaaactagcaaatggaattaaaaataattgccaggcctttggatttattggtagagtgaaaataacaccaagtggcttttggcaggaccgccttctccgtgcacagaattatattaacagatgatattttttctatccaaaatagagagccgtaagtgaaaagcagatctgtctcctcttagagcagggaaaaaaaatccaaatacatttccttagtttcattttggcatacaagccctaggcctggaattttggtaaaaacaatgccttgttcctgcctgttctggagttgtgccagtgtcctccattcagcttacaagaacatgcacattgcaggtgggaaggaaccttgactaaataccttctgtgggccagacatctgactgctggttcacaaacatgagttaatgtcatccttctaagatccctgtatataataaaacacctaatcctggttgagcagggactatgtggcagatagttcaataagtgccttgcagttactactttatttatttccatgagaataatatgatgtgattactcctattatgcccacattacatataaggaaactgatgtccaagaagtaaagttagtcaagttcatatagctggtaagcagaagagctgggaattcaggtccagatgtggctgactccaaaatccacatcattttcagggcctattaccagaagagataattatagttgataattgactgcaggaagatcatagttatggtggtcatgttggtacctctgtgtgctaacttgtctgttttatttatttagagacagagtcttgctctgttgcccaggctggagtgcattggtgtgatttaggctcattgcaacctcttcctctcgggttaaagtgattctcatgcctcagcctcccgagtagctgagattacaggcatgtaccaccacactcagctaatttttgtatttttagtagagacagagttttgccatgttgcccgggctggtctcaaactcctggcctcaagtgatcctcctgccttgccttcaaagtgctgagattgcagatgtgagccaccgctcctggctaacttgttcatttcataggtatttgtgcatctattatgtaagcagccctgggctgggtacgagggccataaaggcaaacagaacacagtcccaccctcaatgagtccactggggcagacagatgagtgtgcaggtctcacactagctagtgaggtagggaaaggagaggctacctgcccagttttatgggattagaggctgcttcccagaacagctgccctctgtgttgagttctgaaggacacataggagagtgccaggcagagagtgggaaggggttttctgggcagggtgagtagcgtgttgaaacctggcactgagagaaaagctcaatgtactcagaagcctgtgattagttctgtgtgattcatgagttgatgtggggcagggctggaaccaggagttggttgtcaaaatgaggctgtcatgaatgcagagggaagggaaggcctggggaggaggccaggtcacttagaccatggtcaggcattttcacttgattccagctgcagtggggaaccattaaaaggccacaagctggggagtggaagggccagatacacagaggtatttaaagtgacgatttgggctaggcacggtggctcatgcctgtaatcccaccactttgggaggttgaggcaggcagatcacctgaggtcaggagtttgaggccagtgtggctaacatggcaaaaccccatctctactaaaaatacaaaaattacccaggtgtggtagtgcgcacttgtaatcccagctacttgggaggctgaggcataagaatcgctcgaacccgggaggcggaggttgcagtgaactgagatagtgccactgcatccagcgtgggagacagaataagaccctgtctcaaaaaaataaaaaataaagtgatggtttgggctgctgtttggagaatgggatgaagagcaaatctaccagaagcaagaaggccagctaagaagctgagtcataaaccagtgagaggtgaaggcctggatgagggtggtggctgtgagttaggaaagcagtaaaaaatgttcaaatattagaactatcaaggcttggtgattgatttaatatatatgggggtggcagaagagagatgaattaatggatatttccatggttgggatttcaagaactcctatatggcagatgggagagaaactattttttacggtggaagataagaggctgagttcttctctaagcctactgagtttgaggtttctcggaggcagtagagaagaatgggggaaaggcagcagatcaggggctgtcaagagaggtgataactggagactgtggagcagaagaggccgaggcctgagcctggatgttctgggggcaagagggagaggaaagacaagtcagatgtgttcagagaaggagaagcttgcattttggcagagatgaatcagccaacgaggtgggaaacagttgggtaatggtagtgtcctgacagtctagggcagagaactcaagaaagatgtgagtagtcccattgtcaaatgcagaggaggggcttatgtgcagtgcacctgttggatttagtgaaaaccactggaggtcttaggtcagtttgagaggcaaggacagtgcagaagagaatgtatctagagcccaagggctgggatgcgtgttaggctagaggagagatgcctcctttattactgaaagaggggagaagaaagacatgtgtgcagaggcaggtgagtttgtgggtgatgtgggttgtccatagagtctgaaataagaggcagattcatcagctgggagtggggctggagctggcagctttgcagtcttgtgggcaggtgtgaaggtttgaaatagtttctagggaatgggagagatgcaattaggaaaaaggaaagatttttagccagagagggagtcctaaaatttgaaatgacattaatctatgtggttatatgatattctccacctgtacttgctgctttacaggtgtggaagtggtgggattgactcagagttggggagggtgctgccaggtgggtgtgataggaagacaaagtgggggcaggaaaattgtgggtatgacaagaaatctgttaatgttatggataaagaggtctaagttggaatcgggaagaaatgaaggcatgaacaaatagactaattgagagaagatagagaccagggatgacgctggagaggagacataagaatacctgaatgagagctgtggattttctgaattcagagtcatttgagtcaagcagttctaagtgaatttcccccatgggaatgggtggctacagtggactggaggttctaaatttagagtcactcaagtcaagcagttctaagtgaatttcacccataggaatgggtggctacagtggactggaggtggtcagtggagagatggtcaaaaaaactggccttcagttttatccaaatgctctgacaagtatggatgtgtttatgaaatgacatcaattacttgcaaataggacaatttcaaaatatgtaaggagtactaagtcctagccatatgtggatgaaatcaccaatattatccccaggtgttgagtcagagggatttcccaaggccaattgccaatttcaacttaaatgcaaccaaattccaatgtgcacaaagggattgtagcccaatatccaagggcttcttcagtcttgtcccatggtatccctttattcctctttccctctcttctcctttatatatttgtgtttcttcctgtttggacaacttcctagttcacaaacatgtcattaaaactcagcttctaagcttttgtgcatgctgttctctgatcctacacatcccttctttccactctgacttttcaggtcctttgcaaactgcacaactcccctccattgcactccttcatgatttcttccttccctcatcagatctgcctctcacttctgaagccctctgcatttcttgcacctttcaccctttggctgttagcattttctgttttattgtatgattaattcagagggcattgtattttatcttcctcactggtgagtggatcctttacagataaggacttagagcaggggttgacaaaacccctaactgtttatgtaaagggctggctagtaaatattttaggctttgtgggccatactctctctatggcaagcactcaactctgcatttttagtgcaaaggcaagcgttgaggctatgtaaggaaataagcatggctgtgttccaatcaagctttatttagggacactcacattcaaatcttatataattttataattgtgtcaccaaatattcttttcatttttttcaaccatttaaaaatggaaaaggaaaacccattcttagcttgtgggctgtgcagaaacagcttgcccttgggctgtggtatgctgaccccaggtttagggtctattcactgctgtgttaccagtgtgagaacagtttatggcacatagtaggcactccatgaatgaatgagcaagatgaatgcatgtgatctaaccctaaggaactgaaaacctacagaatagttctgtttattggttgtaacacttggagtaattaggaatcctgagattctgcttttggctataatttgtgtgagtttgaaaggttttgatgtgacatagctcataagtatcatagttgaacttggacttgggtcttccaactccaaatgcacggttcttttaaactgctgtgtttgccactatattaataattcagtgggaaaagcaatgctgagaggcttcctgattggtcaccatgattctcatttctcccagtggctccatagggctctcaaattgttgattactgtctgagatggggataattggtttgggtgaaattggattgacggtggtgggttacttaggcttagttttcaaaaacagcaagtcttatccatcccatcccaagggaaccctcctcttcccccagtgccttagaataatcacgtttttaactgggcaaagctgtcgttaagcttattactgttttctcactattaaatcttctgttggctttagtatttcaaatgatcctcttgttggaatactttagagctcagacaagcctggagcaaagtagttttgggccagagatgagcaaagaaaaatgattgtcaaaataccatcttatctaaggaaaattgaaattctcatcagtgtgcatttcatcataacgatgcatttcacccatgcacaacggctttggttagcatcctcataataactagcagggcctcaggcaccaacccctttcatttggaagaaggaaaatgtccatctcaaaaacttaaatttattattttgccccagatacagaagaacaaatgcccatcagagacctgctaccaagttccagacatttcacctctcacaacgcaataacttttcacaggcgagggggatgaaatgctgttccactgattgatacctccaggttctgtaaccttattgcaaaactctgcagacacagtcaatgaggttaactttgaatgttcagggctgagatccaaatggaattggctttttacataatgctgagtgaggaaatccatcagcttttgacttgttagatccttcaagtcaggtttgatgcattgaagtctcgtgcttccttagcctgcagtttaattacctggaacttatctccttttataaactgttacacactcagccccacattttaccacttttcaaggttttcatttaaaaaaaaacttgccatagagtaagagaagtcatatctatagtcatgttcagtcataattttcaggctggtaagaatgaattgattatcacaataaataaaaggctttttcagctgtcagcccaggatcacagtctacctctcttagccactttctaactcttattggcaagtttgctgagggaaaaaaaacttcttaatatcattcaggtaaatactccccaaaagagctgtttactctgccagactgcaaatggcatttcatttattttacaattggatgttatgctgatctttgaaatttacccagaaaaagtacattagaaggtcaaacaaaaacctttaccatatttctaaattgtctttatgcaggtattaaaaaataataatagttatcactgttactgtaacaaaggactgtccttaggtcaagttctcatccaatgttatgtgtttaaccttccccagccccaattcctgtttctgtgattgtcctagttaccttcacatctcctcctaaactttttttgcagacctatatgcattctagttttctcctccaagaagcagccccttaagttcaaccaagtttatgtttgggtttttataataacagatgcagatatagaaacagaattgtgttgtgttggccaacaatatctcaaatataacatgatacagaatgaagatgaaatcctcctttctaaggccccttacataatggatggagatgaccacagaggcaagggagaagtccaatcagctgctagagcattaatgacattcctcttggttgaaacccccaaattacctaattgacacatggttcacatttgaacagttgattttctctgcctgatctgctgttctgatcgccttttggatgtccgtgttggtagcagtggaattcaacatcaagcctgcaaagtagagctcagtgcagctctgctgttagaggtattttctgtggtggaattcaaggtcctcagaagagtcaattcacaggcaaatggaagaagtaaaactgtcatgagtaaaagcacactgtaagaccacctctggctgctttctccccacctcctgtgctccacatggaaagaaaatgttgccccttcccaaagtggaagactgtgcatattggggcgagaacctggcttctccaactctcaggacatcactgtgctgcatggtgctaattattaatactgtcttcccaactgatccatgaaatattcccttaagaaaccaaactgctcatgtttgccttaatatttcccaaagcaaataggatggcagccttggaaatatcaggcagtggtaacagctcctgccctgaagtccaagctcagattccaggtcttctcacttgctgtttgatcttgggcaagtcacttaaattccctgtttgccaacatacaaaacgagtctaataatggcgtttttatcagaggattgtgagggtaaaatagaaaatgcccgttggggtgatcacagtacctcaataaatgccaacaattatactcgttaattgtttaataattattattgcagcccatggaagacggactgatacggaacttgcacaatgaaggactcccaagagcaagttcaaaaaattaatccatgattatgaaagagctccttttttatttttgctgatttttcaagtctctggcattatattactccaaggtagaaccaaaagagagaaaacactattaactttttagctaattacaagaacccatcacttttaagagcacacaaagaattaaaagtaatccaaagaaataggactcctatctttccccagggatctggcaacaaaggaactctggaggactgaagattatacatgaactcctgaagaaaatgatggctctttgttccaaagatttttccgcttttaaatttgagattgaacaagcattgagctcttcccctgttggctgagcctcaagaggagaatggaagcagagatgcgggttgttcatggaaataacaatcaaaacacgtttctatgaattaccagatcagtactgggttctaagacagttgatgctgttatccataaagatactagattatcttgagagcagttattacgagaggaaaaaaaatctacttctccaatgtgagctgtgtaacaattaggcaattctgaaatttcaactgagaggaatttaattaaggctctaatagctgattaaactcatttagatctgctggcaattgccagtggttacataagtaacccaagaagaaagatttccatcttgttcttatgctttatttaatcctgtatgttagtcataggtcttcccctcctggtgctccttaaaatggggtccttagaccacacggagcagaatgactctaggacgctggttgaaaagtcaggatcccacaccttatcccagatctactgattccaacactccagagatacaggagtctgcattcttaatcagcttccaggaaaggttcttattcatgccaaagcttcataatcccaccacctccaatcgttgcatttaaaacagtgcattcagaggaagcaggcactttacctcaatatctgaaaagcagttcttagtttcactctgccggtagccatccaaggctcatggcagtgaagacagagcaggtttgacccacacctgctctttagtaatttctgcatagaaacttgtttgtgcataccacacaggggaaaattgagttccaaagtgacgcttgatttcagcagactggttttctgggatactctttagatcaggtattggtttaaaaaacatcactgaactcaactgcaaagtcctccagatacagcatatgtcaacctaatatcaagccacagcagtggctcagatatctttattgttgtttctggatcaattacatttagatctgcttttggtttcaagcagcaacccaagacccagaattacttatgtgttaacctgtgatcggtttgtttgtgtgtcagatgtgcattcagcggcatggaagtgatgctaatccatgttgctacttatgataaatatggacactaaatcattttaaatttccttcacggccatttatctcatgtcctttggcagactttatatttcaggtggagagaaattggtctcccgtttgctttgtttttcctccttaacatcatcttcctgaagagttaattactcatgttttctccagcttgggagtaaatcactgcttattttctggagtgaaacatactccgaaggtttgcaagctcaatgtgtttgttttaaagcctgtttccccatggttatgaaaccacccaatgagctaactgggtccagccagactagagcacaggcagcctgaactctgcttctgttgttggttttaataaatttcctgtctgatttttagttttgcaatttctattgtcttgtctccaaggagagaagatgagtaaacaggcaacttccctttttaaactctgaattgtaagtaaaaatggatgatatgctacagtcagaattgaattcagttcagcggatacttcttgaactgcattgtgggtgagcactatactatatcgaacatggatcacgtggttgaggaagactggccagccatgacactctacaaaaccataattcgaggcaaactgggccctcattccccacccctacagcccatctcttttctgttgattttacactttgagttcacaccagcctgaccatcatggcctgtgtcatccagatcctgcagccatctcccagcttgtcactctgccttccgaatcttctagctacaaactctatctctgcactacattgagaagaagtgtttaatccacttctaattgggggattgatttcagtaaggtcttcagtaagtcctcatccccatcccttacatatgtcacttgcccataggataaagataaaaccccataacaggcaacctactaactcccttggtctttctttttttttttttttttttttttttgagagactcttgctctgtcacccaggctggagtgcagtggtgcaatctcagctcactgcaacctccgcctcctgggttcaagtgattctcatgcctcaacttcccgagtagctgggattacagacccatgcctggctaatttttgtatttttagtacagatggggtttcaccatgttggccaggctgatctggaactcctgatctcgagggatctgcccacctcagcttcccgaagtgctgggattacaggcgcgagccaccatgcctgtttcatatttggaagccacttcctgttagaagcattttttggattctcttccagattaggaagctgtgttcttcaacagcatcctgtgcctgctcccggcatagcatttgtctcacttcattcacttcattgctattaagctttgacttctctccaccgagactggaaactctagggataggatagacctctctgaggactgttcaccaccgtagccccagggcttccagtattacccggcacagtggaaagcactgaaggcatgtgggctcatgaataaacaagtgaggggaaagtgtgttctaaaggcaaagaaaatgcaaaaatgaattccagatggagaattaggttccatgggagtattggcatttgagctaggcctgaaaagagtgggtaggatttcagtagggggagataataaggagaagaattccaggcagaagaaatagtgtaggcataggcaggaaagtgggtgtcgttcagggtgtgttttgtgaaaagtgtatgcatcattgtagcttcatatcctctctgtgtgtgtgtgtgtgtgtgtgtgtgtgtgtgtgtagaggttcgagtatatgtgtttgtgttaggtatgtgtgtatttgtagttgtacgtgtgggtgtgagcgtatgtgattataatgtgagcgtgggtaggcatgaatgtacctgtatataagtgtgcttttatgtagaggttcatgtatagatgtataggaatatgtatacatatatgtgtaggtgtactgatggtattgcttgagttcttataatagtaaaaactgacattcactggacacttatgtatcagacacttatgtatgcacggtttttagtgctattttaattgtaataaacttcctatacacaagaggaagtttgggaaatactttttatctctattatgaatttttccatgtttaattgtgaatatgtgtaggtataagtgtgtgtgcaaaggcagatgtgtgtgtgtgttagtgtgacgatgtgtgtgagaatgagagagagaaagtgagaaaaagagaatagtgaggttgattgggcctgtattatagaagagcttttactatacagagcagtctggatttgattttgtaggcagcatgagacatggagggacttgagcatggagtagatctataattttggtgtttagatatttgttttttaggaggtggcttcagagaccaggagacctgtgatgaggttattttaattgtctcttgtaagcatttcataaatagatcaaataagataaaacactcagatctctttgaaagagccacgcacatctattaacctaatttcttccagccttttgcagccttggcaacatccctctgaatttatccggacataagaggtgtatattaacttgagacatacaatttctggagatgaaattatctctgctctaagaacatattggctgaacattttgataagtaatcactgccctttaaaaaaaatctttctaggagctgaagagcaattagtttcctaaaagcactgtatttaaattttattaataggaattaaacatcattacaaagttaatctaccctttttatatttcttttagcaaaatcacttttctccatcagcggtcaattattattattattatttttgtcgtcacaacttcagtatatttctgaaaacactcaaaggcttatcaccaaaattcagtttattttaaaggtaaagattttttttctcctcccacacaacctattttgttgaattgagaactgcttttaagtaccaaaaaaattcataatagagataaaaaagtatttccctaacttcctcttccgtatagggagtttattagaattaaaatagcactaagaatggtgcctgatacataataagtgcctagtgaatgtcaatttttactgttattataagaactcaagcaatgccatccccactttattgctttcttctctcaatttcttagccagtatttattttctgataagttgttctctcatgactgccctgttctgatagttccatcaaaagtcccagggaaaactctcattggcttagcttaggtcacatgcacattcctgagccagtcagtgtactgatttgccaaataaaggacacgtgcctattcgttaaattagggcagcatctctccaagggaaaatgaatatgctataaccaaaaatctgataaatgaatgacaggtaagcaaaacagcataaggctattgtgaaacccttgggagaaatgtggagaaaagcgtgatttatggctaaaactactgacatggtaaaaactgtgtctaaattaaactaaagttagtatcgagaaaagctcttatgaagttaaaacatgaaataatctaaattctactctaaaattgtttccccattgatttaaacaatgacaaaatagcaatacatagcacatagcattgggcattcctttatgggctttaatacattaatttagtcctctcagcaatcctgtgaattatactattaacatcatcctacttttcaggtgatgaaactgaggcaaatagatattaagaaatttgcccaagtggcacagctcacaagtggtacagctgggatttgaagccagagtggctggctccaaagtttaaactcctggcaactttgctactctgtgtctgagaacatatttgctgtttttaaaaaactctcccttttgaattcaaaaacagtttttgaataaactttttaggttaactagttttatatttacaaaaaacttgcaaagatagtccagtgacttctcacatacctaatgcccagtttctctgattattaacacctgacattagtatggtatatttgtcataatgagtcaattcgtatattattgtcaactaaaacccatgattttttcagatttccttagtttttatctaatctttttctgttccatcctgatagctgatccaggatcctatatgacatgtaattgtaatattgccttaggctcctcttgactaggacactttcttagaccttcttgttttttaatgacctttgacaatttggaggactactggtcagatatcttctagaatacccctacattggaatttttctgatagttttcttataattacaccgaggttataagacgacacaggtagaacaccacgccattatcatcacatcatattaaggatatgtactattagaatgatttatcattgtccatattggctttgaccattgagctgacatcacatctgtcacatttctgcattgtaaagttagtcttttttttttgttcagcagaaaattctagttgcattttttcacagacttaaaaatgagtcctgggttcacatcctggttctgccatatgaattggacaattacttaaaccccatgcctcagtttcctcatctatgaaatggagataataaaagtagcatgttattcatgtatctatttttaggattacagaaattattaaagctttcggaatagtagaaacggaaagacttatttttatcatctcatgtaatctttttttttttttttttttgagatggagtctcactctgtcacccaggctggagtgcagtggcgcgatctcggctcactgcaagctcggcctcccgggttcatgccattctcctgcctcagcctcccaagtagctgggactacaggagcctaccaccatgcccggcaaattttttgtattttttttttagtagagacggggtttcaccatgttagccaggatggtctcgatctcctgacctcgtgatctacccgcctcagcctcccaaagtgctgggattacaggcgtgaatcttatgtaatctttataacaactctgtggccttgttgtaacctttaaaatatgaagaaactaaatttcaaaaagggaggtagtgattaagctgtgctctagaggttttcactgactaagtttaaattcttactgtgagccttatgatctgacctgagcaagaaacataatatttttaagccctggtttcctcatcatgcaatgaggataattatagttatctatgtcctacagttgccttgaggattgagtcatataatgaatgaaaaacccttagcactgctcctggaaacacatagtaaagccctaatcagtgttaacaatggtctttgtcattattgcccactgtgccccagctaggaatggacaagtcaggatttgaactcatgcccttctttagagaatgaggaagagccagctttgagaaaagcctcagatttgagtaccactgttttttgtgcagcatggagaattactatccaagagggctctattgaccatgttcttctttcctcagtcttctaactggttctcagaaccatcctgccaccttttttagagatagcttgccatttggctgttttctgctgtcctttcaccctgggtgcaagactgccctaatatatggttgccatacagaattaaatgtcaagtaaggagtgccacctttgcccctcttctaattatgtactcattaccctgagctcaaatcaggaaagatttgggagggcagcttatccttgcattttacatagagtgctatacctgaaagaccttagagattatctgattcaaacccactcccctcattcctgttacagtgaggagaatgacacccaatcagtgaggtcaaaagtcaagggaatgccattgaagaaactcagatctccatttgtcaattagttcttctgctacagaggctcattttcctgaagataagtttaacaaatgttgaattaatgataatagttccacgtatggagacctttctgtgtgccaggaactgtgcattaagagatgtttgttgttattatcttataagtaagcctcataacagcatatgaaatggaagtgttgtttttatttggtgattgagtgaactgaggttcaaaaagattatgtggcttgttcaaggtcacatggctaaagcagtgacaagatttgaacctgttcatctgtctgatctctaagcctgtgctattaatgattctgaaccctcttgtcctgtgccatgtaaaggagagaagagaggggttctgtagcaatgaagttgatgcctgaaaactcaatgggatccatatgtgcatatacatgtacatgtatacagcacacacacacacacacacacacacacacacacaagcgtgcttgcctgtcctggttgtgtataaatataaccagaagtttggcaaggtgtcctggaacttcattttccctccaagctccaaaaatagcatgtgattgacaaggactgtatgatttcacttgctctgatgcattgaaaccttattcctggaagcactgctggaggaaatggattgaaaccttactcctggaagcactgctggaggaaatgcggtgcaaccctggtattggctcacacttcagaatagcttttatgagtcaggaatgctgatctaaagttacagactcagctgagtgtggtgttcacttttatggagaggattgggaacaggaaaaaggtccagtttagagaatagcagaagagtcaccatcacgtccaaggtgggagcagagatatttttggctgccatcttcaaagtgcacagggtccttccattttggatataacttctaaataaaggcatttggagcatacatactccatgccactgtggaaatggagacaagcagaaacaatatgacagtcgaaactgaggtcttcaggattcaacccattggttctttctttctccctgaatactctggtggctggagtccctttttaaaatggtgttaggatgatgctgtttgctttctctggggaaatttaatacccaaaggctattcagacggccaccctcaatggctctgagtctcgggggctgaagttgcagtaagagcaagggagagaatacaggtccttgatacttccatattttgcctagggtacaagattccaaagctgaggcacatatggacacattaatcattctaacactttctgactcatgcacatgtaaaaaatacaggctgtatgtttattcactccaccaaaaactacccattaagtccctccatgtggcatgccctgagttagaagctgtggacatagaaaccaatcattacgcatataaaattcctggtagactgggaaatcatagtctcataagtaaaacatatacataaacacatagattattgtagattattgaggtataatattgtgaagcaaatgatgtttagatatttaaatcaaattaaggatttatgaataaattatataatgggtttttttgctgtaatatagaaggagtgagtgggagtataaatgaaacaagattggtcatgagtactaattattgaagctggacattgggaatacggaggttcattatatgattctactcttaaatacatttgaacatttccataattaaaaaaaaattggagtaggcaaagaagcttccatcttcaggcaggttatatatggacatatatccatggtgacttctataaatctttttccattctggccattgaacttgattgactcttagtccatttgggttgctgtaacagaataccatagactgggtggcttataaaccacagaaacttgtttctcatgcttctggagactgggaagtccaaatcaaggtgccagcagatttagcgtctggtgagagctgcttcctggttcatagacagcaatcttcttgttgcatactgatatggtggaaaaggcaatgggtctctctggggcctctttcataaaagcactaaccccattcatgagggctccaccttcatgacctaatcagctcccaaagacccctcctcctaacaccaccacattaggggttaggatttcaacctatgaattttggagggacgcaaatattcagtctgtagcaaacccttaaggtaaatcccaacttcttaatagagcctacaaggctttgcattttctggtctccacctatctggagtgctctttccttctctgctcctccacaattccttcccacaactgccacgatgcaactcatcctgaatttccaatttcagcttaagtgtcacctcctcagggaagatgtctctgatatcttttctcctatatgctctcttagacccatgtttcatttcttcctcccaatttgtatgaacatatgtttttgtgtaatcatttgactcatgtgtcttctcaattagcacaaaaatttcatgcaagcaaacattttatcacttccattacagtattctcagtgtctagcacagtgcttggaacctagtaaccactcaacacatatttatggaatgaatgactctgctaaacctgtctacaaacactggcctcagttatagtcccttgtaaataggaatataggcagggaaagtgaagaatgtctgttctcctttatctggtatatacgatttagtagttgagatttttggtgtttgcagtggggtgccgaagggtctatcagatgagaaaagaaggtaagagctcttgggacctagggcagtgttgacacagcagcttcagctcctgatcgagttctctctacctaccactcatcttcaacctccttggctgacccatggatacttggatgtgtcaggaacagggagtagaacttggagaagatttaggaagttattgcactctgggggctcataaacctttgcaacttttctctccatgagcgagcgttggactgaaacttttgcctgactcccatggtgtgggggttgtgatgtggtcaatgacatcaccaaagattctgctagtctttgccttaatttacattatcttgggactttaggaaacatgtctgcaaggaaggaagagtgttggagctataacgtggttactgtagctcaattcacagaaacactgtacatagcgagaaagcacctttgggttcagaaagccccacgttataactctggttccaccacttattgctgtgtgagtttgtgcaagtcacataacctctctgtgtttcagtttcctgaactacgaagttggaataataatgcttaccatgtagagtttgtaggaattaaactaagtggtgatattggcacatttcctgactgtacaggagtgctcaaaagttatgtcattgaggttataatataaaatgctacggtggagatatgcgcaaagttctatattactagggaaagcaggaatgattttacaggtaaggtgacagttcagttatgttttaaatgttaacaacaatagtaaaataatagcagccaccatatgtgttacatgccatgtcaggttttgtgctctatatttttggtactttttggctcattcaaaccttactgcagtcttcaaggtcataccctgttgctctcttcattttacaaatggagaaagtgaagctcagagaggttgaatgactttcccaaggctactcagctagtggatgaagccaggatttacacttagttctgtttgacttcaaaagccattctcttacccactgaactacccaccctctctcgaaggttgtgtttgagtcttccaaggcaaatggaaagaaaagggattggtataacatgttccaaaaggaaacacttgtatatttctttatctatttgcatatttcagtatttttggtttgatctatgtcgtacaactgactgacagttccaagaaggcaagagtcattctgttttagccatcattattcctaggctggcactgggacatcgtaggtcttcaataaatctatgtcgaatgaatgaagaatttgatgcgctcagcattctccccagcctgttacatatcatagcgtgaataaatgaacatgtgtgtgtgtgtttaaccaaattgctctactcgccatcctatcttaaaaagaaatgtatcagcaatgctggacaattttgtaattagccacaggaaatgtttctttatagccagcaaaaattttccagcccatatgatgaggtaatcttagagagcactgattcttttctctcctcccaccctgtcacctctcctggtgtccggcatgtttgaattctctttaagggtttgagattcatttctggtgacacttaaacattacaggaggagaggtgagtgggtctggtcaacacagacaagcctggatttggcacttagcttttcacacgaggtgttttcctcgaggttggtattacaaataaagcggtgacctgtggtgtcaagcaatggcgtgtgggagcaggaggagaagggagaaagagcggtgcgggggcagcttcctcccagcgtgtatgtgaatagcgccaataagctgtcaaataaaattaaggttcaaaatatacagccttcaatttgattgcactaagatgccgactgctgctccgagggaatacaatcgattctattttgacaggtcttgatgtacgctaagcagtgacagtctcccctctgtgcaggattaataaaagttcaccttaatttgcaacttaaatagaactgtatctggggtcaaaatgatgcttttaatttccccacctgctccatctcttctctgtgttgtctcaacccccactcctcttcttttcactctctagcttcatcttcctctccctttttctcttttccttcatcttagcacctttttcttctttctccttttcactttctctcctttatacttagaaacaatatggagtacctatgttgtgcttttgcctttcatgcattgctttattgaattcccatggcatccttaggaagtagggggaattgtgttcattatacagatgagaaaacagaagatcttaggattaagagcttgcctagtacagctagtaagtggtacagtgggagaatcaaacccagacctctctgattctaaaagtctatgctgtttccttgccatccgtggtcctgaactctggcagaacattagaaccacctgcggggctgtaaaggtatcagtgcctgggcactgcctccagagatgcaggttgattcctctggggatgagggcggctgggatggagaactgccctatattctgttttctctttatgcccgtttgtcttagcacagaagtagatgcatatgttgagatatgtggcagaaaggcccttgagacggatggatgtctctggcagggaaaggatttgcctctccagaaatcagcggcggaagaaagcacagctgtgtctttgtgtttgtgctgcaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaagtgagtggcaggaatgctgtcacctgaacgtgcccaaccctttgaaatagcatggatcatcgatagtaacaatatgtgtacttgaatcacaaaatgtcatagaaaatacacgtcgttatagtaggtataatacaataatcaatttaaaaaagacttagataaattcctagagatgtgccacacttgcattcatttaattccaccagcaatatgaggtgagtagttttgcccattgtaaatatgataaaaccgagttatgggaagattatgaaacatgttcaaagccatctagctaggaaatggaagaggtaggactcaaacagtggtccaactgactccacagacatgtttttaacccttaggttgaatcaatcctccccttcagtctttctagtttaatttaatttattcatttatttatttttgaacatacatattcaaaaaatatctttatatttttaatatagaaaacatttttgtatattaaaataaatataaaacatatcttaatatattaaaatataaaacattatatataaatatatagaaattatatattttatatatttaaatatataaaacagtatattttatatatttaaatatataaaacagtgtattttatatatttaaatatataaaacagtatattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaaatattataaaacagtgtattttatatatttaaaatattataaaacagtgtattttatatatttaaaatattataaaacatatattttatgtattaaatatataaaacaccatatgtttttatatattaaaaatataaaagatcatatatttttatacattaaaatatgtaaaacatcatattttatacattaaaaatataaaacatcgtatttttatatattaaaaatacatatggttggacacagtgattcacatctataatctcagcactttgggaggccaagctgggcagattacttgaggtcaggagttgaagaccagcctaggcaacatggctaaaccctgtctttcttaaaagtacaaaaattagccagctatggtggtgggcgcctgtgatcccagctactcaggaggctgaagcatgagaatcacttgaatctgggaggtggaggttgcaataagtcgagatcgagccactacactccagcctaggcaacagagtgagactctgactcaaaaataaataaataaatgaaaatagaaatatataaacattatacatttttatatattgagatatataaaacatatatttttacatattttatatataaactatttttatatataaactatatgtttatagataaaatatatagttaatgtacaagtttatatataaaatatatatttatatgttaaaatatataaaacattttcatatattaacatatagaaaccaatatatttttatatattaaaaatatataaaccatatattttcatgttaaacatatataacatatatatttttatatatatataaaacatataaaaataaggcctgttttggtttggagaaaattttatcaatgaggtcacaaatgtcagcctctttgaagttgaaatcctgaatacatcatggaataaataaatatgcccctactgttatgttagaaatgtataaaacgtatgtttttatatgttaaaaatgtataaaacattatatatttttatgtgttaaaaatatataaaacattacatatttttgttaaaaaatataaaacatatatttttatgtgttaaaaatatataaaacatatatttttatgtgttaaaaatatataaaacattatatatttttatgtgttaaaaatatataaaacattaattttttttatataatgacagggtcttgctctgtcccccaggctggagtgcagtggtgtgatcacggctcactgcattcttgaactcctaggctcaagtgttcttctcacctcaacctcctgaatagctgagactacaggcctgtgccaccatgtctggctcatgttttaattaatttttttttttagagacaagagtcttgctatgttactcagcctggtctcaagctcctggccttaagtgatcctcatgccttggcctcctgagtcactgggattatagatgtgagccactgtgtccggcttcctttagtctttttaaaaataattatttagtttccacttttctggctgtccctttccttccccccacacattcttcttccatctcttttatagatcccagatctatgcttctcaagaaggttaaaaacgtctctccatttgggagtgaacacacaccttgcatgttactttctgatacaatccaggtgcaaatggaacttctggcagtttctcagctcagcaacagccagcaggcactgcatctgtgtcatttctccttttgttatgattgaagaaagagctggcattgtccattatgaggtccccttaatctacaaaccctctggggacacagaaacctccatggccacctccaaggccctgatcctggtatttcctaatgcaaacataagcaaaaacaccacctcacaggagactcacagaagaaaaaggcctgctgttggaaactttatttgttttctgagtcttttctgatctgtttcttttacctaattcttactcatcctttaagtgtagctcctgcgtccccaagctgggttagctcttcctacttccacagtacctgggtgtatctctctctaccctcatcacctgtctttacagtgtatagtttgtcttctccctggcttctgagccacctacatatagggaatgtgacttattaatatttgcaccctcagttacaagggcacagcatgacacaccaatgtttgtttcatgactaggaagagagatttttacttcctcgtttcaaactccagtctcagctattatcacacaagatgcaagtgcccagatctcagtccttgagatcaggattttaaagatataatatgtgattgctaaatgtattgtgaaggcctgttttggtttggagaaaattttatcagtgaggtcacaaatgtcagcctctttgaagttgaaatcctgaatacatcatggaataaataaatatgcccctcctaaaaaggcccttgctttctccagtgtccccactgtggctccctgggatgaagtttttttttgataagcagtcccccagcctccactctcctggagatgaggaagaggtggggcccaccaaggaagggcaagtgtacatcccatgattcatgattcataattcatcatgattcataattgtgtgaaacagaccatgttttggggtcaggaatgttttaatgatttttgctgaattcctttacagtgaaataacacagacattgttataagtaaaattgttataaataaattgttttaatacagaatgaatgaatgtgcattaagcacagtttgcatgttaggcacattgctgggcacaggggatacatggatgaacagggagggcaaaagactaggacctttccatcatggaacttacgtggttagaaaacaattcgaccaggaagaaatgggtgaccccatgttgtaataaaccttgtgatgaacagaaagagagtggtgtgagaagagagtacatcggggtatgtggggttactttagctcacacagataagatttaaggtgatatatacaggatgagaagaagccagacatgtgaatatctgggcaaagccttccaggtagaggcaatggcaggtgcaaaggccctggggaggaaaggagcttgggagtttgggaaacggaatgaaacccagtgcagtgctagagagtgatgagttacaaggaggatggaggggatgatgtgggaaagttgtcagaggatgttctaatttgggtgggtgttctttgagcagaacttggcccgatgaagaaagcaaagtggctggcacaaagcagagtctaacttcagtgggacacctcccctatgataacaataccctctgtgtttcaatagggcaatcaactgaggccccgtgtgctccagaatcaataataggagtttagagtctttaaaatcaaaagccctggagctgaaaacaagtagatccccaagtactgagtcacatttgtatgaggaagagaaatcaaaataaattgctgtctttaaaagaattgacttttctactgaagactatcaacagcttaacaggttcaaattcacgtttttggtttctgtgaggagatagtagcttgcagctttccttcttccgcttggggatatgaggagtttactgtgtctggatgaaatgaaagtctgactcgtgagagcaatagagaattgctaggatccactaatcccaacattaaagaagattagatcaattgcatttcctatagggaacgtctttgaggaaggctgatcagttgcaaaaagaattcctgttagacaacatgattgtgtgaaacctttttgtttctcacttctggcaagtggtgggatcttctaagaataccaggtaaccggaaatgagctgagaaatcttcctttctggtctgttagttgggtgataaagacatgcagagaaaattggaaaaatcatttggcctgatgtgtagcgagaaatggccatgctgtcaattaagctcccaaactgtcaaatcattggtgggaagaaaggaaatttatttttaagtgctggatgagatttgtctgagtctgcgtggtggacaggagccaacccaggacctggacacagctctgactcgcatggctgtgctcacatccaccggctatactgggaaattgtagagctggtaaactggacaatttgttggatccctttccccgtatttgtttttgtgagtcattccctctcttgggtggtggtggagcactaagagagatcacatggggaccatttctcagtctgtgtagttaagtcacatcccctgcacacccacacaagggctgtaataggaaccaacagacgttcccaattacaagctggtctgcaattccataattactgtgataaattcaactattgcctttgctgcgtgcctttttcatcctgtgtccccaaggcccagttccatgtcttgtgcacagtaggcacttagtgggtgcttgttgggtgaaaatgcgtcattgatcatttgtatttagaaatatacctcatgttcagggatatgggtgagataactcataaactggctgaggtttccagggagaccaaagaatgccactatatgcctgtgaccttgaatcttaaacctggggcacctaaaacttctctctaatcttccagaaatcttgaccaggtgaaggaagagcctgtgataggggaagaagggaaggaacatagaatgaaggtgatacaaatgaacagaggtagggaaagggcatcagtgcatggccaacagcgaccagaaagaaaaagagaattcgattttgacacatttttcagagccatgtatactaagaaggaaatggtatctggacattccatcaactttaatgtacttaggacacatttctatcatatttgtggcagttttaactctagcccaaccccctccattctgggtaattggtggagatggagctggcacatatcccatgactgtacagtgttgaggtcactaatcatcacatgtaaatatacacagatgtggcctcctactacccccccactaagggtggtggatgacagcaggtcatccagcctctaggcaagagagtaaagtctctatggtggtctgggttgacagaagcagagtggttgagtacaagtcactgacaggatgtgggggtgggatacaatggtgaagagagtgattcaagacaggcagtctgtgatcctgagataaaggaaagcattgataagcaggtgtcatttacaacccacttctgttactcaaaattatgttttccagcttgagtatggtgtcgcacacctgtaatcccagcactttgaaaggccaaagtgggagtatcacttgaggccaggaggtccagtctgccatgagccatgatcacatcactgcaacccagcctgggcaacagagcaagagcgtgtctcttaaaaaattgttctgtcaaatctgcccaccttcatggatatagagatgatgtatatcatgtaaatcaatgttgtttgatgcgtgtgtgtgtgtctgtgttgccaattacataagtagtatgtacttactagataatttggggaaaaaccctaaaaatgtaaaaaagaaaacatgtttttcaccgttccaaaatagcttgcttctttctttctttcctttcttcctttcctcgtttcctcctttatttctttctctttctttctctcttctctctccctccctctctttctctctctctctttctttctttctatctctccctctcccccctttttctctttctgtttctctctttctttctttctttctttcttcctctctctctctctctctctttctttctttctctctttctctcgacagagtcacattctgtcacctaggctggagtgcagtggtgcgatcttggctcactgcaacctctacctcccagattgaagctattcttatgcctcctgtgtagctgggattacaggtgcatgccaccatgcccagctcatttttgtatttttagtaaaaatggggtttctccatgttggccaggctggtctcaaactcccaacctcaggggatccacccaacttggcttcccaaagtgctgagattacaggaatgagccactgcacctgtcctatgcttcatatttcattgtttttccatacagttatttcataagctcatctgtttttatatagctgtgattattctgtttgtactactgtgtaacctacttttttcatatgacatggaagcataagaattttcctgtgatgatgttggatttccatagacatcactttagtgcttaggtaacactccaatgtgtggatttgccaaaaatgggatattcaaacagagaacatattcatgaaatgcataactcaaagacagggttgagctaatgggatgtccattaatcaagcatattgcccagaagaaaggctttgatcttatgtgaattgtctaagtactttttgctatccgttggatagaccagtgtttcctttctttcttttcttttttcttttttttttggagacagagtttcactcttgtcacccaggcttgagtacaacggcatgatattggctcactgcagcccccgcctcctgggttcaagtgattcttatgcctcagcctcctgagtatctggaactacaggtgcctgccaccatgcctggctaatttttgtatttttagtagagacagggtttcgccatgctggccaagctggtcttgaactcctgacctcaggtgttcacccgccacagcctccgaaagtgctgggattataggtgtgagccaccatacccggcctcctttctttttaaaggtatttttctggtttgcctgggtgtcctttgaatatgtcttgttcaggtgaatacagcaaggtggctggtacaaaacagtaagtgtagccttggtagagtatacaatagcctttaagatagtttaaattttaatggggtctttacctgatcaaggaccttgcttttagaagtgtctccttttatactacatgtcacataggtaggtagggaagatgttattaatgagccctcatgtaacatttggctctatcaagagaagttcagtgcacaaaatcaggcatggaatagaacccaggtctcctgattcttggctgaggtgttgtctgggtaccttcacttctcccctttggtttcaagcctctgtaattatagaatgaagcaaaaccttgctttctctgagaatttcacatcctcctctcttccattctctagtaagtttttatgactcagtttagatctgatgactaaactctagtctaaagttgtgtatgttataaactcttaaaaatttaagagttggtaatttttacctgtttaatgggtgtacaaatatcaactaattcagaaaatgtcatgaagattaattcaacaattagtatgaagcctttaggatagtgcttagcaaatagtaattactcaataagtgttagttcttgtcatgataactgctataattaaggacactttctgcttttgctgtcatgtactcacagtgtgtccttgggaaagccacttccccttttaaacttcagtttactcatctgaaaaataggagaagagtacagctaatgattgtgaacaaaccttccagtgctaacattctgtggtcttggggtttttctttacagcaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtaagttatcttttcatcccctaggctcttactcagacaaagggcctgcagtcctcaggaatgttagcaggaaaagtaaagtactgttgttctctctctctcttttttttttttttttttttgccttgcatccaggtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctaggtgtgtgaatttcatagtgactattgctttcctataaggaattgtaggaaatcttgtttgctcagaggatgggaccagaaaggaacttgtttagctctgtttggccatggcagcatatttcagaggatgctgcatttgaattatcctatgaaagggttaggctttgggtccccacccaaatttcatcttgaattgtaatccccagctgttgagggagagacctgatgggaggtgacgggatcatggggatggtttctccccttctgttcttgtgataatgagtgagttctcatgagatctgacggtttaataaggggctctcattatattattattattataaggggtttaataaggggctcttcccccttcgcttcacttctctcacatgccgccatgtaagacgtgtctgcttcctcttctgccatgattgtaagtttcctggggactccccagccatgtggaactgtgagtcaattaaatctctttcctttataaatttacccaatctcagacagtttatttttttgagatggagtctagctctgctgcccaggcttgagtgcagtgttatgatcttggcttactgcggcctctgcctcctgggttcaagcaattctcccacctcagcctccccagtagctgggattataggtgcccaccaccatgcctggctaatttttgtgtagagatggggtttcgccatgttggccagactgatatcaaactcctgacctcaagtgatcctcgggcagttctttatagcagcgtgagagtagactaatacatcctaattcactcccctccatccccagttcacatctttcatttgtcttaaacttggaaaaagctgctgaaaaaaatatgatcacatattcagatactggtcttgactctgtagaatgtaaattaatagatatattgcttagaatattgaaaacatttaaaaataaagctgtccacagttaatttaaaccagctcatagacctttattcagcatctacatatccatcctccatcccacaaagaacagcagtcatttatttgctagatgtaagagtgaaaataatgatgactgcacgatgatttatgccaatattctgctaataggaatagtctgaaaagtatatgctgatttaaaattaatcgaatcatattttaaatgtgactacccattaagccaaatagtttgtaaagaaggaaattcttgtgatttttttaaccgttttgtaaatttatgtttttacataaaaggtgttttttttttttaaatcaaggaagagctatgttttctatcatctgcttttctctagcacttggactgtattgggtagcctggctagagttgaaatttcatggaacatagtaaagcattatttttgtctttaaaggaaagtgttgtattaactgtttggttatcataaatgagttttgactgtaactatcttgttgaatatcatgaaattcagatcactaattcccccttggcactcccatataagtgggtttgtcccaaattagggaaggttaagacaaacgtgaatctctggaggaaaactgagaggggaaaaatatgtataatttttaaaaaatttcaatagctcaggggtacaagtgatttttggttatatggacgaattatatagtggtgaagtctgggcctttagtgtacctgtcacctaaatagtgtacattgtaggtaattttccatcactcatctccctcccatcctctccctttctgagtctccagtgtccattataccacttgtgtgctttttcatacccataggttagctttcatttagaagtgagaatatgtagtattagattttccattcttgaaaaacccatcccccagttcacatctttcatttatctcaaacttagaaaaagctgctaaaaaaataagatcacatattcagatactggtcttgacactgtggaatgtaaattaatagctatattgcttagagtcttgaaaacattttaaaaataaacctgtcggtccacagttaatttaaatcagcccataaacctttattcagcatctacatacccatcctccatctcacaaagaacaacagtcatttatttgctagatgactatcatatatttagaatgatggcctccagtttcatccaagttgctgcaaaagacattgcatcattcttttttatggctgagtagtattccacaatgtatatataccacattttctttatgcaatcatcagttgatgggctcataggttgattccatatctttgcaattgtgagttgtgctctgataaacatatgtgtgcaagtgtctttttgatataataacttcttttcctttgggtagatacccagtagtgaaattgctggatcaaatggtagatctacttttagttgtttgagaaatctcccccctgggaaaacagttatattaaagtcaactaactttcttatatttttccagagacaaaaataactttatctcttaaagcaaattgtaaactgaaaccaatttgtggacaccaactccaagcccattgtcttattcttccactgtcttcatttatatgtaatgttggcatccagtgaaactttcatgtttcgttctcttcagtgaaatattgactaacaggattttggacactgccttacattcagagcgctatggatttactgttttcatttttgataatccatttaagctgttaaaatgcttgccactctctggatttgattttgcactcgttgcttcaatttttgtaacctttgttggagtaatgtggaccctgacaaatacacacctcattatgttccttttgtccctccgtctgacatggattcagatactcgtattttaataagagagcctcactatgccaggaacaatgcaaccagctgatattgacaacacatgcagaatcttaataattcttaagtggacattcactctttagtcactcctagtcatgtttcccctcattccctttcagactctttggcaggaatcctttgtcctggaggttaagaaagggttagaggaagtgagttcatggatcaaaatggaaagaaattgtttcttttcacacaaaaaagtcttgtatctctttagtgagctagagagaactctttttccaattcaatcagagagaaaaaaatatcaattggcttgtcttatgaaaatgggtcgtgaatattgaatctggcctcaacccagtttctctagatttttatcttgcttgcatttgtaaaacatttccataaaaatgtcaagtattttgctaaatttagcaaaacctctctttccccacacttttcctgctgcatttttaaaagtaaaataaattgtaaccagaggaaactattttcaaagctgtttttacccagtaggcttaatatttttcctagtcactaaattacatccctatttgattgactgtgcacccccttatttacggtcattatctacagattttgaaagtcataatgaaccagctaagctacatttttccattcactggcttagtcatctggaagagccaaaacattcaaaatctgattttattgctgttcattatttcctattttctctcctccacaaactccattaactcacatcagaagcacttgcaggtaatgcctctaagcttttgtgtaaaaatgtaaccagtggctcttcaaggacagagatggcatctcctgtaatatttctatctagttaattctgaagagtttccaaacaagttggattctttgatccaaagaaatgctgacctggtatctcctcgattgcagttccttcatggacaaatgttgaatctgttttaagccattagaagatgtaatagagagttatctaaactatttctgggtcactccttagacactatagatgttgctttaacgatgtttctttgttctggagcatgtgtgtgcattcacgtgtgtggtatcttagaatagcaacccttcagggcactgataggtacttaatttactaaaacaagactactgcagcagagtcctttgatccgtgctgtgctcacaagttaaggaacagatgtggtcaattccaagtggggagacatgtgggaacagttgcttcatcagtttccacttgattttctgactagcgtgttagtgacaaggatgcacctaccaaaaaaagttcactgcaggtttacagattcttacatgcacataggataattcagttatggtcccttctaatgtttaaaaataatgttttcacagcctgcagagaaatagacgttaccagattaataaatgtgctttttcaaaaaccagcacgcccttttcagaaccatggacagcgtattgttgccccagtatttctggctttaatcctggaatcacacagctattccactcagtatattgtctgtatattgtgtgcctcacacacgaacaaacactttcatgtatatgcttatttgctcatcataatgatcctcctccaataagacacactacgcaactcggagaattattttatctctattcttgaatatgaagtacttataaatctcctaatcatttatttatctaatttcctttttggatacaactcagtattaaattgctattatttcagggacataatattgtttattactcaagctaaagttaaaataaatttcagttgcagtttcattgatttcttggagcgcatcttgtgttacttaagtaagttgtgttacctgttgctttttaatatatttgcactatcaaatgcattagaaagcattcctcccagcttttaaattatccaatatagctaaagttaagttcggacatattagtttcttgttatacattaaactcattaaattggaatttgtggtgacctctagctgtgttaagtagtcatactctaataagaaggtggcctgctatcaacctagctctttattattataagtagcttcactaggaaaacaattttaaaataataatatgtttactattcaagaagtattattggacttattttaaccctcagaaaatatttgcttatgaggaaaagggttttaagttcattggtgtctataggcaatttcttccccatgatacattcaggtggagatgtattcatttttaaaatttattttctgttgattttatagcaaatctataccataaataaaatggctgcagtcagctaattttcatatcctcaatcaagttgaatagtaatcttattttacataatatttcttacctttctagagtgttacaaggcttagagccttatgacttggcctgcccttctaagacatccacctactgcctaagttacatgcaaatgagctgatgaaaactacttttagtggaaataaccatctatccatctactattttattgcctctaccctttaagtgatgcttttttattgaattatcatgtgaagataatatcctcaattgactttcaattgcatttaaggctgctaccaacatcaacaagattaataaagctgtaggaatctcatctatctgaggcaaaaggtgaaatggagagtgtggtagattataactttccaatatttctgtcacccatgattttataattcttttccaacaggttataattctccctttatttttggaattccctgcatatcatctttctagcatgaaaaaataaaaataaaaaccataacaatttgcaggagcctatggtttactatttgggtctagtcttttttcttcctagctttagccccctggatggttctataattacaaaggaaactatggcctgtttatttgcattctaacttgctccctctttcttatcactcttttttcttctgattatccttgacctaatttgtaaaatgtcctatgctcttctctatttttattatattatatgcaatcttatacttcaaatattttgtagaataaagaatgatttaaaatgatgaataaaaaatgtctggctggccaggagcagtggctcacgcctgtaatcccagcactttgggaggccgaggtgggcagatcacctgaggtcaggagtttgagaccagcctgggcaacatggcgaaaccccgtctcaactaaaaatacaaaaattagccaggcatggtggcacatgcctgtagtcccagctactcggaaggctgaggcaggagaattgcttgaacctggggggcggaggttgcagcaagtcgaaattgtgccactgcactccagcctgggtgacacagagagtgaagctacatctaaaaaataaaaataaaaataaaaaatgattagcttcttttgaaggatcagattcaaattagagaaaatatttttggcgagcctgcaaatggatgtctgggcttcctgctggaagtgaggaagagataactaaccacgtttccattcctttatctgtttatttgcagaaccattcagcgcctctgtctgggtgatgatgtttgtgatgctgctcattgtttctgccatagctgtttttgtctttgaatacttcagccctgttggatacaacagaaacttagccaaagggaaaggtaagggtaccttcatgagcatgattcaatgttgttgcaatttcatttacctttaatgaaaatttcagttttagaacacattactctagaccaggcatggtggctcacgcctgtaatcccagcactttgggagaccgaggtgggtggatcatgaggtcaggagttcagaaccagcctgaccaatatggtgaaacccatctctactaaaaatacaaaaattagctgggcatggtggcacacacctgtaataccagctactcatgaggcagaggcaggagaatcgcttaaaaccaggaggcagaggttgcagtgagtcgagattgtgccactgcactccagcctgagggacagagcgagactcaatcacacacacacaaagaatacattatactgcgttggtgtaccattgtatgaatggttttgggtcactgatattgcttgtaataccagaaaagtatggtttatgtacttcaactgatggataaaacaaaatgaaatattttaatcttgtcataacctgaagtcaatagttgttaggtgaaaaccactgatgttcaatttgttgggaaagcagatttgaaggaacttttctgacaattaatttaaaaaatgcttgtcaaatgctaaaattgtcatgggtttcaacttcagtctatgcaaagaaaatgactttataaaatctagtttaagaacattcctcaaactactgaatcaatttacattagtttgacaataaatataactatgaagtgatatatttccccatagggttatattttcctgttggtgatgccaggaggaaatcaagtgtgctaaaataaaatgcattgatcttagtgcattgtagttgataaagggacaatcagtagataggaaataaaattgggaggcattcgttagctataactcattaaaaggatcccactctagccagggtttatgtcatacacgttatgccattttgagtgggctttcctcagtgggcactaccttctaaatgggtgttatcagaaaagtgtcaggaccaaatctctttcccaaaaaatgacttgatatggtagaggatggaacttgaagtctcatatcccccaaaaagcagagcactttaatgtgatggatacatattcttttcacttagatgttttaatattggaaatactcaacaggtcatgggaatctattaggaacctagttttattgaaatctttcaacttcttcctcaccattgaagagtggtgattaccacataaaccatcttcaatcaaccagatactaaacaatgccataaataatgatgttgtgtttaatgggagattgcaagccttcatttaaagggtaatttaacctctaagaagatttccaacagggtggaatctgagacagtttctgtgagtgaccacactgtgatacagtagttccttatatttgcataatcagggcttgtgctgttgtgaatttacacattttctgatgaatatttatcaaatgggtactacgtgccaggaggcactatactgctgccagagataatgtggtaaatcaaatagagattttctatcaggcagtttagaatttagttgtgaaaataacatgtagacacacaaactaataataacagattataataaatatcaagaagaagaaaaaaacatagtgacatgatagtgatggggtgcagacactacgttagataagatggtccaatgggaaaggatgttcattgagctaggacctgaagggtgacatacaattttatctgtcaaaaacagttacagtcatttcatgtaaaaggaacagcaaacagaaaggctgaaataatcttgagatgctcaagaaacagaaaaaggctgagggggtgcagtggctcatacttgtgatgtcaaggctttttgaggccaaggcaggagaattgcctgaggtcaggagtttgagaccagcctgggtaacatagcaagacctcatctctacaataaataaataaataaataaataaataaataaataaataaataaataaaataagcctggcgtgatgatgcgtgcctgtattcccggctactcagaaggctgaggtaggagaattacttgagcccaggaggtttaggttgcagtgagctatgatcacaccactgcactgcctagtcagcagagcaagaccctgtctctattaaaaaataaaataaaaagatgtgagtgaatgaggtagacaatagtataagatgaaatcagagagataggcaattgaccatgggaagcatgtcagactttcttcaaaatacaatggagggaggccaggcacggtggctcatgcctgtaatcccagcactttgggaggctgaggtgggcagatcacttgaggtcaggagtttgagaccagcctggccaatatggcaaaaccgcatccctactaaaaatacaaaaattagctgggcgtggtggtatgctcctgtagtcccagcagttcgggaggctgacacaggagaatcccttgaacccgggaagtggaggctgcagtgagccgagattgtgccactgcactgcagcctgagtgacagagcaagactccatctcaaaaaaaaaaaaagaaaaagaaaagaaaaaaaaaaaacaatggcagggagacaggtgacatacatgtacagagcaaaaaggtcactggggctactctatccagatagtgtgtggggacaacagttggaagcggggacggggagggcagttaagaaggtgtcacttttccaagagaaaggactgcaatgacttggaacttgtcaagaacaacgaaaatacagataatcaggtaaatctgagttacattttggaaggtaaaaaccacccacagcccatccttgcaatacgttctcctttgcctgaagcatgctggaaagactattgtaaaggatggcatcagttgtgcaaactcctcagcccttccattctctccaggctctctgtttccagctcatctgctgtggcaactcttgggaaatgacagctacttgtttctttgtacaaaatggttttctgttacatttcgctgcactttatgggaaaagttatatggcccagtcatagtattcatgaatcaggaattcctagaagtcttggaccgatccttctgaactgcctacatctgattcctaaatagctgtcatttctgatcagtgtgcatccctaaaaaaactaaatcgttcataaagttgactggattaactctaagttttccccaagaatttcctgcctcttgagaataagcccagaagatcacaaaactagccaaatagaaacaggagagattgagaataagagaattaactgctttctctttaatgggttgtgtcatggatattataagtacagctgtagcctgggtttggcctccaatgtgcagagagcttgcttttcctaggcttcctgcccagcacttcataacttccattaatgtgaatttgcttctgccactttatttattgcccactctgcttatattggcaggtgacatctgagtagatcattttttcatatcttcatttacttaaatgacataaaaattaacctcctgttaaagggaaaccttccctatgaaattagggcatcagttgatttttttttttttttttttttgcccatgcagaacaaagacttgaaaaccctaatatgtgtgttttacagcctgcatatgccccatcgccataaattttggcatatcattctgtctctttagttaagtctgttgcaaggaacatttaagaatcttaaaagggctgcatagctattgcgaggatatactggaaaaagtgctgtgatatgacatcagtgttcattttccatgaccctgcaatgaaatgtcttccatctgtgaagtgttggaagaattaagatctattgttccattccttaatgtctccatttggagagggttttagtttggtttaattcttatgttgtacacactttacatctgagtttgaacaggagcaattgctagggacaatcggattagaataccaaacatcagtcccgctgaattgcatggttcttatacgatagcacatccgatgaatttggaagcagtccccatgcacacatttttgtcaggctctctttatgtttattaagaaggctggtttcctcaaatgggaatcaaatccaaatttaaaacaggtcataacactacttattcaaacccccattttgcataaccattttcgtttcctttctttttttaaagaaatgtggcaaaaatccagttagatagaaatgtgagaagaatgctaatttttaaagaaaaaaataagttattgtggttctagggcaatcacaggacacaactatgatataattccatcttctggcaaccttcggtgctgctggtggctgctgcgtggttgtcatacacaaacaggcatttttttcagaaaatgctgagaatgtccttttcatcttctgcagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaaggtaaggtcaccttgctttcctctccatctgagggttggtcttaactgctctcctttcaggaggaagagattcaggtgcctctcattgagatccatcaactcgaatgcacaaaagccagaaggttttttctctttaactcaaattgtcctctttctcaaagtttttgaaacagaacattaaggttagctctcctagacctaaaagattccagatctaatttggaagcctggcttccccgagtggtcgtgtttcctatttatatgatctttctgatggtgcttgtgaatgacctatgactcaagtgcttaggttgaaattcatcctttcgaatgtgtgatgttaaggaaggcccattttcctggatgagaagaaattggggtgaaggagcactgtaggctgtgggtacctcatctatgacctgaaaaaaagtcatctttaagccctacccagagacaaaattatctgacagctcctcttttccatacagccaaatcagtctcagcatcagcgcttctgactcacctgaaatgtcttcaaggcacacaaaaggagcagagagtttttttctttctttctttctgtttttttaatttcccactggttctttctactcagatatatcactaatcttcccttatagggctgtacttcccacatcagtaagacaggagtaaaaacacctgctctctcattctccagtgaaatgaaatataacaagggttgcagggtttgagtagctattcagaaacacacattgaggaagaaaagaggtaaactgggtgcatcctcctattgagactttagttcaggaaacatcctgacttgctaagctcagcaagtgttgagattgcagcaccacaaagattttctgttctgtgtgtggggataatttgtctctcgttataaaacctcgctaacatatctttttgacataagtctacatatatccttttgccattcatcaacaaactgctgaatagaaaatcaatccatggaaagcttttacagcttatccatgatacacactgtggttgaaagaatcttgtcaagagagctgatgaggggttggggttaaagatggagtcatttccacaaaggcatgagagtgcctcacctctctctgatggcttccgattgaggcttgagtaagggtcactttacttaccatggcacacaaagccctgtgttatctcacctgctcccacgtttccttcctcttgctccatccctgtcactaagtttatttcagctcagtgtccttgtgcctcttaggccctctgcctagaatgttcttccccaatcttctcatggttggctcctcctggaatttctggccttagggaagacattacctcctcagggaagtctttcctggctactgtaataaacttggcagaatgagctcaggctcccaagaaacttaaattctagtaggaaaaaaataagcaatacacaagtaaacatcaaggaagaaacaaatttggaaatttggggcaggaataagtattataaagaagataaagctgatgagactaaaattgtctgggggaagaggccctcagggatgtagttttgatagagttattttgcactttggaggtgctcaggacactcttgctgggtgaatgaatacatgcatggtatactggacactgtgcataccccacctggatctcctgggatcccttttgcagcgctgtgtgcccagccccacctttctgtgctttgctgacaaagcctcacttcagggatcctcagcagatttttgcctttgggcactggaatggtaaatgcctggcaatttaagttccctcaatctttgtggtcacctgtaaccaaagactaatctgtgtgagaatacaaaggctaagctgctcccttgcttcgaagcaggaaaaactttaaggtacgaatcactctctggagctccctgcaggacgggactgagatggagacttggccttaaatcagacccttgatttctcccccttctccagtctttcctaactttatcctgctcccctgctgacttctcctggaacccttcactagtaaatcatgctcacccccaaatccttcacttggggtcagctactgtaagatccccgcctaaagcgggtggtatctcagaggcagcagataacacactgtgtttagagtcagaaaagttgtgtttcctctctgcctgtttcctctctgccactcgccagccagccgtataatgtttttaaagccatgtcacctcacggtgcctgctttgtctgctttgtaaatttgggagtcacaattgcagtaaggatgaaagaaagccacatatgtaaatgtatcttgtagcatatgaatccctctgcagacatgaagcgctattgtgcaagtctgtcgcattatgggatcaaaagtgcaattcctagaagtgattggaggtatggtggaagcagcaggaagcaatgtcctggaagagaggatttttcaagaaagtggttggcagcatattttgctttttgttgctatgttcaaaggcaagggcggggggaaatccttactacatagttttgggtctaaataacatgaccacttgtgggaaaactaattaaaaccactaataatttgactgaccttcactgacttggaaacacccagtaacagataccatatcctcaagagacaaagctcagtctccatgctgaaaacattagaggcaagctgatagctcttttaattaaatgtttgatacaatgagataaacagcaaaattcctggagtaaataacctatatgctcccagaagattaatagaagatacaccaagaaagtctgcaaaaaaaaatcaatattgaatcaatttattgtacactgtggttggttttgtttttgttttttgtttttgtttttttgttgtttgtttatcatgaatacctgtgtaacaactcaggtttacaatgcttttaagccattagtgcttgctgtgaaataatcatattggagcccatggtgtgctcagatgagctgggacttaaattataaataggtgaattcatgggtaagatgcttccctaggaattattaagagaaaattgcaatgttgatagggatgctttccaaaatgttgggaatcactctgacagaggaaatccatctctgggaggcagatttatgttgtgggaagagcaatatcatgtttggggtcaaatggacctgggttcaaatcctggccttgccatatgattggccttctgtatgtcagtatccccttaggcttaatttcctataaaagagaagacattatctcctttctggcaaggttgataggaggattagaaataatcctcacaccatgcctggcacatggtagatgatcctgtaatgtgttatttccttcttctaccctcctcctttccactcccccctctcattcctccccctctccttctctttgtctcccttctcctcctactccttccatcatcttcatcatcgcctgactcaaaccattcttggcttctggggcctgaaatgttattgcactgagttggtcttttgtgacaaccaatggagggaattgaggcaactgctctcagtggatgagcccaggaatgtgttctcaaggagccatgctgtctctgggcactgtgctgctgctgctgagtggtcccagttcaggcagccaggcctcctcccagctgatcctctctctgctcaaggacacacctgcttgctgctcacatcaagaagcacgtgggacttcaccaacagaagactgtactagaaataggggctccagttgccagatgtcccttatttacaggcacagaagacagatagatatttttaataaatgggtagtttttggttcacaaaaaaagaaaaaatatcttggttaattgctgcatttttctggaaattttatctccaagtgttgcatctctacctcctccatcatcaaatacttgccatgttttagtcacttggatgaccttcagacatgcctccatattggatggaaaaaaaattagaaaataatcctctgttctccaaactgtaaggagacaggcttcattgtttggctgaaatgtcgtgggtaacaacaggtgatctatcccaagcattagaggatgccaggtgttctttcaaacactataagatttgttgcaaaagcaatctccaatttacagatagagaaattcaggctcaggagcttaactggttgctccaaatggcgcagtttctaagcagcagatgagaacctgaacttgtctcctgtaagtccaaagccaggtgaaaccagttaacctacacagcaagggaaccctgcagagaagccaggggagttcctctgactccagatattgtgattacattgttctgtggtcttgctgacaatggagacctctgtcctaccccttcctttgctaaagcccatattggattctttctgcttgcacgtggaactctctgggagaaagtcttgctaggaatcattctcgcagcaagcacggagtgtgtcctggatgtagaccctgggacttaatagatgagccatccttgccccctcactgtttttcacgctgtaggtcatgactctttagtgagccatgaaattaatctaaggattgcagacatttttttaaaaaaatagaacataatggataacctcagagtatatcacagatagaaagaatgagtgctgtgaaatttcacacatgtgcatggagtggtgatgggaaacgtattgtgagtcatgctttaaaaagtttgacagtcttcagtctagtggaaaaggttcctggagcttggtgtcaggctgaattttgtgtgggtgatggtactatccaggccagagaagcacggaaaccatcacagagactgaatatctatctctgttactgtgcaacccagacacagggaagaaagtgaatttttaaagacctatgcagctcctctgcaacagacggggagtgaagtggaaggcatttagtcaaataggccatctccggatatctctggagattgggaatggctgctacaaggagatttatgaacagcactattacctctctcctcccgagcaggcggctgccatgaggatgagcctgggcttggccttttgagcttttggtgattagttaaggcactgcttggtggagtgactgcaaaaagcattttgctgttcacatacacacacatgcacacgtggacgcacatactcccagggcaaggcacaccctggcaggaggatctcatttggaaaatggatggccacttctcccaaatccagttatgactgcatattaggcagcagcatgcctaatttagggaaaacgattttcaactggaaattttaattaacagtgaagtgaagtgtgagtctggaaaaaagaataatgtttctagctggtttgactcttgggtaaatttggacacttaccctggcggttcttagttctgtggaagacacactggtctggaagttggagagactgctgcattgtggtcctggttctgacactgattttctgggtgctcttcccctcctggggtctttaaatctttatgtctagatgaggagagagtcaatagcaatggtctctgaggaatgatagagttaagacctcagcctgtggtcagacgcatccgggtttgaattctgggccactgcttggtagttgcataatcttaaatagatcacatagcctctctgagcctcagttttcttatctgcaagaagcagcctctaagattaactacctggcatgggtttgtaaggattaaatgacctgacgtttgtaaagttcttggcatagtgctggacccaactaggttcccaaaaagtgttagtcattgttgttattactttctagttccagaattcaatgtttcatagaaaaatgaggttcaggttcctttttcactcataatgataataacagacggtaatcatagctttatttttgaatgctttctctggtccaggcactattccagttacttgacaaatgtatgttgagatcttcatggtggccccccactctacagatggaaaataaatggaggcagcatgaagtgaatgtgttatctagggttccatagcttgtatgtgatagaacccaattttccaaccagccagttcgagctcctgcttataaccacagcccgccaccatctctagtgtttagctgtatttctggaactcagatccagttctattgattcgactctcattgagtcacctgaaacatcgaagctgtggacagacagaatcatccaatccatcagagaagactggtgatgcatggactacaggcctttatggggggcttgagtgccgagtgctgcgtatccctgatagctaaagatcaacagggactctggctcaacaagtattcatggagcctgccatgcactggcaattatgcctggggaatgttaggcactagataaatagtgcctgcaggagtgaatgaatgactgagtgagtggagaatgaatgagtggtaatatatagtcattttctgggtgaggtgaaggtaattataaatggagtttagagaagggagtgattggtggagatcacagaaaatttcatcataaagtggataaatggactggactaaggtagtaccttaagttcagctcattcagcatttctaagtactgactgtgtgcctaacactgtgctagtctctgtaatggcactgaaaagttcaactcaacaaatacctatggagcacccagccgggctctgtgctaggatctgagcagtagtacagaagaaaacagatgctgtgtccaccctcctggagctcacagactggctgaagatgtgactaagtagaaagaaagaccaaaaagcaacattttattgtcatcctgccctaatgcatgcatttacctcctaacaccagacaaaatgatcactaatttattatttgttctctcctccccctcctcccttctctttcttttcctactctctctcttcctttctcgttctctctccagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggtaaggatggcagtttccttttcaccacaggtctgcgagcgataaaccttacagaaattgactctcggcatgcctcagttcctatctgctcccattgtatttctggagagtgactgtggtccagatgggccccagttgagggcagtttttgttaatctaatgagcatcccaggtttccttctgagttgggtgaagaaaaagcaaatccaggatgctttgaaatgcacagaaacagaggggtttcttaaactgataaagaagtttgtccaactccataggatattttaacaaatagaaagatccaagaaggccaagagtttaaagtagtgaaaacaaagatttttatcagattttaggtaggaggttttctgagtgtggggaggagtagcttgctagtaggagctttatgaaaaaactaattgtataacattgatgaaagagaaagaaaagatgggagaaaagcaatgagaactcaaatcattcaagttacagttagcattcctctctgtctgttggcattgtggagtgtaacacagactccatagctgaagatgtaaagaaaagatagcacaggggttaggagtttaggctttggagagagagtttctcatacctcatagcctcatatctaacatgggaataataataggacctaagagagaaaatctgatggaaagccttttggatgggaaatagacagtacctaaatgtgagtgttgttatttattgtaaaggttagattctattccatggactcttctgaaaagtccattgttctgtggtcttgctgacaatggagacgtctgtcctaccccttcctttgctaaagcccacattggtttctttctgcttgcatgtggaactctctgggagaaagtcttgctaggaatcattctcgtaggaagcacggagtgtgtcctggatgtagacccaggaatgcatgaaatccattttagaaaggattaaatccaataaaaatgattttattttaaatgacagagttgtttaatgaggggattttgattatccagaaaattagctcatatggggcatttcagttgtcacagattcctgcatggaaacatgactgtaggtgcattctccttgtggcttaataaataacctccttttcggctgttcggcaagcccattgtgaaggccttgctgctggctttgtgtctggtagggggagacagaggcccctctaaagcatcaaagcccagatttctgcatagaaatcccggtagttttggctgtgagcattctgtcctttcagtctgtgcctttggaatgtctttggcatctcagcaggggctgggagagcatttattcagaagttaagtctatgatttctgaaaaactcattcccacagtgctcattctggtttggaatgatttctttaaacttttgaagtataacaaaaatgcagaaaattcacaaatattaaatatgctgctttatggcttcgtacaaactgatcatccaggtcatcactccctggaaccccgccccacaccctcttccagtcaatatcttccacccgccacctgcacttctaaagccgtagattcttggtgcctgctgttttaacatagaaataaagccacactcttttcttttttgtcgtctttggctcaacattgtgtttgcaagattgttgcatgtaatttcagtgctttcattctcattgctggaatgcagcacacatggatgtctctgtcctaatcttgatggacatttgggtaatgtcctattttggggccattatgaataatgcttcttttgttaatgagtgagcgcatttctgttggtatacaccgaagactgcaactgctgagccatagaatatttgtgtcttccactttcacagatacctgaaaagaccaattgttgatgactttacagtttagccatgggtttgggatttttgtttgtttccattgtggtcttttaatcaacatatactgttgttttggacagaccatgcgcacaaatgcagatgataatggttggagacagtggttgatgcctagctggctttctctccctccatttattaaccagagcacaaaatgggttgttttctttctttttcaatcttttttttaatataatagcaaaaaggagagaaatggaaaccattcgtggccataaattgtacaaattggtttctggaagccatataataattataacatccatcttagaaaacgtgggcagatggcagattcattctatactcaatctcccatgtgggggatgctttgcattgttactttaaactcagaaactagagctgaaggagtacaagtcttttttttttttttttttttttttttttgagacggagtttcgctcttgttgctcatgctggagtgcaatggtgcagtctctccccgctgcaacctccacctcccaggttcaaacgattctcaacacactcagctaatttttgtgtttttgtagagacagggtttcaccatgttgactaggcacatcttgaacttctgagctcaggtgatcctcctgccttggccttccaaagtgctgggattacagtcatgagccactgcacccagccacaagtcattttttaaaaaataattcaatatactcttagggatgaaagcacagcagttatcattactggagatttaatttcattggagttaatatttggggaaaccacatacatgtttaacaggctccttgattaattatttaaatttttttttttttttcagacagggtctcactctgtcacccaggttggagtacagtagtgtaatcatagcttattgcagcctggacttccctgggctcaggtaatcatcccacctcagcctcctgagtagctgggactacaggcaagcaccaccacacctggctaatgtttgtgtttcgtgtggagatgaggttttgccgtgttacccaggctgatttcaaattcagaaggctcaagccattctcctgcctcagcctctcaaagtgctgggattacaggagtgagtcactatgcccagcctaaattaaattttgaatagataagatatttatatacgtcaaaaataaaaaagtacataaaaagaaaaaaacagtgaaaagttttccctgcacactattcctcatctagtacccctccatggtaaccacatttactctgtgtatccttccaatatgttcttctgaatctttctatattaatgcataaaaagccataaagttattttttatagagtcataatctttcattatgcaaatataccatattttatttggtcaggcctctattgttggacatttaggttgtttccaatcttttgctattgcaaacaaagctgtagtgaatatctttgtattgcgtcacattcagtgtagaataaatttcttgaaagagtgggtcacagttgcaattttaacagatattgccaaatctccctccaaaggaaattcatacttaccccatcagtgcatgagagagcttatttctccaaagttttgccaatacaatgtgtaattaatctttcaaaattttgctaataggtaaaaagtatgctgagatataaatttgcacttttctcagtaaattttggccatatttatatacttaagagccatcggcaattccttttttacttttattaatatttctattggtttgttggtctttttcttattaatttatatattggacagatgagccttttgtgatgtgattacaaatattttccctatttcttttttagtcttttgagcttgcttttttttttccatgcagattttatcttttttgtagtgaaatatatcaaccatttgcttatggctgttgaattttgagacgtaattcaaaagtctttcatcattctttattacaagataattacctcgtgttttcttcttttttggttgcattttttaatatttggaatttttcttggtgggtggtatgagacatgacttcaactcctcagatgattatgaaaaccagaatatgagaattaccaccacagagctacaccaagatccgatcaactttgtgttgattgtgtcttctcaacgtcccaccacgagactgcggtctttcaggtgtccacgtcaccacactcacaggccttttccttccttttcacatctcctgtttcctttttaaaattttcattatgaaatatattgctgtttaaggaataataataatacaatgaaatcttcttgtacctaccaccgagccttaaaaaaaaaaagtcattctcgtcctttaccacgaccagcatctgtagaaggttccatccctctggaaggttgaagaaggtaacctcatctgctcccgaattgctcagcttttgaacattcccccaacaccctagaatccagcaagccttgacttagaacatccagagcatgtggctcagctgctgggtctcactgctccacccacacgtttcagtaacatctgctgcctagcaaagccacgtgcatgcacaccagggtcagtgaaattgtgggttgtaattttctgggagagtcctgaacaccagacaggctttggattactgtcaagtgacagtcccagctgggtttgagtctggactcgagcattagctagctgtgtcctgggacaagtcatgtcacctctccaagtcactttctagtttccccatctaagaagtgaaatggttgaattctttgatctctaaactagttcatgagattcttttatctgtgtcaaacacttaggaagactcagacaaaccacatatgcaaacaactgtcagttttgcagaaaggatttagaatcatgccccaaaattgggtgcctccaagcctggccaatggaccaactgtacctgaatcacatgattacctgtcaaaatgcagattcctgggcccaggacaaggctttctctctagctatggagcctgtgaatctttattataataagcatcattccccgcagcacgccacaccacgtgattttgagacacacgaatatttgagaactactgttttagaagtccaacacactattcattgtgcaacagagctgagaactactattttaaaggagttgaagaaacacattttattgggataggcatatacagagtagacaagccaaatgcttgtctttggaatccctaattttttgaagaaaggcataggcagagaaaaacttgaaagctaagttttactgtttattgaaattcataataaatggagataaagaaattatcagacaaatcagtgagaaaaaagggtttgatgtgtaaacatcaacagagatgggatttttcaggcacagatctgttgtgccttgtgggactcctgtgaaccaaaggtggatgagcgtcagtgaccccaggtttctaggctaatgcttctcaagcatagcctgagtctgaatcagaataggtgctaataaaaatgtagattgctgagccccactgagccagttgaatcagaatctctgtaaggaggggtctgaagatctgcatggtttaacaagctcttcaggtgactccgatatgccctaatcaaattttaagaacatccactctagaagagggagctgaagctgaaatgagtggagacagatttagatttacaaatgctcagtcatcagaagctgatgtcctccaagccattttggcatgggggcaaaactgcaagcgtcgcacatatgccagatttaaattaaacaacgtccctagaactccgaagagcctaatatttcaagacacagtgggatagtttgtgtttttcttttaattgattttcatgtacaagtctgggtgtatacatttatggaaaagtcccaatttccttagaagcctcagttttcagctctcaggatccccagtcccctgtgcgatttcattctcagcacaatgttaaaaaacaggtctctgttggtttcctttacatgcagtagttagaagaattggaagagaggattgtcttttttcccagtattttttattgtgataaaatatgcatagagtaaaatttgccatcttcacatttttaagtgtatagttcagtggtattaaatgcattcatcgtgtggtacaaccattaccaccatctgtctccaaagctctttatcttgtaaaactgcaactctctatccactaaacaaaaactcctcaacccccttttccctagcgcctggcaaccaccattctactttttgtctttatgattttgactgctctaagtacctcatctaagtggaatcatacggtatttgtctttttgtgactagcttatttcacttaccataatgttcatccatgttttggcatgtgccaaaattttattcctttttaaggctaaacagtatttcatcgtattcaggtaccacattttgctcatccattcatctttcaatggacacttgagttgtctcagcattttaactattttgaatcatgcttctgtgaacgtagatgtgtgaatatatttttgagactttggttttttttgttggtatatatgcagaagtgaaataattggatcatatgtcaattctatttttagttattgagaaacaaccatactgttttccacagtcccatttgcattcccaccaacagtgcacaagggttccaatttctccacatccttgccaatacttgttgttttctgtttttctaatagtagccatcccactgggtatgaggtggtatctcattgcagttttgatttgcatttccctaatgattagtggtatcgagcgctttttacctgcttattgggcaattgtatttattcttttgagaggtggatatgcaagtcttttggccattttacatttgggttgtttgggttttctttttttttttttttttggttgttgttaggttttaagagttctctgtatattctggatatcaatcccttatcagatatacaatttgcaaatattttttcctattccatgggttacctttttatattctagctattacattgatagtgtcttttgatgcacatttaaaaaaaaatttagggagtattgtctttttaccaataaatatttttctaaaaggcttgagttgtcctcagtgacatgtctgtaaaaacaaaagaacagtgtagtcccatctccgtgtatgtgtttgaaatgtcttcatagaaagttttgcattgaaaaacaaatgagcactgaattcctatcctagagcacaggtttgcaaagcctgtgggatttaggaatgtacctttttttttttttttttttgaaacggagtttcgctcttgttgcccgggctggagtgcaatggcacaatctcggctcaccacaacctctgccttccgggttcaagcgattctcctgcctcagccttcccgagtagctgggattacaggtatgcaacaccatgccctgtcaattttgtattttttagtagagatggggtttctccatgttggtcaggctggactcaaattcccgacatcaggtgatccacctgccttggcctcccaaattgctgggactacaggcctgagccaccgcacccggccaagaaggtacatttttattagtgcttctagtgattcagatgtaggtagtccatgtctttgagaggttagttagttgactattgagaaatggagttctgtagtgactaaacaggacaaggaagagggaggatatttcagaaggagggtgcaggatgggtggagatgtggcaaaatgtgagtttaggtttaggcatattaagttggaagtgcctttggaacaccatcatcatatgtccaggcatctttgcacttaatgtgacctgacaattagtgagctacagacctgagcacttcatatgcctaatctcaattaatcctcacaacacccctacgatctgggtaccattaatatcccttttaagagatgaagaatgtgaagctcaacaatgttaacctaattacccaataggctattcagctaagtaactacattgcagaattagtaagtatagaagttaggcttacttccccacttggaaatgccacctaggcagttggaaatacggggttatggttcaggggagaatttaaaactaaagttagatattacatatgtgcatatattatagagtacatatcatattaattgatgatctgagaactgataaaatcacagcattatcatttctatgctcaaaagaaactggttcagggatattggcattcccaaggcaaaggtaaaccaggagagtataagggttgtcactgaggttcagttgctctgcagagcaaattttttcaaagatgccatttgagcaggttttatttgctgtattttatcagtcaaacagaatcagacacaaatggttcatttccagctgctgaattcgaaagcgggcatagacatcagggttcagtgagctgttctaaatggggtagcgtcatctccagagaaaatcagatcaacaatgacctggtttctgagatccacccccacactgcaaacaaagctcaaaaataattgcttccacatcatagagttagaaagttttttccttaataaaaactcaagtaaacacagacatcttttttttttttgcgggggggtggggttcttggaattatttcctggtaagctctattaaaacaacgttaaaggattttcaaggccacctataaaaactttttttaaagtagaaaaaaatgtctgtggggggcaggagttaaataaagtgagatcataattctttaaactcagagacggaaaaaaaaaaaaggcaaaaaaaacagactaaaaagaaatatatcaaaatgttatcggagatgctgctaggtgattgggatgatggactttacatctttttacatttaacaaattttcagcaacacagtattacttgcaatagctagaaaaaagtttcttctgactataattctctattttttcctgcatttcattcttgtattgtcaacgcatatatacaattcatacaagttgagtcggtgcatatgcaaatttgttttgcttttctcaattaaagtagacagttctgttgtttagtttccacatttaaggaccaggtgataatttcattgagctagaggaatattaattaatttagcttttactgctttgtgttttcatcatgccttaactagcactgaagggtactacaagaaatagttatttttgaaaaggttgctgatacggttattacaggacagcttgtggagaatgtcgtcctgtagcatccctcacacttctgtacgatgaagagcattgctttgttctgtttgaggcacgctttgatcttgttgacaacacaattcttataacaacttatggttttctttttgcttggattaccgcacaattcagagcttaatgcatgattcttctttcacaattgtggagcctttggcctgaaaatctgtttactgactttccctaagactgagctactattccacttctgaattcacttaactccaattgctttatccgtatgtgtaaaccttattctattctattacagtgagtgtgagctacctgaattgctttggacacaaagcaattctttgttttttaaatttttttattgtgtgtttttatttattttattgtttatttcttttttctttcttttttgtttttgttttgagacagagtctcgctctgtcacccagactggagtgcagcggtactatctcagctcagtgcaacctccatctccgaggtttgagtgattctcatgctgcagcctcccaagtagtgggattacaggggtgcaccaccacacccggttaatttttgtatttttagcagagacggggtttcgccatgttggccaggctggtcttgaactcctggcctcaggtgatcctcccacctcggcctcccaaagtgctgggattacaggcgtgagttaccgtgaccggcttaagtgaggcatttctaactaacagattccatttattgggagcttacctgagtgccaggtactgtgttaaatgctttgcctccattatctaatttaaacatcatgacaaacctatatgacggtgaccatcaagattttcatccacctttgaggaaacaggcattgagagattaagcagcgtgtctgggatcaatcttacgccagagcccctgctttgagtcacaatgtaaaaaaaataaaaaatatgactgttctcataatattccacaattaaggccgtttctaatggcccaccattatgcaaaacctagtaccaatttcgtcatatttttacttcaaaagttctccttttttctttaaaatctttactactgtttcaaaaggggcaatgtttcttcttccattgagataaggaaaataaatgaatgtgtggagcaagagcgtggaggaaatgaatttcttctattcgagccaagccacaggaagcacatggtcagaaaattcctcctggggaagaactgtgaagaagcaggaactccctggcaggttctatatccttagggatcacctcttgtttgtttttgtttgtttgttttttgagacagagcctcactctgtcaccagggctagagtgcagtcacgagatcttggctaactgcaacctccatctgcagggttcaagtgattctcgtgcctcagcatcccgagtactgggaccacaaatgtgcaccaccatgtctggctaatttttgcacttttagtagagacagggttttgccacgttgtaccaggctggtctcaaactcctgacctcaagtgatccgcctgtctcggcctcccaaagtgttggaattacaggcatgagccaccacacctggcccacctcttgttattgcttgctgaactcacatgggaacttcaaacatgtgacctcatttcctcctgattcaactctgccagataatcattttctccattttatagaggaggacactgaagttcaggcagaagccacagttcgtctgaaggttaacatctaatgagtagcagtgccagcattcagttgaagacccaacatcttttctgacccatgatgttgtgctaaccctctgcttgtcctgagaagggaacagctctggcaagggttgtacctatctgttacaaggtcgtggggttaggagatgcgaagttgctctcacccatgaagcatcacaggtttggaatagctcagcttcctttctccccacagtaaaattataaacacatctccactgacccaggtgctaaaaaggtcatggtgttaatgtatcagccctgtgtgttctcttgctgcagggagaagtgagttttcctggcactgggctcactcagaccatggaaagcctctaacacaggttaggagacactgtttacaccccatggaaagtgcccggggccaaccccagacagctgcctctcccaaagcaagccccacctccttcctcccatagagaaatgcaggtggaggagtgataggaactcaggtactgcaccttcaggtgtccccagtgaagtagtttcctagagtggccataaccaataacaagcatggtgggttgcaacaacagaattttattctcagttctgggggccagagtccaaaatcaaggtgttagcagggccttgctccctctgaaggctctaagcgagggccattctttgcgtcctccagtttctggtgcctccaggtgtttcttggcttgtggctgcatctctccaatctctgcctccatctccaggtgaccttcttcccttggtatgtctcctcttcttctaaggactccagccgttggagttaggacccaccctaaatccaggatgactttatctcaagatccttaaacaattatatctgcaaagacatgattttcaaataagggcatactctgatgtcccaggtgtacatgaatttggaggtatactcacctaggctgtagtgtggttttcccaacatcacctcctgataggtatccgacatcagtgctgccagtggaggctgtcctcaggtgtcttggggaccaggggaagaggccatgctgcccagtactttatctgggtgtgctgtggggagtggtggtgtattccacaggaatgcacagcacacaggtatgcaaagtggattcttgcgtgtgaactcccaccatcaggtggtaattgtgctggccaatttcccataccttccctatcccctgcctcctggtctcagttgtttaggtagccctcactccatgccaggaagtttttctttttgagacagagtctggctcattcacccaggctggagtgcaacggcgcgatctcggcccactgcaacctctacctcctaggatcaagtgattctcctgcctcagcctccagagtagctgggattacaggtgtgtgccaccatgcccagctaatttttgtacttttagtagagatggggcttcaccatcttggccagactggtctcgaactcccgacctcaggggatccaccctcctcagcctcccaaagtgttgggattactggcatgagccaccacacccggccccagcagcttttatgagtgtattacctgtaactcttagtttaatcttcacagcttctctgggaggttggcatgcccagcatctccactatacagacagcttaagtcatgacgcaggcacagtgctggtaagcttcagagctgggatttgaactggctctaggagctatgcccttaaccattatgctatattgcttctcattaaaaaatgtatcctcattgtaaaaaaaaaaaaatgaaaatacagataagcattcctttggcttggcatctcaatgccaatctgttgtctgtttgatgtacgttccatttctccaagacttttattatatgcatttgcatatgtttttgtttttctgagacagagtcttgctctgttgcccaggctggagtgcagtggtacgatcttggctcactgcaacctctgcctcccaggttcaagtgattctcctgcctcagccaccagagtagctgggtttacaggctactacaggggtgcgccatgacgcccagctgatttttgtatttttaatagagatggggtttcaccatgttgcccaggctgatctcaaactcctaaccttcagtaatccacccacttcggcctcccaaagtgctgggattacaggagtgagccaccgtgcccggtctgcatttgtatatattaatatatgtccacacagaataaaattttattctgtggaatgctatcaaactctatgcagtatgtcacagtttggttttcagtgaacgatatgttttggagagctttccattttttgccttcattctctttgactgctggaaagaactccatgatatgcatgcatcagaatatttttaagcattttcttctcactagactttttttgggggggtgggatgagggctatcagtcatatggctgtgttaaggatcgttggggagtcctctgtgtacctctacaagtggttttctaggaatgaaaccaggacatagaatttctgggtggaagtatttatattttcttgaagccttcaaacttacgtagtcaatttatttgatttgcttatttttatattttctgagtggcctcttggtgcagagagtggattttggggtaagaaacgcctactttaatattctgtctctaataccagctgtgtgacctttggcaaattaaataacctctctcagcctgtttcccacatgtgtaaaatcctatttcctggaattcctctgagaaataaccaagttgacttatggaaagtaccctgcattctatctaacacataatagcattttcacaaatctcgatgtttttcggaatctctctttcactctcatgttttctggcccctgagagtccctgtctttcagtcctcctgtgtgacaagttccgtgatgtcgtcactactaacagtatgatggggtgcttaaaggataagcatcctggattcgaattcccactccagtgacatccagtgttgggaccttggacaagttattaacatcttagactccagtattccacttttataaaattatactaattgtgctgccttcacttggaaatgcactgtaaagattaaatgagatattccggcaaagagtgcagtgtccagcacatagtaaatgttcaagaaaagtctgaacaaagaaaacctttttgagccatctttctaatattataaaaacgctatgcttcgtgaaatctgcagcagaatggttaggtctgacctcaacccttgaaaagtacaatctaagaagctctataaagagtagcattccagaaagaaccaatactgttcctatgtcagagcatgagttgtggtgaagaaaatacagcatcgcatagtgctttgcaattcaccaaacaaattcatggctgggacttcattcaaccagtgcataaacataggagacagattatgttttccttcctgtcagatggggaaatcaaggcttagagaaatatttagactttcccaactttccacaaagtatgcagagccagttctctgaccctgcatcccagctgaggccttgcactgggggagcccggcaatggtgtcctgaaggcacactgctttggtgagtgacagaccggtctggaaaaattgggcggagatctctgggcctcagtgtcctcatctgaaaaatgaagagactggattacatactgtctcaactccttgggtatagtcagtttgggtccaacgttacatttaacagaaacaaagtacttacagctagatggacttggacaatcatttcaatccttccctatctttgaaattagcagtcaatagacaaagtgggtacattcatctcttgggtattctttctctttctctctctctctgtctctgtctctctttctctctgtctctcctttctctccctccctccctccctctctccctccccctctccctccccctctccctccctctccccctccacccttcctccctctctccccccactttttccccctctccctccccctctccctccctctccccctccccctcccccctccctccctctctcccctccctccctctctccccccactttttccccctctccctctccatctccctctctctctctgttagttcattttcacactgctgataaagacatacccgatactggataatttataaggaaaaagatgtttaatggactcaaagttccatgtggctggggaggcctcacaatcatggtggaaggtgaaaggcatgtcttacatggtggcaggcaagagagaatgagaaccaagtaaaagaggaaaactcttctaaaacaatcatatctcatgagacttattcactaccacaagaaccttatgggggaaactggccccatgattcatttatcccccactgggtccctcccacaacaggtgggaattatgagagctacaattcaagatgagatttgggtgggcacacagacaaaccatatcactgtcctcactccttccccgttaccttcttctatcctctttttctctctttctttccccccttttttctcttagtttcttgcaatatatctcactttttattctctccctctctgtaccttactaacatctctttctccttctctgtttctcttcctcactttctctttctcatcgtttttctctctttctgtctccgtcttcatgttttgcttggtacctccttccatctggatctcttcctcctccctagttctcttcctctcttctatcctctccccttctctgcttctctctgcctctgtcttacaaaatcactcaggatttattatcagctaaaaaaataaatattaaccatccatcttttttgcccaattcacagtgaatattattggtaaaaaaaataagccacacaaaataaactgacaagagctgaaagcacacagggtgaaatttggtattgactaaaaatccatagatgactcaaatcttcttagctaattttggatctctgtacaattttgacccaggagaaatggacttgacttggtggaaataataaccacaaaagaaaactcaaaatggcagaagttataaattagtaaaatttgttgtggtccaaatcctgatcaatgaagcaaatatttataaaatttaaacacaaaagaattgaccccagtaaaaatgtttccaaaaaagttggaaacaatttaactacgctatgcaagacatcgatcgaggaattaaattagcttaagggagtttgctttgaaaaatgcttcctttgtgaaaattcatcaatgttggtataactctgactttagagtttgtattcacaaacccagaatcaaaatgtgattctaggccattttcccaaagccagttttagaccattctgtgctgatggcaggtagtccctgtataggttgagtgtctcttgcccaagtaaacaatttcaaagcttgtcatgcctcagtggtgccatttctggggatcatgaatgcccttccccgatgggtacccggtggtgatccacacctccactgcttctctgcataatgataccaccactgccagataatctcctaaatcccaccagcatctgcaattacaagcaaaacaccttcacttccattttaatccatccaacagccagccctgtaataagttattatttatttcccatcttacagatgagaatactgaagctcagagaggtcccatgaccgggcttcactcatggagctggtgaagataaatctgaattgtgttccctgttccacagttgcccaaacatgccaactgacctcaagtgctaatgtgttcctcttcctggcaagggtttggtttgatctgaaaaaaatatattcagttatcatcaaagagatgttttaattttcagtaacacacacacacactcatgtgcacatgctggtttcattaattcatcaagacaagcagtgtcttgttaaaggcttcttgaatgttaatgaatgaataattaactttaactatataattagcctttaaatgtgctgagacccccagagagcatctgcaaacatgcataagaagatgatgagctaaaaccggaaacttttgattaggaaatgtcaagccgcttgataatacaagttcccatccctaatgtgtccatgcctctactgtggggtatagtcctccccagggtagggacaattagatttgccagtaaacagtcttggggctaggattggactttcaaggccattgtgcaggtataagagagacccactgactaaaggaatggggtcagatctacacacttgtgaaagctgtagcagctcttgagagctgtcaataaggatggcaggaaaccactaggttaaagtagcatggggcacatgtgacatccgtccttaccttgcttctttgctaatttacagagaggaggtcttatttccccctcttgttctgaattactgtcatttctaatcatttgtgctccttgaggactgccggtgatggagaaggtaatggcacccgcacagccactaagatgcctggcagggggtgagcctgtcatgtagccagcatagcatggcattcttttgagctccagcactgctccagccctcatggtgtgaagccaaggtgtctttggtctgtcgcagacattggagaagagggatcgctcctctccaacatcttctatagggagtggaggcagaaaggtggcatggaccccagtgtgtcagatggtgtctctgtcctcatcacaggcaacatcccacagttctcagacctgacctctgaacgtcctcctgcccagtgggagaaacacaaccctggtacctgggtaggaactgagaatgtggcacaaagacaaattcctcttcaaaaaaggaagagaacatgcaccaagcagagaagagtaaatgggttcccttagctgtgtgttcttaactgggctttcagttggatgctcttggttctaaggaaccagcccctcagtggtgttccaagccagtgctgcccataccaggctgcagcctaacacgtcactctgagtccagcagtcgcagctcaacccctccaaatgccattggtccacatcagaccaatactctgacactgtctactatggaaattaagcacttgaaatatggcgggcttccgtttcaggtggccttttttctctttcttaccctccatcttcaacaagaagctatggccacctatacctacatgtcttccgatggactggagtagactatgttaggggcaagagttttctatggaggtaactgcagccccttagatgactctgtggctgttgggaacgagacagatgaagtggaacaacccaccacgactattgaaactccggccgctctggccccatccttgcctcttctgtcaaaacatttggcttatttatagctaaaaccccccatctgaattttctaagtaatagagctgcctccatttactctacaagtcttatggatagcatggcttggtcacagtggttatgtcagtggtctttggtgtcagactgcataggttccaatgccacttttgacacgtatgggctgggtggtagtgctgagtcactttactgctcaatgcctcagtttctccatctgacaatggggatggcagtagtatgcccatccctgcacaaggagaaggaccaaaaaatataataatgcatataaagtatgcagaactggatttctcctataggatccataaaattggtgagcccctttggcataaaatctgaatttgattgaatgcatttatgtgtttcgagcatttgttatgttctgagcattgcacacatactttacttatataataacactttattcccagcagccctctaagggcaaatattgttggctccatttttctttcttgtttttttttttgagatggagttttgctcttgttgcccaggctggagtgcagcagtgcagtggtgcaatctcggctcactgcaacttctgcctcccgggttcaatagattcgcctgcctcagcctcccgagtagctggaattataggcatgtgccaccatgcccagctattttttttgtaattttagtagagacggggtttctccatgttggtcaagctggtctcaaactcccgacctcaggtgatccgcccacctcggcctcccaaagtgctgggactttaggcgctagccactgtgcccggcaagttggctccatttttcatagggaaaactgagcctgagaaatgcagttgctttgcccaaagtccctgttgacaaatctcagagatttaggggatttttttttctttttaacaacaggaacaattattttttccaatagaaaacggatcaaaagtagactttttgggtcagagcaaaaagggagacccagagtcctgctccctaagccttccccttgcttgccacagaacagctagggctgtgccgcaatagcccataggcacgtgggaccccctacattacaatctaaattaatgaaattaaatgaaatttacaactcatttgcactaaacatatttcaagtgctcgatatccatagtagatggtgtcagagcatttccagcattgcagaaagttctattggacagtgttgtcctagagggttttataatataaagtctggaaatatcaccaacaagccccaggctgccttaggctttctgaaccttgtctgcttatagacagaatagaaaaataataacaataataatatcttgctactggacagttgtgaggcctcagtgggatgatgtctgtgaaatgctaagtattattttataaaacatcttgcagacaatggccatctctttttttaaagtgattattagtgattccatttgttattatttattttaattcatagtttgttcctgcatcagtttgctcaggataatggtgtgcacctccattcatgtctctgcaaaggacatgatgttgttctttgtcatggctgcatagtattccatggtgtatatgtaccatattttctttatctagtctgtcactggtgggtttgattgaggttgatgccatgtctttgctattgtgaatagtgctgcagtgaacatatgtgtgcctgtgtgtttataatagaatgatttacattcctttgggtgtatacccagtataggtctttgaggaatcgccacactgctttccacaatggttgcactaatctacactcccaccatcagtgtataatcttttctttttcttcacaaccttgccagcatctgttattttttgactttttaataatagccctttctgactggtgtgagatggtatctcagacaatgaccatctctctgggaggggactgtgtatgccccaggatatttttaaacacgcagttgtctgtagcccattgtgtgtaggccccagctctctagaatctagaaaccagttcatgtggccctacagtttcctttctgtgttgtaatcacttcagttctgacatggccctaagatgacagtcaggccatggagggctggcccaattgtgtgcctccatggccagacccctctgacagcatgaccaccagcccaccccagtcatgccaatgtgtaactgctttggtcagagtcaaccacatcttttgcagctgtcctgcctctgacttttcagcattgtgcttttataaactttgttcccaaagaaaacttcctttattccttgtactcatatgtctgtctgttgctcagctcaaaaagacctgtcatgaaatatggtactgatttgaagatgtctatgcctgtccataaaataccaacttaaactgcttctggacaactcttatgtggttgctaggtacgtgtgtagatttccagcctagcagcacctcagtgcacagtggcttagcaggataggagaaggtttcaccccatgaattccaacagagggccctaatgtttgaatgtgcccatgtgtacatgtgtgtgtgtatatgtttattttttgaggaatggagagacgagagttgggtggtacttagaaagtctaaataaaaccaagtttctatatctccatggcaacatggatacgggaagtattgacgttgcaagtatctcagctttatcaagagaccaacaccttccacggccctaagtccttaggatacatgtgttatccagagtttcaatttccctatggatagccacagaatgtgactgttggctcacacaatcttagaataccacagctgaacaagtgtctcagcaagaccacaatgaacgccacctctcacagaggagaaaccagaaatccaaaaggagaaagtgactttcctgaggttgcaccatcatcctagcctagactagaactcaggttcctttcacctactactccagtgttcctgttacacaccctactcccattatacacaagttacttttgaccttgtataactctccatcccatatttctgcaggtctcactattgctggctgttcctcttgacttgctgtcatcaagccaagctctaggttgctccaggttacgtatgacagctctaggttaccatcgctgttgccaatcagtgcccagttctcttctgctgctgcttgatctgattccctttaatactctcagagcctaaaaccaagtctctgatacccctaccttgagatcaaagcttcagagtgtttctgtggatgagacaagtcctacagttttgcgccacctcaaaccattatagaaacaaaaaaaaattaaaatgaagaacacggctgtaaacctgccaaatagttttgttcccatagggagtccttcggcagctgtctctgaaaagatgcagtgtttcacatcctctctttgccatttttatttttatttttttgcttcactgttttatgttttcttgttaaagaaaggcaataaagttgagaaagtgtcatgaagttgagtcatctccgatttagttttcttacccattttagagttgagacattcatccctgcattccacagtgatcatttcagcctcgttaaataactttaacatttggaaacaatatccaggactactgacagggatctaatcataattagcacctgtaatcccagcactttgggaagccgaggtgggtggatcacttgaggccaggagttcaagaccagcctgaccaacctggtgaaaccctgtctctactaaaaatataaaaattagccgggagtggtggcaggcacctgtaatcccagctatttgggaggctgaggcacaagaatcacttgaacccaggaggtggaggttgcagtgagctgagatcgcaccattgcactccagcctgggcaatggagtgagactccatctgaataataataataataataataataatatttaggcacagttgtgcccttggagagattacctgatgcttattttctggggtatgcataggatttctaaggaaatgataacattccacattttgaactgcatggtgatttcaaggatatatacatatgtaaaaattcatcaagcattttattacacatacgttatacctcaataaaaataagtgtatcaaaaaagaatttaaaagtgctatgtgtattcacatggaaatatattcactaggtatggaatgagagaagaaagcaatatgtgaaatagtttgtgtggcataataacattttcgggattaaaacaagggttggcaaactacagcccgtggacccatctgttttcctaaataacattttatcggaacacagcaaagttcgtttgtttacacattctctatggctgctttggcactatgtcttggtttcctagggcagccataacaaaggaatgcaacctgagcagcttaaagaacagaaatgactgtctcgcagctctggaggctagatgtccaagatcagggcatctgcaggaccacgcttccaccgaaggctccagggagggatctgttccaggcctctctcctgacttctggtagttccttggcttgcagcagcataactccagtcttcatatggcgttctccctgtgtgcatgtctgtgttcagatttctccttttaataaggacggcagccacagtggattaggggttcaccctacttctgtatgaatgttaggggtggacacagtgcagccccataacaccctacaacagcagagtttaatagctgcaacagagacggtatgtcctacaaagcctcaactatttattatcttgtctttatagaagaaagtttgccaatctctgtgtatgcgtgtttgtgcatactcactaaaacatttggaaggctgttcactaacatgttaacaaaggttgaatctgagttatagaattataggtagctttaattttaattgtatttttaatacttttctatattatttggatttttaaaaattctgcaataatttctgtatgataaataagcagcacatgtatttcttttgggaggaaaaaatattcctatttagttcctttccccttcatacacactaccaccaaattcttctgccccttagtggtttattttgttctgatgcaaacctttctaaatagggcactgtcctccaccactgggagtgttaaggacaaacacttagcaaaccagcaaactcaactgtttactcacttgggtatatggatccttcatgtctttatttagctgcctcttgtaagttggagagaaaaggttctggcttttatctcctcattaaaaatagatccttttatgatgaggggatggagaggccatgagtcatcatcaccagcatgaaagaaagtgtgggatgctttcaggatcaggcctcaggagctggaccccgaggtggtacctggccacccctatgaccccctggtttcttgtcatttcaggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtaagaccccgggtgacccctttctttagggggacttgagaccctcacactcgctttgtttgctcctgggcttcccagtggatctttgcatgatgagtttgctccctaaaaatatttactgagttcctgtcacatgaaaccatggttctttaggttgcttataatggaaagcaattctagataactaaatttaacaaacaaaagtattctaaggatacagtctctctcaggggatttaggaaagagttaaataggtttagaaaaagacaagagccaggacagtcctggtgccttaagtgggaatttataggtcttctgtctagggcagtggttctcaaagggtgaagggcaattttgtccctcaggtgacatttggcaatgcctggagacacattcagtgatcacggctgggaatctgcttgctgatctaatgggtagaggccagggccagaagatgcaggaaaacaccttacagggtccaggacagccccctacatcacaaaacacaaaattatccaacctcacatgttggtaggctgtggttgagaaacgctgctgtacaaaattacataactaggctgtaatcagtcccaatttcactccagagaaaggatttctgatgcattttgaggtcaaagactctttcctagacttatcaggcatgactcacggtggagtcatgttgtaccaacatggcaactcatgttcttatcccgtggaggaatgaaggaaaggcaatctctattgcagtctaatgagactgtggcatttatagaactgtaaagccgcttgggccagctgtgtcaccagaagcatttcctcctgtctgccctttctacttcatagctggtgatctcactatagcccggggtttcctggcatggcctctagaggctggccgtggcttggaatggcaggttggtttcctttcaattgccaacacggaggaaataggaaaagcaaagtcagctcagatagcaggttaacaccaaaaatgagctcggtatgaggaggatagaaaggctcaagccagagggcagaagccccgttcaaatagtggaggctatattcagagatgattacagaacgtgttatgccaggctacaggtgggagagaaaaatctagttaccactacagtgaaatgcaatatcaaaataggcagaggttagctagtgcatagggttagtgtgaattcgaatgaagtgcacaattacttgtggcttcttatcttctttctattcacagagttaaatcctagattctcacagtgccatcaggcattctaaatgtgttttatatttaactcccaaatgagaacatgtgagtctttgaattctccatagggcatttgtaccttcctcagatcactggccatgttctctgctgtgtaataatgatttgtggctgtgttggtcagctttttgctgtgagatcttagaggcgtacaacagtaagcatttattttcctcatggtagtgcaggttgagtggagaagctctgcctggggtggggatagtgcctctgcttcctgccacaagcgtacgaatcagtggtgtggtctctgctccacacgtgtttctgctgtgtctcgggctgaaaaggtagcagctacctggggaagctcttttcctggccatggcagaagcacagaaaggaacgcctagctgcacatgcacatttcaagccactgcttggtcacgttcacgtctgctaacatccttctgtccaaagcaggtcaggtggccaagttcagggtcaagggattgcaggtatactctgcctttcatgagataggtcttgaagttttatggcaatagtgtggacactgagagtatgctgaagaattggggccaaatgttttgcctatcacaggggtggataatcacccttacaggggatgaactattcagcaaacaggagtcttatttccagcattacaacaaaacactgaacatcacaggtaaattggtcaataaaggtttgaatgaataaatacatgtatggatgaatgattgattgatgttaagatgtatttcatttggctggaaacttttaaatgtgataggtatctgtcaaataagtgagttctaactctagccccacccaccattggtgtcactctcgaagcatctattataaaacagctaacatatttagggacttgggtatgtcaatcatcatactggatgcattacatacgttcctcaatgtaatcttcgtaaccttatgaggttaaatgttgcttattcccactttacagaggaggaaattgaatctcagagggcaaatcccctagctagtaagtggcaaagcttctacttcagggaccttactctggaagggggccaattagggaagactgttgttatatttaattctctaagttatctatcaaagatgactaaactcttgagatgtataaatcctttaggaaggagtaatttagtgcacatctgaactaaatctactgtcccatttacaaatacttctatgaaagaagtgatcttttttagcctcggtttattcatctgtgaaagggtacagaaataattacctaataaggctggtgtgaagatgaaatgggagaatacatgtaaagtgcatagcttagcttagcatagaccctgtaacatacaagtggttcaataaatgttagccatcaccattgtagttacagaaaaggggtcccaatgcagacctcaagagagggttcttggatctcatgcaagaaagaattcagggcaagtccatggagtaaagtcaaagcaagtttattaagaaagttaaggaataaaagaatggctactccatagacagagcagacccaaggctgggttatttcttgatgatatgctaaacacggggtggattattcatgcctcccttttttagaccatatagggtaacttcctgatgttgccatggcatttgtaaactgtcatggcgctggtgggagtgtagcagtggggacgaccagagatccctctcatggccatcttggttttgttgggttttggccagcttctttactgcaacctgttttgtctctcagcatggtctttatgatctatatcttttgcccacctcctatctcatcttgtgacttagaatgccttaagccatttacgaatgcagcccagtaggtctcagcctcattttacccagctactatttaagatggagtgttctggttcacacgcctctgatatcattattatcattatcatcaccaccaccatcaccgtcatcatcatcatcatcatgaccattgccatcatcctcattaccacgatcatcaccaccatcatcatggccatcaccaccaccctcctcctcctcttcatccttctccttctcatcatcaccatagttgcccgtgcacaactctagtatcaaacacaacttctttagtgttgcactggcaataatgtagtcaagttagtaacacagaaacaacttttgtggtgctaaacagaaaaggtcttctttgcaccaaataaaaaataaacagtaaaagcatccagatgggccaggggtttgttcatgtacttacagaacatctaggttctcatcgatattttctgttctggctcattgccttcctggtcagacttgggtttgggaaatgtctctattcagcttcatctcttgaggccatcgggaggcataagacttgggagagaaaatgccattggtccagggggtgtctccagatgatcttcccggaaagccatgaccaattctgaatgtctctctaggagtaaatacatgaattaacacagctgcataaatatttcacttatcgtatgcagcttcagcaggattaattatgctctaaaattagacgtgtaaagagcacagtgctgagcagtacctaattattcatcctctagaatggagtgtttatctcttgttacacagtagcttcagtggacgattatgagtctaatgagtgtcaaaagtataaaaaattttcctaatgagctgtgtaaatataacctttgaatggagtgtttggttattgagggaacctcttacatgaagcctgccatgcatttccctaggaaaaaggctgttcatctgcctggaagcatacacaagatcctagcaagatgttgccttccttttccatctaattgtctgtggtctttctaaaatgatagagtgcaccatggcatctttggctctcagtactggagtaacaatgctcatgcatatgtttcagcattgctcagcatcgatacccaacatttactgagaaacagatgttttcgtaggcactgatattcccagaaggggttatcatggtctttttcttcttaccctcaatgaacttacagtccagtaggctgacaaatgtataaatgcaaaatatctaatcctaaaatcgaaacgtttctagtaattcacatatataaatttatatcacacgtgtatatatacacatatgtagacatacatatacacatgtgttatgtatgtggtatatattcttatgtatgtgtatatatatacatacatatatattcttaggtgtgttgggtagataagagaatggtcaaggagaaatacgagacataactagtatctttaagaataaaggacagaatgattcataaagaaaacacgtgtggcaagatttagacaaagaatagaatgggccagggttcacagaagactcagccatttattcatccagcaaccagcaactctttattgagtacctcgattctgcttggtccctaaaaggtaacacttgagtgagaacctgaagactgggtaagccttggacttaaagaatggcatttctggctttgaagtaaaggtgaacaggggatcccataagtcccatctatctcatgcattttgtgattttcaaaaaaatgattgtggggtttgaagaagcagaagaaagaccataaaggtcaaacccttctcatatctgggggccagaacaaaagatactgagaagaacaagaatgcctaattttattattcagtcacaagtgatgctgagaaaagggaaggaaaaaattgttttaggtcctctcatctatggttcagcactatgccaagcacatcacatataatatcctagtaagcctttatataatattctggagtaaatcttattatctcccttgcacaaagcaggaaaatgaggctccaatgagtaaagtgaactgcagcagagctcattcagctttaccatgagcaagaatcacgtgaggatcttcctaaaacaaagactgtttcagtgggtctagggtggagcctgagacccagcatttctaacaagctgccaggtgatgctgaggctaccagccaatggacaacaccctgttcagacttttatagaggtaacaattggctctagttcatctgagtccaattctgatcatttcctactaaaccaagctgcaaggagaaacctggtttgcaggcggccaggtcagcttagctataagtaatactttttagtattgagaagcgtttaatcttcttctttgtattttgctcagttttaatggttgtggatttatttttaaactccaatagacattactcatccctgacatctagtctgaggtcatttaacacataaaattaaatgtatatatttatcatgtatgttaaaaattatgtatatggcatattcaattgcacctatatcatatttaggtatatataatagatatgtgaagtatttgaaagatatggtacacatatctctcgcattgatattatattaggctaggtgcagtggctcatgcctgtaatcttaactactcaggagcctgaggtgggaggtttgcttgaatccaggaggtcaagatcagcccaggcaacatagcaaaaacccatctctacaaaaaaattttttaaattactgggcatggtggtacatgcttgtaggcccacctactcaggaggctgaggcaggaggattgcttgagctcaggagtttgaggctgcagtgagccatgatcatgtcactgcactgcagcctgggtggcagagtgagaccttgtctccaaaaaataattacattaatagagtgaccaactcaaccaatgttgcctggactgtccaagttttaaaactagtgagtgaccccagttatatcatatttgtacatataatcatatgttaaatatttgaaagatacacacacacacacacacacacacacacaattttacttcatcaggttccctctgttccttttgtactgcaacttttgccagcaataattttaaagactcatctagattgttaacagattggagaggaccacaaaccctgctctcatgttaataaggaaacttcctgcaatggactctagagttttaatagcaccattcagcataatgatgctcacagatcttggagtgggggagccttggaagtcaatggagaactcactttctccctctgagtgggtcagtgttggcatcctgagtcctttttttgttggccttgtatcttccactgaagcatacaagatagcttttgacggcaggggaccccgtgctggcaggcagaatagaaagtgtttgtgtggtcacagaagtccttgtatctaattagaattctcataaattgctctgggccgctggatgggttgctaatatcctcaacactgcccttgatcaacttcccagcttaatatctttgggctgacatccgagtctggggtagagctggacagtcccacagctcaggcagtgatgaccacacatgtgtccattctgaggacggcgtatccctgagaggccttcacagccagtcttcttagggctggcttaggaatggtatgacagtgtggactggggaaatccttgaatgccccttacccctgaatatttttccctttcaactttctacagcatccagaatttcaccatttgaaattttttttttagataagtgtggattgctgcatgcaacaccctataaaaatggaattcctccttccctcttttcctaaccccatttcctgatatgacatctcatccatccttcagcctctgcgctcctctgtgaatactcccataaagacctctaagctagataccctgcctgtgaactcccttatctctacacttgtggcatttagcaaagcaagagaagtgaaataagtaagatgaaggttctgcagtttcctagtggtgtgacctggggcaaattaatttcttagagtctcatttttctcattttaaaatcagaattctttaaggattaaatatgaaaataaacataaagaagctagtccatgcctggcacacattagatgccattgttggcctctccatgtgccctgggccacttgagtgcactgcattatagattcctcgagggcatacgctatccatgtccacccctgttgctgttcccttactgcaggactcagtggagcttggcataaacaaaatttgtttaatgaatgaacaaatgaatgaattagaaaatactgcagatacacttttgcaagtcttatgtcatcgatttaataccttctttaatgaaagggaccttattttctttagaaaggacactagatacctctagagagagagatgcaaggaggtaatcactgaatcactgccaatcttttgacagtcttcccaggcatcttacctctgtattcaccacaagatagaggcaaattcctccattgtcttatttgtatattataatagtcaaatatccctgtattatgctctttaatgcaatatatgcaatatgcatatgaggcacatatatgcacatatttaatatgtgcaatatgaggcatataaccaacagaattatatattccctggcttttacaactgtagtggatcataaattgctacttagtccagtaatatggaaactgaagccacagaggggatatgacctcacctaaagatgcacagcgagggagtgcagagttggggctcaaacccaggttctctgcctcctagacaaattatatattaaaaacaaaacaaagggaacacaaaaccagtgatggtcctttgttctgtttctttgggaaagacttgacctctgcagtagaagtaatggtcgtagaggacagttggggtatctccaggcatattggtcagcagccccatccaaatcataaaagcctccagtagaatgagccttgctgtctcccaggcaccctccttccctgcagcacagtagaggcaagacaggagaaacaatgtggactccaaaacatgtgctttgtttatttcaggcaagactgcatgctaatgggagaacagtagacaagtttcatatccatagtgttcccaggcacacaccactggtttatgtctttctttgacaaaccagccctgttcacagtttctccctttcttccatgcaaacctcttccaaactgtagctctaatgccttccccaaggaggggcttgtgaaataaagctgcgttgctccacccttgacttttgctgttcttcactgatgtggttttgttcattgcaatgtcattagcatgaatagagaattctaaaaccccaacaaccaggaatgataattgcacagttttgacttagccagaccctttgccaaactggatcgagctcctactgtgttctttgctaaacttgctgctgcagtcctaagaatttaaacactcaaaagcgtcctccttaatttatttatgtgtttgtgtgtgtgtgtgtgtgtgtgtgtgtgtgtgtgtgtatgtatgtttcatatatcttatcaaccaaggtttgttttccaaattctctaaactcagacaggaattcaggcgttcccacataatagtcagcaacataagtcagaactcatggttcttccatgtccaccagatctagggagggttctggaatatgggattcagtctctttaatcaagaacctgggagagagggactgtaccttcaggggcccagaaattagtaccatgaggctgaaatctgttctttagtctgctggtttatgatgaagagggcgaccaagaaaaaatagtatttcccttagcatttatcaaaacccatgacccaaatcccggttactgcctggttttgaaaatgaagttttattgaaacccaatcacatgtaaagcctagtcattgcaacagaaaccataaggcctgcaaaggccagtatgtttattatctggccttttacagaacaagtttgatggcacctagtctagactgtctggagacagataagaagggcagagaaggctgggtgcagtggctcacacctgtaatcccagcactttgagaggccgaggagggtggatcacgaggtcaggagttcgagaccagcctggccaatatggtgaaaccccttctctactaaaaaatacaaaaattagccaggtgtggtggtgggtgcctgtagtcccagctactcaggaggctgaggcaggagaattacttgaacccaggaggcggagtttgcagtgagtcgagttcgcgccactgcactctagcctgggcaacaaaatgagactctgtctcagaaaaaaaaaaaaaaaaaagaagacttaaagttggttgtccagttctcctaagagaagggagaagatgaagatgagaacaagaagaaagaaagacaaatagtgtggggaaggaaaaagggatagagatatatgagggagaaattagagggggaaaaaaggagaaggaggtggtaataataaaggataaagaagagaaaagaaggccaggcatgatggctcatgcctgtaatcccggcactttaggaggccaaggtaggtgaatcactcgaggttaggagtttgagaccagcctggccaacatggcaaaaccccatttctactaaaaatacacaaatcagccaggcatggtggtaggtacctataatcccagctactctggaggctgaggcaggagaatcacttgaacccaggaggtggaggtggcagtgagctgagatccacaccactgcactccagcctgggcaacagagcaagactccatcccaaaaaaaaagaaaaaaaatagagtcaaaaagtaaggagagagaagagaaaggaagagagagaaaaaagggaggagtaaagggagagagaggcaaagaaagaaggagtgggagaggtaagaaatgtttgctaagtgatagttcaggcaatgtttagcctgtgcatccacagagcaggctagttttattaaactgagaattagccatgctgcagatgaaattgaagatgtctcagagccatccgtgcttctcctcggctccggtgtgttggtacaaggcacagaccaccagatgactcactcctgccttggagatgtctaatctgtctttcgatggcttccctgccagcaattcttcctgacataggtccctgtgtcctcagatgactcagcaacacccattacaaccagcagcctcagcccaattaaagagataaatgcaaagtaaaaatagaggggagaggaactgcagagcatctgaaaacctcgtttgagaggatgggacagttttccatttctccacatggaagtagttcaacagctaccatgattgttatagatatttgtcataataagtaacacgagaaggataactacatgtcacaaaatcatctcagtccttgtatgtatttatccatgaagagagccaaactctgtaaaatattcgaagaaatctattctgagccaaatgtgagggccatgacccaggacacagccccccaggaggtcctgagaacaagaacatgtgcccaaggtggttgggctacagcctggttttacatgttttagggagacaaaagacatcaatcaatacctgtgaggcatgcattggtgcagtctgatagggcgggataacccgaagtggggtagagggtggggcacaagtaaaaggtagagtcaaagtccaaagattttctgatttgcaattggttgaaagagttaaattattatagaaatgcctggaatcaagagaaaggactttctgggttaagagaaggagttgtggagactagggttcttatgtgcatgaagcctcagtgtttctattcagacctctaaaagatgctggattctcagatagtctcttcaagattgggagggcctggaatggggaaagatcttgttatgttaatagagaatatatatataagatgcatttttccccaacaagaatggctttgcaggccatttaaaaatacggcaaagaaacatatttggaggtaaaatattttgacttcctcctttatctgtcatgtgatgttctgccaaagttggaaactaagccatgttatatagcatggaataaaacccctctgacaagactttattgtctgtaggatgtgactcttcaggtcccttagatagggctttgggcaagagaagaaaatggtcggagtttggtccttatattaatttcatttgcccctcacaatgactaaatggcatggagttataattattcattcctatttacatatgaggaaactgagtcacaggtcagttaagtaaggtgtccaggattatccagctaagtgggagatctgagattggtacaattggtacctatgcaggagggcgccaggatctttgctttaatctttacatgatgttacttctttagctgctataaaccctcatagacatcttggaagacaggtggttttctcatctggaaaggggcaaggctgtgatttaaacacaggtaggtcacaccccagagtcagtgctccttcctcttttactaatgaaacagcatcattaccctgcagaaggtactgggcaaaatcactttgcgacagaagtttagggtgggagagaaaatgacctacactttttttccattgttcatggtgaaggagactcgtccatgcctcaggccccagcaccgtgggagcaggcccagcctaatttttgagatcattcaaccctgccagtttggggaaaactaaggacccagaagcaggagatgagaaggaatgaaacaaggacagaatgtaattaagagaagtcagatgtttggcctcgatacaggcttgcaaagcagcctctccaggttcacaaagacctgtcttggttgctggaattgcttgttccccacagagcttcttggagctgcataatctccagaatttcagaaagttattgttccttgctaaacgtgttttaatcaaattgagacttcaaaggcagaaatcacagttggggatgagctgggctagtctgtaaattactaactttctaatcaagttaggaagaactgggtgccattgacaacccccttcccatgtattcacccatttgttcattcattcattctcccttctagtcatcgattcaacaaagaacaactgagcagcttttaaactccaggtggtgggatataaaaatgattaaacactcctgctctattgcccttgcctatggagatgcttttgacattttgcatccaatagaatcacttggcaagaaaatacagacacctaattttcacctcctgtggggcatttctacatcctttctgggtgattctaatacacattaagggttttttttattgaaacttatactttttatctagtgttctaaattgaatctccatgtacataattttataatattttataacttttaagtgaaaattcttaaagcaggcatttgctccctttacattatatatatatatatttaattatactttaagttttagggtacacgtgcacaacgtgcaggtttattacatatgtgtacatgtgccatgttggtgtgctgtacccattaactcgtcatttaacattaggtatatctcctaatgctatccctcccccctccccccaccccacaacagtccccagagtgtgatgttccccttcctgtgtccatgtgatctcattgttcaattcccacctatgagtaagaacatgtggtgtttggttttttgtccttgcgatagtttgctgagaatgatggtttccagcttcatccatgtccctacaaaggatatgaattcatcattttttatggctgcatagtattccatgttgtatatgtgccacattttcttaatccagtctatcattgttggacatttaggttggttccaagtctttgctattgtgaatagtgctgcaataaacacacgtgtgcatgtgtctttatggcagcatgatttataatcctttgggtatatacccagtaatgggatggctggctcaaatggtatttctagttctagatccctgaggaatcgccacactgacttccacaatggttgaactagtttacagtcccaccaacagtgtaagtgttcctatttctccacatcctctgcagcacctgttgtttcctgactttttaatgattgccattctaactggtgtgagatggtatctcattgtggttttgatttgcatttctctgatggccagtgatgatgagcattttttcatgtatcttttgactgcataaatgtcttcttttgagaagtgtctgttcatatgcttcacccactttttgatggggttgtttgtttttttcttgtaaatttgtttgagttcattgtagattctggatattagccctttgtcagatgagtagattgcaaaaattttctcccattctgtaggttgcccgttcactctgatggtagtttcttttgctgtgcagaagctctttagtttaattagatcccatttgtcaattttggcttttgttgccattgcttttggtgttttagacatgaagtccttgcccatgcctatgtcctgagtggtattgcctaggttttcttctagggtttttatggttttaggttttttgtttgtttgttttttttttttggttgttgttgttgttagagttttgctcttgtagcccaggctggaatgcagtggtgagatctcggcttactgtaacctctgcttcctgggttcaagcaattttcctgccttagcctcccgagtagctgggattacaggcacccaccaccacgcctggctaatttttgtatttgtagtagagactgggttttgccatgttggccaggctggtcttgaactcctgacctcaggtgatccacccacctcggcttcccaaagtgctgggattagagctgtgagccaccacacccagccatataattctttttaaaaaacttttgttggaagttcatgggtacatgtacgggtttgctatataggtaaacttgtgtcatgggggtttgttgtacagattatttcatcacccaggtattaagcccagtacccattatttgtttttcctgatcctctccctcctcctatcctccaccctccattaggccccagtgtgtgttgctcccttctatatgtctatgtgttctcatcctttagctctcccttgaaagtgagaacatggggtatttggttttctgttcctttgttagtttactgagaataatggtcttcagctccatccataaggtttaagaatcactctttaaagtaacaatatttaccatttagaaacattttatcctgtgattggcagacgttgagtacacatatcagttgccatccaatcactcagttggggtccatgatattgaatctttgccctgagttttattcattctctttctctcagggcttctaattgggtttacacagagcccttggtgattgtgaaaactagaggcataaatggtttggcacttctaagcgttagtccacatgccaaccacaataaagaacataggagatatgagggtaggctatgaatggaagacgtagtcagataagctttaatgttaagcttcctcatccaggaaggatcgaaatagacatgaaagcctttattgcttccaaagatttcattttcatttattgactataataacagtgttaaaaataaagcaggcaaaactgaaaaccccacatttgggtaaagactgagccagcacttctatcgattaaatcggatctggaactagatttggacgcaatggctatcctgattccttatacgtgtagacggggtctcatgtgaaaccacggggaaagtgcagctaaagaccgttgattgagtctaattttttatgtggatttcattattgctcccacgtatgtgggtgacttttgcatgtacataaacctcatgtatacacaaagataatacactgatgatatagacatcagaagggggtgatcattaataaccattctgatgccccaacaactaagtcacttactctcctatgacccaaaaactgtctagggcaaaccatttattcagaaatgcaacgttttcaaataagagatatgtcagttctaagcatagattagcaataaaggacttaactgcttctccattggcctgtgaccagatgataccataaaaattagacttgtttatttccctcctaattttaactagagacatatttggaataataatggaacagtacttattaagaaacagataatatccataaatatcctggagagccactgagtcttcctcagtggtaaaactccaggggatttaatctgcgtaaatttgcagtgaattccctaatgggcctgttgagattcagaatcttagtgtctgttatcaatccaacaccaggattagtacaaggtcagcatgccaggcccatgcctgacaagcagtgaattgctcaaaccagagaaagtcaaatgtcaagagaaccatcaaagtggaaataagatataatgaatggcttgttggtaagtcaaacattgatgtcacataggctcgtgcaaaatttatggcatggataaacagtggccccaaatccctctcagtctatattttttaaacactttaatttggaaaggcaatatattatatatacagttgtccctcagtattgtggaggattggtttgagggtctcctacagacaccaaaatctgtggatgctcaagttcctgatataaaatggtgtagcatttgaatataatctatgcacatcttatactttaaatcatctctagtttacttataatacctaatgcaatataaatgcgatctaaatagttgttacaccgtatggtttaggaaacaatgacaagaaaaaaaagtctgtatatgtttagtgcagacaccattttctccccaaaatattttcaatctgtgatcatttgaattcacaaatacagaaagggctgactgtacatataatcaccccaatctactactttaacataattgtttttaatttatgtattatctcctgatccctgttacttgcagacacatttctttaattataattattggttatatatacttttatagtccatgatttttcacttattattacattttaagcattcttatgtaactatactatctgctttcacaattattttaattttttgcataaaatgtcatcatctttattaaaccagaaaccattacattattttccaaatgctacacattttgatatttggctagtatagataacgatggaagaaatttcttcatgcctatttcttttttcttttgaactatttgcaacaaactcttagatgtagaatttaaaggttactggttctaaagatctctaggagtcttgatatatggcgtcatattgatgcccaaaaggtttgttaaccctgggtgcagtgactcatacctgtaatcccagcactttaggaggccaaggtggggggattgcttgagcccaggagttcaagactagcctgggcaacatggtgagaccccatctctacaaaaaataaagacattatctaggcatagtggcatgcacctgtggtcctagctactttggaagctgaggtgggaggatcacttgagcctgggaggttgaggctgcagagagcagtgttccttccactgcactccagcatgggtgacagaacaagaccctgtctcaaagaaaaaaaagttttgtttccatctaaagtaatagtaatagtggatcaatgtaccaattttaccactatctagcagcattaggcattacagttctttttgctattttagaaggtgcaacatgctatctcttttatataaatataaaaagttatttcatgtttcatgttttgattggttaaatcagaattctgcaaattatggcccattacatgttttttataaagttttactggaacacaaccacactcattcctgtattacgcattgtctatggctgtttttgtgctacaaaggcagagttgagtagttgtgatagagaccgtatggcctgtagtgctgaaaatatttactaattggccgtttaccataaaaaaaaaaaaagattagtgacctctggcttaaacaataaaagtgacatgttattttgaaacaattccaacaattggaagaatttaactaaacatgactggtttccccttatccttaaagaaattttctctttttgtaaagaaatatcacgcttaaaaaagtttgtatttttctctcctctggtttagaaagtctgttttcttcaactttccttattattacctcacttaacccccaaagtaaaagaacacttatacctgtactatgccactcactgtttttttctatttgttaccttctataaactatgacatacattcgttatattgcacaaatcccaatatccagttaatttttgtacagctgtgcaactcccacccagattgagctataaaatgtgaccactatcctagaaagcttcctcatggcccatgccagtcaatatgccccccacaagtaatcaacattctgtcctccatgaccatggggtggttttgtcttcttttgatcctcaaataaatggtggaatcatacaacatgtattcattgatgtctcttgtgacattgatacatattactgcatgtaaccacagctcattattttttttcgttgctgggtggtattttatcgtacaaatttatccattttgctgctgatgggcatttacatcacttttagtttttgtctgctttggatatttttgtacctttcttgtgcacaaaggcacttattggtttggaaatatacctaggaatgaaattgctgggtaatagagcgcgtctactcaactttagtagatactttgaaccagtgttctgaaaatgtaaaccaatttacattcctgccagcagtgcaggtagtttctccaatttgcaagtgctccttttcgactttctgtaagaggtaaagctggcttgtgcaacagaactctaggtgtcttcatcagtggctgtgtggttggctgttgccaccagtcatttagagatccagattcttgccccaacatcaacattgccttattttgtgaccttggttcatgtaacctgacctcagatttaatgtcagtacaatgggggcagaggactgtggagtctgccccacttactttcctgagttagaattgatatctagcttctctgccacccgcatgtgctcttccactcatccctggccactgtctcaccccatctggtgccttagacttgggaaaagggagaggaggtcagaggagcacctccatacctggggagcgggaggatgtcatcaaaggaagagctgagagctctcctaagtcataacccagccctgcacaccaccctattaccctctatggaaagaaaaacagggtcttccttctgctttagttacggatggttctgacagctgatatagggtcccttctgtaatagttttatttctcactttctgtccttctccattcccctttttcttcctcctccttctcttccctgtcctcttttctttcctttccactctctccttctctcttcattccacaactaagtctccgatgcccattaagctccttgtgtatactaagcaatggggaatacagatcaaatggaagtgatccatttcgcttctggattttacagcttcaaggaacttgttgacaacacttcgataaaaaagaaactgaaaagcagtgagataattttacttgctgaaaagaggagctatttcttggcatgtagaactgagcaacacagcataggttaccttggagttacaagagaagcatcacacccaaatggctgaagcccctggccagagataagaactcagaggcatctccccaacctgggagaccaggctccatgctttcccactgcttcctttaaatggatcattcaggcatttgcctgcaaacttaaagtgacccgcacgctattcccttttatgtaccactagttggccacattctctctttctcgggctgactcttcattcttgccttgtgtgatgcaggagcagaaaactgtcctcttgattcattgcaccctccctgcccaggatgtgtaagtaataaatctttgagcttattttctatatggtggtgtattgaatttgcacctttcatctgaagacctaggaactaccgcagactgggttttccctcggggagactacaaggttgggcttccagtgccagagcgatgatcaggcagacataaactggacatgggtcagacaagagctgcaagggcatcagcagttataaataagttcctcctgggagagatcccctggtcatggataggaaaactaggcatgaggttgtctactaggtaaaagaagcatcctgtgaaaggcacgtgtaaacacccagatttacttcccctcgttggtcattagggcagggttgttagctgctgtagtactggaaacccagtttagccagtggctctcaaaacagcacgggatctgaagttattgctatccttttttttcttaaatctgtatgtgtttaaaacacaagaactcctttgtgatattaaaaagtcctcataaccttcccatgataagtcatcagattttgaggactattgattgagaaaatatgcaatggcaaaaagtcactatgaattcatttgtgctcacaaatgcatgtgccttttaagccatgtcagcttgaccgtctttatttgtgtgaggcagattggttaagcagattccagaagtgcttggtatataataaggtttcctggattcctacaaggtttctgccgtcttacttcaaagaattgtatctctccaacttcatccagtaatggaaaattatgaccatgtgtattgtttgatgtttgatagagttgtccaatcttttattgtccaatcctctttttaatttttcttctgaaagagacactggttgggaagctgcacaagttgtagttgggttttttgttgttgttgtttttgagacagtttcactcttgttgcccaggctggagtgcaatggcgcgatctcagctccctgcaacctccacctcccaggttcaagtgattctactgcctcagcctcctgagtagctgggattacaggcgcccacgaccacgcccagctaattttttgtatttttagtagagatagggtttcaccatgttggccaggccggtctcaaactcctgaccccaggtgatctgcgtgcctcggcctcccagagtgctgggattacaggcgtgagccactgcacccggccagagttgggagattttatggttgggaacctgtgtgcataaaatcccccaactccatccaacttgtgcgactaatcacgtggcctgtgaaatcctgcaatgtgacaagtagcaatgaacttaacaatactcaagtttcatccatggagcagaaatctcagttggaaggtggcggtgaaacatttatgccaaagacagcctgtccctgcctctaactggatacatttaagcctagccctatttttattttggttttgtgacttctcagcattatacagaaatggaatattctgacatttaaataaggaatatttatctcccaaattcaatctatttgtgtccagaatcttgtactatttcctatcaccaccaccatcaaaagtattttttcacttcggcaaatagttcagtgaccctctgagatcgtgagaacagaggtcacaggctccagaatattatttctgaacccagggttacttgggtcttatttttctctagctcatttttttttcttatttgtcagatttattgggcctttgttttgtccttttgagagtttttaaatttgtctttaaaacaacatgggtgttgggtcaccacagggaagagagaaaggaatgagtttctcactgctgcatctgggagggtggacttgcctcacatggctttgagtcaagatggtggaattaatgaagttgggccctcaaggtcaaagctcagatggtctagctgatcttactctgctccaaggccacagaccacatccccaaatctgatacacaacttcctttcatctacaggacaactgggcaaggagaggatttggccccaattctgtgtcccccaggccatcctcaattgcaggaccacaactcagaactcagaatgaccaagtctgttgtcatcgagaacatgagcctgccaatgaatctgtgccctagatttcccataaaaaagttgttcctttgccatttccaattccaatcgggcttctgagaaacccaaagtacccaacccctgggcaagacatgaaacaggattgaaatggggtcagttaccctctcggtgttcacagcgaacccgaatgagatcagcagcaacaaccttctgacgtctttcagctatagatggaagtctgttccctgtaggaaaccaccaggctctattgctgggatctttgatgagaacatactcgcccaagagccagccttgatttctgggtttcagaatctattcctcacccctttgcctggggcttctcaaacttcttcctgtcttgggctctgaccgatcctcagatctgtggatcacaaactaatcaaggagacaggagccttgtgttatccacagttggtgcaatgtcatgaaccacatgtaccaagacctgtgccacagactgggggtacaaggagaataaaacaagatccctgccctgaataaactcacctcccagtgacaattacgttccactgtgacaaattctatacaaaaaaaaaaaaaaaaaatccaggatgttatggtagaggaaaccatggcgtcatatttacattcctgtgccttcagggaagacttcctgaaggtggatacctctgagctatacaccaaagatagctattgccaagttttcagcacaaataccatgcagctggtatatccagagtagactgtaatgggttatgatattggtgacagtttacaatgaatccttgccagcagtttcttgtaagtgcgtttctcccagtcactgcataacctcggaacaggaaagcttaagctgcgtcttctgtctgactctgaaatcaggacaggactctaatagtgactgtgtcaccaggatagagttgactggtgaccttcctccacatggtagcaccattgtacacatttgcaatttgaatgagacattgcacactcactcatcacagcttacctcctattgtatgtgaggagacactggatttccaatcagggggccatgactggagaaacatgagcaacaactgaagaaccttgggtccactaagaaaatagttgggtgttcactacagatgtacatctgacggccttgctgttccctgggtaccccagacttgttagaatgaaaatcaagttcttagcattctggcttctactcttcgggctcctcctttgatcccttcttccttcccagaaatcctgaactgctctctgatctcaacactccttgtttcttcctgcctccagccctatgcaaatccaatcatctcattttgccgtaactactggttttcatgactgtctctctcacaggaatgagctcttagaggccaaagactatctgtaattcatctctatatgaaaatacagagatgtttgccacatgttaagtgctttacaaattttctcttttcaatgagtgaatgaatgagtaaagaaaaaaaacaaatgaagtcctcggaaaaccaaaaagcaacagcttccttgaccagacatgaaatagaacatcgaactcagcttctcagaaccacatactctctcttttcatctttcatcactgccttgggtcaggtgctttggcaagaaaccaagaaaaaaaaaatatgtagacgtgtgcctgtggaagctgattttagaagatatgtttcagcaaattttggacaaagcctaaagggtacaggttcaaaatggatttttcacaaatgacctcaggggagaggtacttgggaagtttgaaggctagtcacattgcttgctataaaatccattcccaaaaactgcagttcctctggaagtgctgagaatgagtcttagggcaaatagagaactaatttctcttactttggatataagagagtctccatggagagctgaaccttctccctggacttgcgttcttggaatcatagatagagtgagttagaagggcacagagagcattatgtggtccatcccaccccccagcttccctgatttcaggcaataataatatctccagaaatactgattttgtaattagtgtatgccaggcactgtgtgtatgcaacatcgtttaattctaacaaaactcctatgagataaattctgatgtactcccatttgctcgatattaaaactgaagcttagagtgattaagcaaactccttaacctctctgcacctgcgtgccctcatctgtaaactagacaagccatattaagtttacatgagttaatttttttaaactctagtatagtacctgaaggacagtctattttatgtaattttgttaaatagaaaaataaatacatgaatggatgagtagttggatagattaaagtagagtacctggaccatgatcaaagagccggtacctgtggaagccaagagtctaatgcaggccgtctgactcagatattgagtgtattaatacctgagtgtattaatacctctgtgttactatctagaccttaccagatgactggatgtgctccccaaaatcttaagggaagggtgcttccttttatatctcattctagtgttttctacctgaaacattctttcttgtaatttgctggacagtatctagttgaattttctttcattcctttttgcaaatataaaacccctggcttccaccttgtcagtgggtggatgggtaatgggagaaactcctccactgtctgcatcctgtctgtgccttttgtctaaccagccttcttacagcctgacccaagcagccagtggaatggaatggaagcaagttggagacacacacacacaacactgcctcaattatccttgcctgttcccttttaaatggaatggaagcaagttggagacacacacacacaacactgcctcaattacccttgcctgttcccttttagattctgcatctctctgacggttgactcctgaaactctattactctgtcttttaatgttgtcagcattaggaaaagagtgaccttgacaccttgctccttctactgaacttacagctttcctcacgatggtgcagaactaagtggttagtagagatacttgtggctggaaacatctcccctgaaaacagatataggaagaacaggtgcaagttcccatgggcgcaaagaagttctgcaaatgtgcatgagcttactgtcactggaggaggtggaaacacaaaaggagagggctttgagtgctacatggggaccagtcctctccggtggggagacaaaggcagtgtggtttgactgcaaccccaaaacttcccaggctccatctgttcccaagagagcatttagcttgtgtgttcccagcaagaatgagtctgcttcaggaaagagatttaattgccccatttatcagctctggttcacaagatcacactgacaaagatcacggcctctttttaataggagaaactggcagcagaataaatatcatagagccactccttggaaaaacgacatttgatgcttcaccctacctaaaggatgcacatttcccagccttttactctcaagcccgctgcaagttcccctttgctttgtattccttctatttatatggcagaataactcactaaacagatttgaacacttctgcaatgctgcccagtttaagcctggggatgtaagaaaagaaacagaaacagaaaatatggattcaatgctcactacgtgctgcaggccacgaaaaatatcaaaaccataaaacatggtccctgatctccctccaggagattacaatatacttgagtaaattaaaaatgaaataagaaagtatttgaactacagttcagtacgctagtcaaagagggccacgaggcaggaaatgattaatttgaaaatgattggaacaggctgtaattggtaatgagaaatgtgcatttgctctttttttttttttttttttttgaaattgaagtctgctttaccatgttgatttcctctaaaaagaggtattgtttgggcaaagggcagaaggaaatctttttatttacatcctgaaaagaatcgagatgatgtttcttatatcagactgccctccttacaggcttacaaacctggcttggtttgaggcaacaccgaaaggaagatgttctgggaatctgatgagtcatagtgagaagacccatttttgtgtcctcccagactccaaagggtctgagcacggtggctcacgcctgtaatcctagcactttgggaggctgagccaggtgggttgcttgagcccaggagtttgagatcatcagcctgggcaagatggtgaaacctcgtctctactaaaaatacaaaaaattagcacagcatggtggcatgtgcctgtcgtcccaactacttcggaggctgaggtgggaggatcacctgagcccaggaagttgctactgtagtgagttatgatcgcaccactgcactccagcctgggcgactgtagtgagaccccatctcaacaaaacaaaacaaaatacctccaaagggaggggggacgtcaacagcacattgtatttccaaagggatggcattggtgtttttgtgagaagaggaagcagccgtgcaggtctgaggtacatggtgggcagagaaatctggatgagtttgagatagtgttggtggacagtgagatattatttcaaagtctcccatgactttgtgactgtgcgaaagcatgggaggctgttggaagaaaaggaattgaatcaagataccctcttctcatccctttacctacacaaccgattgatcagcacccatttttgtgggtgaggaactggaaagggatggatttcctatttttttaaaaaaaaactcattaacatgtatgcttttttttctggttaatacatttgagaactttaatgagtcacttagtctgtaaaaagaaaactaggaaaatctctgtccatcaaagtgaagaaaatgcaaggaggtttaccatctgtttgaagctgtcagtaagaaattaaagcccaaatgagcatgtgagttcaaatgtatgctacttaaatggtgtagtaatcaaagtaaaaatttttccatacaaaaactcatacattgaaaattcctggaaccatggcagaagcaaacccagaaactctctatagggatgtttctgtagcctagtgttcttgggagtcccatggggcttagagggaaaataattctgcagaagattagctcatggtcaaaagttacagacgtcacaaggaagtaacccaccatgagagtcagaacacacagcaaacagaggaatgagaatcccaagaactaaggtgggggtgggggggagtaatctgaaagactagaggtttaaaattattaaatatatgaaagttttaaaaacttttaaactttatataacaaactatataacaaaaggatgggatattatgataaaaagaacaggcagaactgtaaaagaaccaaatgaatatcacaattaaaataaataaaattaaaacataaagctaaatattaccaacaaaagaataaattaacgggaaaatacatctattggaaattacccaaatgcagcacagagagaaaaaagaatgcaaatattaaaacaaggtaaataacctagaggagagaatgaaaagttccacagtattttaaagttttcaggaaaaaaaaaaaaaaagatgggactattatataccattagggaattgcaaattgaaataatgagctagcactacatccctatgagagtggctaaaaccccaaacactaacactaacactgacaatgaaaagggtggtgaggacttggagcaacaggagctctctcattcattgttgatgggagtgcaaaatagtacagccactttggaagaaagtttggcagtttcctacaaagctgaaacacagacttactgtataatctagcaataatgctcctaggtatttacccaaatgaactgtaaaaactgtaccacactaatgcaagatgttaacagggaaaaccgaagggagcggggagaggtagtatatgggaactctctgtactttctgttcagtttttctgtaactataaaaccactctaaaaaaataaaatctattaactttttaaaaaagatatgatagggagaagtaatattcaaagccatagcaggtgaatttttgccagaactaaagttctaagtattcagattgaagaatcgtactaagtccagagccgaaccaataaaacaaacccacatctagacttcacaccaaagacaaagtgaaattctcaaaagcaactagagagaaaatatagattgcatagaaagtaacgacaattagatgattagccaacttttcaacaactgccatccagatcagaggaaaatttaacatctccaaaaggtcaaggaaaaataattgtcaactttgatttttatattcagccatatcattcaagagtgagaacaaaccaaaaacaatacatgctaatttcacataacttaaaaaaagaccaatattaaatcattttgattgacttcttcaaagagaattgatataaacatttggagtatttcgttaatttttctctgcatgtccccattacatcttagagatcatgtatatacatataaaatatagtcatacttttcatttagcatacacatcttgatttttactgtccttgaaagatcatttttaaaggctgaatcatagtctaagtgccatagtttagtgaattgctagacagtataattgctagacatatagatcagagaattttctcctaaatggcaacaggataaaatgcacataaaagagggacagaataattctaagcatgcctactcttttcttccccccattggaaaaaaccacctggttctttaattgcctactgaagttggggggtgggtatagtttagtttgcaaggggccattcagagccagctggatgtctcttttcaattaaagttttgtgccctaagtatgctgctcatgtgtgacttttctaagtaatcctgaatgttctaaagagagagagaaaaagaaacacacatatttgaggattgccacaggccaggcactgtgttaggcattttcttcacaacagtaaatagtagcaaacatactgcttatgaaaacttactatgatctgggtcctttagggattttatacattctcatctcattcaatcctcatggcgactctaggaagtatgttctattattatgcctatttcacagacaggataactgtagctccgaggccatgcagctagcagatgatcaagtcagaattgcaatgaagtctttctattgtcacgttctgcccttttattcccatgtcttgttccaagcttgggtgggtattgggggcaggggtaagggaaagcaaggtcagaaaaacataataatgaccaaaaaaaaaaaaaaaaaaaagacaaaactccaaaaaacaaaaccaggaactgtgctaagttatatatattatatatgtatataatatataatatatatacatattaatagagaataagtttgctatactctctctctatatatatattatattctctatttttatatataaattttgtcctcactgcaacaatattaggtaggctatgtaatcattattatcttcactcaagaagtgagcaaatggaaacccagcaaactcagaaacttgtcttaaggttacatagctgtgagttgcacatcgtctgttccaaacccagaagcgtctgccccaaagtgcatgttctggtcctcactgcctgtgaatgttgtgatctgtccaggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcagggtcagtacaccgggtggctactttcttgcactgcaagcaggtttagaaaagcgcttgggttcttgatgtctcagtggggtctgcacttcctccccttaccagcctttcttgggcatgtcacaagagcatccagattttgtgcattcataagccaggtgttgcaaacttagatgactaaggaaggcagaaaggaaacgggagtgggtgcagcaggcgggacatgagaaaaatagcacagatgacgtgaaacggcagctaaacctcagtatcaaagtgagagaacgatagggaatactgaggactgtggccaattgcatgatgtttacctcaccagtagcgtggcagccatcctcaactcctgctgagtattgtcttatgggaatgtagagtcaatattatcaggtcttctagttttttaaaaagagaaaatgtcatctgattttgttagaaacctttccatttttaaatattagtaactaattccatgtaaaaattttttggccgggcacggtggctcatgcctataatcccagcactttgggaggcccaggcgggcggatcacgaggtcaggagatcgagaccatcctggctaacacggtgagaccccccccttctctactaaaaacacaaaaaattagccgggcgcctgtagtcccagctaccccggaggctgaggcaggagaatggcgtgaacccgggaagcggagcttgcagtgagccaagatagcgccactgaactccagctccagcctgggtgaaagagcgagactccgtctcacaaaaaaataaaaacaaaaaataaaaaaaaatttaaaaacactgggccagacagagccagcctgtggctcccatcactagcacccaggtatgctgtataacactactaatgctgctatgcaagatgttacaatttgtgtatgcattgtaacagaacatgcccaacaaaacaaaatctacttgcaatgctatggaatatgtatacacatctaataaaacacaaagagcatgtggaatgcaatagcacatgaaaggaaacacaggtgtaaagtaacagaagaaaatgcacacgtatcaagcagaaaacaaagtttaccttcaactcaacataaacaacagcacaaaatacatatgtatctaccttcttatctatatgtccattcattcgtttcagccatctatgcatccatctatttatccactcatctctcttatttgcccaccttgtttttttgtttgtttttttgttttgtttgtgtttttttttgtttttgtttgtttttttgccttggaagaacttcattaattaggatttgaaaaatggtgaaaactctttggttaaaaacatctaattgcagcaaaccaacacagcacatgtatacatatgtaacaaacctgcacgttgtgcacatgtaccctagaacttaaagtataataataaaaataaataaataaaaatctaattttatatgctattgtttactgagaaagctaactaattgctttaaaacagatttgtatattcttaacatttgctagtttcaagaactgtggagattcggaaggtacacattagtttagtgaggaagatttattttctccattcacttgcactccaaactcgggttctgtgcaaatacatatttcctaattagcttgatggcatctaaacacatagattgcttaaaaataacaacgtacgtgcatagagctaggtattatgccaactttaagctaattctcccagccaattaccaaaggcttttcatatccaaatgattctgggattagcaccaaacaaatgcacactgttgcgtttacttctaaatcttgcttgtttttggaagagcatttcctctatctatctaaaacactgctaaggaagccaagttgatttatcaacattttaagaaatgaagtaaatccatatcttcctttccaaaggatgggaatggaaggcaaactgggcagcacagggcaggcattgttggtggagtcccttgatcatctagaatttgaactttggcctctccatccctaggggagaaggaccccaagttttatgggagcaatgtgcttttattgattgattgattgatttgatttgatttatttacttatttatttttttgagatggagtctccctctgttgcccaggctggagcgcagtggctcatttgtaagatttccacatccacagtctggatgctccagcagctctggaagcagtgatggcaggggcagatgttattttgtggcaggacaaacagccaaccacacattatatatagaaggagaccacagataagtttgcaggaatgcaggaaaggatgtaatgccagtgccctgagcctcagggggccttcaccaaccatgaagcctggggtggagaggatcagagaaagagcagctcaaacttgcaactgtaggcttttgtgtttacggttccttgaaggctggagtggagagactgtctactacaagaaaaatgtagcagtgaaaatgagttgaggctgtcacagttccgtgagcatccctgcagggtgagcttgtccccaccatgggggaccgatggagccaccattatcagagtccacagttaatcacacttactttcctgtagtttatgccaaagtcagcagccactgccaattctgccctacaaaccccttcatagtttggctccctgtcagccttgggaagaccaggtcaaatcctgcagccttgatctgactgtttcctgtaggtacggctgctgaaatctggggtaggagtggggagaagcaggggaagccacagatcaaaatgttccagacgtccttttgcctgttattgtggtaggaatcaagggctcttcccttgataacagttgaacagctacttttaagtgaacgtaaacagttgttttctaaaagaaagaaagagtagaaaatgagaagacatatagatggaggtgcttgtatttgggctgcccaggagcccttaagtcattcagttccctggatggatttaaaggcggtgtcactgtgtcatcagaactcttcactgtgactagtaactaaaacccagttctaactacattgaatagactcacacacaaacaaacacacaaggaatagattgagtcgattaagtaaaaaagttcaagggagtggctccaggggtttaaaccatgtctttctctatctcttgggctctacttttcactgcaatggcttcactgataggctcacacccccacatgatggtaagtctgcaactccttctatccaagcatccacatctatccccccctcaaagagtatgatgagcctcacatgaatttcatgccttcctttagatgaatcaatgtgtgcatggagaagagattttctgattggccacttaggacacattctttgattgttagcttttgcataagagtaggggtaattccagaaaagaattaacaatggatgatcctttcatgctgactgtgtttgtcagtagttaactctctggtgcctaaactttcaaagatgatgctgggaaactttaatgaaagcttggattggtgacccgggtgctgggaggctcagttatctgttcttatatgccactttggagacactgaggcattgacagttgtatgagcatcggttgataccttttctcaaactccatgtgtgactctttgcaaaggtgtcagctaatcttgagccagagcaataagataaaccctatgctttgcaacttgtctcatacctttaagagacattatcaggattcagactgaattttgctgtttctccagggctcctgcaagaagtgcaaatctcacctttgcaggtaaagttcaagtgcaaagtggtttcatgttcactgctgctgctgctgacagtgctttatgttgctcccctacagggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtgcgattgacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagagacagagaggggaatacttatgcatggggagcctgttagcacagtgcctgccacaaaaacaagtgcccccgacaagatagttgctatgttatgacactttctcagatcaggattttctagtttaaaaattaaatatcataaaaccagcaaataatattaactaaaccttttatatagttctactctgttaattagtgtatttcatgtacatgaatatttttgaagtatttgggataactagccatcagtgtttgcagaagacctcagtctgttttgggccattacggaaacactaagctaatgtagactcgcctggccatttcctggtttcctcctgcattctgctttacattcttgaagaaagggataaagtggcaggttgaaaaattatcccatttcttctcctcatggtgtgcgttctgttttgtaagtattattttcttgcatgtgggcaagtgtcagggatgattcccttaaagctcaaggatgcatggaatagctccatctttgggaaagtacacctgacctacagtgttcctataatgaaaagtggttgcaataaatttcagggtcaatcatagggagacagagggaggcagtgggtgagaggagcttcctttcatttttgaaaggcagaaggggctgactaggtgctggggatgcatgtgcttgaaaatgacattttatttcccggatgctgtacctctgctgccccaagacccagccatggagaagcctggatcgaagggcccagaatagtcaccccaacatctgatcctaaatctgaatctccatgactgtgtagccttttagccctttctaccttctgcccttccagtgcattccagaccttaatccaccccagcaaggatcgcctccatttcctcatgagtctgggatgttttgacatgaatgaattaaaaagtcttcccagaatacagaagagtgatttgtcgtcaagccaaagaggctttctgtcttcctctggtgtcctctaaacccagggggctgccaaatgccacagagacctccagggagagtgagagttatacttggactgacttcatcggtcagaaagccttcccctaacagcagcattatttctgctattaaccccatacatctctggataaagaaactgaaaacgtggcctttggaagaatcaacagtaatgttgtgaaaaaaatatatattcttttcactgaccgaagtgttttttcaaataaataatcagaaatgttatgctacacaaagtttatggtatcccttctctactaattcaatgactcttcaatgtgatgatcccaagcaaaaaaaaaaaaaaaaaaaaaaaatcaactactgatcagatggtcaatttctaaggaaaagatgtagagttattcaaaggtcatctaagtcagttcagtctttgcaaaaagaatatcaggaatgtaacgtccagtggtaaatggaacccacagtatgagaagtaacaagaattaaataggaagcctggaagcctgagactatagatctatcacagaagattcccgtaacatatcccagctctgagttcttagatttgttgatgtcaaggagcccaaatttctgaacacaaatgcctgagtttcagctggcttaagtcagagctggcatccataatgatattttgttaattctaattggttttccccacttgagaaggacccaactagtcctcagataggtacacttgaatgcaaacggttgggtctctgtccatgggtaatagcacgcacatgcaaccaatttaaaatactctgggtaagagagtcttctagagcataaactgtacttgagaaacctttgtgcttctggaaaatgggtttcatcatccttacatctgcaggttcttaggccacttatggtttcaatgctctgagctggcaagtccctataggtctatctttctgccagagagacttgcaggattataatctcacaatctcaccactcattactgttatgtcctctgcaaatctctctgcgttattttagccagcaccatgactgggcatccacggattactcttgattttctcttccctgattcacaggatgccagagagtctgagtatttagtttttctggtgaaagcattaaaattcacacattgcagcaaaatctgtcaaatcatttcacgcttattttctggggagaaaaatagaaaattacaccttgtttacaaatgaaatagtttcacttaaatgggactctagccaaggcagttaattagtcaaaagatccacagctgtcatatagtcacacattgtttattctatttgctatgtcgaccactgatgtgtatttaatattctgcatccttcacaggaaatgacaaatgccctgaattatttgcaaatagaattgctaatgaaaaagaaaaaaaatgttgatgttaattaaatggtgattaaaaatttatctcctttaaatctaaaaagtgcagctttaataatcagttgtcatataaataagtaccttgtactgaaatcccttgcggtttaagacctaaataaacactaatttgagaactctaaataccttacagaggagctggatatattcgttaacattatgcacattcctgtactgtttctttgtgcatagctgttgtgcatgaatccttgaaaaggggacatgcgttgtttctgaaatggagcctgtttgtattaaccatggctatagtagacatgattggactcaaagaaaaagaagtttgagtaggtggaagctaaatgtgttgcttgatatttaatgagtgaagggttctatgtaaaggcaattttccttccaaaagtactgtttattttcactggagacaaaattagacctttccagataccccatctctttttggtgaacagggttgaaagtgctgtggggtctatacttgaaaagttctcccaatatgcagttactgtttcccattcaatccctatacattgtactgtgttcatatctaattgtatcagatgaggtcagcttgccacttgatatagatcagagatgatcaaatgcacttatcctgtgaatacaactgcttgtgtacacatgtatataatatacatgcttgatttctacaattcacacgtaagtgtattatccaaataaaattgtacatattgtaaagtttatgttaaaaattaaatggtgatgatggtattaacacatggaaaacccattctggttatttttatgggaggatatttctgtagagagggcactatatttttttaatctcagttgtagggaggatgacagagcctaagtagaatatgggtgttggcgttcttggccccttctttaaaaaacaaaactctgggatgaggggtatagaatatattctgctcgcatttgcttctgaagacaatgccgatatggacttgtgtgtgatttccttaaacacatcaaagggcatagatttcctatttaaattccttatcctctttcctcacctgcactctttctgtgcccagcagtactttcagtatagtattagctagaagtgcctgcccagaagggtcttagaaaaatagagttcgtagaaccacaccaaaagttaggagaaggggaggagagatgagaaaaatgaagtttacaaatgggcagttgcctgtttaagatcatcaagttagagagtatcagagcgaggattagatccaagacatggttcaatttctggctcgattctctgaccgggctgacttatttctaggtttctttcaaggggaaactcctgagtagctctggaataagagccagagatccccataaggctgccctggtttttgttttgttttgttttttgtttttgccacttgccccagaaagacctacccatgcttctttgaatttggttttcctttaaactccctcacaatccctgtcttaaagttcctagaagagaaaacttttctcagagaccgtctccttaggaaaaatcaacagggatattgtttaaaacctcaaactgaagataaaaggctggcagtgaccattgaaataattgaggtctatgtatcatgcattgaggaagaaccaagcacattgaccagctaataggacttcactgaatgtccactttattttgaaagccagtttgggattgtgggggaggggatgcaaaataaatagaaaatatagtctcttcccataagtagcttatggtttagaagttcagttctctaatacaaaggataaccaaggacccatgcaatgcaaacagagactaaacagcaaaaattagaaatgacaactaaagttgtagccaggaaaaaaaaaataatctgattctatgagcataccttttttaaaaaaaaaaaaaaagtccttccctaaacctttaagtaactccggagaatagagttagtggtcccggaaatgcagttgatttattttaatcttcaaataatggacttaggagacccaggagctgctaaccaggtgaacacactcacactcctacatttttgcacaggaaggcttttgtctggttccaaccagttctccagtccttgccaaatcatgcctcctcccagccttgcattatgacatgtgcctcaagaaaaggttgaaaaaattccccaaaggattagaaaatagaccatgatgtaaaaagacgaagcatttccctaaagcttttttgtttggttttgtttttgacatttgaagaacccttctgatacaccagggtatgaatgtatcagggaagcatagagggaaaattctttatcaagttccaagtgcctactgctgtggctgacagaaagcatcaggttccctagagagaaaacggggcaaagagatggcaaaaggaatagaggtgtatttcaggaaggatggcgaggtggagagggagcttttgtcactctgtctatcccattctgtgcattcttggaatgttacattttctgcttatcgcaagtacttgccatggatctgcacctgaatttgaaaatatcaaaatatatctaaattgagtgtaggcgatattctaggcatatcctagaatgtgatcctcaaaacaaccttaagatataaatatgattgctcccattttacagataaggaaactgaggctcaggtttttctcaacctcgtcagcaactagaattagctagtaaatccctaacgttagacatattttcaaagtgcctggtctcctccagggaggtcagaatagaagtcagaaagagaggtgtgctcttttgaggttcctgggcatatacccttgagtatcagcctctgtgacagggaagtctgttagggtcttacccctcattgcctgatctgtgtgtatggagaacttctggggatctcacctctgttcatagttccttctgagacttgaacactgtttgtgtctccctttcatatgcttgcacttagcatttaaaaaaatttctggggagttattttctctacttagcatgtgcctaatcttaaatatctctttcctaatgtctcatctttttatcagtcaacatcagggctaattccattaaacatatatacatagtacatgctctcatgtgtgtgggtatgcacacacacacacacagccatgtgaccctccattaaagtcctcctaaatattgtgacccatgttcaaagaggtgatattatttgcaagttgactattcctcctatttcatgtctatgtttggttatctttgccaggcagatggaatgagtttcagaggtgggacagggaataggaaatagagtttctgcatgaatgatggagagctttggtagtcagaatgattgaggaccagctattaaaatgttgttgttgttttccttcttggtctgttcctttttttttttcttttccaaattgtcttagagataattcccggctcacttagcattaggataatgacggttattctgtcccactgaagagtgttgaactggaacgcttccaccgggctttataggtacccagaatggcctaatgtttaacatatcctgcaggcatgcccctgagcacacactgcctttcctgcattcccccctctccatggtctaagccacatttctttcctggcatttatatttactgagaggtgaggggtgcattaggcccatttgatggatgaggacactagcggggatttgaaggaatgtctttctgggagtctccatgaattctctggagagttagctaacttaatgcaagttaagtgctagtctatgagaaaaatttctcagctgttttcatctttcaagctggcagtaaaaagccttttaagacagaaagattattatttgttatttggagatcctgttgttgggtctacaagtgcgtgaccatgttctccttggaatgttgagctatgcagaaatggagcactccaaagaacgatttgaccaatagcatttcttctctgggggttgtatttcaaagcatgcaactctccagggaaccagaactaaattgcttaaaatgaagtcattcctcagattaacttcctcagataaagtgtcagcggtctgcagaaacgaagaagacaaaactgagattatcactcataattctcttacttactatgtcagtgaaacaatgagtttgcatttttgcaatcctagaacattcttcattagccctgggtcatgacctcttccagttaattctctttcacacctttaggaaagatttaagatgaaccttcaataggatattaacataactcatagccaataccacagctgcctttcaaattaatgaggttaattgttctccagcaaacatgagtttgtctttggcattttaaatgcttcccattgatctgacattttgctgtttcaagttttaaagggctcaaatcaaagactattgataactgagcaaagagcgaagatccagaaatacgaaaacattgtctttttttttccatgaaaaacaatcatagccttttgaattcaatcgaagtttctacattagccatctaagacttatttaattatttctgttctcagtcaagctaattcaagtgaatgaacagtattgacttttaaaatcttttttaaatttttttaaatctttagtttattaagtttgtagaaaagctctggggccatgaccacttacgtaaatgtttcagtttaaaaacaaaagattcaggcctctaatttgagccaaatccaggtgatcttgtttgaaatttttgatgaatttgaaaagatgaaagtggaacttttaacattcatgttccccaaatttttcactgggaagggatgctaattgcctacttaagatataagttcaagaataacattttcatagaaaattcagaaaactgcttgacacagcagtgacatagttagatgtggctcagatgccttccaaacctgagggtccccaaagatttctttaccagttgtttttaactatgaatcttaatcttgttcattcccctgccaaaacaaatttaaaagcataaacctgctgaattaattggcagaattcaccatagtttatatcaccccagaatgtttatgtgtatatgtttatgtatagtatatatatttcaagctgaatgttcagaaagaataaggtgagtttcttggtagcttgaataagaattagatcataaaaattataaataatggccttctcaaagaggataaatgattcatttttcactcacgtattaataatatgacttgttgcataatacacaagctggtcattgcctgcaagaaagttattgaattaagcagctatccaggtttatgtctgagtccatttttaacccaacaaggctaggattgaactccatatgcagagggtttctattcacagctacattcaaacagaatccaaaacccacatcagaactgacttgatgtcttgtatggtggagctgaaagcaagctgtctgctctaagcaatggtcttcatttgggaattaatgttcactgatcaactgcagcagtttatatctgtcatgttttaatccactgcatgaggaagtgctaataagtgtattaaatatttccaagcatagctacaaaattatatgtttgcttaacacctttctatgatagaggaagtatatactatggttgtcttcttgtagtatgtcttttaattttgttcaatgtgttatcaactgttttaaggaatggggattgaaattcgtgtgcaaactgatatgtatataactcctgaggcaacagaagtgcccggtcatatggtgtaaaaatgtaaatacaggaaaatttcatttttctaataaagataatttctgccaattgatatgaaaatgagaaa

SEQ ID NO: 50 - DNA, 249581 bp, Homo sapiens
  source 1..249581: mol_type = genomic DNA
gggtcctcttctgtcccgtgcgtagtttgttatttcgctcttcacgataaatcttgctactgctcacgctttgggtccgcaccacctttaagagctgtaacactccgtgaggaggtccacggcttcgtttttgaagttagtgagaccacgaacccactgtcaggcagaaacatctgaaggaacaaacttcggacataacatctttaagagctgtaacactcactgtgaaggtaggcgtggcttcattcctgaagtcagcgagacaaagaaccatccggaaggaaccaactctgggcacaatgtgattaatattttttgtgttgatgttgtattctgttactttgctgaagtgacttttagttctagacctttatttttgtatattccttggaatattctatgaagatgatcatgtcatctgcaattggaggtagccttatcttttcctttctcttctgcatgtttttgcttttctctccttgcattattgcagcagataaaacttccaatattatgttaaatacaagtgttgagaggcggaatccttgttttgctcctgatcttagaaagaaaacattcggtttatcaccattaagtacaatgtcagctgtaggattttgtaggtgttttttatcgaggtcacttagttcttctgtattcctaatttagggagtttctagcatgtgtcagtactaaattttgtcaaattcatttttgtgtcatttccttctttagcctgttagcatggtggattacattaattgattgcaaatgtcaaacccaccttacattcctggaatgaatcacacttgatcactatttaaaaatgtttttgtacatttttgtatttaatttgctaatattttgttgatggcttttgtgtcaaagtttatgaaaaacgtttgtctatatttttcttctttggtactgtttctgtcttgttttggtatccgccttataaaatgaagtatgaagtgttcctttctcttctattttctagaagaaattgtgtaaaatttcgtcagttctttaaatatttggtagaattctccagggaaatgaagtggagctgcaagttgttttttaggagcttttaaattatgaattccatttttaaatagttttctttactagaaccacttagattatctgtttcgtgttggttgcattttggtaatttttggtttttgagcaactgattcattttttctacattgtcaaatttatgagcataaagttgattataatattccctttctgccattttaatggctgtgggctttgtggttagtttcattactgatactgttgatttgtgtctcttctgttttaattttgccagtcttgctagagtgacattgatatttttgaagaagcagctttttgttttattttttctactttcctgttttccgtttagttgatttctgctctcacctttatgatttccttctgcttgctttgggtttctttggctaatctttttctagttttttgaggggaaaaacttactgttttgagtcctttcttcttttctaacataaacgtttagggttataagatccccctcagctctgcattagctacatcccacatattttgatctattgtctttttattcttattcaattctatgtgtactttttgaaatttccttggatctccttcttgaccatagactatttaaaggtgtattatttaatttcagagtatctagagatttttttctgttgtctctctaggtcatgtacttttaacttatcacaatctatttgtgaatagtattgtgaaacttcattaaaaaagtgtaagaaacttacaacagtgtaattctattttcccctcaatctggagttgagctggttttggtctgggttgtagatttaattaatttcagtttaccacaggtttcatatatttcaaaggtagcagccagggccctcctttcattaggaatagagagctaagactctgaggtctccctaagctttctcgctcatttccagcttcccgtaccttggaagaaatccatgttgcagcctgccctggcttccgactccacaggacctctccttctgtctgccatcctaccctgtcccaggtgcccagccatcactctgtatttgagatgaaatgtctgaacgaaaagatttatggggcacgtagatgagtgtactttgggggcgcttctgggtttgaatccatcacgcctggcctacagggtccttctagatttctttggtttctttttgtctcagccaagagccgagtcctccctgcttatggctggcttgttcttcccaccacaccccagagataaaagcagttgcaggtttttattgctttggacaggctcgtccctcccttgaatgttgtgcgtttagacttctatgcattttcaggtctctactgattgtcacgtgtgatgattggaataaatcaagatttcctcattgttatattgcgagcaacagctttttacaaccttttacactctaacaagaagcagagctcccactattctgtttaaccagcaaaacctctcagcaacctcatctgtcacccatggccttggagtttgggagctaatggtttggtttccaacatgtttgaaaaaaatgtcataatgcctcccccataattttgtcacaaatcgtatctgtcttttccaaagtgctactctcagaaaaagatacctctatctcacagatacaaaaattcggggaaatcttagttattccaacaggttgagtaattctacttttctcattcaaggctggaattggacacctattaatattagaccctcatgtaagtggtacctaaattctcacctctccatacatgaataaggtcacaactttaactgctatgtcttgcttcagaagttgggctaagtaggacttcctttaagttaagcactattctgagcacttcaacagaccgagtcttttataagacttacctatcaacaaccttataaggcaagtatcattataatccccctttcaatgcatagataccttgagtgatgtggctaacgacccatggttagaaaccgaagacaggaagtgtagagtcaaagacaatgatctggccgagcacagtggctcatgcctgtaatcccagcactttgggaggccaaggtaggtggatcacctgaggtcaggagttcgagaccagcctggccaacatggtgaaaccccgtctctactaaaaatacaaaaattagccgagtgtggtggtgcatgcttgtagtcccagctacttggggtgccgaggtaggagaattgctcgaacccgggaggcagaagttgcactgcagtccagcctgggcgacagagtatatgccatctgaaaaataaaataatcaaaaagacaatgatcttttcttttcctctaagctatattgccatgcacagtctgtgcctcattaccattgggtcataatgtctatggctgagccaatgatgcctaatttaatcattttgaggagtatggtcaagtcagttgcagtcacaaagagaacacctctggtttgtaccatttttttatttgtttgctttggttcagaattctgttttttaaaatgatttcttttactcttactattattttattactgttactttaaaaattgtcattaccccatcctatctccttatctacccaaagctaaccttgacattggtgtggggaagacttaactttttgtgaaaagtgtttgctgcccttcttgaggctcatgcctgtaatcccagcactttgggaggccgaggtgggcggatcacgaggtcaggaaatcgagaccatcctggctgacatggtgaaacctcgtctctactgaaaatacaaaaaattagccgggcgtggtggcgggtgcctgtagtcccagctacttgggaggctgaggcaggagaatggcgtgaacctgggaggtggagcttgcagtgagccgagatcgcaccactgcactctagcctgggcgacagcgaaactctgtctcaaaaaaaaaaaaagaagaaaagtatttgcttccctttcctgggggaggagtagtttctccaccttgctgccattaggattggctgtgtgaattgctttggccagggaaatgtgggcataaatgatccttgtccctttcagcagaagtagtttcactttttcttttccgtgtgccatgagcctggcaaactctgagagtgtctgctttatctaccagattccagagtgaagaggatttggtgccatggtgtggctgatggatatgtaacataataggatgggaaaaaaagcgagggggcaggggtgtggagcattatttgttattgcagcataacttagcctttacttataaagggtgccctgccaagacatgtttttatgattttactaaacgtgttatataaaatatatctctaaaccatatgtgaattggttctcaaagtgtgatccctggatcacaaaagggtgaaagcaagataaaatggtttcagtcttttggggggaaataagataaaatatatttacataataatactaagacattatatgaaatttttttactctcattctttcatgaggatacagtggagctacctaaaggtgtaaatgctctgatgcctaaggaaatgaatacttgcattcttgtgtttcaaaacttttttagctttaatttcttatatagaaaaaattaataaatgcaacccaaatgaaataaatctctttggaacttcaataattttaggagagtaagagattcctaaaaccgaaaaagagaaacattgatgtagtttgctgtttagtatatttataaattttacttaagtgatatttggtgacttgctttttaaattcaacattccgttgaggtctatcccgataggtcttttcctgtagcctgcacgttgttggaaatgcctcatagagtaactctgtgattttactttacttacaggactattgttacatctgtgggaaggaaccacaagacagttgctgaagtatgaaaaagacagttactaaactgtctttagttcagtaactgtcttagtaaagacctgataatttacttttttaccttaggtattggcatattccacacatctgtactattcttgaatttgatcacttaggaacgaatatgattggaactcattcatgtttagagagggtgtcaaattgagaaccaggcagatccacctacactaaaaatgaccctaaagtaaattggtggaagaaatcagatcccaaagactactggtgaattttgaagtcttcgtcagtatatccatattaaaaggagatgacagaagccaaaataaaagaattatgggttgacaggacaactggattaaaataaatgtcagtttcatttgaaagggctaacttgaaggtaatttttgaaaataaattttgactccagctcttcagaggatctaaagtgaccttgatgggcagtggaagaaatcaaaacatgaaattccttgaataaaaatttattgactttacaaaataagtaaataaatgaattcaaccttctctcgctaagttagtgtatgaaagtgggtacacattagactgagctcattcctttcagctgtttatactgttataaaatagtttcaaaaagcggaaaatacctgctcttcaaagtttttggagcatgtgactttataaagcatatgcatttgatcaccttcccaaatgcctttcttgtgccaatgaataatacatttgcttcacaattgaagtaatataccctcctgctctgcttcctatcctattgccaaattcagtgactgaatgggcattttcatattcagtcccctaactatgacctctcgattttacagagaagcttaatcccggttagtctcattctctcactggggattctctgtttccttgaggggcctctgagatgagaacagctttgcaaggactgggaacctgtgatgagcatagtgttggaaacacttgaggcctttgttcttccagagtagacatctccaactcccagggacccctgctttccctctgtccctgaatgctgattatgggtcatgagattatgtaacagacagttcataccctctgcatgcaattttttcctacatattttgttagggaaaaaataaaatatacacagtagagagactagtatactagtaatctagtgtactaataacctagcttcaaaattgccaacacatggtccatcttgtttcattcatttcttcacccactccacactctccccactgcgttatttttagtcaattagtagacatcatacataaatcctacagtacttgtctccgaaacacattgattcttttttagaaaacgtaactgccgggggccgggcgcggtggctcgaacctgtaatcccagcactttgggaggccgaggtgggcagatcacgaggtcaggagatcgagaccatcctggctaacacagtgaaaccccatctctactaaaaatacaaaaaagaattagctgggcgtggtggcaggcgcctgtagtcccagctactcgggaggctgaggcagaagaatggtgtgaacccgggaggcggagcttgcagtgagccgagattgtgccactgcactccagcctgggcgacagagggagactctgtctcaaaaaaaaaaaaaaagaaaagaaaagaaaaaagaaaacataaccgctgggcatggtagctcttgcctataatcccagcactttgggaggccgaggcaggtggatcacctgaggtcaggagttcaagagcagcctgaccaacatggtgaaaccccacctctactaaaaatacagaaattagctgggcgtggtgactaacgccttaatcccagctactggtgaggctgaggcaggagaatcggttgaacctgggagacagaggttgcagtgagctgagatcgtgccattgcactccagcctgggcaacaagagcaaaactccatctcaaaaaataaaattaaattaaaaaaataaaaatttaaaaaacataaccataatactgttacttatacctgaaagtctacaattcttcaataccaccgagttatccagtcagcattcaaactgctcatttcgcatcaaaaacgtttttatagccggttttttggaattaggtttcacaaaaggtccagacatagattggttatgtctcaaatctatctgtaggtttccccttccctatttttatatcttgcaaggtgtctgttaataaaactggatcctttgccctgtggaacatcccacagtctagatattgctgattgcagccctggagtgttgaacacgttcctctgtcccttgtatttcctataaactggtagtaaaacatggtcttaattagattcaggctcaatatttgtggcaggaacgctgtatgtttagtgcatttgcttgctattatgttgcatcaggagatacctattgtctatctccttttttgatgttaatattgatctgtgggttcagatgttatcaggaagatctatccattataaaatttcctatcaaataatagttccagctgccaatgatgaccattgcctgcatacattacttcattaggggtttgagaaagcaaatattctaattcgatcatttcttctgaattcattagctgtaaaggaatgcatgctcatcagctattgggttaccgtgagttatgagtcaaaaggcaaatgaggtgaattgtgcatgtggcattcccccacccactctccatgtgctcagccttgtctgtgccctcatgggctgcatcaaaggctctgttgcccactggattctgcttgggtatagctcatgggagtcctggaatgagatcaaagggaggaaggagaatgaggatggagtttattcccctgtttccttccctgtgctgtgccccggcgggctgcatccattacagctgtctctgcacagacctctcttacctgggttttgataaccactccttcttttgctcctccgatctgcatgagatcatggccccctaaatgccgtggtgatcatggcatcgccaccctgtggtgctgccctattccttgtggtttccctacaaatactgcccgtagcttttatacaacccttttactaagtctcatattacaaaatttgactgtagtgcctgtttcacattgggaggtatattatccttcccctcttccttgttttttgtttttaaattttatggacataacagctgtacatatttatgaagttgatgtgatattttggtacaagcatacaatgtagaatgattgaatctggataacggggatatccatcacctcaaacatctatcatttctttgtgttgggaacatttcaaatcttttcttctagctatttttaaatatacaataaattgtcattaacaccagccaccttattgtgttatcaaacatagaacgtatgtcttctattgagctgtatttttgtacctgttaagcaacacctcttcaccctctgcctcctcagcaccctttacaacttctagtaaccaccattctattcaattcactgtgtccatgagatcagtttttttaggtcccacctacgagtgggaacctgcagtatttttgtctttctgttctgacttagttcacgtaatgccctccagttccatctgcattgctgcacgtgatttcatgctgttttatggctgaatagtattccgttgtgtctatctaccacattttcattttccattcatctgttgatggacacttagtttgattccatatcttggctattatagatagtattacaataaacatgggagtgcaaatatttctttgatactgatttcccttcttttttttttttttttttttttgagatggagtctctctctgtcaccaggctggagttcagtggcgcgatcccagcacactgctacctccaactccccggttcgagcgattctcctgcctcagcttcctgagtagccaggaatacaagcatgcgccaccatgtccaactaatttttgtatttttggtagagccagggtttcaccatgttggccaggatggcctcgatctcctgacctcgtgatctgcctgcctcagcctcccaaagtgctgggattacaggcatgagccacagtgcccggcctaatctgttgtctaaatctaatttctatgatgagagttcccatttttaggaatgctccttggttactttcaaatgtgctctgtttttacagtcttgtctttcttcagcatacttttcaccccctctttatgacctcaaacattaaatgtgtgtatttcatgctctgcggcataattccaatatcttcaggctttatgtatcagcttctgaagtttgtggtttctgctgacgtgtgttcgtgatggctttttttccttcacaaattcagtcatttggatgagctcgtgttctttggaattttgtgggaacttttaggcctgagtttaaagcatgtttttgtggagaggattttcgaagaactttttttcagtactctatcctgcagcacccctgagagagctatatagacctgcaacccgctctgcagaggagttgtcacctggtgcacccactgaggagctgggttccattcagcccctctctcctcttgctgtgcaggctctctatgcctctccacctgagttgtatgctataactcttgctttagatttagactaaggattttttgtttattgcacagcttgtctccaactcatggactcaagcgatgttcccaactcagcctcccaagcagctaggattacaggcttgagccaccacgcctggctagactaatgattttcagacagaatgttgcaaacccttagtagttcatgcttattttaatagattacaaacaggattttaaaaacagacaagaataatataacagaaaaataaaatgtttggctgcctcacagacagggttgttttgtgaaattcagttttagatataaacgtgtgggtgcatgttcatgcatgtgtgtgtgtgtgtgtgtgtgtgtgtgtgtatttgaaggtatgtgcactgggtaaagacatataaagttagaaaaacactgctgtagatcagcagggaccagaatatatcctcaggacaaactctagctcttcgtgttttctcatttctgactacattgtgtcattgaagaaatctttactactttatggttataaagtaaatctcctatactctctttttaaactttattgctttgctttttgccttaaatttataatccacttggagttgatttttacgtatatggtgaattcagtacagttgttcccccttatccactcccgtgttcttttgacacaaacctattagtgtttgatagctaacttgctttctggcacacaaaaatcccagattcatgtaaagtttttatcccaaacctgtaatcgtttatttcgccaagggtccctggttcttttcttaaggcaaatgatacataccacaatttgtgtcccagaggtgttcgcttttatgtcataggcattacttttaagttttgagtgggcagagctgggaaatgcatttactttttcaaaaggagagacaagaaaagagattgtactaatgtttccaattcaaatgtaagtctataggagttttacttaacttcttcatacttatgttagaaatcttggtttctgatgacagtaaccactatttgcttcattatactatatatgcacacacgtaactgttttaaaacaatactaatattaataataaaaagtacactactgagtaacaatagttcttttagttcagtgcatctatctcactgagggtgtatagttaaagtgttgtggttggggtcacttgaaataaatcttcctggaaagtttttgccaccaacttctaaaccattgggattagtcacatcagtccttactgatggactttcaaggttgtcttttgctgtcataaatagtgctgtgatacataaccctgcacatatgtcacttcatatatttgcagtgtgttttatggatagattcctagaaatgggattcctagggaaaagataaaacatttttcttgattttgtgaaattcccctctgttggcatgggggcatttcatacccccacattatatgactgggagtgccagtgccagtttttccacagctttaatgtatatttttaagcttttgggacttgccaatctgataggtgagaaacggtatcccagtgtagttttaatttgcatttttcttattatggtaatattgaactcagcctcataaggtgtctactgttaaagtgaggacattgatggggaaggaaaggggtcctgtgtgggaagccctagaagacacacttttcagcaatgctttgaggaataggtttgtgaggggactcctgcatccttaaagagctccctgaccgctcttctctgcaggccggaccttacagtgggaaccatagttactcaactggaaagcttaaatgcagtgggaataaacggattacaggatgtcaggggccaagttgtggaactcaactgcagaaaacaaggtgggcatagttactgtaacgaatagcagagacaaagcaacagtgagaatagtctgactcatgtagactcatggcattgggtaattagtcatgcgttcctagaagtaaagtagataggaagcccactacattcttccttcatatatataaacaaaaaacttccaggttaaatgaatggaagtctaactcaaatcctaaaaacagagattcacagcccctcaataaattcccagacttgagcagttttcagactcagaatcccttgaatgaaggagaagctagatcctcttgaggaagaagcctggcacattactgacaacttatacttttaatctttctgttatccttcccaaagggtcctgggaccttctggcagggtaactgtgcatttccaataaagaaataatcagaactttcagggactgctgcatactgtcctttaactgacatttattccaggagacctgaaatatcactggccctccaggtagagttgaggcttatggaggtcaggtaatcagtagatttttagctcatgtccaactcacagtgggtccaatgagttgttgaacccatcttgcggttatttcccaattggaatagacatacttagcagctggcaaaatctccacattgtttccctgacccgtggagtaaggaccattatagtgggaaaggccaagtggaatccattagaggaaagtagtagatttaaagcaatcctgctaccctggaaggattacagagattagtgctgccatcaaggacttgaaaggtgcagggctggtgattcccaccacatttccattcaactgtcctatttgccctgtgcagaagacaggtggagtccagagaatgactgtggattatcataagcttaaccaagtggtactctagttgcagctactgtgcaagatgtggtttcattgtttgagcaaattaacacatatcttggtacctagttatgcagctgatcatctggcaggtgccttttctccatacctgtccacaaggactatcagaagcagtttgctttccagcaatacaccttcattgtcctacctcaggagtgtatcaatatgccatccctatgttataatttagtttgcaaggaacttggctatgttacttttccagaagacatcacaccggtccattatatcgatgataaactgactgcataaaaacactcagcaagaagtgcaactagtgaataagaagtacaagtaccctagatttattaagacatttgcatatcagagggtaataaataaatctgactacaattcaggggcattctactaaacttctagggatccagtggtgtgggacgtgtttagatgtcccttctagaataaagcataaattgttgcatctggcccttctaaaaccgagaaaaaggcatagtgcccttttcttatagtgggtctatttaaatagtgggtctatttagatttggaggcaaaataatggatctgtttagatttaggtgcagtcagtttattccagattatgcatctggaacagggaaatatccacaagatggattcaaggacccactggaccaactgcccatctacctagtgactaaaaacgctgctagttttgagtggggcccagagcaggagaaggctatgcaacaggcgcaggctgctgcgcaagctgctctgccacttggaccacatggtctagtgaatccgatggtacttgaggtgtcagtggcagatgttgaggctgtctggagcctttggaaggccagtgtaggtaagttgcagtataggccgttaggattttggacaaagactctgccatcattttcatataatgattctccttttgagagacagctctcgacctgctattgggccttggtagaaactgaatgcttgaccatgggccataaagttactctgccacctgagcttatcatgaactgggtgtttttggacacaaaaagccatatagctgggtatgcacagcagcactccatcatcaaatggaagtaaaatatacatgactgggcccgagcatgtcctgaaggtacaagcaagttacatgctgaagtggccaaatgcccatggtctccactcctgctacactgctttctctctccctgtatctatgacctcgtgggaagttctctatgatcagtagagatcacactagaaaagactagaaccttgtttacagatgtttctgcaggatatgtaggcatcaccagaaagcgagcagctgtggcaccatgcccctttctgggacagccattaaggacagtagtgaagggaaatcttctcaatgggaagaaatggccagatgtgcaattgtataccagatcctgggctgtagcctgtgggttggctggatggtcagggacttagaataagattgaactattggtgacgaaggtatctgggaaaggagtatgagcatagacctctctgcatggggaaagaatatgaatatatttatgtcccatatgaatgctcagcaaaggcttaagtgagcagaggaggactttaataatcaagaaaataggatgacccattttgtggataccactcagcttctttccccagccacccctgtcatccttcagtaggctcatgaataatttggctatggtgtcagtgatgaaggttttccaagggctcagccacatgaactactctcaccaaggctgacttggttacagcaccataataaagggatagcattttgtcctcaccgaaatgcatattttctctggatataaatttgccttccctgtatgcaatgcttctgccaacactaccactcatggacttacggaatgtcttatccaccatcatggtaacactctgggtgaaaccattcagatccgcactgttttcactggaaggttaataaatctgcatgtaagtttttgttgtgtttcacatgtttatcttgtttcaagtatggtaggttgtatttttctagaaagttgtccattttatttaatttgcctttttagggtacagcaaattcttactttcttttttttagttctgttttttttcctactatttctttttttgcaatcagttttatcaaggacttattaattttattcattttctcaaagtacaagccaattgtgtttacatgtttagtttctatttggttaatttgttcttttacttacaatttcccttttttccatcgtatgtgaaaaaaatggaaagatataccatgctcatagattggagacaatattgcaataccatcccaatcaaaactccagcagacttctttattttgtgaaagttgatgacctgattatatactttatgtgttgtgtatgaacaaagcaagagaaatgacacactggggaaaagtatttgcctttatatagcagacaagtaatttgttttcttaatcatttcaaatcaataagaaaaagaccaacaaaccaatattaaaacatgcaaaggacttgaatagtcagatcacagatgagaagagttaaatgagtcttaaacataggaatgatgttcaaaatcatttaaaatatttaaactgaaacttaatgaagtaaacatgtacaaaattacaataaaaatggacatacccataaccatgaagaaaattttagtattaaagaagccaatcagaccaaaagttagtaaagataaagaacatttgaatagcataattaacaagcttgaattaatgaatatatgttgtaggagtttgtacccaattagggattatataaactttttactgacattggaaagtactaggccacaaagccaaccccaatgaataccaaataatcaatttcgtacacataagatgatagtctctaataactattcaaagatgaaaatcaatgccaaaatatagccaaaaagccttattcctttggaaattaaacatactctgctaaataattcaaggggtatataaatcaattgaaatcatgaaatatttataagtgaatgataaagagtgactgtgtatcaatacctgagtgatgctgctaaaatggtaattagaggaaaattttgaacttcaggggcatccattagaaaagaaaaaagactggccattattgaactaagtttgcaaatcaaaatgctgtaaaaagaagtaatcccaatgaaagcagagcaaagtaaataaagcagaaacaaacatgtatcaatgaaagatgaagcaaagaaaccatgatgatagtcaatccatgagctatttcctcaaaaagggccagatgtaactatacgtctggcaagaccaaacaagtgaaagaaagaaagtaccagtaaataatattagaaggactatatcatcagatacagtcataattttaaaattataaaagaaaaccttgacaaaacagtttgtcattacattagaaaaattaaatgaaatatataattttctagagtatatgtaaagtaccaaacttgccactgaaatgaaaaaaagaaggcatatgagtaatcccattagcattacagaaattacaattgaaaacctctcatgttctccttcaaattgtactaggcttatggtgtttcaagtgggctttagaaaactttcaaataacaaatactaatggcttcaatttcattgctacatagaatacatagagaaggaaaagtaatcagcttaaatcatgaggctaacataagcttcatgcccaaacctgagacagacagaatactaattttaattacagtaatgtgggggaaaaaatcacaaatatgttaatacaggatacacttcagaaatggttgaattgagaaaattttccagtggaacttacagcactaaaatatgacaagtaaatatgtgattatttcaagttcttgaaaatgtgcaataaaaagccatttatgatcaaatatttatcataatagtagattttcatcatgattatattatgtattgagattaatattatataataaaaattaaaacaaatattatacttaatggttaaatttcagaagcgttttctttatattcaggacaaaacaagaatatctgctatgttgattttccttcaacaatatcctagagatcttaccaaatgcaataagaaaagaaaaaggtagattaaaaaataaagtgtctgttcatatccttggcccactttttgatggggttgtttttttcttgtaaatttgtttgagttcattgtagattctggatattaaccctttgtcagatgagtagattgcaaaaattttctcccattctgtaggttgcctgttcactctgatggtagtttcttctgctgtgcagaagctctttaatttaattagatcccatttgtcaattttggcttttgttgccattgcttttggtgttttagacatgaagtccttgcccatgcctatgtcctgaatggtattgcctaggtttccttctagggtttttatggttttaggtctaacatttaagtctttagtccatcttgaactaatttttgtataaggtgtaaggaagggatccactttcagctttctacatatggctagccagttttcccagcaccatttattaaatagggaatcctttccccatttcttgtttttctcaggtttgtcaaagatcagataattgtagatatgcggcattatttctgagggctctgttctgttccattggtctgtatctctgttttggtaccagtaccatgctgttttggttactgtagccttgtagtatagtttgaagtcaggtaacgtgatggctccagctttgttcttttggcttaggattgacttggcgatgcaggctcttttttggttccatatgaactttaaagtagttttttccaattctgtgaagaaagtcattggtagcttgatggggatggcattgaatctataaattaccttcagcagtatggccatttggatgatgttgattcttcctacccatgagcatggaatgttcttccatttgtttgtatcctcttttatttcattgagcagtggtttgtagttctccttgaagaggtccttcacatcccttgtaagttggattcctaggtattttattttctttgaagcaattgtgaatgggagttcactcatgatttggctctctgtttgtctgttattggtgtataagaatgcttgtgacttttgcacatcgattttgtatcctgagactttgctgaatactggggcttgttgtggggtggggggaggggagagggatagcattaggagatatacctaatgttaaatgacgagttaatgggtgcagcacaccaacatggcacatgtatacatatgtaacaaacctgcacgttgtgcacatgtaccctaaaacttaaagtataataaaaaataaaaaaataaaacatttgctatttatagacaagtttattattattattattttacataaaaacccaaaataatctgaagacaacacatttagaactattaactgagtttgggttatcagtttctggattcaagctcaacatataaaaatcaatggtgtttcaacacatcaccagcaattagtaatttaatctttatccattttctaatgaccttgcattctttatgtgatcagagttctgatctatgttatttttcttcttgctgaaaaatatattttaacatttcttgcaaggcaggtctactggtgacaaattccctcaatttttgtttgtctgagaaagtctttatttcgccttcatttataaataataagtaaactaggtacagaattctatgttggtggggtttttttcctttaaacattttaagtattttacttcagactcttctcacttgcatgttttctgaggagacgtctgatgtaattcttatccttgttgatccataggtgcttgttgctgtgttttgtcctttgacttcttttcaagatttcctctttgtctttagttttctgccatttgaaaatgatacgcctacatatcagttttttggtatttctcctgcttggtgttctctgaactttttggatctatggtttagtgtccatttttagttttggaaaattctcagtcattactacttcaaatattctctttcttctctctctggtgatgtttctccttttgtaatcgtttaatggtttttggatattttgttctatctttttcagtggttctctttgcattttagttctggaagcttcttttggaatttcctccaattcactggttctgttcttggccatttccactctgttgataagcctgtcaaagacatacttcatctctgttgtagagtttctaactcctagatttatttttgattcatggagtttccatatttctgattacatcagttatctgttcttgcatggtggctgctttttccattagagccatcacattttaatcatagttgtttaaatttctagtctgataattccaaattccctgccatatctgagtctggttctgatactttcctctgtcttttcaaactatattttctttctcttttcatgtgccacataatttttttcgttgaaagccagacatcatgtggtaggtaaaaagaactgaagtaaataggcctttgtgtgaggctttatgtttatctggttaggggttaggctatgtttatagtatgctatagccgcagaacctagcagaacccctggaggtaaaactcatgaaaatatgagttctcttcccccaagaatgggcatcccttgagtttttatctctcaagtttgtccatagcaactttaactctgagattgtcgtctagcaactcatcaatgacagtttagttttcctaccctggtactcactgtagtgttggtttctgctccagggtttttgcttttaggatatacgtgggctgaaagtgaagggttggaaaagtatattatatgcaaggagtaatcaaaagagagcaggagtggctatatttatagcagaaaaagtaagctaagttaaaaacttttatataaggccaaaaaggtcattacataatgataaggtggtcaattcctaaagaggatatagtaattgtaaacgtctctacacctaacattggagcacctaaatatgtaaaacaaatattaacagaattaaagggaaatatagatagcaacacagcaatagggagaacaatacccctgcttacaacaatgatcatcaagacaggaaacagtagacttaaaacaacattatggacgacatttacctgacagacatatacagaatattttgtatatttaaaagcagcagaatacacattgttttcaaacacacttagaaaattttccaggatagttgacatgttatgccacaaaacaagtcttaacaaatataagaaggctgtaattatagcaagtatcttttctgaccacaatggcataaaactagaaatcaaaaacaggaggaaaattggaaaattaacatttgtatcaaagtgaaataacatttctgaacaaaattaaacaaaacttctggtaaaaatctaaaaagaaataaaaaaagatcttgagacaaactaaaatggaaacacaacaaatcaaaacgtgtaagatgtgccaaaggcagtctgaaagggaagtatgtaatgataaacaactacattatgaaaaagaaagatatgtaacaaacaatctacacttcaaggaaatagaaaaaggagaacaaactaaacccaaaaagttagcagaaggaagacaataataaaattcagagcagaaataaatgaaattgagtaaaatctaatggaaaggattaatgaaactaagacttgtttttaaaaaacaaacagaaccaacaaacctttagttatattaactaagaacaaaatgaggaaggaacaaataaataaaattataaaataaagaggaatcattagaactgataccacagaaatataaaggatcataagagactgctatgaacaattatatgccaacaaattaaataggctggaagaaatggataatttctagaaacaaacaaccttaccaagactgaattatgaggaaatataaaatctgagcagacaaataatgagtaaggagattcaatttgcaatgaaaatcctccccagaaagaataggactggatggctccactggtgaattctccaaacatttaaaaaattaatgccaatcctcaaactcttccaaaagctgaagaggagagaatactgtcaaacttattttaagtccagcatttccccaatactaaagccagacaagtccaccaacaaaaaaaaaaaaaaaagaagaaaaaagaaaattagaccaatatccccgatggacatagttgcagatattttcaacaaaacaatagcaaaccaaattccaaaaagtccaatgccacggccaagtgggatttatcccaggaaagcaaggatgtttcaacatatgaaaatcaataaaggtaatacattacgttaacagaataaagaacaaaatgcatatgatcatctcaatagatacagaaaaaagcatttgacaaaacttaacatcccttcatgtatacctcaacataatgaagtccttatatgacgggcccacagctagtatcatactcagtggtgatcaggaacaagacaatgatgttttttgctacttctattcaatatagtattggaagtcttacctagagcaattgggtaagacaaagaaaaaaatgcatccaaattaggaaggaagaagttaaattgtctgtgtttgaagatgacatagtcttgcttatagaaaaccttaaaggctccactagaaaaactcttaaaactaataaaaatttagtaaatttgcaagatacaaaatcaccatacaaaaagcagtagtattactcaaacaacagacaatacgaaaaagaaaataaagaaaataatcccatttacaatagcatcaaaaaatacttcgtgatgaatttattcaaggaggtgagagatctctatatggaaaactataaaacattgatgagacaaattgaagaggacacaaataaatgaaaataaatcctatgttcatggattagaaagcttaatattgttaaaatatccataacacccaaaactatgtacatattcagtgcaatccgtatcgaaatttcaatgacatttttcacagaaaaagacaattctaaaattcatatggaatcacaaaagacctgatatagccaagatgagaaaaataagctggaggcatcacactactcaatttcaaaatactttcaaaactatagtaattaaagcagtatggtactggcataaaaacagacatatagaacaatgaagcacaacagatatcccagaaattaattcatacatttatgatcaattgatcttcaacaaaagtgccaaggatgtacaattggaaagaatggcgttttcaatgaaagatgttgagaaaactgaataatcacatacagaagaatatcattggattcttatctcataccatatacacaaatcaactaaaaattgattaaagacttaaaggcaagacctgaaactgtaaaactactagaagaaaacctaggggaaaacttcttgagattgatctgggtaacgattttttggatatgacctcaaaactacaggcaacccaagcaaaaacgaacaagtaagattccatcaaacaagttctttgcttgctctagaagtattcacattttctacttctttttgagttagttttggtaatttgtgtctttctagaaatttgatcagaggatgttttgtcagaagtcagcctattctcaggagggggttgtatatggttcaggctgagagtgggccagagctcattcaggggcctggaggaagaagagatgcttaacagaagtttgattagaagcatttcgttctgactgatctttgtggacaagcagtacagtgaatcatttatgaagcaaagagtaggaatttcaaaggcctatttctgaccctttcatagataaacaaggggacatctatgagtcttatcaaaatcatttgggaaagggtcgttctttgcagtaagcccttttacagaacactaaggttggagggattctttttttaaaaaattaaattttattttagattcgggggtaaatgtgattattttctgtatgggaatactgcataccggtagggattaggcttctagtgtacccattacccaaatagtgaacattatgcccaataggtaatttttcaacacttgtttccccaccctccccctttttggagtccccagtgtctattatttccatctttaagtccatgtgtacccattttttagcttctacttacgagtgagaatatgtagtatttggttttctgtttctgagttagttcacttaggataatgacttccagctgcatccatgttgttgcaaaggacacagctgtattcttttttatggttgcatagtattccttggtgtgtatatgccacattttctttttcaggcaaccactgatagacatttaggttggttccatgacttgctattgtgaatagtgcttctatgaacatagaaatcctgaacagattaataacaagtagtgaaattgaatcagtaatttaaaaacttccaaaaaacaaaagctcagtaccagataaattaacagccaaactttaccagatgcacaaagcagagctagtaccaaccttactgaaactattccaaaaaatagaggaggaggaatccttcctaactctttctactaaacttgtatcaccctgataccaaaatctggcaaggacaaaactaaaaaagaaaactacaggccaatatccctgatgaacagagatgcaaaaattctcagcaaaatactagcaaaccaaatgcaatagcacatgaaaaagataattcattataatcgattgggttttattccagggatacaaggatggatcaacatttgcaaatcgaaaaatgtgattcttcgcataaacagaactaaaaacaaaaatcatatgatcatctcaatagatgcagaaaaggcattcaataaaatccaacaccctaataccagcctgagcaacatagaaagatccctgttctacctaaaataaaaataaccaggcatggtggcacacattagtggtcccaactactgaggaggctgaggcaggaggattgcctgaatccaggagtttgaggctgcagtgagctatgattgtgccactgcactacagcctggattccaaagcaagaccttatctcaaaaaaaaaaaaaaatccaacatctcttcatgattaaaatcctcagcaaactaggcatcaaaggaacatgcttcaaaataataagagtcatctatgacaaacctacagctaacatcatactaaatggggaaaagttggaagcattcaccctaagaactggaacaagacaaggatgtccaccctcatcactcctgtttaacatagcattggaagtcataccagaacgacgaggcaagataaataaaaggcatccaaattggaaaagagaaagtcatgttgatgacatgatcttatatctagaaaaccctacagacttctccaaaagactcctagacttgacaaatgatttcagtaaagtttcaggatagacaagcaaggtaaaaataattaggaaggatttcttaaacgtcattgtttttcaggatcatgggactcaggaaaattcaacattgttgcattgtacaaaaaaaagcagaaaggcagatccttgggaaaacatagactattcccaaaatggttccaggacaattggttttaggtataaaataataataataaccatgccacaccataaataaaaaccaattccagaaggattacaaatttaaatgaaagttatattttcagcaatagggcaaactagattgtctggaaaatctctcattgtaaatctcctaaaaatgatggataaattttttttaaagggaagataaaacttcagaataaataagagactgcaccaatttatagttgacccttgaacgacatgggtttgaactggcacaggtccacttacacgtggatgtttttcaaccaaacagaaatacagcatttgtggaacgtgaaacccttgtatagggagagcagacttttcttatacgtgagttccgtggcaggggtgactgcaggagttgagtatgtgcagatttgggcatgtgcttgggccctggaaccaatcccctgcatatactgagagatgactatatatattaaatattaatacaagtaccttaaatatgtaattataattcttatgcaacatatatttataatattggtatatgcatgtatttaagatatttacatgcaatttcataactatatattaaataagaatgcatatctatgtctatatatctattagaactaactgaaagaagagacagattacctacaaaggaataaagtatagaagcagtatgaaaccagtagaagttagagtaagttctgggagaagataactggcaacttagacttgtatactccctgaaactttctttcaagccatgtgggcatgacctttatcctttggaaagatttttaaataccaggttaatttctttactattttattacttttttttttttttttttgagacggagtctcgctccgtcgcccaggcctggagtgcagtggcgcgatcttggctcactgcaagctccgcctcctgggttcacgccattctcctgcctcagcctccagagtagctgagactacaggcgcccgccaccacacccaggtaatttttgtgtgtgtgtgtatttttagtagagacggggtttcaccgtgttagccaggatggtcttgatctcctgacctcatgatctgcccaccttggcctcccaaagtgctgggattacaggcatgagccaccgcgcccggcctactattttatttctaaaataatttcaacttttattttaggttcaggggggtacatgtgcaggttttgttacatgggtatattgtgttgatgctgaggtttgacgtatgaatagtcccatcatccaagtagtgagcatagtgcccaataggtagtttttcagctcttggtccccttcttctcacccccttctagtatccctagtgtcttttgttctcaacttcatgttcatgtgtaccccatgtttagcttctatgtataagtgagaacatgtggtatttggttttccattcttgcacaaatttgcttaggataatagcctccagctgcatctgtgttgctgcaaaggacctgacttcattctttttatagctctgtagtattccattttatatatatatatatatacacacacacaacattttctttatccagtctaccattgatgggcatctaggttgattccatgtctttgctattgtgaatagtgctgtaatgaacatactggcgcatgtgtctttttggtagaatgatttattttttctttggttatatacccagtagtgggattgctgagtggaatagtagttctaaattctttgagaaatctccaaactgctttccgtagttgctgaactaatttacattcccaccaacagtgtatgagtgtttccttttctctgcagccttgctgacatttctctgatgattggtgatgttgagcattttttcatgtttgttggctgcctgtatgtcttcttttgagaaatgtctgttcatatcctttgcccctcttttaatgaggttatttgttttttccttgttggtttgtttaagttccttatagattctaggtattagacctttgtctgatgtatagtttgtgaatattttctcccattctgtaggttgtctgctcacttgttgatagtttcttttgctgtgcagaagctctttagtttaatttagtctcacttgtcaatgtttttgttgcaattgcttttgaagacttagccaaaatttatttgccaaggccattgccaaaatggcatttcctaggtttccttctaggatttttataatttgaggtcttacatttaaatctttaatccatcttgagttaatttttgtagttggtgaaaggtaggggtccaatttcattcttctgcatatggctagccagttatcctagcaccatttattgaatagagagtcctttccccattgcttatttttattgactttgttgaagatcagatggatacaggtcttattttagaactattcacattttccgcttacttttgagtcagttttagtaatttgtgtttcgctagcaattgttcatctagttgtgtaatctattggcataaaggtgatgatagtattctttgataattattttcatttctgcaagatctgaaagagaagagatgtcttctctttcactcgtaattttgctaacttgtgtcttctctgcttcattaccagtctgtgcaaaggtttagcaatttttaaaaaatttcattttattcacattcactatttttgttttgtctgtttaatggatttcctctctaatctttattatttcttttctcctgcttgtttaagatttagtttactcttccttttctagtaaattaagatgaaaccttacttttttcttttctaaaaaagtcatttaaaaaccacgaaaatttccctaagcactgctgtatcccataaatattgatatactgtaatttcattttatttgatactaatatagacactccagttttcttagggttactatttgtattgtttatctatttccattctattactttaaacctatttgtgttcttagatgttcttagaaaaggtgtctcttaagtcttattatttttacccaatttgacattctctaaaactattattgaaatgttcaatctatttacatttggtgtaattatttatgtgatttaatgtatatcttgttttgctatttaattttatatgttccatatctttttaattcatacattgcttttaactgtctttcgtgttagatacttctattgtactgtttaattcttttcttttttttttttactacattttaagggattttttatggtttatttgtggattacaatacgtatcttatcacaatttgtgaattacaatatgtatcttaatttatcacaatctgcttcagattaatactaacatttttccagtaaaatatagatatccaatagaactctatttctccccttctttgttctattttactgtttatatgaaatttacctattattataatctataagtataggttaaaatccaacaattctaatttttctctgcaaagtgtttaaaataagagaagaatataagaaataatatacttaagcagattttatatttacctgtgtaattatttttaccagttttttttatatatacagattcaagtaactggtgtcatttctcttccgtctttgtttatctggtaatgtctttattttacttttttttttgaaggatagttttgttgaatacttaatacttggttgacttttctttttcttttagcactttgctttctagcttctgattgtttctgatggaaaatctcatcacaataaaatgttaattttattgtggttccttgtacttcatgagtcatttttcttttgctgctttcaaaattttctctttcaacaatttgattataatttgttaaggtgtgaatctctttgaatttattttagttggagtttgttgaacttcttggaagtgtaaattagtttaaaaaatcatgtgtgggatattttcagccactgtttcttcaaatattttttctgcctttttctctctccttctctgggagctgtgttcaattttttaaaaaaattctctctgttcttcagattggatggtctatattgatctgtccacaagtttgcttatctcttctgccagctaaagtctgctactgaaactcttcagtgaaattttcacttcaatgacagcacttttcaacacaataatttttattttgttacgttttataatttatatatagttattgatagttttaatttgataagccatggtcatcatacttttgttttattcttaaacaccgtttcttccgttctttgaacatatttataatagttggtttattatcggtgtagggtacctcagaaacaatttctattgactgctttttctcctgtatatgggtagcactttcctgggttttttgcttgtctcctaattttttcttgaaaaccagtttagatcatatattacaacaactctagattccgattccactctccccttcccctagggttgttgtttctttttgtaaattttttgttaatttacttactgacccttccgtaccaattctttagaatggtttcttccaaagtatgcatccaaagttgtttttcctcattaaaaaaaaatcttgttttcaatttttaaggctggattcctagggttgccacttggtcagcatcatgtagtgatcagccaattactggtcagcgtctatgcttaaacgtcttgatccacaaggctaatggttccatgtccgaggtgggaaattcactgaatgttcaggcagtttgtaggttttctctggtctctgctttctgccagctattcctgtttctcctttgagcattacattctgttagagaggagaggcatcttattccatgtagcgctgctatagtagaatgcctgagactgaacaatttgtaaggaacagaaatttatttcttacagttctgttgactgggaagtctaagatcaaagtgctggcacctggtggaagtctagtctctgcttcaaagatagtgccttgaatgctgcatcctcctgaggggtggaaccctgtgttatcacatgacggaggagcagaagagaccacatccacacctgcaagcccttcatacagcagctctaaccttgacctaaacacctcccgttaggccccacctcccaacctcactgctttggagattaagtttctaacacatgcattttgggggatacatttagaccatagccagggtcctctccagtctggtctggtacatttctggatgtcaataaatatactttgaaaacataatatgtaatatttcataatatattattttaaaaatatctcatttgtaccaatatttaatcttttaaatcatgttcaagtggactttctttttcttaaaagtttattcatatttgcattttttaaaaggctgggttcttataaatagactgataatacaaaaataccaatatattgtggtcaatcttagaaacccacaactccaataaaagtcttttagacttatcttcctctcccctgtgtccacaaagtagagaatgcaatccttcaattttcaggagctcatagcttatatctgtttttggcaccccttccccaattcttcccagtattatatttccctgtgtcttaatcacctacttgcactataaacctcttagagcagaggactgccgctttcttccatctctaagcttgccctgtcccctgcaccaagtctcacacatagtaggtactcagaaggtgttaagtgggattttagctggctgaaaaaggagcactcgctcttggcttcccattccttatatgggccacgaagcccctgtctccaaggccctttgtgtctgtgacattctcgggcttatgcttcttgtgaacatttgtgggatattagtcatcttatgtagaacaggatatatctgtcacttctcctctgtgaatccctcctttcaacaagatttattttaagaactgtgtgaaaagagaaattttcataggcaaccctgtgaaaacgcagtcatttgtcaacatgtggaattaagtgccctgagttcccatccaactgtcctggccctgcccaccagggggcccctctaaggaggcagcatccaggcaagggtctgagttagccacaaaggtgcatcttagggcccctcctgtttccttgctctccagtgctcctggcatggtgagttctccgttctcttgaacagtgcagctgaggagtacacgtgagacctcattgaatcctcaaggctgccttaggagatcaaaatgaccctgctacagaaagggaaactgagagcacacagctagaatgtagtggagctggactttgagctgaggccctttgcctccacatccaaggctgtgtccgttagcctgagctgctgtgagcagcaggggccactggctttctctcaaaacaacaagttggtgatctgcaagatttcattgagtttggagctgacggagccagatagcttttgggcaagaaccagaggtctttgaggagatgcaggagggaagaggttatcacccaaaccccagctgggggcaaggctccctgacccctgtcctgccaagggagggagtgtggcatgtggccactccatggggcagtggtgccccattgtctttggctattggcaatccctgcataatggatggcaaccctgggcctcagtttcactgtctctgaactgaggtgggtgagttcaataagccctgcactttccctgagatcagaagagggaaggctctcttttcaaggctggagttagcagcaaaagagtagagcggcttcctcctccgcgctctgggatggcacatgttgggtgagaaatgttgggggcttgattgggagctgccatgctcattgcacacggctgcatgcatcagctgcgaggattcacaccacatcctccagacacccccactgggagtttctatagcaactttctgagaggaatttccagggcttgcagattctgtcatagtaacccagtgagggaagaaagctcagggtgtgtgagtagggggcaaaggatccgtgtgtgctgaggtccctgtgaggccaggagggcagagtgggtgggctctcggaacagccacagagctgagcagtcaggggctatggtccagtcttcttccagctccttaacaacaggcaggtcacaagtcatccctgaaggtctcactttagatcataaaatgtacctcaaagatggtcatgaagattaaatgaaagagacctgcagacttctcatttatctttcctgaggattagggcaggacaagctgggagtgtgattccagtggcgggctgcctgtgggtgtctgtagaatagaaatgaaattatgcaagcagatggcttgatgaagagacaaaaatatgaatataaaacactatagccatggagatgctaatttatttttacttttaataatgacacaacttgggatatcaaaggtgtcttcttgcttttagatatattcagccctcaaaataaaatctttcaacagaacacagctccaaatcacacaaaaacattctgaattggaggatcagcatgcctgcctgttaatatgcaagcactgagcatgagcagtttatcccaacagtgaatccacactgcagatatactacacacacagcattctagggaatggagaaatgaaatgcacaaagagctctgcccttgaattggtagtgactagtgaaacagtccttacaaatgttatacaattaatcaagaaaaaaggggggagaaacagctcagcattaatcactaggtcagcttgttctctgacctgcttcctcatagctgttttccgtctgttgccctagaatcatgtagattctagattataggtccctgtaactgctctgtagataacagcctgggcattgtgaaacattaagttttccatctgagatattctttcaggtcttgcaaaccaatgaaactactgactcagcttgtccgaagggccccatgagaagatgactcaccaaagaatgcagtttcccacatcttaatgatttcatcccctttacctggccaatcagtgacccaattttccagccccttgccctccacaatgattcttttaaaaatccctgtctagacctccttggggagatggatttgagggtccctcccatcttctcactcagctatcctatcaatcatcattaagctctttctctgctgcaaaccctgctgtctcagtgtattggtctgcacatgcacaatggactaagaaacctgttggtcctgtaacagtaacaggggagatgagacagattaaccattgcagggatagctagatatatttaaaggaatatagaaatgcctctggtggcaacatccagctgggtctccagtgtagcagagctaaggctaaagccaggctctgggggagggtgaatcacagcagaaacgtgaaagtgcaggagggtgcagatgggggtgaagctgcaggctcatcccattctgcttatgcccctcaaagcaatcacgagtaagcccctaacctgcaggcctcgggtgttttctctagcagacagtagaaatacctcctctttaagcccatatggggataatttacttcaagaagtcatctctgttcctggcatacaaaaaagcacttaacagattataagacaaacaataaaaaagtaaaagccatgcaagttgaaaatgaatttagaatcctgccttacactgtgtagggacaacagtatctgtgagtgtgggggatgattggatgactagaccactttgggacatttttctaaaaattctctggtgaaacttaatttgtccactcactctcagccacaccatgcactgctctgccctaggacagccagtggaatgcacttggagcccttcctcaggaccaatgttgaggcaagccttcttgctcacagtcaggggtgctaagtaagtgatccaagctttgcagagagatgtctttagtgttttcagcacagtgtggatcattcatactgctaggcattagggaggatacaagaagatgtgttctgccttcagggagttgggataggatcagaaaaggagtgtgttgaacagaggagctgcagagctcacatgatcctgtgggtgggacagacaccgtggaggaggccagccctgttgctgtcccacccagactccttggaatcccattggtcagcactgggcctctccaaagcttacttttgtccctgatagcaggaacctgtgatgcttcttcacatgactttccccaggctactctgctcctatattcagaggacatcccccatgacaaccctcagcttaggaagcttgaaagggagtctacatgggatgtttctgagatataatttatacccagactttatccacggggtgcatatcatggcaggcataaggatgactgcaattggggtttgcagtaggggagagagatggggcttatctctgaatgcaaaaggaaacgggggaatttatggccagggagcatggtagggatcagagggtagaaaattactaagaggtaatcagggctaaggaggttttttgttgttgttgttgtcattgctgtttttgttttgttttgtttttttgctaaagtgacctcacaggattcttgctgaagccaggccaaggtgatcagacatcacctgagggatggtggaagaggaagaacctgatcagatatcaaggatgatcagatatcgacggtggcatgttctggctaaaccaattaagaaggattcttgctaacactggacaatgcaaagatggactcagacatacacacgtcagagcctagttgagaagagaatttaagaagcctggctagagttaggtcacactctgagatcaatctgaggctacttattctgggactttgcttgaaattttaccctgttcagccccttctcattccttgccctgcttcctcatcttggtttcttctggtggcatttccaccacaaataactcatagaaatcttcacctcagagtctgctcctgaggaatgcaacttgagacagttggtatggaagtagtcctgggagctcatcaccaatgacaggagcatgtgaatagttgtggtttatctggggtaaatagggacaaggtacaattagaaaaagatgcagtggcttgtgcaataactctggtgtgtaggacatgtggtgaaatagtcactagaaggatgtaaaattggttgatgctatggatgtgttgaggaaataacaaacttaagtgagccaattactgatttaaggcacagtggtaggtccagttgcagctggctggatatgctgtctttacaagggtattcaatgtagtttctagtatgtggcatgcagcttttgatctggtagatgcattttttattagactttagagcaattttagtttcaaagcaaaattgaagggaaaacacagaggtttcccacatactccctgcccatctatatataaccttctccactattaacataacccaccagagtgccaattggagtgaaatatagaagcctcacattccttttagtccctttatcttctactgtgtataacatagttgtcttaaatattttctataatagatttaaaaccacataagatagtgttatagagggtgttataatttttgctttggctgtcaaacataatttagaaaactcaataggagaaagaaaatgtattatatttatctatttttaaaattctttccactgttctttctccctttctcatgttcccagtttcctccttttatcatttctttctgtttagagaacttggtttagccatctaatatacttcggatatttgtccccacccaagtcccatgtttaaatgtaatccccaatgttaaaagtggggcctggtgggaagtgtttgtatcatgaggacagatccctcatgaatgacttgggccatccccttgatgatagatgagctcttgctctgagttcacatgagatctggttgtttaaaagtttgtggcactcccctcaaatctctctccctcctgcttttgccatgtgaagtgcctgctcccattttgccttctgccatgagtaaaagcttccctcctcagaagaatgttctagtattttgtttcctatatagcctgcatgtgatccaactaaatctttttgtcttataaattactgtattagcctgttttcacactgctgtaaataatgacctgagactggataatttataaaggaaagaggtttaattaactcatagttctgtatgtctgggaggcctcaggaaacttacaatcatggtggaaggggaaggggaagcaaagcatgtcttacatggcagcagaagaggtggggtactgccaaacacttttaaaccatcagatctcatgagaacacactcagtatcacaagaacagcatgggggaaaccacccccatgatacaatcacctctcaccaggtccctccctcaacacatggggattacgattcgagataagatttgagtggggacacagagccaaactatatcaattacccagtctcaggtattcctctgtagtgatgcaagaacagcttaacagaaaactggtactgaggggtggggcattgctataaagatatctgaaaatgtgaaagcaactttgaaactgggtaataggtagaggacggaagagtttggagggctcagaagaagacaggaagatgagagagaatttagaacttcttagagactggctaaatggttgcaaccaagatgctaatagaattatgaacagtgaagtccaggctgcaaaggtctcagatgggaataaggaacttactggaaaatggagcaaaggtcatgcatattatgccttagcaaagagcttggctgcattctgtttacatcctggggatcagtggaagtttgaacttgagaatgatgacctagggtatctggtggaagaaatttctaagcagcacagcattcaaatgtggcctggctgcttctaacaacctatgctcagatgtgggagcaaatgaatgacttaaaattgcaacttatatttagaagagatgcagagtataaaagtttggaaaatctgcagcctggccatgtgatagaggaagaaaaagcttttttaggacaggaattcaaacagtctgcagaacaacacttactagagatatttgaataatcaaaaggaggcaagtggtaagcgctgacagtcaagacaatggaaaaaagtcctggtaggcatttaagaagtctctggggcagcccctcccatcataggctcagaggcctaggaaggaagaatgatttcatgggccaggacccctactgtccgcacagccttggagcactgctccctgaatcctggctgctttggctccagcaccagctgtggctcaaggaggcccaggtatggctcaggctgccattttggagaatgcaagccacaagccttggtggcttccatgtggtgttaagcctgcaggtgcacagagtgcaagagtggtggattcttggaagccaccacctagatttcagaggatgtatggaaaagcctgagtgggctgggcatggtggctcacacctgtaatcctagcattttgggagggcgaggccgatcgatcacgaggtcaggagtttgagaccggcctggccaacatagtgaaaccccgtctctactaaaaatacaaaaaaaaattagctgggcatggtgatgtgcacctgtaatcccagctacttgggaggctgaggcaggagaatcatgtgaacctaggaggtggagatttcagtgagccgagatcacggcattgcactccagcccaggggacagtgcaggactcggtaaaaaaaaaaaaacaataaaagcctgtgtgtccaagcagaagcctgctataggggtggagccctcacagagaacctctactagggcagtacggaggggaaatgtggggttggaggcctcacacagaatccccactgcagcattgcctagtggagctgtgagaaggggacaccatgctccagatctgagaatagtagatccactgacagtttgtaccttgcacctggaaaagccacaggcactcaacaagctttgagagcaaccttggggactgaaacctgcaaagccacaaaagtagagctgcccaagaccttgggagcccactccttgcaccagtgtgccctggaggtggcactattttggagctttaagatttaatcactgccgtgatgggttttggacctgcttggggcctgtagctcctttcttttggccaatttctcccttttggagtgggaatgtttacccaatgcctatttacacattgtatcttggaagtaaataaattgcctttgattttgtgggctcatatatggaagggaattgcctcatctcaggtgagactttggactttagacttttgaattagtgccagaatgagttaagactttgggggactgttgggaaggcataattgcattttgcaaagtgaggacatgggatttgtggaaaggccaggagtagaatgatgtagtttggatatttgtccctgcccaaatctcatgttgaaatgtaatccccaatgttggaggtggagcctggtgggaagaagtttttggatcgtggaggcagatccctcatgaatagcttgagccatccccttggtgataagtgagctctcactctgagttcatatgagatctggtcatttaaaagtgtgtggccctcccaactccctctctcactcctgcttttgccatgtgaagtgcctgctcccactttgccttctgccatgaggcctccccagaagcagatgccagcactgtgtttcctgtatatcctgcataaatgtgatccagttaaactgctttcttataaattacccaatctcaggtgttactttacagcaatgcaagaatggcctaagacaacatccttttagggtaagtttacttttgaaaaattatcttaatttttcttcatctgagaacatcttgattttcctcttatatcagaaagctattttcactggatatagaattctgaataaactatttcttttgtttgtttgtttgtttttagcacttgaaaaatcttttaccatttctttctggcctccaatatttctgataagaaattgacaataattcaaattgtttttctcctatgggtaatgtgttatttctctctggctgctttcaatattttttttctttctttttagtttttagaagtttggctatgatgcatcttgatgtgtacttctctgcgtgtcttgtttagggctggctcaaagctacagtttggtttgtttgatcctccagagctcatttgaaatctgatccccagtgttgcaggtggggcctagtgggggactcatgggggaagatccctcatgaatgacttggtgccatccttgtggtagtgagtgaattctcactctattagttcccatgagagctggttgttaaaaggagcctggccccaccctttatctctttctcatttactcacttaccatgtgatctctgcacatacagctcccctttttctttcaccaggaatggaagcagcctgagagtctcaccaggagcagatgctgatggcatgcttcttctacagcctgcagaaccatgagccaaatagatccctttttctttataaatcaccaagccttccatatttctttatggcaacacagactaagacatgtaccttcttgaatcctttggtttatggaaattctcagccataattctttgtgttttcagctttctcatattcctgctcttctttcaggactgtgatgacacactcttagatttttgttatagtcccacaagtccatgaggctatactcattttttaatagtctgttttctctgtcattcaggtaatttccattgttccaccttcaagttcactgattctttcctctatctacttgtacttgctgttgagtccatccattgatttttctaaattttgtctattttagttttgtgttctaaaatttccatttggttttcctttctatcttttacttttttgctaaggctttctaattcttttttcttttgtcccattgtattgtaattgctcagtgaagaatatttattatgcctgcattaaaactttttttttttttttgagatggagtctcgctgtgtcatccaggctggaatgcaaatggtgcaatcttggctcactgtaacctccgcctcctggattcaagtgattatcctgcctcagcttccctagtagctgggattacaggcatgcgccaccacgcctggctaatttttgtatttttagtagagacagggtttcatcttcttggccaggttggtcttgaactcctgacctcaagtaatccacccacctcagcctcccaaagtgctgggattacagatgtgagccaccatgcccagcctctgcattaaaattttgtcagataatcctaacatctctgtcatccaactgttggtatttactgattttttaaaactcaagtttatgttttcctgattcttgcatataactagggactatttttattgaaaactggatatgtgcagtattatgatagtcttggtattatttaggtcttctctttcagatggttgcttctgacatcactctggtggaggaagttagacctttgccttgcagcagctggtggatgtagaagtccaggtccctcactcaacctccatgaacacccaagagactccccattactgctgagtggagtggggtttctgactctctgacaggcctccactaaaatcaccctggctggtcagaataagaatgcctctcattccccacatgacctgtgccgacaccaccgagaagtggctttatgatgcccaggtggtaatgaaagttttggctcccaagcaagtctcttttacatcaccttagggtggaggaagggcacctcctcactgtcagaggagagtggaagttcagacttcccatggggcctccatggggcctccactgacaccacaaagggagagggactatcgcctcctggagatgaaaattccagctcttgacttgactatctctgataccaccctgatgttggggaggaggattggggcacctgattgcagcttggtgagagtagatctgtaggctccctgccacccctcactagtgtggatatgggtgaggccacagtttcttttgtggtgtatggtggaagttgaataatgactgttttaacattttctaccttgctaggttgaacctttcctgacctttaactaaagagagaagtcttttgttgtgttgtgttgtttgcttgttttcttgtttgtttgtttttcttttttcccccttttcacccatggtctgtgagttgtcagcttctctagctttaagccttggatatgtgaaatggaaagaaatcccagagaacatatcgccatgtgttcttttggtcctggggtttctaatatgtctgttgctttccacctttcagagccagggattttagttggacttagtcggaggaattgggaaaagtacatcgattccactttcccagaggtggaagtcccaagcacatctttatgaaatattttatctagcttttataattatgtttaagggtattgatcagaattacatagtctacttgcaaccattgctgttttcacatagcttcatatttttgtcttttttatcattttagaaatatgggatggaagaaggagtatagcatttggccagtaaccttttaaaggaagcctttgttaagcacatgctgaatggcagtgaagtccaacagtgacaagggaaaaaaccactgcagccagggatatgcagtctagggagtggctactgcccacagttagggtaacaatggaaaatgctaacttctttctgagcagctttcactcagaaatgacacccaaccaattcttgtgggcaagaaagattttctcaggtttattagtcgtagatctccagagaaacagaaccaataggagatatctatatctctatattaatatatctgtaggtatacatatatctctatatctatgtctccctctatctacctatcgatgtattgtaaggaattgactcacatgattatggaggctgagaagtccccggatctgcagttgacaaggtggagacccaggagagccaataatatagctccaatttgagtctgaaggcctgagaaccaatggcgggccaatgacgtaagttctaatctgaaagccagcaggtttgaaatccaaaaagtcaatgtctcagttcaagtctagttgatggccaattgattattttatgaaatcatgatgagaaaccaatggagaaaggcatctataatcaattgtagaccaaggtggcatagaacagtggagaaagaatatgaaatgctgactcatttaatattcatgtggaaaaaattaatctttaccatcacctcacattgtacagaaaagtcaatctcaaacggacttagacctaattgtgaaaggtaagataataaggcttctaaagtagcacagagtatattcctgactctacggtgagcaaatctttctttaaaaagacaccacaaaggaaactactttaaaattttactttattaaaaccaagaatttctattccataaaaacaaaactatatgaggcagaaaaaaacggcatatgagaagatgtttgcaatacacacctgagaagaacctaaaaattctaaagcacttttacagattaatcagaaaaaaaaaaccaacccaatttaaaaaataggcaattgtcttgaatattttatttttaaaaaatttcatccaagtgccctcaaaacatatgaaaaggtcatcagtgttatatagtcatcagggaaattcaaactgaaaccagcagctaccattccgtcctccattcccaagtggtccagtgttaatgagattaaggagcaacagaaactctcatacatgcatttgggaatattactctttggcagtgtccactagacttgacaaggtaataacatttgtaggtatatataccccatgcaaatgcactaaaagatgtttatacaaatgctaatagcagcattattcataataaccccaaactggaaacaagccaaatatttatcaatggtaggataagtaaatatgttctgacaaaatcacaataaaatactttaaatccctgaaaaataataaacaacttcagtgtacaactacatggatgaatctcccaagcctaatgtttgtcacaaaatgccagacgcaagagtatgatgtatataattctatttatgtaaggttcaaaatagataggagtaatctatgtcgatagatgttatagcagtggataccatttttaggatgggtttgacacgggatgagggtgccagaagggctcctgaagtgttggtaatgttttatttctataaatgggtgttgattacatgaatatattcagtttgtgaacattatttgaggtaaaatagaatttgtatgcctttccgcatgtatgttattctgcaataaaaatttatttaaaatgttttgtattcttattttttcaagtacaaaaattgtatgaattgcatattaaaagctctcttccccacctccccgcctaccacacatcatgccctagaaaatgccaactctttgcaggattcaaagaaatacagtggtggttctggattcacagttcagctttcttctggtgcttgcacttccactagaggatacagggatactccacatttaaacatgaaataaagaacccagtgaggctggggaattgccagagaagtgttcgtcagtgacttacagggtggtatttacctcaacacacttatttcggaatctcaaaacctcacaggtaaatgtttaccctcaaggctttaataagcgttgttgttgttgttgttgttgttgttgttaagatcaatatctttttggttgctattttaatggaatatttaaaaattctatttctggttctgcttgatttggtaatttaaaagaatcattttagttttttaaaaagaattatatattttttaatgcacaaaagtaatacaaggtaattgtaataaatcaaaatataaaagtacataaagaagctaataattcccctttgtttcctttcccactcctgtatgtaatgattcaaactattttctattttcaaacaactaaatatgaatatacatggatagcctgctcccttatttttttcacaaatggaattaaatcaactgtattatacttccatttgctttttaatcttttcaatagctgcataatattccataatgtgacagattaaagaatgccacaaatcatttgtggatccttccattgagaggcctaatgccctgatccttaaatctgggttgaacttgatgacttgcctaaccgatagaatgaggcagaagtcatgctgcctgaagcttctgccttgatctctggaactcaggtgtcatgctgtgaggaggtgcaaaagttccatggaaatgcatatggagaagatccaaagctcccaggtacagccctggctaagcacccagaaaagagtcagcaccaatttgccagccctataaatgaacttggttttcatgttagtgaaataagttttcaagctgaatcctctagccacagaagagctgcccccattgatgttgcacagagcagggataagctgttcctgtcatgtcccactcaaatagcaaattctgagcaaaatacactgccattattgtattaagttggtagatttagggacgtttgttatacatccatacataaccagaatacatagaatcagaacagcttaatttactcattattaactattacactacatataaacagatttttttcctccaacttctaatagcttgcaacaaacatctttgtgtacttctaatttttgccatttaaataatactgcattgccgcattgtcgatttacttcatttgatgcttttattttatgctgttagtttttcttcatatgtcttatgacttttgttttgtggtatgtaatttatagaaaagacataatatttggggtgtttctaagcttttaggcttgccctgcttctctgccaatcactcattctatttttttggatgcgttttactagtgacagatgctgactccttttctcacacattaaggaaaaacacttatttgattttttaaaaaatcaacaggatgagtcatgatactctttaaaatctaatctttgagaactcctctatctgccatcttgctacatcagtctcttgtttgtttcaggaaaactagtgcaagcagcaaagataatgctcccttgaaaatgcttcctgaaaccacaaaatatgggtcctttgtaatttattcagaatttatttgaacaaggaaaccatggtattggtattttttttactgtccactgagaaaaacagtgtttttacaagtttttctttctcctcatcatcgttaacatgatttcaaagcacaaggctggaagtgctgcgcagttagtctaatttcaacaaaatatgcttgctgctttcagacctagcacatcagagctgatttgatgcttgatgtagcattgcagcatctttgtgctagtttctttcaagctccatgtgaactaatgtaacaattccccttgaaatcatttgattcctattattttggtatattaaacatgaaaataacagttcagctttcttctggtgcttgcacttcctctagaggatacagggagggactccacatttaaacatgaaataaagaatccagtgaggctggggagttgccagggaagggaaactgctcgtcatcgacttacaaggtggtatttacctcaacacaccactttacaaaacctgagtctcaccttggcgagattttcatcagcaaatggggaacgtggccatctctctgtgatgatttgccaatcgaggtacgagggagcacaagtaaaagttgaatgtcaacttgctcatttataatgactgatgagaaacataaatatatttacaagttctctcatttcctatataaaaatcttcactgaaatgtaatgcctagggcaaccacttaatagtttatacgaagaaatccactcaaaacactatagaaaaatcaaactagaattgtaaaaaacgttcaaacaacccacaggaggcagaaagaagaaaacagtaaaacaaaaaactcggaggaaacaaacagaaaacaaacaaacctgcacgttgtgcacatgtaccctaaaacttaaagtataataataataaaataaataaaatgacagatttatttcctaatgtatatgtaatcacattaaatataagttgtctgaatacaccaattaaaagacagaaattgacagagtgaattataaaatgagctaactatatgccagctacaagaaactcactttcaatctaataatatggttaggttgaaagaaaagatcgaaaaactatattacatataaacattaatcaaagtaaagttgaagtgtatatgttatcctagaggacagacttcagagtgaagtaacagaaaggaacatttcctaatggtaaaaggatcagtccctgaagaaatcatagcaatcctaaacatgtatgcacccaacaatggagctgcaacatatgtgaatagaaaactgatagaaaattgaaaggagaaataaacaaaattttaatgggagacttcaacactcctctctcaacaatttatagaacaataccattagctgacaggatctaaacatttagagaacaattcacccaacaacagtagaatccgcatgtttttcaagccctcacacaacgtttaccaacttagactgtattctgagccattaaatgaaccacagcagatataaaataataaaactcgtacagagttggttctgtggccatcatggactcaagctaccaagcaataacagaaagataacaggaaaatctccaaacatttgaaaactacaaaatgtgcttctaaataatctgtgactcaaagaggaagtattttaaatttaaaaatagcttgaactgattgacaatataacatagaaacatttatgggatggagtagacatatgtttccctattcctcctacttagtgcagcgaaagccccttaacattatatacaaaacaagacaactctgaaaggtggagaaaggagggcagatcagtcagggctttgtgtcctgaagaatgacatgatagtgcgtttctttgctcttcttagtgccttatatatctcgcactgagtgctgcagaaacctgaaaatgccaataggaaaatacagactcccttatcccccagaaaacaaacaaacaaacaaacacaaaaaaaccctgctttctgcagccacagaacaagaaaaggggcagccaagcaagacagaacatttttagacaataaccacactcctcttcagccaaactccatggaaataaccactgccccagccccaccccagtagcaaaggccacctggcgagcttagactatcacccttgccaaactgtagcaactgctcctccacgctgtggtgatgtcagagaaggccaagtgggaggtcaggacttccattgctgaccagtgctagtgaggccccatctctggccgtgccagtggggaccagtggggagctgtggccacgctccctgcctttcatggaactcttacccctgcccagcagtgatgagaagcccctcctcttgggggccaatggagcccaagcggggatctgaagtttgacccccaccttgcagtaataggtgaaaccctctctacccattccttccttcagaggaagcctgctaaaacaaaaaatttaaataaggtttggtctcataatacctcagatgtgcagatatcattgacaatccctcatcataccaagaactagcaaaatctcaaatggaatgagtaaaagtgatcaatggacaccaataaagaagtagcaccgatgttaggattttccaacaaggatcctaaggcagccatcacaaaaatgcttttactaaaaattttttaaaagagagaaaaaaggcataaattaccaatatcaagaatgaaacgggatatcaatatagaccatgcagatggcttaaggataataagggaatattgtgaacaaccctacacacataaacttgacaatttagtttaaatggaccaatttctcaaaaaacacaattactataattcagtaaacatgaaagagagaatttgaataatcctattattaagaaaatttaatttgtaattttaacccccccccaaaaaataaatctttagaaccagatgattttactgtgaaatttccgaattaacattaactctaaaaagtatcttccataaattagaagaggaggaagcacttcccaacttattttacaagatcagtattacctgataccaaatctagacaatgatagtacaaaaagagaaaaaaatacagatcaatatctctcaagagtataaacacaggccgggcgcggtggctcatgtttgtaatcccagcactttgggaggccgagatgggcggatcacgaggtcaggagatcgagaccatcctggctaactcggtgaaaccccgtctctgctaaaaatacaaaaaagtagctgggcatggtggcgggcaactgtagtcccagctactcgggaggctgaggcaggagaatggcgtgaacccgggaggcggagcttgcagtgagccgagatcgcgccactgtactccagcctgggtgacagagcaagactccatatcaaaaaaaaaaaaaaaaaagtataaacacaaatgtcctcataaaatattagcaatcaaatccatcaatgtacagaaagcagtggagtttgtgtcaggggtgcaaggctgattcaatcattaaaatcaatcaatataatgtgccatattaacaggctaacaaggaaaaaaattacaagtttatatcaaatgatgcagaaaaaaatttgacaactaacattcatgacaaaaactctcagcaatctagaaaaagagggaacttagacaatttgatataaaataaagataaacagtagacaaaataaaaatatgacccttgtaatcacctattgaggtgaaagctaccatggtctggattttactaatgggggttttggtgtggcaaggagacaagaggtagcctccggaatttactcagctcttaagtgaacaggtagggacttgaacctggttgtttggctccaagtaagaaatagagtccaggtggtctggctccgtagcctgggatggtgaccaccctgctgtgctgttgcttaccctccagagctccccacctcccccagcaggtcctagacctggacaacaacctggtttcttgaaggaggtgatacccatagtacataaacagtgttggaacagagagacaacatggagaaccttcatccctcattcaatgatagggtgggggtctggggacagcctaggcatgggcagacacattttctgtggcagacggaggaggctgggagctgggcattgctcatggcatccgtgcagcttcaaagtgctcaccgtctgcaccctcaccctcaccaccgcctgctggccactcagcagccctggaggcagacactcctttgaccctgtttgacaggtgatgacgctgagttccagcgatgttgagcctcaaggtcaagttacccaactccaggaagaggtgggcttgggtgggggcagctggactccccagctgcactggaaattctatgccacattgccaggaatgataaataactccttctgcattaggaaacaagcaggacttcctcaagacagacaaatgattgaatatatagaattgtccagaatcacacccctcttaaatggatatgctcagacacacgagtgggactggaagtggaggccgggtgaggagacgttggctttgcagtcaatacacttctgttttgttttttttttccaacaaatgtattcatgtgttgcacaatttttaaaaaaggtaaaaagagatggtgctatgtatataatagagctgttataaaagtttaaattaagttatataatagtcgcagtatctgggacatagtaggtgctcaaaataaacattattttgcaaagcgtcttagtctgtttgggtttctataaccaaaataccatagactgggagacttaacagaaatgtattcctcacagttctggaggctgagaagtccaagatcgaggcactgacacatctggtgtctggtgaggacccacttactgtttcattgatggcaccttctccctgtgtcctcacatactggaggaggttgctgactccctggggccccttatataagggcagtaatcccattcatgagaaacattcagaccacagcatacatttaaaatgctttacagaagcagatcaagtgagacgatgatgggctctcagagacccatgctcttctacaatctatctgcaaagaagacctggctggaggtggagagtataaaagccaatcaggactacagcgaatcaggacggtctctgattaaaggtgttaacgacgtgacctagccctggctggatgcagttcagggcctccctgggtcttggttgcagccttcatgaatataacagccccccacaccacgcagagcaggttttgttcactcaagccatgcaagaggcatgggctcagcgtgcagctctgtcttctccagcaatctgtccggtttctgtctcttcagctccagccacctccatgcgctgcatggagcccctccctgcactgggtcccagaagttctgcttgttttcagcgatcacactcccgcactgtctgtggctcaaagtctgtaaataatggtttagcatatttcatccacttttctacctggacagaaagtgtagtgttgttagttggtcagagcaggaggtggttctgtgtgttttgtcagccttccagatgtccccaagcagcaagagaaggaaggggctgtgcacagcctttgcctggggcttcctatgtccatcggaaagagagtggatcgcataagctctcacagaaagaatgaatgagcgagtcagttgcttccctgaatggctttgttctgttctggtgcatcctctgcttgggacccacctgctagggcgtggtagagtgaacagctacgtgtctttgttcagcacctgcttagtgccaggacctttctctctgcttgggaaattgccgtctttgtttcacagaggatgaagctgaggttcgtaggctgaattctggtggcccagttttccggcctgggctccttccacttgtagagtggcctatctcagtgctgcctatgccgttgggaggggtggtggcaaaggcagaccaagagtcaccaggcaatttcttaggagcctgaagtctgcaatcctccagtgaagcttttcagatgaatgtccttcacaccccaagaattctagaaatgctgagcccctagcctggagggcaggcttggtgcctgcaacagagcatgggcccagcgacccctatggtctgagagagagggtgaggtgggaggaccatccactctgggagacttgggctggccttgcagactgaaacctctcctgtaaagtgatgtgtgtcctggacctgcagggagggaggggcctctggaagtcaggccgattgccagggtctgtgaggcatcttctgaagcccaggccctgtctggctttttcttgccaggagtctggctctcttgctccacatgaatgactgaagttatttgaagaggtcccccagagagtcatcaggcctctggtggaattgcaggggctcagggaaggcacagagatagggctgtaatgcccggggagggagcggcccaaggcctgccccagaccactgcaagcctgggtgcttggagaggagacggccattagcatggctgttaagagccgctgctgggggcactggcaagggacctgttcaacagcttcacccactgggccatgcacctgacaagcattcaccaaccactctttctgtcttacaggaaagtgatgggggtggggagcaaggttgctttggcctgaggtcaaaccatcaagatctgcatatgtctacagttattgatccttctattaggtaaagaaaagaattgtataaaaaccattcagagctgctgaagatgttgttacacttgccagatctgggaactgcgattttcctttgcagcttcaacaagagaagaaatctcacaggggaggaaggggtcgctgagcgtcctcggcccatggataccttactttgtggcgccacctaacggctaaaggttaaaattgcaaatcttaaagattcctccggcagaggaagaggtgggaaggggccgggtttttgaagagcaggctgagagagcttttttgggagatttgtttcctgctttctgggcacatgcacctaatgacgatacaatcctacgacccatctctgattcttcccctgacccactctggtgtagccctgcggagataattggcaattgcaaagtcacctgcctttgacttctgacccagtaacccaggaaaccttgccaaagatactctagcaagaaatacgagtcgggtttacacgtgccacaccctacggaattttttgttatcgtaagagactcagagcgattcacatgtgcatcagagagggcactgatggaagcaaacctcgtgcatcccacagagttacagccagcagcgctcaggctgtgtggctgccgcaagtgcccctgagccccctgagccccagtggctggcgacagccccgctccatgtcgccttcatccaagatctgcgccgcggggcggccgccatctggagcacggctggccacggtcagccctaagctggtgggtgacactgcgtctgcgcacacttcgttgctcaaagccaactgtatgtgctgactgggtgtgccttctagtgtcctgtgttcctgctgagtgcctagcatgcatacttcctttgtgcgcccagtgttgtgtgcctgtcactgtgtgtccagtattgagttatgtgcatggtgttatgcaccaggcatggtgtgtctgactttgtttgcccagtgtcgcgtagccagcatctgtgtccagcctgtgttcttgccatgtgcctggccctgcatgcctagtgtggcacctggctgtgcatactccgcattgtatgccgggtttgtttgctcccgtctgtgagccttgcagtgtaatcctggagcgtatgccctgtgttgtttgccaactgtgtgtgcaggtactgtgtgtacctggcgctgtgttcctgcttgtttgtgcctagtgggcatgcccagtattgcatgcctggtgttgtgtacctggtcctgtgtgcccagtattgagatcccagagtgtctgcccggcctgggtgcctgcgttgtgtgtccggccctgtgtgctcaggtttgtgcatccagcttggtgggcccagagtgtgcctggcatacgggcttagtgctttctccctggcattttgtgcctggcatgtttgcccagcactgtgtgccctgcatggtgtcccagaggctgcgcctactatggtgtgtctggctttgtgtgtctggcattgcatgctcattgttgtatacttactgtgtgtgtccagcatggggcgcctgcattgttttcctggccctgtggttccagagttctgtttctgcactgcatgcctggtgttgtgtgggtggaattacatggctggtgtgtacatggctggtatgtgacccagcgttgtgagctcagtgtggtgctcctggagtgcctggcccggagtgcctgctggtgtgtgtgtggtatgtgtttggcatcatctgtctgaggttttgtgcatagtgttgtgttcccacagtgtgtgctggcattagtgcctggacttgtgtgtgcctggcattgcaccctggcttctgtgcccagcatggtgtgtcccagtgttttgtgccctacagtgaagctcagcattgcgtttggtgtgtgtgttcaacatgtgttacaagcatgggttcttgccgtgtgtgcattgtgtatgtgatgctgtgtccctagagtgtgtgtagcatctgtgcctggtgtgtgcccgatgttgtgttcctgcagcgtctggtgttgtccccagtgtgtgccagtgtgtattcccagtgggtgtgccagcttgtcggtcatggtatgcctgaccttgtatgcccagagttgtgtgtccagtgtgtccccagcttcagtgtctgtggctggagagtgtgtctttccttctgtgtctggtgttgtgacccagcatggtttgtgtggctgtgtatgcttggcaagcgtgcccactcctgtgtgcctggtgctgcgtgactggcacgtgtacctcgaattgtttggctgacagtgtgtgcccagaattttgtgcccactgtgtgggcctgtgttgtgtcctgtgctgtgtgctctgttgttagccctgtgtgtgtgctctgtgtgtcttgtgctgtgtgtcctatgctgtgtggcctgtgctgtgtcctgtgtggtgtgccgtgcactgtgtgccctgtagtgtgtgtcctgtgctgtgtcctgtgtggtgtgccgtgtgctgtgtgtcttgtgctgtgtgtcctgtgctgtgcgccctgtgttgtgtacccagtacttctgtgtgtcctgggctgtgtgtccagcacatgtgtctgctgccccactgtgctgagtcccaacacccacctgtgcgcctggcactgcctcgttgttggggaggacaccctgtgtggccgtcctcgccacctgctcgagcagagctgaggatcccatcgtggcctctgccctcacttccaccgcagtttgccttccttcctggggacactcctgcctggcagctccccatgtttagcctgttccagggatcagcttccaccccaggcactctccatttatttggggagttcccacaggatgaggcccttaagggagtccctcctctctactggggatacccctgagcaggtggggactcctgtccttcattcagctcatccccagccctggctggagctttccctcctttgcggaggtgggctcaggcaggcctcgctggggagctcaccaggccctgtgcgtggggctctgcaggcccagccagtcctgactctgccgtgagccccgcaccaggatgggaagtgccctgagagctcatctcctaccacctccagggctggggctggcgcctcctccagcctggcatctggccgcggcggtctccccaagcagccaccagggggcagagccaccctctgtccacaccccgatcctccctcaccccttcaattgctggacaagggacccttgcctgaggacgccctcggatccctcctgtgagacaaggagctgcagataaccccaacctctacacagacagaaaggagcagatttcataaaaagcagggaatttttaaaatgtgagtaatttttaaaaatacaatctccgcgtaaaacccacttagaaaaccttgtgctttctgattaatagagagcaaatcacttacccagggctattggatgctgtaattttttaaggttttaaatatgcttttatttgtttccccctgatggtctgaggcttctattcttgctaactttttagttctccttgtcctggggacacagggtatggggcaggacctccctggattaaaggaagtgagtcagacatgccaccgcccgcaggttccaggacagttctggtctgaatgcagtcccgacgcgagtgctgttccctgggagctgagacccgcaaagatgcccttccaccaccctctccccacggttctttcgtgctgctgcgttcctggaggctgagcttctgtcccatcctgtctcctttgtgtgtttcaaacctctttccaatttctgttatactgatgctgttctcctttccggtactattacatgattttcttcccatttctcatgattcagagcccatggtgggtgagggggacagttgggtggtccacacctgagacttcatgcatcctgtgaggctgagtcacaggcctgggggtccttgaatccctcttatcccacaagggagatcctcctggaatctcagcagattggagagcccagctgagaagaatctgctgtcctattagtgcccttggttttgaggtggctgtaaaatcccttgctagaggcggaagagagaggatcgcaccccagtatcggactgctgtgggcaagttggtgaaatcaaatgtattgttactttctgagaatcagcacccacattttctgcatttaaggattttatggagcacaacgaaatccacagcagtcacagcaactgagagagaacgccaggccacactccctaggcattcctggagaggtgttctatgccttaaggatgaacaatagagaatttgatttaaaaaattgatggaaagttaatgttgaaagaagtcagggtgaaataaaagcatgagatgctgtatgggatgtgaagatttctaggagacaataataatagacaagcaaatgaagactggtgtagagtgaaagttaggtggccaggatacgacaagggcactgcagccaggattcctgtcccggggacaatcggcacaaagagtctgcacccgggaggacaggggccttcagtgtgtgatctgtactgagggtctgcacctgagaggacaggggctttcagtgtgtgatccctactgagagtctgcacctgggtggacagaagccttctctatgtgatcggtactgagggtctgtacctcagaggacaggggccttcagtgtgtgatctgtactgaaggtctgcattgagaggacagggaccttcagtgtatgatctgtactgagggtctgcacctgggagcacaggggccttcagtgtgtgatctgtactgagagtctgcacctgggaagacaggttccttcagtgtgtgatccgtactaagggtctgcacctgggaggacagggcccttcagtgtgtgatctgtattgagggtctgcacctgggaagacaggttccttcagtgtgtgatccgtactgagggtctgcacctgggaggacagggcccttcagtgtgtgatctgtattgagggtctgcacctgggaagacaggttccttcagtgtgtgatccgtactgagggtctgcacctgggaggacagaggacagggactttcagtgtgtgaactgtactgagggtctgtacctgggagcacaggggccttcagtgttttttgtttgtttgtttatttgttttctgtaatgagagtatgcacctgggaggagaggtgcctttggtgtttttttttcctgtactaagggtgtgcgcctgggaaaatagtgccttttgtgtgtgatctgtactgacagcgtgctcccatgatgacagggtcttcagttgtaatcttctcttagagtttgcaaatgtttggacattgtgtcatcttttgatgtttggtattgagtgtctatatgggtgaagttaggggccatttttttgtcacttgcactgagagtgtgcacacgagacctgcgttccttccatgtgttatttgtgctgagagtctgtgtgttctgaaaagccccttcactttgtttttcactaatactctgcacatttgaggacagggatccttctttgtgacctgtagcgaccatctgcaccaatgaaggaaaaaggcctccagcatttgatcttgcttagattgttgctttgtgtggatgggatggatttctgcatagatcattctcagtctgtttttgtacagagatgattgatttgcttttctattctctgatctgtgtcatctcatgctatcctcaactttacttgctttacatataaattgagtattgcaaaattaagtaaactcttaataatgagaagtaaacttcttagtaattcttagatgggcttaattacaacctttcatcttactgctttgtccttggcacacactaattacttcctgagtcatctggttttggtttccttatgctgttgctatgatcattcaatggatcatggatgtagaaagagtatcttgctcccctggaatactcacagatggaatgagcttgttttgtatcttggaatggtttagggagccacagacggacaaggaagattttgccttctatgccacagtagaaacatgacaatgtacggggatgggaacagcctggtgtgctcagagaccagactaagctttaatttaattgtaataaccctggtgatttggggaatgagggttagagattggacaatgtgaactggagacagattctgaaggactggtagagtttggattatggaagggtttaagcacttgcaaacaaaattgatttttttgttcttactcacaccaatgtgtgttcaactggggaaagatcgtagaggtaactcctgaagaaattactgtggtgggtccaatgggtgcaatagatttggatccatagaacttgtcctggtggaagataaggcaggcatcaaacaggggtggagagcagatgggaatactgtgtttccttattgatcaaggagagggagggaaaggaagagggactcccagtgtgcaggggcagagagcagtgtagagctcagatgtctttctggtccagggttgaccttggaatcatatatctgctcacgtgtctttttatttaagacatcttttgcctataggtgagggggcgagaggaccttctcccaattaaataacaataataatagtaatgactttttaacggcatgtcctaaagtctattattagaatatagtacgcctgctgcaggctcataacctcattaacttggaaataatgcagtatgggcaattaggatgataaaccacttatgcaatttcatagtatgacattaatgaatgtacttgggaagcatttccttagcaccaaggccacaggaaaagtcaaggggagacaggtgccagtggatgtaaacagtacagatcagtggagggccgtatatttgaaagcctagctgtgtgttggttgagtaggtcccttccaaactatgctgtgcaggttatgatggggaagggaacagagacagcccagcgccttgcggacggggcaggaaggctctgggctctacagcactggacatccaaagtttcctctatgcctataccctggggtctctaccaaacccaattcctgggtagagaatgctcaccttaaagaaatgctggaaatccagagacccttacactggttcataattaagaaagcaatgctgacaaaatcccaacaggagccccatgcagaggatcttggctggctatgtcttttagtgatccagaacagtgcctggaaaagccattaagaaattacgagttgaagattagctgagaaaaggcaagaaattgaatgaagtcagtctaagtgtgccatcaggcatttttctagctgtctgctcagaaaggtctttaaagggtgaccaatcagcatgtcagagatgaaattggatgctgtgagaatctcaggtaagcagcccatgaaaaggagggagctttccagatatgccttcttcctggagacctttcctctctagtgcatgtttatggatggttcaggatccaggggcataaaattcagccaatttacaataagcagaaaatattggcaagatttcacttaggagattgcagatccaggtgtgtgaatcaaccacaaacaccaccacagagtactcatggtggatggtgcccccacaccagtgcccaggacaggcaaacaggctgtcagttctgcccatctgatgctagacacccagatggagctctgcactgcaccaggccgtgtgtgatgctcactggagggcctacgcacagcctttcctcccggggaactatggccatgtctgccgaaagaggtaattctctgacagtacagcaactggaaatgagaaggtctcaggggagcatggagttatagaaaaatgaagcagaagacattgaggttgtttcccaagacctgttcccagagacctcataaatatctctgtccaagagcagaggatcccgctccagtggcctgagcactccaggctccagtttgcttttctgtaggctctatgctctttccttaggcttatggcttcttcctttttataggaaacactcctttttttttttttttttgagatggagtcctgctcctgtcactcaggctggagtgcagtggcacagtggcacgattttggctcactgcaacctccacctcctgggttcaagcaattctccttcctcagcctcccaagtagctgggattacaggcttgcaccaccacgcccggctaatttttgtatttttagtagagatggggtttcgccatgttggccaggctggtctcgaactcctgagctcaggtgatccacccgccttggcctcccaaagtgctaggattacaggcgtgagccgctgtgctggccaggagacactgctcctgatacatccaagctacagccatgatgctgttggcgtgagcctaggagataggtgcacgcttcccactggcacaagcttccctgtagcctctcgaacagttctgaagctgtgactaaggagcagctataccaaggcctcccacacccatatttgttctccttcttgtggagtgctctgtcgacctgatgcagggtaaggattggccagagcagatccccgaagtcgtgtgaccctggccctatgaatcatcatggaaaacaactcctccttggggaaggtgcctaaaaaagaggagttcaagacactttatgcataacctaatataatagctaaggaacccagcaaagctgcttgattaaaaagctctgtgtgtataggccgagcgcggtggctcatgcctgtaatcccagcactttcggaggccgaggcgggcagatcacgaggtcaggagatcaagaccatcctggctaacatggtgaaacccccatctctactaaaaatacaaaaaaaattagccaggccaggtggtgggtgcctataatcccagctacttgggaggctgaggcaggagaatggcatgaacccgggaggcagggcttgcagtgagctgagatcatgccactgcactccagcctgggcgacagagcgagactccatctcaaaaaaaaaaaaaaaagctctgtgtgtatatgcaaatgtgtgcacacatgggagggagtgctgtgtgcgtgcttcagcagggctgagaggaagaacgggaagctggagacaagtgtgtccttgtttttatgattatctcctaatagtgtgtcagttaggattctacagggaaatcgaacaaacagaatgttgctgtagtttggatatctgacccctccaaacctcatgttgaaatttgctccctagtgtgttggaggtgtggcctaatggaaggtgtttgggtcatggcagtggatctcttatgaatggcttggtgctgtccttgtggtaatgagtccttgctctattatttcccacaagaaccggttgctacaaagagcctagcatctcgctcccctctctcttgcctcctgtcttgtgatctctgcacacacggactcctcttcgccatctgctatgagtggaagcagcttgaggttcctatcagatgcagatgctggcgccatgcttcctgtgcaggctgcagaaccatgagccaaataaaccacttttctttatacattacccagcctcaggtgtttatagcaatgcaaatggaataatgcaggtgtatacacacaagaggcgattcattatagaaactggctcacgtggttatggaggccaagaagtcccacaatctgttgtctgcaatctggagaacaaggaagctagtgctgcaattcagtctgagtccaagggcctgagaaccaggagagcagatgtccaaggacaggagaagatggagtcttagcttaagcagagagggcaaattttctcctccacctttttgttacatgcaggctctcagtggattagatgatgcccacccacattggagagggccttcttcttgacttagttcaccagttcaaacaataatctatcctggaaacaccctcacagacatacccagaaatgatggtttaccagttgtctgggcattccctcacccggtcaagttaacacataacattagctgtcacacattgtaaaggatgaaattcagatcagaggattgtcgagggctggaggtaggtcctcaagctcacactcctgccttcacccaggaggcaagagagactagaagtccagctgaggtgaaggtgtaatgagccaaatagagtcaggactgagactccagcctcctgaattctactgcatcaaacttcccctgcacctcttgcagatgcagattcccacaggcccctctgcatctttgcttagggtgcacttccccactccctgtctgcctagatgaatactgcatgggctgttgaacagcgtgattggggttgtaccgatatgcacattccatccagtctgccaacgtgagttgaattaattccaatttcgttaaggaagctgaggacaacctgaagttctactgaatggaatccttttcagaagagaagaacatttaagtagattacagtttgatattgttggccattttctgttgaatagtggagggatgggggtagtgagctgcatcgcttcatagggtggaaaatggcttatttctggctcatctgaagttccatggcttttttgatatgattaaacaaggcataaatgaagcactggcacatgttcaatgcaacaacacccctttgtgaatctattatacactgggaaccgagctgtgtcctcaggatctaaagctgaaggaggcacaggcatcaggatggtggcaatctcgcagcatcactccaataaaggaggcatctggcattgtgagaacacagactagagagcaatgcatacttccaggaagtggataggcttgagacatgctggaggcaggaggcagcctttgactgaagcttggggcaaaccagttggggcctgggacagagggggcagatggccatgactgctgtgacttgattggggagtgtctggacatgagacttgacaggcctggggccttcaaggggagcctcacgggaagcagtcgttgaagacagaagtggcaaaaaaagaaaaaaaaatgtggttccttttttagaacaaagactctggccacagtgcggggagagagggcacaggctgctgtctttgcaggagtgtcaggaaccttgtagagaagatgccaggctgagtccgagcccagctgtgcaggagaggagggacaggtatgatggatgtttctagggcagaacagacaggaagcgggggagggaaggaaggaaagacggaggtggggatgcatctgaggtctcccgtttgaaagctgggagaagaatgacaccttttaatgagacaggccagttgatggaggtttggggagaagcaaggtgtgctcatttaaaaagttttattttagaataactagacttatgggaaaatttcaaaatagtacagagaattccagtaaatccttcacccagcttcccctaattgtgagcatctacagtgcgatgatcaaaaccaggaaacaaacaatgatacaatattattataaaaactacagaatttattcatatttttccagctaagcggcttatttttagatctctgggttgaggtgctaacagacttccctggagcccaggattataacatgtgtaatgagacctttgctttctctttccatctgtgctcagctccgcacttcatttcatttaccttattggtggatagatgatttctttttcaatcccttggatgtgattttattttaggttatcatataagatgaaagatacacacacacacacacacgtgtgtgtgtgtgtgtgtgtatcctcttcccctctgtgatttcagaattctttttaacttgcaacagttcaatccacttacctccactgcgccttcccagtggaactctcacagtcaccaggcacgtcctatgtgctagtgcggtactatctgctcagtcctcacactaaccctgcaggcaaaccacgacacactgggatccgggagctgatcagctcacctcctgcaggcagccgaggaaccgagtgtgaaccccgagcgctgctcctaactgtcatgtgcataagcatctcaatgcacgttttgcttgtgttttctcgatttcctgttccttatgttttctcaatttttcttcacaatgatatctttttaggcccttttcctttcccttgtgatttggaaggtgatagtcttttcaccttaccagcagttgttcttacgttgctggaactcccctgcaagctcttatcaagtgcttccctgctgtcccatccagtgaattcacttcgtgtggtcctcatccaactcagcccctgagcagctttgggattgggggaccatgccttccttctccaaactcttccctcactccttctatgacaccagagctgcacctgcctccctgctggcaccccctgttctactgcactctctatgtcagtttgccttcagccttggacctggggtatttccttgtctctctttatctgcacctttcctgtgtgatctcctacagtcggttgctctacgtcccagccccaatccatagctccaggtgtaatccctcttctgcgagactgactgctggaaaactcagctcggacgtcccataggggactcacccctaacaggctggttattgcactcttgttcccacatgctctcctgtcctgccccaaggagtcactcttttttcctcctttccctcactccccgcaaccaagtcatcagcaagtcctgcagattctaagaaaatgcatatcgctttattcacttctctctgcttgccctgcacccatagctcttccaaggtcaattgcaaggcctaagtcatctcctctacctcccatgcactctctttgagtggacttttgtcattgtaagtccattatgtcactcctttgcttaaggaaacaagtgcttcatccactgcttgtgaaaatgcaaaatgttacagaacacaatgcagggaaattgggaatgtctgtcaatatgacaaacgcaactaccctttgactcagtaatgccttccaggaatttgtcttttgtacatatttgcacacatgcaaagtaataaatgcacaaacttattgtaagcagcattgaaacaacaaaatttccagacaactcaaaatcccatcaagaggaagctggataaataagctatggtaatcaacacaatagaacactttgaagcagtgaaaaaaattttgaggaagccctccatatgctgatatgaaaatatctccaggatatactgttaacgaaaaagaaggttgaaaatagtattttatagtatgctatcttttttatataaagagagaaataaaaatttatctttacttgagtgtgagggtggtgaggtcaacaagaaagagaagtgaggcttcccattgtataatttatgatagtgtttttatgtgatttttgaatcttgttgaatatattaatcactctctctctttctcacatacacacacacactcacacttcagggacttctacctgcttcatgcttctagtggagatccgcacttcttcacatgggctactcaatcaggtctccccctcctcctccatcctcccgctggatgttccctctcactaactgctcagctacttggcctgtgttctgttccttgccaacttcaggcccctccagtctccgtgcctccctggaacacacatttccctgctcttcacgtggctgggtcttcacctttctcagggtgcagcacacaaaccaatcctgcagaaagggcctccctggcccagcagtgcacagggcgttgtctcccatctttctccatccttaacaccatttgttgttggtttctggctagtttgttttccccactagccagcgtgctccaggagagcagacaccacctcttattcaaaatcccaggcactcgatctattttggaatatataaaaaaatcatgcttaagcctaattatttatatttatctaatcacaaattttctagcaaagttatgaaaaagtgactttttatttttttccatattcaatgaagaattttgctcacctttgcttcctttgatgttcaatctctccaactgcctcacccctctccacaagatactttggaatctttgggaatttgtccgatttttttaaacaatgtataattgatctttgatatttaaatgttcttttaaaaaacattggattttgcatgcaatttgttactacgtttataacatatttatacctaaaactatatgttcaaactgttttgatggctacatcaacaattctgtctctttcttatctttggattcattttcatgtttgtaccatgctgctgaaatataccttctgtcttcagtctgctcaggctgccataacaaaataacacaggctgggcagcatgaacaactgaaatttatttctcacaattctaggttctagaagtctatgctgaaaacaccagaaaacttggtttctggtgagggctctcttcctggcttgtagacagccaccttctcacagtgtgctcacatggcttttggcctctgtgtgtgtgtgtgcagagagagagacagattgctgatgtctcttcctgttcttgcaaggacactggttctgttggattagggccccacccgtatgaccttatttaaccttaattatctttttaaaggccctatctctgaatacagccacactgaggtttagggttccaacatatggattagagtggggcacaattcaatccgtagcattccactctcaggcctcctcaaatttatgttcttctcacatacaaaatacacaaaccaccattccaacagcccccaaagtcttattcattccagaatcaatctaagttcaaattctcatctggatgtcatccaaatcagctatgggtgaggtcctctctagctgtaaacctgtgaacagacaaattatgtgcttccaaactacaatagtgggacaggcttaggacgtacattcccatttcaaaggggagaagtcagaaagaaaaaagggatgatagggtccaagcaagtcccagacccagcaagacaagctccatcagatcttaaggcttgagaggaaaatcctcttgggctcaatgccctacctttggatccagtggggcagcacctttgcctctgggccttgtggggcagccctgctcctacagctctgtagggcagtcccaccccagtgcttctggtggaggccatctacctgctgaaaccaaagtggtggcctgagcctgaccctttgaagacaacgaggcagccctgatgttctctgaaacaccttccacgtcgttcttccattttcttgatgaaacagtccacgttcacagccaattagcaccactgtcgtcgcctgcagagtttaagaagtgccaccaccctccttcatttattccctctctcatccccttcagtgtaagccagtggtgtaggtgtttctgcttgtattcccttcaatgagccacacccttggttctctcttcaggatacactttctcatttttattttttatttgccacatggacagactaagaattttccaaatctttaagttcttgtttcttttgatgtaataatttcttcttcaatttatctgtcttctgtcacattttactacaggcatatccaagagattttggtttggttccagaccaccgcaataaatggtctgaatgttacaataaagtgattcgcagaatagactgctatactgtaatctattaactgtgcaatagcatgtttttaaaaatgtacacatcttaattaaaaagtactttattactaaaaactgctaatgattatctgagccttcagtgagttgtaatctatttgctggtagagggtcctcccttgacagctgctgactgatcagggtggtggttgctgaaggttggggtggctgtggcaatttatttcttttttttgtttttgtttttttgagactgagtctcactctgtcgcctaggctggaatcagtggtgcaatctcgctcactgcaacctccgcctcccgggttcaagcaattatcttgcctcagcctcctgagtagctgggcctataggcacgtgccaccatgcacagctaagtttttgtatttttagtagagacggggtttcaccatattggtcgggctggtctcgaactcctgacctcatgatctgcctgcttcagcctcccagagtgctgggattacaggcgtgagccactgcacccgacggcaatttcttaaaataagacaactgtgaagtttgctgcattgatggactcttcctctcatgaaagatttctctgttgcatgcattgctgtttgttttggtaggcgtggcgggggggagcttagaaaaaatgtcttatataataccaagacctattattcaaaccgatagggagccatttccattcttaagctttattttgaaatatatgtcttcatttttataggatgtgagcaaagctttgaaattaaattattctgtttaaattcagcctagaattcaaggataaatatttattctatcaaagtagagtttgaatattcttctccatgtctcctcagcctcttccaactttttccttcatttctctctgcctatattttttgcacttcccctgcatccatctttcttctacatgagcccacctttcatttccctgtcgcttctcctgggttcttccatcacgctgtctcttatgtacaaattgctaccactctattggtctgtctccagattctttctgtcactgtttttcttctgcttgccctaccctctcttaaaattctgctgccttctctcaactcttgtcacttttaacttatatacttattcaaatctttttttctcatctttttttttttttttttgagatgaagtctcactctgttgcccaagctggagtgcagtggcacgatcttgtctcactgcaacctccacctcccagagtcaagcaattctcctgcctcaggctcctgagtagctgggactacaggtacacagcaccaagcttggctaatttttttgtatttttagtagagatggggtttcactacgttagccaggctggtcttgaattcctgacctcatgatccacccacctccgcctcccaaagtgctggggttacaggcgtaagccactgggaccagccttttctcatcatttcttaagttcttattatatgtgggccttttaccttacctcttagctctatcagtgttttgcttcctatgcctgagaacacacacattccctgtgggaagcaggggtagaaaattcacacagcaagcaaccaggggtggaagggcaagctgtggagatatcctgctcagcagagccctgcacaccttgcaggcaagggcattccatccaacttcacaccgacattttgctaaagtaaccaacagtcttggtttgcccgggactgtactagtttgtcactgaaggtcttgtgttctgggaaatatctcagtttcaggcaaatcaggacagctgattactcaacatcttactttctttacatctttttgcatagccctttcatcaaactatgctcacctcaacattcagccttacattgttcttctttctatagtaactgcctggtgggaccattgttgttaccaagtctcccttgcaccttgcccagatgagtgcagtactgtctcttgattgacacattgttgttgttgttgttgttgttccctggctttagcctaccctgtacttatcctttctctacctgttttagcatgtaccaggcagactcagttatgggaacccgtgtggccccattgaaaggatgctcttaatgccgggaggtatctttctctgtacataaaaatcacccctggtatgtcatcttgtttatggagtagtgccagagatacctggccttacctcatacttcacctccttttgcctactgtgatctctctttctgcccaccctagctggcccagggcttactgagcctccccatggcctttgagctatggctgtatttattggtgtctaatctggttttaccattcagcttggtatctacctaaatgactccaacttgaacttgacctgcataccaggccctatgtggcacagaagatgctaggtgcaggaggcaagccaattttctgcccctgctattaagtcttccctaagccgtctccttgaacttgtgtttctctgcatgttggtgcatttaactctcccagtggatctgttttcatttctcagaacccttattctctcctgcccggtgcttctgtttcttggtgttttagccagggatgatttggtaacaggaagaaggaagccactcaaactaacttataaaaaagttgatagcaggcaataaaataataaatagataatatgaacttcatccaaatttaaaacttgtgtacattggacgacactatcaaaagagtgaaaagacaacacacagaatgggaggaagtatttacaactcatatgtcgataaaggattattatccagaatgcataaagaattcctacggctcaacaacaaaaaacagtatctgttcatatcttctgcccatttcctagttgtattttttggtttttttaatattgaattcttgagaatctttatatatcctagctataaatcctttactagataagtgatttggaaatatttgcttacattctttagcttatagatttattctcttcagggggtattttgtagagcaaaagtttttaatattcttgagctccaaattatctgtttttggcatcaaatttgagaaaactttgcctaccctagattctgaacattttaaaatatttttttctaaaacttttatagtttatattttcccttgaaggctataaagcattttgagttcatttttatataagatataaggtttatttttttcttacccaatggatggccaattgcttctacaccattttttgaaaagactatccttcctccatttagctgcttttatactgttgttaaaatcaattagacatatgtgtttgtgtccatttctgggttctctattctgtttcattgatctatgtttctctctcctcaataccacaatgtcttgattactacagctacacggcaaaacttaacaccaagtaccatgtttcctcccactttattattctttttcaagattgttttagctattctaggatctgtgcctttccatataaattttagaataatacaaattacaactatataaaatataataatataataaacattacactatgataataattttaaaataatacaaattttatctatgtctacaaaaagtccttgctgagattttaataggaattgcattaaacctataaatcaattttgggaaaattgacatttttgctatttctgagttttctaatccatgaacatggtacactgcctatttattaaaaggtacactgcctatttattatcagatcttctctgatttctttctttcttctctgatttctttctttcttctgtgaagaaagaaattttcagcatacagatcttacagaggttataaatccataattaagttttaattttatttggcatgattgcaaatgttattttggtttctgcatactcactgttagtatacagaaatgggattgatatttgtgtgctgaccttgtaaactaggactttgctgaacttacttattagttataagagtttccttgtagaatccttgggatttccatgtagacaatcaagtcatttgcaaataggagcagttttatttctttctttctgatcagtgtgcctattttttttaatcttattaaagtggctagaacttccagtacaagagtggtgattgctgagatttttcctcctgtttccaatttgaaggaggaaaaaagtattaaatgtgatgtaaggtataatcttgagctttgtttttatttttcaagtggtctttatcaaattgagaaaatttttctttgttcccaacttgctgagaatttttatcatgaatggatgtgggattttgtcaattgcattttacatcaattatcaaaagcgtattacatcaattgataatagcatatggttttttcctttagcttaatgacatggtgcattacagtgattgactttaaatgccaaaccagccttacatccatggaataaatccaacttgataattcagttgataatacttttgagaatttttgcatataaactcatgggaggtattggtctacagttttctttttgaaaatactgtcttatactggttagtcacggtaatactggccttaaaaaatgaggcagaagatgcccctcactatgttatttcctgaaatagattgcataaaattggtgttatttttcttcaaatgactttataattcattggtggaaccatatcagcctggagatttattcctccagacacttcaaattgcaaattcaatccttttaatgggcatagggatactcagagtatctattttatctagcatgagtttttgtagcttgtggagcttttttggaagttttccatttcttccaagtttttgaatttatgagtaattgttcataccatcccccataatatctttttaatagctgaagaatctgtagtaataccccctgttttatttctattattatttatttgagtattctctttttatttttgccagttttgctataggtttactaatgttattgggttttttccccccaatgaactagctgttggtttcatttattttctttattttttgttttcaatttcattgatttctgatctgtatttattatttccttctttctgcttactttccatttattttgatcttattttcctagttattgaagtggtaatataggttatttatctgagatattttctaatttttaatgtaaatatttagcagtataaatttcccagtagtgcagtaactacattccatgaattttgatatggtgtgtttttgcttttattcaactgtatgtcttttaaaatttcctttgagatttcctatttaactcatggattattcagagtgtactttaatttgcacttggatagaaatttttctgatatattcccattattgacttctagtttaaattcattgtggttagagaacacacacactcacacagtattttggttcttttgcatttgtggagattttttttaactaggaaatatttctattcaacactaataatggaagacctagccagtatcattatacaataaaaatgacactgttcactgacaaatgattgtttacataagaaaccctataaattttacaaaaacactgctagaagtaataaataaatgtaacaaggttgcaataattgtggcccataaacaaaatacaactatatttttatatactagtaatacacaattagaaaataaacttttgcttctttttaaaatttttagttttagatttacatataataattgtttgaaactgtaagtttctctctttcaaaagattggaaaaattttccaccatcattgtatcaaatattcattcttccacactttcttttcttcttctaaggccttggtggtactatttttgaatgaatctcttgttattgtccacaggtctccaaaggattgttcattttcttttggtatattttctctcttttgtacagtctaggtgaattctattaatatgttttcaagttcattgattccctcctctgacatttccattccactattgagttcatccagtgggcttttaaaactttctcttactatgtttttcagttctataatttcaagttagtcatttttataccatatgctattttactaaacttttctagtttttatttttatttgttttgagagcatctgtagttgttggctgaaatatttttacaactgctttaaaatctttgtcaaatagttctaatgcctgtttcttcttgttgttggtgtcagttgattgatttttctcattgaaggtgatttttcttatgatataattttcaactgtgctctgaaaattatatctgttaggccaggagactttgagtcctatttatttatttatttattttattttgagatggagtcttgctctgttgcccaggctggagtgcaatggcatgatctcgttcactgcaacctctgcctcctgggttcaagcaattctcctgcctcagcctccccagtagctgtgattacaggtacctgccaccacgcctagctaatttttgtatttttaatagagatggggtttcaccatgttggccaggttggtctggaactcctgacctcaggtgatccacccgcctcggcttcccaaagtgctgggattacaggcctgagccactgtactggctggtcctatttaaatattaaatattttattttagcatgctgtcaaccggttcagattcaacatgtgggtcttagcctactcttacgggttgtggttccaatagcaatttaacattcagaaactttgcagtgttattttcctctgcttgattcttccagtgcccataaggctcccactgtagtctgctggtggtgcctgtagggaaaaagtgatttttccaggtatggcagtcagatgtctcttgatgtgggaggggtctcactttaagctccctcctctctttctcggtgtctctgagtgagggaggagagttttgggctcacaggatcaaagaggcttccaaagcctgatcacttgatgtgaccaggtcttattcttttctgcctggccgtccctgcgtctgcactggggagaagaatttggcaattttatataaattaagcatccacctaatctatgatccagagttctattcctctgtatctaccaaagataaataaagatttagggatgtgaatgcccttgaaatgacaaatggataaataaactatgacacattcatataatagaatactattcaacaataagaagaaacagatgatgcatgcatgtgacaataaggatgattcttcaatgtattctgctaagtgaaagaagaaaggtccaaaggctatgcatcatgtgattcaatttatgtaatgctggaaaaggcaaaactgtcagaaggaaagaagatcagtggttgtcttggattggacaaggggtttcatatataggagcagcaaaggggaaatttgaggatgatggaacagtttcatataaaactttggtggctgacacagttttacagactcttttcatttgtcaaagaacaatttaccataaaaaatgaatttcattgacataaatttttaaaaatcaaccaggatgtggggaaaagattgagtccccagactgtgatgatgagttaaaccatattacaaatgaattacataagcacagtgagggcatgaggaacaaaagagctgacctaagtcatttcaaaaagcagtgttttaaatggttactgtaagactaaagaaaaaaagaacataaacgaagactgcttttgttggcatatttgtttcccagaagggttggattgagaattctgggctgggcactgtggctcatgcctgaggtgggaggatcgcttgaggccaggagttctagaccagcttggtcaacatagcaagcaagacctcaactctacaaaaaaaataataataattaacatggtgtggtggcagtgcctgcagttccagctacttggaaggctgaggctgcaggatcacttgagctcaggagttctaagctgcagggagctatgactgagccactgcactctaacctgggtgaccgagcaagatcctgtctgtaaaaaaataaataaataaaaagaattctgaaaccactttatttgtatagtagtgttgaataaataagtaaatatatttgaaacaatggaagccaggttctccttattgtaagaagttacaataaggaaagagataagtctaaaatggattaagtgatgctgcattgaagtttgagaatcaatatgaactcatgagtgtgcatgtatgtgtgtgtgtgaatatatgaaagtagatgcagaagtaaatgtagatgtatgtatacatgagttagcatatatatctccgagccctatccactgataggaactagatgctctgacaccccgtggcaatgagcatgccttctcttcagctcgtggtttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggcccagctcgtggtttttaattaccattctccaacaaaaggaaaacatggttctttgcaggtgtggttaattccaggcctgtggcagggaagcttcacaaagattctgtaacatcttgtagtgccagtaggaaggaagtgctaaaataaaacaaaacaaattaagccagcaaaggaaaagcaaaatggtttgagggagtgtcaaaagagcacaggagtaaacctaaaagggctctaagcctaaagaacaatgaccttgcagtcatggaaaagaatgagatcatgccctttgcagggacatggatgaagctggaagccatcatcctcagcaaactaacacaggaacagaaaaccaaacagcacatgttctcactcataagtgggagttgaacaatgagaacacatggacacagggaggggaacatcacacacccggcgcctgtcagtgggtgggggcaaggagagggagagcattacaacaaatacgtaatgcatgcggggctaaaacctagatgacgggttgatggttcagcaaaccaccatggcacatatatacctatgtaacaaacctgcacattctgcacatgaatcctcgaacttaaaagtaaaatttaaaaaataaataaataaataagagcaatgaccaaagcattccccatgaacaacttggactaaaatgtaatgatcgtgttggaatataatccaaagaataaaataaatgcccaggaatccatccaatgtaaatggataactgaatacataaattaataaagaagtgatcattttccctttacataaaaattccagtcagtaagcgcagaagaaattggggatattctaaaaacaccattagaacactacaggtacagttgtcataggcaagatacattggtgaattttaagtagtgggcaaattttaagcagacagtatttacaatattcacaatagccaagacatggaatcaacctaagtgttcatcaatggatgaatgaataaagaaaaggtggtatatgtacacgatggaacactgtttggcctgataaataaatcctgtcatttgtgacaacatgaataaacctaggtgatattatacaaagtgaaataagtcagatacagaaagacaaatactgcatgatctcacttatacatgaaatctaaaaagttgaattcatagaagcagagagtagaatagtggttatcagaggctggcgtgtgggtagaactgagaaaatgttggtcaaaggtataaaatttcagttagatgggaggaataagtttaagagatcgcttgtactttattgtgactacagttaataacagtatataatatgcttgaaaattgctgagagtagattttaagtgtgctaatcataaaaatatgaggtaatatatattagttagcttgattttttagccatttcacaatatctacgtatatcaaaatgttttataaatgataaatatatataatttttgttcctcaattataaacagagataaaaaagtaaaatcattataacagaaacacagaatacctttgatggactcatcagtagactaagcacagccaaggaaagaatcaatgagttttaagaaatgtaatagaaactttcaagactgaaatgcatagcgaaaaagcaattaaaacaatggaacaaattatccaagaactatgggacaattgcaaaagatgtaacatatacataatggtaatatgagaaggagaaataagagatatgggaacagagaaaatttttgagacaataatggctgagaattccccaaattaatgtcagacaccaagccacaaatccaggaagctcagggaatgccaagtagaatatatgctgagaaatctacatgtaagcatgtcatacccaagctgcagaaattaaaagacaagggggaagtattgaaagaagtcagagggtaaaaaccaccttatctattgggaagcaaggataaaaattacatctgactttagaaaccatgcaagcaagaaaacagtggagtgaaatatttaaggtgcttataggaataacgaaaaagcctaggattccacactcagagtaattatctttcaaaagttacagagaaataaataacttttatagccaaacaaaaatgagggagtttgcctagcaggatatgtttaaaaagttgttcagagagaaggaaaatgacataggttaaaaactttaatctatataaagaaaggaagagtattagggaaggaataaataaagatgaaatgaagcctttcatttttctttttcttaatggatctaacagataatagtttgttcaaagtaataatagtaaacagtgaattgtgtggatgtagcacagagataaatgaaatgaatgacagcaattttataatgagtaggaaggagaaactgtaaacactctattttaaaacctttaaaatgatttagcatatttggagacgaacttggattgttgtaaatgtatgctgcaaactctagggcaatcgctgaaaaacattttaaaagagtaaaaattgagtcagacaaaatgctcaactaaaaccagatgaggcagaaaaagaatgggagacaaaaaaaaaaaaaaaaaaaagaaagaagcagaaacaaagatatttaatagaaaacagtaagaaacttgttagatattaatccaattatatcagtaatccctttaaatgtcaatggtctaaatacatcaattaaaatagtgtccgagtgaagaagaaaataagacgcaactatatgttgtctaccagaaactcattttaactataaaaacacatatagataaaagtaatagagtagagaaacatatgcatgctaacgctaattaaaagaaaactgtggtagctatattaatttcagaaggaacagacttcagagcaaggaaaataatcagggataaaaatgtacatcacatcatgataaaggggttccatcacccaaacatcacaattcttagtgtatgtgcacctaaaaagtgtcaaaatacatgaggcaaaatattattaaattttgaggacaaatagatgggtctattcttataggtggagacttaaatattcttctatcagtaattgacagacccagcagggaggaaatccataagaacatggttgaactgaacaacaccatcaatcaactggatctaattgacacttatagaatacttcattcaacaacagcagaatacacagtcccctcaattttacatgcttacattcatgaaatagatcacattctggactataaaacataccttgacaaatttaaaagagtaaatgaaaacaaagtgatacaataactatattagcttttcacagcactcaattaattagtggatgcaggcactgggtatcattagttggtgacatcaaaacagtgaaaaccagccacaatgtgaaaggccacaacataaacagtgaactttcaaaaggactgaccctgagtttgactgagcctctggatcccactgttatttggtagaaaatagggcagggatacatgctgagctacataaccagtttgaaatccacgcattagaagactctacaggtaaaagagcccagactcaacagacaaattgtatattaaaaaaagaaaaggatggaggagtaatctcaagattgactgaaagataagtatataccatagcaagctggcaaaatagacataactgtactatagtgactactatcctcacttggtaagattatgaagaaaggcaaggaaatgtctgttacaaaaatcaatataacatagttacatttacaggaagcaatgtaatttggctggggcatgatggagggcttttgggtttgttgcaaagttctgttttttgtttgtttttgttttttttctgagacggagtctcactctgtcacccaggctggagtgcagtggcgcgatctcggctcactgcaagctccgcctcccgggttcacgccattctcccgcctcagcctcctgagtagctgggactacaggtgcccaccaccatgcccggctaattttttatatttttttagtagagacggggtttcaccattcacaggatggtctcgatctcctgacctcatgatccgcccgccttggcctcccaaagtgctgggattataggcgtgagtcaccgcgcccggccaaagttctgtttcttgacctgggtagttgtgacaaagacatttgccttataatcataattaactaatctctacatttttttgggtctggttttctgtttcatcttaaaacaaaaagataaataataaataatgcatacataaatccaaggaaaaaagttaatggggcatgtgttctggaaatcgagggaagaaaacacatatggagcggggagcagagtctcctgtctctgtgtttttctgcacaaatcacaccccaccccacccaccacccagtggccatcagcagggatagtccctcacaataagtttctctagcttccagcttgttcaactgtagagggagcaatggtcagatcctacatgttctgtcccttgttgagtgtgttttggggtctttgtgccttgtgatattctgaattctctctctataatgctgaattaatttttttctctatttttagcatcttattgtttgcctataagaattgccaagtcattcaatcttaaaaccatcaagttattacatctgaagatttctgagtcaatctgagaagcatcattatcttatccttattctgtgctcactgtgcaaatgctcggctataccgattattgcctaagcagtatccattatctttaaaaaggacaaacaaaaattaatctcaatttggaatttcaactgttctgatagatgctatttcttcaatgagctggaactgtagaatcgaatcctctaaggaagcctcaggtacatgagtctcgcagctgcagatacaaccctcttcattcatggtcaaacaagttaaggctggctctagaaatgaacattcctttgcacaattgctagaggttcacatttatgttttctgtgtattgatcactaaaatagaaaatcggtgccatcatatcagagaatcactaagtcatgggttttgaatatctacagaatcatggaatctgagatctgctgagtcatgatatttgaaaattacgtttgcacacaagccttgatttgcattttcaggatattaaaatcaaaactgcagaatcccatagtcattctctttgaaaacttcagctttgattcaaacattctgcagctgccaattcataaattctgagaaattaagagtcagattgagattgtacaatagcagacacatattccattactaaaggaagtccctggagggactaagatattcaaagtggtgagagaaagaaatactaataatttgttctatgttagctacatatcactacttcatataggtcctccactgtatgtggtattatccccatgttagaactgaggaaaccaaagttgaggatgatttgatatcaagtaagttcataggttccagagctaggacttcaactgcacatctatcagaagccttgattgacaatcatgaaatcatggagagagtgagaggatcatggaaaagtcagcctctgtctggccagggtcccatcccagctgcctgcaaagtcttctaatcacttgtacccatgctccattcaggcagaataacaagaccagaccttcagctagctcatagggtttgcaaatgatttttgctgatttatttgatgactaaagtacccacacatccttactcttcccctgcttgaattctggggctattctgggaaagggtctaggagtggatcccaaatttgtgggtatgcaagttacaatcatctgctgatcttcagaaactccccaaaccctggccacatccagacaagttaaaccacaatctctggggaatggaactccaacatgggcattttttaagcccttcagatgattgcaatgggaagaaaagtttgagaacaatgggcttatcctgttattcctgaaaagcagtgatttcatatatgaatcacgtaagggaggtttttaaaaagcactgaatcccaggcccagaacaatggggttagaatctctaggaggctgggcatgggtgattaacaaaagctcctcatgctgatcggtgaaatttctggaaggtcaaggcaggagctccttgaatggtttaatcctttccatatggaactctgcaaactaggtttcagggctttcctccctgttagtcaaaaaatcatctgcttttgcttaactagtgagggttgggtttctgtcacttgcaagttctggaattgaccaagcatcctggtttgcccggtactctcctggtttcagctctacaaatcccacataccaggaaacccttcggtcccagacacatctggatggtttgtcactctacttgtaatcaaagtattatggttattttcttactagatttattgagatgtcctctctttatccttctaaccagtgctcataaaacaaccactaccaagattaactacctggaaccctgagtacatgccccacatatatcctgagatgtcatcccacccatcacaggctcccattctccctaaacaactccttcttcactcctgatccttacacaacacaacccctgcaccctaattcactgacattcctaagtcagaaccacactctcaactttacctccacaagccatgtgagggggtacatggctaccccaccatgtgtggctcatagccattgaaaactgaagcatgaagccctccctctagctatatgttcttttttttttttttttttgagacggagtctcgctctgtcgcccagggtggagtgcagtggcatgatctcggctcactgcaagctctgcctcccgggttcatgccattctcctgcctcagcctcctgagtagctgggactacaggcgcccaccaccacgccaagctaattttttgtattttcaatagagacggggtttcaccttgctagccaggatggtctcgatctcctgacctcgtgatccacccacctcggcctcccaaagtgctgggattacgggtgtgagccactgcgcccagcctagctatatgttcttatgcttgactgtgtcttcttgatcaaagctggagtccaccttctagaaagttaagaaatcaaagcaatgattcattggggcttgcttgcttcatggaacagattttctcaccccacctcacgtaagtgggaatatattttaaggattcatttaagaaaatggaaaacaggaatcttaaccatggggtaggtcttcacaagaactcagagaaaactgaacaaccaagcttcacttccaggtcaggaagaccaggccggccaccagggagacttgagtgggatggcatcctgagtgttaatgctggagactgacatcctcagcagtgggagtcccaggacctccactccagggttccgctggcagatcactcagctctatgctgtctgtccattcctccctgtgcggagccaccttctgtttgcctaccaaggagctcattgctaccaaacttctcacttcaaattccagacaggtagaacctaccttgctcaactgatatccctaaccctgccagggaaaatctttccattccagaccacaccttagacccctgttagtgtggttaccttcagcccatcaccagactctagtccatcagctatgaactgggagtgggggtcatgacatgagtacctaaggctgtcctcttagaaaggtctatatgggcacaaccatgggaaaccctgtaatgggcatgcctaataagataaaatcttagcactggatgagtccatgtggataacagaatgcaactctagccttttagggatgaagataaggtgctatatattgaaaagagtcaaaaatatttgaccttggacctcagcttctttttaccagtagaccttgtgcaatttacatcacctctcttgatcctatctgtaaaatttcagatgagaatgcttgcctattgtgtttgtcatgaagattaatttttatagtctccataagcacctggcatacaatagggccttcataactactagtttccagtgtggacttaggcacttcattcccctgtctctttgtcctcagccatcacgatgcatcatgacacagcacaacaagggctcttcaatcaactctcagttctactttggatggaacgcaagctggttggatgtgggcacccagcagccctccatcaatctccagtctcttgtgtaatccaagcacatgatttgagatcctctactttaaccccagatcatcaatctcagggctaatggaatatagaaaaacgcttttccctggaagattactaaaaggtcacagtcttgttttcccctgatagattttctgtcatattacatagtaatgttccactgggtggcaagattactgtcgtcctgagaataatggtcatctctgtagctgtattatccaactctccaactgggctgtgaatttctccacagatgacttttagtcactagcatccaatttataactggttttgttttctaaaattacagatggactgggcgcagtggctcacgcctgtaatcccagcactttgggaaggtgaaagggtggatcacctgaggtcaggagtttgagaccagcctggtgccaacatggtaacaccccgattctactaaaaaattacaaaaattaggcaggcgtggtggggcacacctgtaatcccagctacttgggaggctgagacaggagaattgcttgaacccaggaggcagaggttgcagtgagctgagattgtgccagcctgggtgacagagcaagactctgtctcaaaaaaaaaaaaaaattacagatgaacaaaattaactagactatatgccccagtttatggcacacttaccatcagtctgtacaaagttcccttttttctttcttttcttccctcctttctttccctcgctccctcccttccttcctccctccctcccttctcctcctcctatttcttgctctctcttttctttctctccttccatcctttccttccttcttttctttctgttagttatttaatccatcattccttttcccattccactccctaccctgaccttcacaatgtacatacattctatctaaagagaatcttttcaaaccatttttatatattcatgtaaatatatgtaggatatagagtagttgtgtgttcatgtgattaatgtaaataatgctttgtttattagtcacacatatgtggatatatataaatctaattccttacatggaccactgttgagatctaaacagtgcaacacacatccttatccatttctgtaaggaaggctttcagattaaccccagctctttgctctcataaccaaggctgaatgcataattttgtagaggtctctctgtgcttaccactgagattttctttgtgggatacatcctggagaagaattcccaggttaggtggcatacacatacataatttttaatgattgccctccagaatggcttcactggttttcaatttccaaagtaaacaaaggtttccatttctccacatcctcactaggatttaacatgatcaaattttctaattttgccactctgatgtcagtacggcaatatgatgttaggagttgcatgtctcagatggtgaggttaagcatacatgcatcggttggcaggtattctgtctggttttccacctgaagagctttctcatgtccatggtccattctttttctattggatggttgccttttccatactgatttgcagaagtactttgtgtgttttaggcacttaaaatagtagacctccatctgttatctgtatgttaactttaccttggctacacagaaataaattctgagtgagtgatgtccatcaatccttcctttccgtgtgtgtgattcttggatcttgttaaggaggatttatccagctgagttcacaaaggaattctgcatcttcacccgttagtttagcagatttactttctttatagaattttaactttttcaatactatttttgttcacatgtaaggtaggaatccagtttcatttcactcagtgggcactcagtctgtttatgcaacaccatttatgcagtaataaacaaattcttgtgaatggtaatgcaaccaccatcatacactgtatccctgaatatatgggtggctgtgcctgcactgcccaggctattctattactcctgttctagtagcacattattttttattacaatagttttgtactatgtgttattttaaggtaggataactgtccaaacttgtgctttattttcagaatttgtttagtaatttacaaacttctagagccattgtttcaattttccttaaagaagattactataaaaatgaagcctggttattaaaaggaagattattatgcagagtgctatctggcaaagttatacccaaaaattaaaatgcaaataagtggaatatcaatgaaaggaattgacataaatgtactagatttttttaattataagaaacttcttttaaacatgacagattaagcctatatttaaaatttcactgaaatcagaataaagagaaaaagtaaagcatcagtggaaaaggacagagcaaataagatgatatgagatgttacaaacttttaaaagtgagaagctccattagtttactttcacacttttaaaagtttgtaacatctcttaatgttacaaactaagtccacggaaagctaagtgcctgtggggagtgaggccaaggaataaagcaggatgcttttaaaaagcacgcagaaaaaaattcttggaaataaaaaagtgtgatgggaaaaacaaaatatttgattgaagggccagaggatagagtggaattgttctctcagaaagttaaagcaaaacaacaaatgaagtataagggaaaagaatacctctggaagggccaatatccaaataattacacttctgaaaggcaaggacagataaaaaggaagaaaaatgacaatgaaataatactagaaagtttctcagattctcagggcataagcctccagattgaaaggtcccactgcacacagtgtaagatgtggaatcgcgtgaaactaaccactgtggtattttggaatatcaggggaagaggcaacattatggattttaaaaagacgaataaaaaaggtgactcgtggaaatgacctcagacaataaacaatgccttgaccttcctactaaagaaaagatatatccaatccagacttctgtataacagtcagtcaatctcatatggggacacagtgaagatgctttcagctaggcctcaaagcgtgtgattgccaattcttgtgcacgcttccttaaaagtatttgctatactaaaatgtggcagtaatagaagaaagaggtaagtatgggaccaaaaaaatttcagaaaacaatcaaagaagaatccccagatgatgaaaagagaaaactctaggatgacagttggatgtttcaaccacaagagcacaagtaaaccagattaagaattccatttgaagagtatctgggaaaaaaatgggatattattaatggcttggaagtactctcctcttagagagtgaagtatttattttatatacatttgaaaaacaatttgatttaaacatttttgacaacaattttatgaacagctatagaggactaaatataaaattcttaatggatacaaagatacagttagatagatgaaataagttccagcatttgacaatacagtagaaaaattatagttaacaataatttattacatatttcaaaataactgaaagatttataatactcccaacatgcacaaaaaagataaatggttggggtaatggatgtcccgattgccctgatttgatcattacacattgtatacaggtacaaaatgtcacatgtacctcaaaatatgtccaactattatacaccaagttaaaaaaaactagatgaagtaaaaaattttatgaaaaagcttaaagtaacaaatttggtaccaaaagaaagaaaaatgttacaaaggccaatagcaaataaaaatatttaaatggtgatcaaattttctccttgcccagaagctgccaacccagacaatattacatgggtaaattctaccaaactgtcaaagaatgtgtaacccatattttaaataatctgttatggaaaacagaacttgaagatgagcttccaaactcatttaatgaagtcagttcataaccttgctaccaaaacagagcaagtaaattacaagcaaagaaaatgacagaccgatttcatgggtgaacatacactcagaatcagaaatggaataatggagtaggctaattaaacccgagtgtatttttaaattaatgaaacaaaatgattgtgaagcatttataccaggaaagcaagaatgccatcagaaatgattcaacatcatattattttattatcagaaaaatctaccagtgtaatttttttacgagtgcagataaagaagaaacttacatggtttttttctcaatgcattcttacaaacatctttacagttaaatgctatttgcattggaaacccatagaaaaagagactcaatagacaagctgtaagaacaacaaagagaatctggagacatttccagatccaagaccagcatataaaaatgaatggtatcccttgaaaccagtaataactgttaagaaaatgtaatagacagtaagactcaatttacaatagaaacaaaatctctaaaatatttagtaaaatccaacaaagaaattcatgcaatctgtatggaaaagaaaatcacactattaaataactgctcttttttcattaaactttaaaaatgttggcataattttagattcatatgtaattgtaagaaagaatatggagatatgttgtgtagcctttgcctagtttctcccaatggtaacatctcaaaagtatatattaccccaattttacatgcatgtactcatttgtgtgtgtgtgttttgttctgtgcaattttatcacatgcataagttatgcatcctccaccacagtcaagatacaggacagttccatcactacaaggctcccccatactgtccttttacagccacacccacctgtccacccccaacctccatcccttgcccttggcacctgctaatctgttctctatttctataattttgccatctaaaggataaaatgtaaatggaattatacactatgtactcttttaggattgttttttcttaaactcagcataattcccttaagatctgtccaagctgttttgtgtttatcaatgtcattctttttcattgctaagtagtcatccactgtagtgatatatcgcagttatatttaaccattttcccattgatggatgtttgggttgtttccagtttggggctattaaaagtaaagtaactatgaacatgtgtctacaggtttttgtgtgaacatgagttttcatttatctgggatagatgcccaggagtgcaagtgctgtgtctgtactaatcatacatttacttttataagaaattgccaaactattttctagagtacctatgccattttacattaccaccagcaataagggctagtttttaatataacagcacaattaagggtatgttaataaacctgcaaacattatgaaagggtacaaaggtaaaagtgcctcttacctcatttccaatcactacaattaatgactgccaacagttatttaattggcttttagaactgttttacccaaatgagataatattctatgtttcataaactttgttaatatgtagttttttgtgtgtattcacttatctgtgtgtacatatttatgtccctcttttaaggttacaaagcattctagttcatgggtatgccatcctttatccacttgtctcttcatgatgggtgcattaggccatttttgcattgctataaacaaatacctgaggcgggataatttatgaagaaaagaagtttatttggctcacagttctgcaggctgtacaggaagtgtggtgctggcatcttcttggtttctggtgaggcctcaggaagcttacagtcatggcacaaggcaaaggggaagctggtgtttcacatggcaagggcagcagctagagagggaggggagatgctacactcttttggatcctgcaagaattcactcactattgtgaagacagcatcaagccatgagggttttgcccgcaggacccaaacacctctcaccaggcaccacctccaacactggggattacatttcaacatgagatctagaggggacatacattcaaaccacatcaatgggctttaggaaatgtgttgttcttttttgttaatgtaaacaaaactgtaataaatattttaacatatatcttaaatgtatatattactcactgtattctgtaggctaatttataaaattattgtgttaaataggatgcaaattcaaattttcatgtatattctcaattcctctcctaacaaccgtgcatgtgagtgcaccttttcttaggcccctcagactttggccttcatcaaaattcttcatctttccttatttgatgggctaaatgtggaatctcaacttcaagtcaaagcagcactgaaagagcctgtgctgaaggctccctcttctctaatcacatagataaaatatgcatgggaataaaacctaaaaatgtgtaaccaggctgtaaaacaggaaaagcatatctgtggctgagaaatctagaaaagcagaaggtgcagagctgatggaagcctctggcacccaggaagaatgggaagtgagccatctcagtgcttaaaatgacctcctgcccccacagcctcctgctcttgaagggtggggagaagctgctgcttcctgggacagctgggaagtgtgaaccccaattgggagcactgaaccgtgacatggacctggcctctgctgacctggggatggtatatgcaatgcccccaggttcacagagaaacacacactggactcaataagatgaaatgtggtttcggactgagggtccaaggatgtagatattgtcagttgcaaaattgttaggtatagtagaatagggaggagagggacatggaaaataaagttcccaaacacataaggaattcttatgctaagaaagtctagcctcttcccacaaaatgccaataaataaagcatattttcactgaaaaaactaatgaaaataataacatcataaaaataggcagcaggggcaactagttctggaaccaaatggaatgacagagttctccccatttctccagctaagccctgaacattatacagaaaacaaacatcagatgctgaaggggagagagaaaaagggagaccaactagggatgtcaggacagaaaaataactcagcagcgagctccctgggatttatttctgccttgcatattccaaacactgccaacaggtacagacaaaacaaaaagtctcaacaaaagcctgcttcccttggctaaggaccaggaaagaggcaacctagaaacaaaacaggtggaaatgaaataagattaagtggactcaaacaattaaaaataataaaagtgaaaacatatagacaatgacatttataaacctcaatggacagaatgaatacattttagatgattaatgaattcaaagtaaaagtgaggatcaccgatcatagatcatagtgaggaccttctaaacagggaaatttttgaaagtgaaaagggcatagtaatttcacagggacaacatgcagggaccaaactatcccatgcaaatagggaaatacagtccacacacccaccaccaacctcagagttagagacaaataaaagttaatgaaaggacagtgattagaaagcaaaggaaaagtaaaagtttccaacataaatttggctggaatttcagaataagaaaccaaaggaaatggcagaaaagcaattttacaacagagaattcagatattttgtaaggtaagggagctttcaaattaaaattgactaggagtatcaagtgagataaataaaaacatacacaccaaggcatgtcttagtgaacccaaagatggaaaaaaaaatcttaaaagcttttgaagagaaaagataaggtagctacctaggaatgacagagaatggtcatagagtttgcaaaagcaattgtcagaacattgtgaataatatcttcaaaaggactgaatataaacaagtatcaaacgagaattttatatacagattaaaaaatttttcaagggtttttggaagatggtacaagtagcagtattgtttttgaatttctctaggcgcccccatgaacacacagaaatggagacagcaaaacacaaattcagtagctatctcctacggtaaagctagataacccagtgtccctaagagctcaaaacacaagaggagagatatgaaccactgacctccaaaagacatgcacggctctggcagaagagagaacaatggttgtctgacaggcctgaggccttcagtatgactgactagaaggcaggcctgactttaaggccctgccaccagtgcccagaaggggctctcactgggaagttagtgattgatcagcagttgctgtctagaaattcttaatgagttcatctttaaacttgtccaatagtacatggagcatgcaccaggggtttggagactcagcacctgtgtggccctgggtctcactgcctccctgcctctgcataatgtgttctcagccctctgcttccctgcctctgcccaaggacctcagccacgcttcatctcctgtggggacctggcaccaggaggcctggggttgggcatgtgcgccccaatgaagggaactgtggattggggctttggggcctataaaggtttgcactcaccccacaggtattcctgggctcaagtgagtacaacattaaacagcaaataaaagtcaccagaacaggttcggagagagatcacagaaaaaagggaaaacattttttctttcttaatttgaacaagggttttacatttttgttttacattgggtctcacaaaaattacatggcaagcccagtgtgatggttgatattgagtgtcaactcgattggattgaaggatgcaaagtattgttcctgggtgtgtctgcgagggtgttgccaaaagagattaacatttgagtcagtgcactgggagaggtggacccacctaccctcaatctgcatgggcaccatctaattggctgccagcacagctagaataaatcaggcagaatttggaaggacttagctttctgagtcttctggccttcatccttctcctgtgctggatgcttcctgccctccaacatcagactccaagttcttcggcttttcaactcttggacttacaccagtgatttgccaggggctcttgggccttcagccacagactgaaggctgcactgtcggcttccctacttttgaggttttgggactaggactggcttctttgctcctcagcttgcagacggccattgtgggatttcaccttgtgatcatgtgaatcaatactccttaataaactccccttcatatatacatctatcctattaattctgtctctctagggaaccctgactaatacaccctgccaatggctactttctggaaatccccagaaggccaacttttgaaagcagctggaattgggaaggatttgctcattcttaaagccagggagagccagaatatctcagaaaggacagcagagcagacaaggtcctgaaaacgctcagtaataataagcaaacctcccttcaggacaaagccccaaaataggaggaaactggaagggcagagttcaaattgaactggatggagataacaatagagaaaacgggaattaaaatccagttatgactggggaggcgaatagagtcagactcctagaaagcaaaatgccatgttttcgaacactttctcaaaacaacaggtcacttgtgttagcagtcacaattcaatcagagaagcagcaccactagcatgtctgtgtgcgtgtttgtgtgcatgattgtgtaacagcaaatcttaggagctgcttcaccagcctttgagaagctgttatatttgcctctggagctgcagtctggagttcacaccgaggcagttagccaggaagggaagatgtctgtacagtggggaagagcaacagcaagcaggaactcacaagcacatgttggaaccttgtgaggatgggatgacatctgggtcagacttgctgcccccgacattagtggaagtggtatcctgcagaagctgtggctctgtgtcatggagctaaacacatgcttggcccagaagatgcagaagctgaaggaagatccagtggaggatgaagcccagccactgcttcacaccaagaaagtgagtcagcagatcagttccaatacctgtaagcttcaaaatggctggtgttccaggtcttccttccaaagctcccccaaaaacctctctagtcgagccaaaaaaatacagtgaagggaattctgaaaaacagtttggccttgtcaaataggcacattacaaaactaccacagtactcgagagctgtgatacaagaaacgcttctaaatcatgcctccattctgaaaatttagaactataatgtcatgtaaagatagtaacagggaaataaatcaaaggaatgcaaacattctatggaaaaaatgttaaatgcttgccagaacgacattttgatgaaaggattaaaagtgtaccaacagagggatacactttgattgtttatagaaatctatatcctataacttttaaagtaattgtctaagaaaatagatggaaaaaacaaaagaacagtgtaaattaaatgatagaattcaggggccaggcgtggtggctcacgcctgtaatcccagcactttgggaggccaaggaaggtggatcatgaggtcaggagatcgagaccatcctggctaacacggtgaaaccctgtctctattaaaaatacaaaaaattaactgggcatggtggtgggcacctgtagtcccagctacttgggaggctgaggcaggagaatggcatgaacccgggaggcggagcttgcagtgagccgagatggcgccaccgcactccagcctgggcgacagagtgagactctgtctcaaaaaaaaaaaaaaaaaaaaaaaaaaagatagaattcagggaaaaataaacttaaaaacagaatcttataaataaacacaacagaaatgcaaataatcacaacatagtgtcttaagaaaagtggaaaaagaggacagtttaaaaaaaattttttaaagatatgccaagaatttgagtgaaagtgataatataaaagactaccaccccaaccacaaaaaacacaacatacaggtccaagaagaaatcccaaataagggaagaaaacaagtactaagaatggcattttgttgaaaaaaatattttataaacaagagatttgaaacaatgaaataataaattgcatacctgggaaagtcaactcagaacaaccaacaccaaaacacagttaaaaagaaaatgtcctttctctttctttttaaatatttaggggaaaaaaaggaaaaaagtgatgtaaaacaaagagaaaattagcttatcagactttcaagagcagcattttgtgccagaataaaaggaacattataaagatactcaactttttaaaaaatgagctgaggattttatatcctaacaaactgactttcaagtataaagggagcaaactgtcatccatatggaataacatacagaatattttccatgggccctttcttcataatgtactgagaatgaggtttaaataatgaacattactggagagacagtggcataaagactggctgagcattaaatatatatttccatggagagctaagacgaaatctgcgatatgagggagagtagagcatgtaatagttatatactttgacaatgggtggaaagcagaattttctaaaaagggaaagagaaaatggaaaaagcatatgcaaaacaatttttaaatgcttctctataatcatgttggtgacaatgttgctattgctactctccttatgttttgcttgaaatgtgagatgaagaaaataagcaatacatgtgttatttgaatccccagggcccttcagaaccaagacttttagaagctgcaagtgtgaaatagaaaagattaagtaagcactctgaaatcctaaatttgaactcataggatatttttcatagatagataggtatcctaaatctgtccactgacgaggcccaaaaataacatttgcaactaaaaggtaccagagtttcttagagaaatagttgaaatagctaattctaggtctggggtgggaaatatagaaaataaacagaggagctcagaatatcatcgtaccacagagagcaagggcaccagccaagaccagcaggattgcgctaaaggaacttgggagtcaacctgtagaacaggcactcaccaaaccatggggcaacttgaggatcagtaaggataacgaccgtaatcaaaacacaccaaacagggttctctgtgagctcataatgatacactgtattagtccagatccaccaatatagaattaaatgtgaaaggattttattggaggaaaagaccctgtgggaaaaaagtagggcgcatgctagagaagtctggagatctatcagactgcaatgtgtatctgatcccaagtgaaggagggagggaggaaacatggcattgaagagtcttggactgccaggaagaaaggttcagcaggagcattgagagcccttgagcccaagttggttgtcagcagagttcagcatctcttaggaacagttttcctgggaacaagaagcaggatgttgtgagacatggcctatcacaaatactgggatggactttgtagctccatagctgcgactcttgttgaattatgctatctgaagttggcagttggcatggacacctggacacacacacacacacccctacctgattagttaactttataggacactaagggaccaggtatctgtgttaaaatctcataaataaagggaacatgtatacttcctttcctgtgcaaactaccactcagaagctaatggcagatgtgcggatatctttaaaggaagagggaatgatagaactggagcattgccactttgcaacacctacaaatcaaacaaatctaagtactagcttctaagaatctattgctactaattacaaaaaaagaaagataaggccaggcatagtggctcatgcctgtaatcctagcactttgggaggccaaggtgggcagatcacctgagatcaggagtttgagattgcctggccaacatggtgaaacctcatctctaccaaaaatacaaaaattagccggggatggtgacgggtgcccataatcccagttacttgggaggctgaggcaggagaatcacttgaacccaggaggcggaggctgcagtgagccaagatcgtgccattgcactccagcctgggcaacgagagcgaaactccgtctcaaaaaaaagaaagaaagaaagataagtatatattgtgtgcctcttgacaatgaacacaatgaacacaacagcaccgatggtgtaatcttcctccccaaagtgaaatctgaatcagattaagtttatagattcaactactaatctgcaggaaatctagaggataaatgaaacattaaactctaccatgggaatgcaatcagcagaatcagcagaatcttgactctacaggattggtttctaaaatgaaaaaaaaatctttcagtttaggaagatacagagagaaatttttaaaaatcaggctaacctaaactcactgtttagggctcctcaactagataatgaaataataataaagagtaataagggtatttccagaaaagctagagcaggagttagtcttgttaggggaggatggtgcttgtcttgggaaggtggcctgaaccttctgtggttgctgccaagttctctctaatttatgggtggagttaaagggacatttattttgtaataactcatcaagtggtacacttggtctaaactgctttccgttttcctttattctgacaaaaaatacacaattcaaatggaaaataaagacatttatagacatacgatggcagagaacttaccatataaagagactcactaaaaagtaaagatatatgtttatagaaagagtaaacgtagggggaaagagagtgaattaagaaaccatatgttgataaaattaattaactatgcctatataaattatactggtaatcttaagtaaatagcagatataaaaagtaactttccagctgggtgcggtgcctcacacctgtaatcctaacactttgggaggccaaggtgggtggatggcctgagctcaggagtttgaaaccagcctgggcaacacggtgaaacccgcctctagtaaaatacaaaaaattagccggcaccttggcgtgcacctgtaatcccaggtactcgggaggctaaggcaggagaaatgctagaacctgggaggtggaggtttaagtgagccgagatcacgccactgcattttagcccgggtgacagagtgagactccatctcaaaaaaaaaaaaaaaaacggaaaagtaactttccagatctagttccagggaagatggggtaaacacaccctttcctactgaatacaacctataaaacctgaacagaatgcataggcagcaatttgggaactctgcaaaataaacatcagtaggcagatcaaaggaagaaaccatcagaataccatcaaaatacacatgaactgctggcgagtttaatctttttttccttgcgttatttcccagtctgaattcaacgcagttagaaaaccagaactaagcactgaggtgcggaaatagaaacaacagaaactctctagctcaggctcaaagaccagaaaagggaaatgtagagaaagagagagaaatcccccattttttctccccatttcctcagttcttgcaccctagccccaggcaattgtataatgtgggtagcaggaagagcaaagacagccagcaatggaaaaactgaaggagttaagtatctgagagagggaatctccctctagcatttggtgtggctatagttccaagagggtagagtcaatcccaggtgtttccatttttctttctgttctgcactgtatgggcccggtatagactgtaattatggaacagagcagtttttggtcagaggactgaaaaagagaaggtcaggaaaccagaaagtactggagagatagcagagcgcaagcttgggaaagtgaccccataacactgtttatcagctcaaggactcacctctgacctgtacattcacggtcctgatcataatcagcacactaaagactctgagaactgagatagccagtagacctttgctcattttcctaactgaccactaagtaagtggtacaggtctaggacaaatgtgaatattactgaaaggcttcgaaaactggcctgatatgggaaccacagcctacagaaggctaaaacataaatagtaacactttttataggatttgaacaaaatttaaacaagaaggggctcacaacataatattcaaaatgtgcagtataaaatccaaaattatattgcatttgaagaataaaacaaaaaaaccttcaactttcattagaaaagacaagcaacagacatcaatgatgagatgttggcattatctaacacatcttcaaagtggtattaaaaagtgctcagataagcaaacttctgaaacttatgacttgatttttctgttcatatgtttccatggaaaaaattacaaaatgaagccttctgacagggaaatatcaagttagatgacttccctggttaatttttctaataacttttggagaaaatatatacataacacaaagcttacacactttcagaatataaaaaatggggaataattcccaactcattttatgaggccagcataatcttggtaccaaaatcttacaagcttattattaaaataagaaaatatgaggcatgtttcctttgataaagataaatgtaaagttctaaggagataattgtgaaacaaattcaacaatacttttaaaaataataaccaaatgtgttacttttcagaattgcaaaatgggaaggaatgggtaaacagtgtgtctgtaactcattcctccagcctctgagacagttttaattgtgacccaaactcctagcaaaggacggctgatgaaacacaccagctacaccgtaagtgaaacttcagcaagggttgctaggtacagactatggatccaggagcactttcaggacaaaacacctagcttgtctataatatttgttataaatagatctgcaatttacgagctgcagttctgcattggacaatagaagttagtcatgtagccagtacagggctgcctgccttggaggatataaaagctgagtgataactaaacccagttgctttcttgcactaacttgtcctctatgcagtttgcactcctcactctgaaggcaaaattcactctgagtagaaaaaggagacacagagagctgagtgtgaagagctcagggtctcccagatattgaagtggtgcatgttgctgctcttgcttgcatcttttactaatcattagtaaagcttggtgctgaacaagacttgaatttcatataaatctgatcaataatgtagatctttgtattgtgtgtagggttaactcaacaataaaaagtcattgcaattcaaaatactaatgaaaaaaggataaaaacaatctcatcttaatagacactttacaaagatgtaactctaccctcatttgtgatttttaaggattgttatctgagtaggaatagaagggaatttcctccttgtgaaaaggtttatctaaaaaataaaataacaaaacagaacaacaaaaaactatagctaacattttacttagtggctgttgtgggttgaattatgtctccaacaaaagatatgttgaaatcctagcccctaatacctatgaatgtgactttatttagaaatagggtctttgcagatgcaatcaaattaagatgaggacattaagttggggcctaatccaatatgactggtgtccttataagaagagggaaatttgaacacagacacacagggagaacaacaatggaagatgaaggcagagatgggagagacatagctgccagccaacaaacatccatgatggccaaccaccaccagaaactgtgaagagacgaggaaagttctccccagagtctcagcaggggcatgctgacatcatgatttcagactcctagcctccagaactgtaagacaatacatttatatgttttaagccaccgagttttcagtactttgttatggaagtgctaggaaacgaatatagtggtgaattattgaaggccttctgcctgagaccagaaatgagacaaagcagtatgctatgacttctactcagtattgaatttgatggtcccagctagtgtcatagtgagtgaaacaggccaagaaaaagaaatagatgaataaggattgggacggataatctacagaaaaaccattataatcaataggagagtttagaacttcactggataaaagaccaatatgcaaatatcatgtatatttctatacatgcaacagttttaaaattaaatgtaaaaaatctgtcattttaatagcatcaaaagacaccaatgtctatgaataattcttatgaaagtgtgccaaaatacctgtgttgaagactacaaaatattattgtgagaaattaaacaagatctaaataagtggaagaaaacatcacgtttgtatattacaggactcagtaaagacatcaatccttcccaagttgatctaaaaattctatagaatcccagtaaagttaatataaaataaattattttattctattaaaatgaaaagggtcaagaatattcaagacaatcttgaagaaatactaaaaaggaggaaaattaacactaccatgtataaagagctactataatgctatagtcattaaaagagtgtgatattggtgcaagtctaagcaaatagactggacccacatatatacactgttatgtgatgcacaaaggtgacatggcaatgcaggaagaaagattactttttcattaagtggtatagagtcaatttaatattcatataagacaatgaatccctattcctaccatacttcatagcatacacaaaatttaattctagatgggtgacaaatatcaacatgaaaggtaagaccataaaactctaggaagacataggatgttaccttcacgaccttggggtagacaaagagatctaaagcacaacacaaaaaatgcaaactgtgattggaagcgttgataaattggactacactgagattaagaatatctattcaccaaaagataccattaagaaagttaaatgaagccagagttctaaaaattatgttcaatatcaatgtctgacaaaggactccttctgaatgaagaattaattcctacaaataaataagaaaaaggcagacaacacaatagaaaaatggacaaaaaaccctgaaaaatcagttcacaaaggatatccaaaataacaataaacacatgaaaagctgctccacttctttagtcatcagggaaatgcaaattaaaagccacattgagatcaaattacccataagccaaaaaaatctgaaattaagtcaaagacaagtggatgaattatgtgaggcaactagatcactcatacattgtgctgggagtgtaattagaacaaatattttgagagactgacaatatctaagaatagtatatatctagaaaaaactgtgctgttttggaaacagaaaagcacaatttgaagtaaatcatcggtcaaagaagaaatcacaaagaagttagaaaatattttgaactggaggttatgaatatagaacatatcaaaattaggaggaggcaactaaagtagtgtttagatggaaatttgcatatttaaatgcttacatttgaaatgaatctaaaatcagcaacctcagtttacacttcaagaagtttgtaaaaaatgagcaaattaaaccccaaataagtagaaggtaataagaaacacaagaatagaaatcactgaaatttcaaaaaaaaaattgagaaaaagcaaaaagttgtaccatgaaaagattagtaatatcgttaaaccttagtaagtgtaatcaagaacaaacaggagaaaacacaaattccttgaaacagtaatgaagaggaggtatcaccacatagcctatatatatacataaggtaataaaggcacataataaacaactttatgtcaataaatgcaataacttaaatgaaataaacacatttgtaaaaaaaaatacaatttagtaagcttttcccaagaagaaatagaaactgaattgtactacatatctattaaaaattgggttaacgttaagaaaataatctttccacaaaaactccagacacagatagttccactagttagtttcatcaaacatttaagaaacaaattatatcttgcacaaactatttcagaaagtagaggaggaggaagcataagatcttctaccaaaattagatgataaaattacaagaaatgaaaatgatggagcaatatccttcatggatatacatagaaaattcttttaaaatctactaacaaattaaattcagcagtaatcaaatccatgaccaagtgaatttgtggtttgatgtcttttgtaaatattgaaaagttctcagaatttattctttgaatagtgcttttgtcttacattgactctccatttaatgaaaggatcttttatatctgaaagacctggggaggaaggtagccacccagcaaagtcatctgaactttttgattgtggtgtgagggagaaagaaactttcattgtggtaagccaatgagaattgaggattatcactgcaatggacatcacccactatgataactagctttaccattttaaacgtacaaattttatttatttttattatttttatttatttatttattttgagatggagtctcgctctgttgccctgctagtgtgcaatggcatgatctgggctcaccacaacctctgcctcccgggttcaagcgattctcctgcctcagcctcccgagtagctgggattacaagtgcctgccaccatgcccgattaatatttgtattttcagtagagacggggtttggccacgttggccaggttggtctcgaactcgtgacctcaggtgatccacctgcctcagcctcccaaagtggtgggattacaggtgtgagccactgcacccggccacaaattttatagtttatttttcagtgtcctattatctcaaattgtgaggcacacattttcctgtttactctgcctactgactttccctaattgacgatggcctaggatgatgtagagtttgtttccttgaatggtttatattttttattttgaactgattttcatggatattgcgatttgggggcattttttggagtcccatgtgtgtaaagttactaaatcttcctccggaggaattcttgaattctaaaccatataatacacatttggactccacacctaagcctaatgcactttttggtttttaaatgtgtaattatctttttccccctatccggagcccaagcagaaaacatgcttccttccacttccctggctaatggttgaggtttcctggtcttttttacactggaaaggagattacaccaatttctggatttatgtgaatatctcagttccagttccccacctctcataggccccaagcccaaggtcaccttacctcctgagagtgtgttaaaatttccctcttacccatagaatctatatttttggtatgcccaggcatgtattcacatcctgctatgttttatttgctgttttttttttgtttttttttgttttttttttttttgctttgggaacgggagtgagtgtagaacctatacagtcccgtcagctctattccaagaatgttctgctcttttcttcgtttcacaaatgaaaaacctgagtcccatagatgggagtcaatacagccaaactcacagacctacctatggcacaggggagactgaagtttattttccaacttccagcagtcctacattgtaagctgagtgagtggactgcgcttgcaggtcctccaggtgcctagcgagaacagaggacaaataaatatttacgaattgcttgtctcacctgaaaatggtttatttctaggtttctgatattatggggtgcaatggcggtaaagaagcagttctggtttcaggaatgtgatcctgatagccatactccagaaaaaatcaataaattcccttggccccatgggctcatgctcttctagaagggaagacagggctcttaggtactttcagcgctcgtagaagagtgttgttacagtcccatgaccagtgcaggggatgtgccactgagaatcttttcactgatgcttcatgggctttctctattctgctactgggttttatttcccttcttctaattctccctttaccaacaactaatcccctgtagataattaattcatcaagtgcctgctctgtgatgtccggactgctagaagtggtagggggactcaagagccagatgaagctaagggcacgcctgtctgctctccagggacccctggcgtccctttctcctggcagaatgactgctatcctttgaggtgaatccagttcagctgtcacctcttctattaaccactctccaaaaacagctaatccttcttctaggctcttaccgcagttatgaaagcctatgctgaccctttgtttaaacatgtgtacattaacagtaatacatttaagacacttcatggcaagggcaatatactgcgttattcttccaaatcaaatagttgggctcagtcccccattcctgctactggggtacagtcaagctcagtcaccttttggtgagcctttccctagttcttggagtcttaaaagaatcccgtggttttcggcagttcagaaacccaggcattgccgctgcgtggtccacgggagttgctctggtggagctcggatgcccgggggctgcaggaaagaaggtggcagcgccccctacgcggacgcagggcgctgctgtgctcagcagaagggagcaaatgggatggagcttcagccaccctggaagccgccccttggcgccttcctccctcccttcctctttccaaaatcaagccccctcttcaacatcaagaactctccgcactccctggacctctcagagcctctcctcatttactctttccaatgcgctggctcaaaagagcctagataagaacaccaagttctggctgtccttccagcaaagagttaggagttaacttttcaatcttttttaatctcctttaaaaaagaatgagccatacattagggtaaccactgggaatcccatcacacacattggcggcatctctcctccccgacagggtgcctccagcacttcagatcccagccgagagtctggctgctggcgcccagcaaacggtgcggaaagcaaaccggggctcgcggaaagcgggaggaggggggcttcctcgggtctgttttgtctggttggcaagacttccgaagcctggttccctatagctgccacccggtcgctggcgtggaggagggagtccgggaagactggaccccagaattgtcccggctttctcccgagtgcccagcgcagcttctggctgagagcgggagcgggctgagtggggacaaagaacgcaagggagaggtagagcctggccttgggcagcccctggcctggccagaggcgcgaggccgagagcccgctcggtggagactgggggtggaggtgcccggagcgtacccagcgccgggagtacctcccgctcacacctcgggctgcagttccctgggtggccgccgagacgctggcccgggctggagggatgggggggcggggacgggggcgggggcggggctcgtcacgtggagaggcgcgcgggggcgggcggggcgggggcgcgcgcccggctccttaaaggcgcgcgagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacggtaaagccactgcctccccgccctccactcctccgtgggatcccgggcacatcccgggcgcctctgtgcgccccgcgcctgggccaggtttgggatctccccgccgccggggaggggcagcgggggcgctgcgggggctgcttgtctgggctgcaccgggtgggcggcgggggacgccggcaggagggagtcgggggtacccccgccggcctgccctgagccccctgcccgggtcttctctccttaagtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggtgagtcccgcctggctacagggctgccctctccccttcctgggctccgaggggctttttagacagcgtcgggcggccaggcggtggagctcggctggggcactctagttggccccaagctaggcagggccatgctctgagtctgtccccagcctgccctctcctgagtgtctcatttctcggtttcccctccagccaaggagggacctggtaaagcttattccatcaccctggccacctgtgcatggttacttgggtcccacctttctctcaggttagaaactcaagcatcctgagctgggactcagtagcaagaacaggtgaagttcactttttaatctcccttatggtgtaagtgttgacttgcattccagcattgtcaatttagccacttctagacttttctgccgcctatggtatgtaacttctttggtgggggcctggccctgagctttgcagctggcgaatctatccaggcagagggcaagagggccagctgtgaactttcactgtgaccccatcttaggaatgggcatgctttgccttcctggtgaggacaggtactgggagtcctgctccgaggactcagggttccccgtcaggaatacatgtgtctgtccctccaggcagctgccatcagttccgtgggtctcttgccttgcagccttgctagtgcccacttcagttagccaatctgtgtaaacttgcctattgttcctctatgctgctttggatattcaatattcatggtatattctccatacaatacaaatacttcacacaagtgtttaattcattataagtgggtttggtgtcttgtctatacggagtatcggattctattgtggagcaccctggagtgtggcagggtggggcacagggataataatgttcattgggagggagagcatgatgggaaagaggtgagagaatagccacaattactggttaaaaaagaaatagtgctaagagctacctggcaaagtggaaaaaggtaagaggtgatatttcataatcctacaaataaacagttacccgcactatcatgttgatgaatggtatatcacttaacctagttaaaattgccatcatacattgcctcctttccaacgctacactcgcctcaaatgtgttcttcctcctacagacagaatcatgctttaaaatattgaatgtatatgtgatgatgtggaaaagttatcatgagaagagctgtaggggaaggcaggttcagtctcatgtgttgcagagcagcaaaagttgctgtttatggagcagttcctcagttgctttaaagagctcaggatttgtacttgggatcttcggtgggttctgtctgtgttggtttctggatggctgctgttaggtaagtttcttaagcatcttgagccttggctttccggctaataaaatgcacactgtcagtcattgtgatcaactaaagaatatggaaacaacttgaagagaccttaaagctagatatgtgattatggtcattttcatgcagaaaccacatgaaaaaggaccaggcagcagagctaacacaccccgcaagtggtgtgtgacagggtgagaaagggacagtagccccctcttcccccatttgtccagggtcaactccagccaggctgtcacactgtttgtgtctgctccacagctgtctctcttggagtgggtgaccctgtattgcctggatgggggtgatggtgtagtagcccctcagtagaggaacaggaggaagtcagtagaacaggctcctgaggttgcaaaggctgcggcagcaccttttggagaagagaccactcgcggagaagctgcaggctttcttctgggaacttcttctttaagagactcttaagaaaccaagttattatgaggagctctgagtcttaggagaagtttaggcataagttagtgttatactacatgaacatttaaaataacttttgtcatgttagaaaattacaaaaatagcacattggcactttgtgtcaatgacattccagtgtccttaggaaatgcatgtgaagaaggctgtcagcagccagaggtcatgggaagggggcgggagaaagtttatctctcaccttagccgtggtattggctgtgaacacattgaacttcccagccaggcaatgctatgttcatggagtggccttgaacaaactcacttacctttctaagctctgttttctcatgtgttaaatgagaataataatacctgcttcagagggttttgagaggattaaatgagagaaagtgcttgcccacactggtgattcactgaaggtctgctccatcttaattatgtaactactcaactcagaggtcaagaagtccatgcctagaagggtgtggtcacatgcccaaggtcactctgtgattagaggtagggctatgaggaaaaccaacatcggacaagtcctttgtctttcatctgctgcttcctttagacttggtaacttcggcagaacaaagtcatttaatttatttaaactgggtgaattgtaactaatttaatgtgactttcctgagatcctggatgaagccgaagtctctatcagacataacaaaatatgcaaacatttgtattccagccttacttggctctgcctggtttttgaagcagagccaggtctctccagctgaaatctcagcgctctggacagagacacaatggttctcataaaggcttcgtgtggcaaaatcttggctggtatagattctctttacacatttgttgcccattttaactggactgttctagagaccatagtagttggttttcctactcccaaatattgttattgattgcttttgtttgtcagcagagattcctgactggagtgataggaagacaccatatgatgttacatatttgatttttgtgaaagatcatttactctttaatcaatttattccacacatgctattgagctcctgttgtagactttgacaaattctgagaattaacagaaagatgagggattatttttcctttcagagatctcatgagctggctagggagattaaaaagtaaatccaaaattacatgtgatgaaatttaacataaatatctatacaaagtgctagaaaacattgtgttcaactagagcagctgagagtggcttcaaagagatggtggttagagttctaaagatgagaaggagtttgccactgaaagtaggaaatcttttccaggttgaggaaagactgaaagtgcagtggaggacagctcactttcaacaaggtgtgttttatgggacactggcaacctgttgatctttactacaggttttgctgcaagacttctcagaaaatttatgctatgttttttgagacattctaaaagaccaatatagtactgaccaaactactgatagttttatagacccttttgtaagaattatatgctctagaagcacaccttacaagggggaggctatgatttttctttggtaggaggtgctagatgagtgtggggacagtaaggttgcagtgtgtgaggcgtcctgagttcctctgcaagtttgcatttcacctggccctagtctaggcatctctgagggcatgaggaggcagtgtgccaggggttttgtgaagctgtaagaccagcctgccatagcatattttcctagaaaaggaaatagtccaaaccatgatatttgtattaaattcaagtataaattatagattggagtgaaaaaactttgcatacattttagaggtacaacatgagtcctcaaaggaattgcttgacctgctgttattcaacaggctccttcatgaagcactaggcagagggggaagatatggtgggtcgttaaacaggggagggaagtaaccgaatctctgcttaagcagaagatgctgagagcagtgagtgtgagacgggtcagagaggagagaaaggtaacggacaaggaggttgaaactaggatggccactgtgggaatgtggagaagggggcagatttaagagatgttttggatatattgtctatgatctataactgtgtgtataaacatcatgaatatacatcaataaatttgctaagtgaaagtgcctaaattattcttatatgcacacactgacttctggtgattattaatttacttcctgggcttgtaactgggctgggaatgagataatacataagaaatcattttgaagtgatgcatgtgtgaggttctaatctgccaagtttccataatgtttctttctcctttatttgtgctgtttagtcagtcacctgagcacatgcatctgaaggccattctaagtgatttgcataaaataaatatgcattggttatgaagcatgtccagaagtcaagtttgttaataatatgaaccaacatgtaattatatacaaatgtaaaacacataattatacaagattgactattttggtattttattgatttgaaatgcagactcagctttttggaagctttagtcacaagaccgtagaactaagtggtcatgcacttacgttttggcactgaagatggcaggcagggctgtggagcccagtatcctaagggcttatgtgttatctgaattcctttggggggccctctgtgtaggtttgcaatatgtatgattttacattcattagccactatttaaaatgctacaactccaacaaaatactgtcaaatattataaaacccacatacctagaatatattgtaaaaagaaatgctgaaggtataatcaggtattgatctttatcatttaaaaaaatctttacttttttgagcagttttagcttcacagcaaaatgaagaagaaggtacagagatttcccacagcttcctcaattatcaacattccccactagagtagtatatttgttacgactgatgaacttacattgacacatcatcatcaccccaaatgcatagtttataagaaggttccctcttggttttgtataatctatgggtttgggcaaatgtataatggcataatgtgtaataccctcattatggtatcatacagagtatttttactctcctgaaatttctttgtgctctccctgcttatcactaccttcaccacagctcttggcagccgctgaccttttgttgtctccatagttgaaccctttccacaatgtcgtatggttggaatcatacagtctgtagccttttcagatggacttatttcacttagtaatatgcatttatgctctctccatactctttcatggcttgatagctcactcctttttagcactgaataatatgccagtggtctggatgtagcacagttcatttatccattcacctccggaagaacatcttggttgcctccaagttttggcaattatgagtaaagctgctgtaagcatcttgtgcagatttttacgtgaacataaggtttcaatcacttgtgtaaataccaacgagggcacttgctggttcgtatgctaagagtatgtttaattttctaaggaaatcacagactatctcccaaagtggatgtaccattttacattctcaccagcaatgaatgagagcccctgttgccctttatccatgtcagcatttggtgttgtcagtgttctaagttttaagcattccaataggtgtgtagtggaatctcattgttttatatttgcatttccctgatgacatatgatgtggagcattttttcagaagcttattgccatctgtaggtcttctttggtaaggtgtctgttaaggtctttggccaagttttcagtgggtttttttttttttttcttatttctgaatttaagagtttttgtatatttttgatgacagtcctttatcaggtatgtcttttgcaaatatttttcccagtcagtaccttgttttctcattctctttacattgtatttcacagaacatacatttttaactttagtgaaacccatcttttcaattctttcttttatggattgtgcctctggtattgtatctaaaaagttactgcaatatccaaggtcatacaggttttcctctattatcttctaggagttttatagttttgcactttacatttaggtctgtggtccactttgagttaatttttatgaagggtgtaaggtccgtgtctacatttatctttttgcatgtgattgtccagttgttgtagcaccatttgttgaaaagatgatctttgctccattttattgcctttgcatctttgtcaaagatcagctgattatattcatgtgagtcttatttctgggttctctgttgtgttttgtcgatctctttgtctattctttcatcaataacacagtcttgattactatagctttatcctaagtcttgaagtttggtagtatcagtcctccaactttgtcgttcctcaacattgtgttggctattctgggtcttttgcgtctctctataaactttataattgctttatcgatacccacaaaataaccttctgggatttgattgaatctgtagatcaagttgggaagaactgacatattgacaatactgaatttttctattcatgaacatagaacagctctttagttagttcttcctttattttgtttgtaagaattttgtagttttactcatatagatcttgtaaatactttacttgatttttacctaagtgcttaatttttgaggggttaaatggtattatgatttcaatgtcaaattctacttgttaattgccgaaatataggaaagcgatttacttttacatgttaaccttgtcttctgcaaagttgctgtaattgtttattagctcctggagattttttttttggtcagttattttgggttttctacatgaacgatcatgtcatctgcgatcaaagacagctttatttcttttttcccagtctatatactttttatttcctttttcttgtccttttgtattagctagtacttccagtgtgctattgaaaggagtgggagaggggacaaccttgacttgttcctaatcttagtgggaaagcttcagttttcttatcattaggtatgatgttagctataggttttttggatatgtatatatatatatataaatatacatatgtacatacattttgtgtatatgtaaaatatgtgtacatgtttacatttatgtataaatatgtacatacattttgtatatttatttacatttatataaacatattttgtatatataatatacatattttatatatacatatgaaaaatatgtatatacacacatatacaaaaaacctacagctaacatcatacttaatgatatatatatttatcaagttgaggaagttctcccctattccgtttactgaaagtttttgtgatgaataggagttggattatgtcaaaattgttttcatctattgatataatcatatgatttttcttttgtagcctgttgatgtaatggattatattaattttttaatgttgagccagccttgaatatctggaatgaatctcacttgaccatggtgtataattctttttgtacattgttgagataaatttgctaatttttaaatttttggttgagacggggtttcactatgttgctcaggctggtcttggactcctgagctcagttgatctgcctgtctcagcctcctaaagtgctaggattggaggcgtgagccaccacaacgtgctaatattttgttgagcatttttgaatctgtgttcatcagtgatactggtttgtggttatcttttcttagaatgtctttatctgccatttgtattagggtaatgcaggcctcatagaatgttttaggaagtatttcctctgcttgtgtactctgaaagagactgtagataattggtataatttcttttttaaatttgtagacttcaccagtgagcccttctgggcctgttgctttctgttttggaaggttattattatttgattcaattgctctgatagatataggcccattcaaattgtttatttcttcttgtttgagttttgagaaattttgtctttcaaggagtagtccattttatctaggttataaaatttgtgagcatagaattgttcatagtatttatttgttatccttttaatgcccatgggctgtgtaatgatgtcttctacttctgatattagttatttttgtcctttctcatttttttcttatttagcctggctagatgcttattgattttattgatcatttttcaaaaaacagattttgtttttgttcatttcctctattgatttcctgtttacaattttgttgatttctactctaatttttagtatttctctgcttattttggacttaatttgctcttttttctagtttcctaaagtagaagcttagaatactgatttttagatctttcatttctgtacatttcaatactgtattcagggctatagattttcgcttaaggacttcttttgctgcatcccacaaattttgataagttgtgttttcattttcatttcagttaaaatatttcaatgtctcttgagaattcttctttgaggcatatattatttaaaggcatattgtctaatctccacgtatttttggatttttcagtaatctttctgttactgatttctagtataatttctttgtattctgatagcaggcaatgtgtaatttctattcttttaaatttgttaaggctctttctgtggcacaattatggggaatattccatgtgaacttgagaagaatgtgtattctgctgttgttggataaaatagtctatagatgttgcttatatccaattgatggacaatgttttgagttcaatcatgtttatactggttttctgcttgctggttcttcaaatttctggtagaggggtgttaaagtttccaactgtgaaaatggatttacctatttatccttgtaggtctaatagtttttgcctcattagtttgatgctgtgtttttgggcatatacacattaaggactgttatgtctttttgtagaactggtctttttatcattaagtaatatccttttttatccctggaaactttccttgctttgaagtacgctctatctgaaatttacatagctattcctgctttcttggattagtgttagcatggtatatttttctccatccataagacactgttaatttatatgtgtctttatatttagagtgggttttttgtaggcacatacagttgggtcttgttttttgttctactcttacagtctctttaaattgatgcatttagaccactcagagtgattgtcgatatagttggatcaataactatcatatttgttactgatttttttgttgtccttgttccttatttcagtttttgttttccactctgacttttatggtttagttggacattttatatggttatgttttccctcctttcttggtgtatcagttatagttctttttttacttttttagtggttgccctagagtttgcaatatacatttacaactaacccaagtcacctttcatgttacattataccacttcatgcataatgagagcactttataatgcaaaataacatgaatttcttcctcctgtcccttgtaccatttatttcttataaggtgcgtgtgtgtgtgtgtatatgtgtgtatgtgtgtgtgtgtatatgtattatatatgtatatattatatatacacaaagtataataaaatacatttttgctattgttactttgaacaaactgttatctgttagataaattaataagaaaaacaaaagtttttattttgccttcactttttccttcttcagtggttctttctttaatttagatatgactttcaacctgtatcgtttccctttttttaaagaacttcttttaacattttttcaaggcaggtctgcttgaaacaaatttcttcaatttttgcctgagaatgtattttttttccttatcttttgaaggatgatttcaataattctagatttgtgactttctctctcaacactaattattttactctactctttttgcttgcatgatttcatgtaagtcagatgtaattcttacctttttggtcctctaaagggaagggttttttgtctgcctttggcttccttcaggattttatctttatctttgtttatagtttgaaatgatatacttagatgttggattttttttcccccacatgtatcagcttgctgttttctgagattcctggatgtgtggtttggtgtttgacactaatttggggaaattctcaatcattgtttcaaatacttctgttcctttctctacttcaacagtccccaacctttttgacaccagggacctgttttgtggaagacaatttttccatagactgtcgggggccatggttttgggatgaaactgttccacctcagattgtcaggcattcattagattctcataaggagcgtgcaacctagatcccttgcatgtgaaattcacaatagggtttgtgttcctgtaagaatgtcacgctgccgctgatctgaccggaggcggagctcaggcagtaatgctccctgacctgcccctcacctcctggtgtgtggcccagttcctaacagtccaggtgacaggtactggcctgtggcctgggggttggggaaccctgctctacttcttctccttctcgcattcccatcacacatatgttacaccatttgtaattgtcccacaatccttggatattctattctgttgttttcagtctttgttctctttgcttttcagttttcaaaatttcgattgatattcctcatactagggattctttcctcagctgtatccaacctactagtaagcctatcaaatatattctttatttttgttacattatttttgattgctggaatttctttttggttatgtcttaggagttccatctctgtgcttacattgtttaactgttcttgcatgatgtctgctttttccattagagcctttagcttattaatcatagttgttgtaaattctgatctgataattccaatactgctgctatgtctggtactaatgcatgttctgtctcttcaaattgtgttttttgtttgttttttgccttttagtatgctttgtaattttttcttgattggtggctgtgatgtaccaggtaaaaggaactgctgtaaattaataagttactaatgtagtgttaaggtgtggagggaggggaagcattctatactcctatgattaggtctcagttttttagtgagcctttccctctggacacgaacttcataggtgtttctcagtttgtttctccccacttgagtgcgataggatggctagagtgggtggagttcagtatttcccttcccttgtgtcaggtaagctctcataataccccggagggttagactctggttaattcatttctcctgatggcaggccttattaaaaacaacagaaaattctggcacatttccaagtggtttctttcacttccctctggtggaaggatgagggaacatttcttcagtatttcctgtgggaacctggtagagcttctggaggtaaatctcatgatatttgggaaccccctatgattgaatccttttggaatttttaactttcaaagttgtacacactgagcctccaggaatttgccaattccagtttcaggttttcttactctgctgctggttcctgtggtggttttgctgattagtctctgctctggaaagtcctggctctctgtatgtccctgtttgtccccctaatcttgagagcagaagttcatcctgtgtgttcccctcttagttgggctccaagaagagctgttgtttttctagtgtgttcacctttttacttgttaggacaaagttcattctgagcttcttgcatcaggaaccaggaactggatctaataatgtttttataagatacatttcttaaaatgacaaaagtaatatgtgtttgtacaggagctaaattaaacaaaccaaaaaaagaatcaagaagttgaaaatcaagggggtaaaaatcagcacacacaaggcattctggcagagttcatgctatcttttctttatgtttatagatgtgtagagaaatatttaaatatttaaaagttaaaaggtataaacatgatgtatggtgccttaagcagtattaacaggcattgattttaaagtggtacacttaggcccattagtaaacaaatacagattttaaaatacatttatatgttttcttcattaactcttaccatcactgcatattcaatctatattccttttgtaatttaaaaaccattttaaaaatgtgtttaaatgatttatgatgatacttataagtaacacatagttgggtttttaaaaaaattgaatttgataatctttgtattttagttatccttcatgtggttactgatctatttggttttaaatctatccttcactgtttacttccacttacccttgtctcttctatgttctttttttcctcttttttcttacacttttctggattaattgctcattttatattattctaattttctcttctattagtttgttagtcatatttctttctttttgtcttacagtggttgatctggagattacaataggaatccatgactaagtaaagtctagtgaaagtcgtcaacctttctgtacaatgtgaggactttacaacactttaattccataattccaatttatctactgttattgtcatatattttatttctataaatatatttaaaccttataagattataattgtcttttacagtcagtattcttttagatttactcgtatatttaccttttttgttactttaattcctccctgtatcttctaactttcatctgagataattttccttctgccctttagacttctctttcttgagagtctggaagtagcacaatttctccatgtttgtttcaaaacttatttatattgcctaatttttgtgtgataattcagaaatacagactttgtgttgccggttagttacagcacttttatatacagcatagtgtctatagtcgattaccctagtgttttctgacttcagtacttctcttaagaggtcagctgtatgccttactgttgcttctctgttcttgttttctttggtcacttttaaattttattctttgtctttgatttttaacagttttgctatgataagaatatgtttctgctcttttgttttacctgcttgggattcagaatgacttattgaatctgttccttggtttcattcacaagttttggacaattgttgccagatcgatcgatcttttcctccttccttccttccttccttccttccttccttctttttttggggatggagtctcgctgtgttgcccaggttggagtgcaatggcacgatcttggctcactacaacctctgccacctggattcaagcaattcttctgcctcagcctcccgagtagctggaactacaggtgtgcaccaccacgcctggctaatttttgtatttttagtagagacaggttttcaccatattggccaggctggtctccaactcctgacctcatgatccgcctgcctcagcctcccaaagtgctgggattacaggcgtgagccactgtgcccggcctagatatttctttagatatggcttctgctctattttttctgccttccctttttgggacaatgattacatgttcaccacagctttcactttatctcagtgattctcaaccaggggcagtgtctctccccagggaatatttggcattatcttgaaaaaatttcagttgccccaactggggagaaagatgctactgacacttacagggaagaggctagggatgctactaaatgacctatagtgcatagggtgactcctcaagaaaaagaattatctggcccccaatttcaacagtgctgagatggagaagactaatttattccatatgcctcctattctttgcggcaattcccattactttgtctctccatgcttcatccggtccgttttctgttgacatatattcaatattcagtccttgaattctctcattgtgtctatctgttgttagtcccatttattgactcctttttaaagtttcagatattgcatgctttagtgttaagagtttccttttggttcttacgatgttttctagctctcaagcttgttctgattttcttcaaatatattaataagacttttttttatagtccctgtctgataattccattcttaagacactttgtgcctctgtttttattagtgatggctctttttgcttttctgttacatggtctgtgctccttctgagcctggttgtgtttgtagtttgtcccagacaatgtatgggaaaaatggtagagatgagagaacggagaacacttttactcctgttaatatttgcttctgacaacagccaccccatgggtaccagcaaccacacataaccttaattagattagggattgagaagatacgaagatgggcttcagtccctttaagcgctggtttgtttctggttcttgcatatacattctagggcataaatacagagaatttactagagtcttctctctcttcaataagtttttttttttttgagacagagtctcactttgtcacccaggctggcatatggtggcacagtctcggctcactgcaacctctctctcccgggttccagtgattctcctgcttcagccttccaagtagctggtatttttttttaatattttaagttttagggtacatgtgcacaacgtgcaggtttgttacatatgtatacatgtgccatgctggtgtgctgcacccattaactcgtcatttagcattaggtatatctcctaatgctatccctcccccctccccccaccccacaacagtccccagagtgtgatgttccccttcctgtgaccatgtgttctcattgttcaattcccatctatgagtgagaacatgtggtgtttggttttttgtccttgggatagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaatagggccacaataaacatacgtgtgtgtgtgtctttatagcagcatgatttatagtcctttgggtatatacccagtaatgggatggctgggtcaaatggtatttctagttctagatccctgaggaatcgccacactgacttccacaatggttgaactagtttacagtcccaccagcagtgtaaaagtgttcctatttctccacatgctctccagcacctgttgtttcctgactttttaatgattggcattctaactggtgtgagatggtatctcactgtggttttgatttgcatttctctgatggccagtgatgatgagccttttttcatgtgtcttttggctgcataaatgtcttcttttgagaagtttctgttcatatcctttgcccactttttgatggggttgtttgtttttttcttgtaaatttgtttgagttcattgtagattctggatattagccctttgtcagatgagtaggtcgcgaaaagtttctcccattttgtgggttgcctgttcactctgatggtagtttcttttgctgtgcagaagctctttagtttaattagattccatttgtcaattttggcttttgttgccattgcttttggtgttttagacatgaagtccttgcccatgcctatgtcctaaatggtaatgcctaggttttcttctagggtttttatggttttaggtctaacgtttaagtctttaatccatcttgaattaatttttgtataaggtgtaaggaagggatccagtttcagctttctacacatggctagccagttttcccagcaccatttattaaatagggaatcctttccccattgcttgtttttgtcaggtttgtcaaagatcagatagttgtagatatgcggcgttatttctgagggctctgttctgttccattggtctatatctctgttttggtaccagtaccatgctgtttggttactgtagccttgtagtatatagtttgaagtcaggtagcgtgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggcagtatggccattttcacgatattgattcctcctacccatgagcatagaatgttcttccatttgtttgtatcctcttttatttcattgagcagtggtttgtagttctccttgaagaggtccttcacatcccttgtaaggtggattcctaagtattttattctctttgaagcaattgcgaatgggagttcactcatgatttggctctctgtttgtctgttattggtgtataagaatgcttgtgatttttgtacattgattttgtatcttgagactttgctgaagttgcttatcagcttcaggagattttgggctgagacaatggggttttctagatatacaatcatgtcatctgcaaacagggacaatttgacttcctcttttcctaattgaataccctttatttccttctcctgcctgattgctccggccagaacttccaacactatgttgaataggagtggtgagagagggcatccctgtctgtgccagttttcaaagggaatgcttccagtttttgcccattcagcatgatattgactgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagtcttgcatcccagggatgaagcccacttgatcatggtggataagctttttgatgtgctgctggattccgtttgccagtattttattgaggatttttgcatcaatgttcatcagggatattggtctaaaattctcttttttggttgtgtctctgctcagctttggtatcagaatgatgctggcctcatgaaatgagttagggagattccctctttttctgttgattggaatagtttcagaaggaacggtaccagttcctccttgtacctctggtagaattcggctgtgaatccatctggtcctggactctttctggttggtaagctattgattattgccacaatttcagctcctgttactggtctattcagagattcaacttcttcctggtttagttttgggagagtgtatgtgtcgaggaatttaccatttcttctagattttctagtttatttgcgtggagatgtttgtagtattctctgatgatagtttgtatttctgtgggattggtggtcatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgctgttagggtgtcaattttggagctttcctgctttctcttgtgggcatttagtgctataaatttccctgtagacactgctttgaatgcatcccagagattctggtatgttgtgtctttgttctcgttggtttcaaagaacatctttatttctgccttcatttcgttatgtacccagtagtcattcaggagcaggttgttcagtttccacgtagttgagcggttttgagtgagtttcttaatcctgagttctagtttgattgcactgtggtctgttcttttacatttgctgaggagagctttacttccaggtatgtggtcaattttgggataggtgtggtgtggtgctgaaaaaaatgtatattctgttgatttggggtggagagttctgtagatgtctattaggtctgcttggtgcagagctgagttcagttcctgggtatccttgttaactttctgtctcgttgatctgtctaatgttgacagtggggtgttaaagtctcccattattattgtgtggcagtctaagtctctttgtaggtcactcaggacttgctttatgaatctgggtgctcctgtattgggtgcatatatatttaggaaagttagctcttcttgttgaattgatccctttaccattatgtaatggccttctttgtctcttttgatctttgttggtttaaagtctgttttatcagagactaggattgcaacccctgcccttttttgttttccatttgcttggtagatcttcctccatcctttaattttgaggctatgtgtgtctctgcacgtgagatgggtttcctgaatacagcacactgatgggtcttgactctttatccaatttgccagtctgtgtcttttaattggagcatttagtccatttacatttgaagttaatattgttatgtgtgaatttgatcctgtcattatgatgttagctggttattttgcttgttagttgatgcagtttcttcctagtctccatggtctttacattttggcatgattttgcagcagctagtaccggttgtgcctttccatgtttagtgcttccttcaggagctcttttagggcaggcctggtggtgacaaaatctctcagcatttgcttgtctgtaaagtattttatttctccttcacttatgaagcttagtttggctggatatgaaattctaggtgaaaattcttttctttgagaatgttgaatattggcccccactctcttctggcttgtagagtttctgccgagagatccgctgttagtctgatgggtttccctttgtgggtaacccgacctttctctctggctgcccttaacgttttttctttcatttccactttggtgaatctgacaattatgtgtcttggagttgctcttctcgatgagtatctttgtggtgttctctgtatttcctgaatgtgaatgttggcctgccttgctagattggggaagttctcatggatgatatcctgcagagtgttttccaacttggttccattctccccgtcattttcaggtacaccaatcagatgcagatttggtcttttcacatagtcccatatttcttggaggctttgttcgtttctttttattcttttttctctaaacttcccttctcacttcatttcattcatttcatcttccatcgctgatacccattcttccagttgatcgcatcggctcctgaggcttctgcattcttcatgtagttctcgagccttggctttcagctccatcagctcctttaagaacttctctgtattggttattctagttatacattcgtctaaatttttttcaaagttttcaacttctttgcctttggtttgaatttcctcctgtagctcggagtagtttggtcgtctgaagccttcttctctcaactcgtcaaagtcattctccatccagctttgttccgttgttggtgaggaactgccttcctttgtaggaggagagtcactctgctttttagagtttccagtttttctgttctgttttttccccatctttgtggttttatttacttttggtctttgatgatggtgatgcacagatgggtttttggtgtggatgtcctgtctgtttgttagttttccttctaacagacaggaccctcagctgcaggtctgttggagtttgctagaggtccactccagaccctgtttgcctgggtatcagcagcggtgtctgcagaaccgcggattttcatgatccgcgaatgctgctgtctgatcgttcctctggaagttttgtctcagaggagtacccggccgtgtgaggtgtcagtctgcccctacttgggggtgcctcccagttaggctgctcgggggtcaggggtcagggacccacttgaggaggcagtctgcccgttctcagatctccagctgcgtgctgggagaaccactgctctccttaaagctgtcagacagggacatttaagtctgcagaggttactgctctctttttgtttgtctgtgccctgcccccagaggtggagcctacggaggcaggcaggcctccttgagctgtggtgggctccacccagttggagcttcctggctgctttgtttacctaagcgagcctaggcaatggcgggcgcccctcccccagccttgctgaagccttgcagtttgatctcagactgctgtgctagcaatcagtgagactccatgggcgtaggaccctccgagccatgtgcgggatataatctcctggtgtgccgtttccgaagcccgtcagaaaagcgcagtattggggtgggagtggcccgattttccaggtgccgtctgtcacccctttccttgaccaggaaagggaactccctgaccccttgcacttcccgagtgaggcaatgcctcgccctgcttcggctggtgcatggtgcgctgcaccgactgtgctgcgcccactgtctggcactccctagtgagatgaacctggtagctcagatagaaatgcaggaatcacccgtcttctgcattgctcaggctgggagctgtagaccggagctgttcctatttggccatcttggctcctccccaagtagctggtattacaggcatgcaccaccatgcctggctgatttttgtatttttagtagagacggggtttcaagacgttccccaggctggtcttgaactcctgacctgaagtgatctgcccgccttggcctcccaaagtgctgggattgcaggcatgagccactgcacctggccctctcttcagtaagtcttgagctcaaaattttccacttttctcttaagtttgtcaaggtttgcttaaaattttagcctcttaagcattattaaataatcaccacaggctctggaaaggtggcctcaaatcttggtattctctcagggctcccctctcttcctggatcttgtccctgcaattcctcactgctctattagtattctggtgcccttaagcatgatttttttttttttttttccccaagctcttctaattgttctcactggagagttgatgagaaccacctagttgatcatcactgatagcagaacagaaattctaagtggaaataaatatcatatgtgctctctaatttgtggaagctaagaaagtggatctcacggaagtagggagtgtagtggtggttaccagtgactgggaagacagtggggagaggagaagttggttaaagggagtaagttagatggaagaggccaggtgcgttggctcacacttgtaatcccagcagtttgggaggccaaagagggtagatcacaaggtcaagagattgagaccatcttggccaacatggtgaaaccccatttctactaaaaatacaaaaattagctgggggtgatggcgcatgcctgtagtcccagctactcgggaggctgaggcaggagaatcgcttgaacccgggaggcagaggttgcagtgagccgagatcgcgccactgcactccagcctggtgacagagcgagactccatctcaaaataaataaataaatacaattaaataaaaaagttagatgaaagatatagttagatagaaggaataagttctagtatttaatagtatagtagagaaattatagttaacaataatttattgtacatttcaaaataactagaagagcagacttgtaattttcccaacataaaagataaatgtttgaggtggtagataccccgatgatactgatttcatcattacacattgtctgtgggtatcaaaatatcacatgtacctccaaaatatgtacagctattagatataaataaaaaaatctgtaatgcacctttataattgataccaatttattatggttgaaattttgtctcctaaaacctgaagaggtttaggagacagagccctgaagagggctgtgggagataaacccacaaaattcttttaatctgtatagactgagaattgtaagcacttttactaaaggaatctttcttgtaaatgttgcctttcaaggctaccactgaagatattccctgaagggttcagctctctcagagcttctcgtttcatctttgacatgctgttaaaggaagagaaatagtcttgtcatggaggaaggccaacgaaaatctctgctgccttattgatttatttttaaaatcaggattaggtagtgttttactcctcctcaaagaagagggaagtcatttggcatcttctacttgcagttcccatgctcttaatttcagtgatttccttattcagttaacatcagttataaaccattatagccaaagaaattcaaaaagtattgtaaaatagtatgtacttgggcatatttatgtgtgtgtaaatgcacactcagtcacacacacccctgttatccttagctctccttgttgattttatttttgatatctcaagacaaggtatcatgtactatgctaattaagtttccaagatctaaagcttgaagataccgcagaggccttggagtcacagctcccaggtagccaaaacaatggactgaaactaataagaaattaagcaatgaattatacaaaatcttgtattacgggttaaaaattagtgcagaagaatgggctgtgggaaaggcctggatgtgtggctgactactggctctgcgtcagctcgtaggtgtaggagctgacctgtctaagctgtaggtggcagtggacgaggagtaggaaattgcagttgtcatggttaatgaatgccacctgtgagagattctcagcatgggaaatttactcttgcatcattggaagtgaattgtctgtaaatattcctgtcttggataaaagagccatggtgtctatactctggggagaggacttagagagggaggagaacttatttactttattttgtggagagaaggcacgtgttaggctaactctttagttggtttcaaatttcaggattgttaaatgagtttataatctaaagtatctattttaagaagtccacacagagaagatattatgatcagagatttagattaagcaaattagggtaaggctgctcactgattgccaaagtatatttcattaagtgcaaatggatgaaatttacaattgaaatcactagtcaggaaacagtttgtttaagttctccattaagaagttttattgtcatttgaagtaacctttaacacactgtgttaaaggtctctcgtagagagacacacatcttattttggaagttattctttaaccctattctaaaactttaaattgtagtagagtagatatacactaatgtggcacgatatcaaaaccaattcagtgggttaccacaaagtgaaccccgttaagctgtcaccacccaatacagaccttcgctcctccagagctaaactgtttgccttacttcaaacaccaaagtctagttttgcccttctctggaactctgtataagaggaatcacccaagcacacagcatgcgttctttgggatctggcttttttggttcatttttatttttgtgagccacccaagttgttgtctgtagctcttctttcttcatttctattgtatgaatataacaacatgtattattatattgatggctatttagatttcttctagattttgtctgctttcaagaacacttcaaggaatgtgttacatgtcttctgacggacaggagtatgcatttctctctgatacagacgtaaaagtagattggcggggccatagggcagcgtgtttttaacttttctggatgatgctaaacaattttcaaaatggttataccaattagcattcccaccagcagtgtatgaaaattcttgttgctctacatactcaccaacgcttggcatttttagtctattaaatttaccattctagtgggtgtggagtgacattttcttgtgattttaattagcatttccctgattacagctaaggttgaggagattttcatttttttattttccattttgatatattattttgagaagtgtctaatcgtgtctctttactatttctctctctcttttttttttgttttgtgttggtttgtttttttctttattgatttgtatgagtttttctgtattacagatataaacccgtagtcattgtctttgttttgtgctgttataacagactggagactgggtaatttattaaaaatagaaatttatttctcatagttctggggatggtaaagtctgatatcaaggtgccagtatctggcatatcttgctgcttcacaacgtggtggaaggcatcacatggcagaagggcaaagagtgggtgtgagagagagagagcaagagggctaaacctgctcccttcataatgaacccactcccaaggtaactgcattagtccattcaggagggtggggccttcatgacctaagcatctcttataggttctgtctcccaataccatcctagtggaaattaaatttcagcatgagttttggaggggtcaaacattcaaaccattgcagttggccaggcgtggtggctcatgcctgtaatcccagcactttgggaggccgaggcgggcggatcacgaggtcaggagatcgagaccatcctggctaacacagtgaaaccctgtctctactaaaaatacaaaaaattagccgggcgtggtagcaggcgcctgtagtcccagctgctcaggaggctgaggcaggagaatggcgtgaacccgggaggcggagcttgcagtgagctgagatcatgccgctgcactccagcctgggtgacagagcgagactctgtatcaaaaaaaaaaaccaaaaaacaaaaccattgcagttatatgttttgcaggtatcttagactctttggcttattgttttactttttgacattctttcttttctccttttgtaaactttcaattgaagtatgacatgcttacagattaatggtgtcttttggtgaacagaaattcttaattttagtgtggcctagtttagaaatcctttcttctacatttagtgcttacagtgtcatattttaaaagtctttcccttccccaagttcatgaagatatttttctgtattttttagaagctttccattgttgttttagtgaatttttgttactgttttacctctcatgtttgtttataacccacctagaattgatttttgtgtataaagtgtatcacttttaagcagttttatggaaattggactggtgactaatttattttgtttttcaagagttgtgaaagggttgttagtggaattaatgcatgattgtttaactgtatcacatttggacattgtattgtccactatgcctgtgccctaatggacattttaattatttaatgtgtgtatgatatgaaaataatgtatgggtaatggaaatttttaatatttaaaaatgttgacatcacacacattatttacaaagtcagtagtaaagaagggcttatgagaagccctagcccctggccccaggtttcccatcaccatcctaagacaggtacttttaacaggctctgtttcaggtcatcactaatattttaacattctgcttatgtttctatttcttgattgattaaaatatcaaattctctggacctttactgaaattaaaatgcctttaattaaatatcttcagtatggatgttcttatttttaggagggattttgttaacaaagaaaacattaggcaaattcaatttagcagacgttatatgagcaaagaacaattcatgaatcaagcagcactcaggaccagaagaggttcagagagcttgactcagtagtgtgagcaaccagcttttataggctgaacacagaagcaaattagataatctgattggctaccactaggcacttgtcttacttggcatggggtgatgaattggctgcctgtgattggctgaaatctagctgttcatggttagctgaaactctgctgttatagtcctaagttaggttttggtttgtttgcttaataaattaggttgcctttgttaagtaggaactcaaagatgggagatagtctccagccagtggccttctgcttatttcatttagcagtttgtttattaggaatggcagtgtgtccctcaaatcaggatctgatgatgaaggttgttggctaatgattgagatagagatgggtttttttgtttgtttttgtttggatgcctatctgactctgaaggaaaagaaaaaaatttccctaagtttcttagcaaatcaaaagccttctacactgactgattttaaggataggctgtaattaggtaatgaacattttggtgtgttaacttggaaaaccccaactttatagccatagctaatatattcactgaaatatatttcgggttttgaaaatcaattggccaaaagctttaaaaacattctttttaaaaacaacatttaaaaactttcttgcagagttttcctttaaaaataaaaagtgctactttttaagcctttgatcaaatgttgacactcctcaactttgtgactgaatcatttaggacaatattttaaatttgcctaaaatatctgtaggttaaagatcaagaaaatttcttgattaaaagtgaaaggataacagatatgttgataaaaatggacaacgtccatagaatcctgatacttgcagacattcaggtgtttgtagttactcttcagggccacatcctataaacaactagaaatcaggatatacatgtaagtcaggtaaatttcagacagcctgtaatgtttcaagcaggaagatgtctccagatctgtcctggaggcttccctgttctttatattaccggtcttgcattttacaacttcagactaaacagaaactgtatcagaggcctttgtcttagtgatttaggccagggagtgatttacactgactagtggtcctaggagcagtaggcttttaattctgcttcctgcactctaggattgactatcatgctgttgaagatgatgtgtggctgcagggtgcacctccttgcctcctttccctctgaaacatgcagggttgttcggaccctccatcctcttccatgcacaaagcagttaatgcaaattccgtggtccaagacaatcctttgacagtaaccatcagtcatgcattaaaacagcagtgtacagatggtaccttcattgtttctgacagggacagttatgggcattggattaaagtaaaaactgaaaaggaatattcatgacaggaaattttccctttccgggggtgttttgcaacagcgggaagcagctggtcattgatgtgtcggcacaaggcagcttcctggatttccactggcttcctggatttttccaggtgtcacttggaaagtgtactgaattagtgcttgaaacttagtgttagagtgctcgaaacttagtctcaaatagaggaaatgaacacagagtaggatacataatgtggcattgtttggattgggaatgctgtacttatttcagaaatgccactcttttggaggaaaattagtttcctccttactttattgttaaatctgggaaatctggaaagggctgtgggggcagaactagagtgggctggtattcagggcctcctaataggtggctttggttgtgtgactttggatgcatatatcactgtgtatatttgaaaaaagccctaaagtaacatcatctatatgtatataactttaaagaactttaacatttttaaagcactttcactgatgtttgtctctttgatgatcatgtgaaatggtgttcttaatgactgtacctgtctaggcagagaacattttgggacctgaacccaggtcttctttgtatttttttttttctttttgggacagagtcttactctgttgcccaggctggagtgcagtggcataatcttggctcactgcaacctccgcctcctgggttcaagcaattctcatgcctcagtctcccgagtggctgagactacaggtgcacaccaccatgcccagcacatttttgtattattagtagagatagggttttaccgtgttggccaggctggtctcgaactcctgacgtcaggtgatgtgcccgccttggccttctgaagtgctgtatttttttgttttcaggatatttctgtttatttgctcattaaatgaatggattatgcagtagccaagataattgaaataggtgaccagtgagattttattttcagtttgaactattgatttttttggcatttgatatgttttactccattgcagttattctttctgatgcttgaactgtcagattggctcctgcattgttttgctttggtcactgtgatccttaatcatttcttctatttcctggcagaaaataaaataaggtgtcctgggctcactgtgtgtacctcccaccacagactggaatctgcctttgctaaggagcattacagtgggaaattaaatttagaagccacagactgacaggaggtattggaagaaattccaacttgagtctaacagatatctcagaaagagacaactgagcgaatgggaagtacagatatagagaaatgatttttttttgttttgtttgttttctaaaagcttctagatttgagggaaaacacaaacacatacttagaagcagcagacccacttcatccttcaattccagtacatcaggtgtaaggaaaaaaaggctatttaggacattacagagggctataacgcccaagctccgatgagaaactgattagtatcctaagatctctgaaacgccaagtagaaaagcaaaaaaaaaaaaaaaaaaaaaaaaaaaaaagtgttttcatgtatgcaaggattcaaagtttaccacccacaaattatctgaaagaattgctggaataatgtaatccagttatgcaaaaccaaaatcaaactctaagcagaataagtgagatataataaatccaagcagttagagtccagaaaatttggcattaagcctaattgtcagttgtcaaacatcccatgaaacatcaacagcaatctataactgaaacttcagaattcactctacaaacggtcctggaggagtgagggtagtgtatttcagaggtagaaaaagcagagaagaaatgcattctaagatacttttctatatctatatcatctatttatatgtatacctgtatatacatacctgtgtgtgtgtgtgcacgcgcacacacgcacgcatatggactgatttatgaaggcatatatagaaaaaataaattatgcattttcacataactttcacataaacttgtaaataaccactgtaagaatagaaataggatataaagttttcaaaccttgaagggcaataatggaacaaagaaaactgaacaatccaataaaactaagaaatgctttaagaaaacacaagaaaagtctggtaaacaggcaacatattatgacaacagaaacccaatcttatccgtaatcaccatgttgtgaattggacattttcagttgaaaatgttccagctatggccactttcaagagatagacttaaatcacaaattctcagacaaaaataagtaaataggcagataggcaaatggagatggggaaaagctgcagcaagcagatattaacagtggttacagaactgtatcttgctgtaatgggggctaattgaggaaaaccatctgcggcgggagggcgtgtcttcactgaggtgcgatggcattgttggctgctgaagcaggcatcagagtccgagaggaggacagagcacgtagccacaggatgagcacacccaccaagggctgatatgcagagctgcctacccgaggagcattgtgggccaggagagctttggattcatcacaagagcaagagatgcatggcagccctgtttcacaataagcatgttatctcactcagtccttgtggcaagcccattggatgtactgtcattctcccgatgttgttgattggataccaatgctggccagattcatggtgcttgtaggagtggaaccaccatgctcagcgggactagacagctgccaaacagtggaggctcaggaaaccccttcacttaagtgccagcctcacccagcccggacctgggaggaagccaggtagtggcaacagaagaggaggaaggaaagtcatccaggcacgtttcctgcgtggaaagaacagcctaagattgctcaaggtctggttcaaatggaggtgtccataaagagacttccagatcccttcccatcagaattaaccttttgcactcccacaataccgaaatactttacttatttatatgtggctattaggacaattcagagagagacaaaatgtttgaattcacaagaacaacatttaaaaatgagataaggccaggtacggtggctcacgtctgcaattccagccctttgggaggccgaggggggtgaatcacttgaggtaaggaatttgagaccagcctggccaacatgatgaaaccccatctctactaaaaatatagagattagccgggcgtggtggcaggtgcctgtagtcccagctactggggatgctgaggcaggagaattgcttgaacccgggaggcggaggttgcagtgagctgagattgcatcactgcccttcagcctgggtgacagagtgagacttcatctaaaaaacaacagcaacaacaaaaaacaccaaaaaaacaacaaaacaaaacaaataagatgagaccctcagtaattatgtgagcttgggaaagctaccacacctcttacattctgttctttaaagtaataataattcctgtgatattgtcacaatactcatgattggtgatactttttaaaattaacattttggtaatataactcttgcccatagtttaaaagctgagataattctgtgaggattattgttctctgcttccatttacatttctcatagacaaccaattctaactcttttagctgtttctttgagatttacgtgcatatcttgaaataaaatgcttatattaccactttttgctttagttctgttgaacaatggagaacctcacaatactgaaggtgaggacttagttctctgttcactctctacctccactaccacgcataattaacacacttcccttcatttatcacatttacctaatgaaattacataatcatttttgtttaaattaatatataatgtttatattaaaatctgtaaactcatgattcacagctgagagccatgcaataggctatattccttttccttagagttaatactattatctttggccggttgttgaatttttcatgtaatgatcactattctatccccaaactctccagtagacctgtaattttctctccccatgttcagacacgtggatctgtgtcttccatgttgttagagacatcttttgaagcattttatcctcctgcttgaatgtaaattgattgtttcctagctctgttctgcagctgtcagactgatattttcttttatgattgccttttgtcaacagctttctgacatcaactgagtattctatgacccagttcgattcagacactaccttgcacttctgcctggccatctacacatttggggcttcctacaacttcctcacatttgttaatttgctataacaactcccagaacttggtgctaaatagtcatttgatgatgaggatgcgttctgagaaatgcattattaggcgatttcgttcttgtacaaacatcagagtctacttacacagacctaggtgttatagcatactacacacttaggctatatggtagagcctattgttcctaggctataaacctgtacagcatggtgctttactgaatagtgtaggcaattgtaatgcaattgtaagtatttgtgtatctaaacatagaaaaggtgtagtaaaaatacagaataaaagataaaagaatgatatacatatacagggtagttaccgtgagtgcagcttgcaggactggaagttgctctggtgagtcagtgagtgagtagtgagtaaatgtgacggcctgggacattactgtgtgctactgtagacttcgtaaacactgtacacttagactacactaaattaaaaaaaaaaagtaattgcactgtgatgttatgacagctatgacatcactaggcaataggaattttttagccattataatcctatgggaccactttcagatacgctgtccatagttccctgaaatgtcattatgtgacacataattgtccttgtgattattgttttattataaaaatgcaaatgagcttccaggtgaaaagttacataggacaaagtctaggaagtcctaagcacagggtcttctgtctctgtggagaccagcagtgccatcctcttcatacattgatgtgttcaccaaccaggtagtttccccaagccttgccgtctggagttattgatggagtttcattttgtatgcatgattgattaaacttttgaccacatgattgagctaaattttcagcatccctccccttcttggaggttaagcctcaagttccagttctccaatcacttggttggtttctctggcaaccagcctccatcctgaaaccacttgagggaccccttccatgagccacttcattagcataacaaggaatttctgatttctgtcactaagagtttttgaagctctatgtcaggaaccatggacaaagaccaaatagctactttgtattatttcaatagctatcaactagagaatttcccttgccattctccatttgtggatccagatcctctttcctggtttatcttctcagttgatggatggtgtcctttattacagtttgggaaagggagcatagcaggattttgaagaccttatttttacccttacacttgatgaatagtgtggctaggaataagttgaatactttttcttagaattttgttgtttcttttcttattccaatgttccagttcccaatagctttgttttgctctctgaatgtttcttgttggaagtatctgatttttgttagtatttttaaagcaatgccgttgctctgttatagtactgaagttgtcctcgtcttcctccttcttcttctttcttcctccccgtgcccctttcccttccccttcttctttctttcttctgcttctgctgctgcttcattttcttcctgctccttgatccttctacttcttgcttttgctttttatggaatttttcttctacttcctgtattgtctgcatcctcaaagtcccttatctgttgtttattttggtctctatttgtcatattagagcctttctcatgatgataggtgatctttggtagaagctgtgtgtgtgtagtgtgtgtgtatgtgtgtgtatgtgtgtgtgtggtgtgtgcaggcagggggttcccatatgtctgtatggtagtggtggtgatgttggagaagtgggcttcatcatagcatgatttggatgggaacgtattttggggaccttaatatgattaggtcttttctcttcattggatcacatttcccagagaaaatttttctagtatgctacctgggcagtatgtgcctggcagtcagagctctggaaaccaaaacaagggaggggctgggggtcatgcattcttaacccacctctgttgtcagtatgcatctgtgctcttgctttacctatgctcatcatacagagtcctcctcatatttcctcttctgagaataaaatgctaatattatgccatggccaagagaggcagttgccacttgtgcattgtggttcttaaaatgaatatgcaacagagcctatgaagaacttttaaaatatgagtgttgaggtatgtatgtgaaaatagcagaataatggcctcaaaaattatttcctccataaaatcagaaagaagaaggaaactgccaacatttgccaaaagtaagtttttcaaaactttagaaataaactaagaggagaccaaaagctagcagcaatctggggagcatttattttttataaaaataggccgaatcttggtaagaacagtgacttttgtgacattttaacctgccctatttccttctcccatctccagctccctggtagccttgaatctgcaattcaggctgcaatcatgatgaaaccatcagcctttctgtcaccaaagtggagagaacagagttaaagctcctcagagtctcactgttggagaattgtcagtatttggtctgtctggtggttcagtagaagaccccacttgcaagactatttttacttgaccaaatgcagagctttcccagtctagaaagccttttccctgggttgttgggttgaaaatttagaagtaattgcttaaccttggggctgcctgaggcagtggatatcaactgaggaagataataagctataaaaagatgaaaaggaaaggctggggaattcgatgtccacaagttctttgaaaagctccaaaaaacacatgtaaggctgtgcacatgctcaggaaaaatctgagaaggccttagactctcacctctgactgaccttgagactgtgcacaggcaggaagtgaaggctaaagcagggctgtcagctgcctggctgtgtgcggaaggtgtgccccagcacacaacacagcccactgcaaacactgggggcagagctgtcagctgcctggctgtgtgtggaaggtgtgtcacagcacacagacatagcccactgcaaacactggggacagagctgtcagttgcctggctgtgtgtggaaggtgtgccccagcacacaacacagcccactgcgaacactgggggcagagctgtcagctgcctggctgtgtgtggaaggtgtgccccggcacacaacatagcccactgcaaacactggggacagagctgtcagctgcctggctgtgccgaagatgtgctccagcacacagatgcagcccactgccaacactggggattcatggatgccaagcattgaaggaaatctcagtttcctaaatagctggcaactcatataacaaaggaaagactttagtgagtatacacaacaaaagatacagactttacagaattagttgagaaaagttactgaataaacaaatagcagcaacaacaaacctagggttggaggatatactttccagatttttcacattatagtatttttttttttttttgagatggagtctcactctgtcgcccaggctggagtgcggtggcgcgatgtccactcactgcaacctccacctcctgggttcaagccattcttctgcctcagcctcccaagtagctgggattacaggcatgtgccaccacgcccagctaatttttgtatttttagtagagacagggtttcaccatgttggccaggatggtctcgatctcttgacctcatgatatgcctgcctcggcctcccaaagtactgggattacaggcatgagccaccatgcccagccacattgtagtatttaaaatgtccaattttcaaaaaatatatgtatgagacatgcagtgaaaatttaaaaagcagatggcatatacagagggaaaaacaaaacagagtcaataggaattgtcctaagaaagcccagatgttgagtttactagcaaaacactttaaaccagttattttatatatgttcaatgcagtaaacactgtctaaaacactaaaggaaagtataagaatatctcaccaaataaataatgccagtaaagatgcatagacataaaaaatttgattctggagttaaaaattccaataatgaaaatgaaatattaactaatgagtttcaataaaggattcgaacaggtggaagaaagaaggaacttaaagacggatcaactgagtttatcccatctgaataactgagaaaaaaaatggggaaaaatgaactaagcatcagaaacctgtgagaaaacaatcatagcaacatacgcaaaagagttatcctagaaggaaagaggaaagaaaggggcagaaagaatacttgaagccaaagggagtaaaagcttcccaaattgggtgaaaaacattgatgtacacatccgtaaagcttaacaaactacaggaaggataaaaccaaagatccacacctagatacatcataatcaaactgttgaaagacaaagagggaatcttgaaagcagcaggagagaaccaactcatcacatgcaaagtagccttaatcagatgaacagctgatttctcaacagaaaccatggaagatagaaagcagtggaaaaggatattttcaaagtgctggaagaaaagactttaagaattctatacccagtaaaaatatctttcaaaatgaaggagcaattaatgcattttccaattttagagaagctgagacaatccactgctggaaaattttccctgcaagaaaatactgaagagtactttaggtgaaatgaaaggagggtaattgggatctataaagagataaagaatatcagtaagtaactacctaggtaaacataaaagacactgtaaatatattttgtgttcataactctttttttctcctctctgatttgagatgcaactgcataaagcaataattataagtatgtgttgatatgcatacagtgtatataaatgtaatttttaatgcaacaacaacacagaggaggagaaagcaaagttatacagggggaaagtttttgtacactattgctttaagttagtatcaatccagacaagattgttagaagtcaagatgttaattgtaattcccgggaaaaacagctttacaagaagtaagtgaagtgacaaggaaatgaaaatggtacagtggagaacatctgcttaacaaattagaaggcagtagggaaggattgggggaagcacacaaggcatgtagaaaatcataaaaagcacctaagacatatagaaaatagcaaactgggcacagtggttcacacctgtattttaagccctttgggaggctgagacaggaggattgcttgaggcctatcgttggaggctagcctgggttacagagtgaggccctatctctacaaaaaaaagaaaaattaggtaggcatggtgactcacacctgtagtcctagctactcaggaggttgaggtgggaggattgcttgagtgcatgagtttgaggctacagtgaactgtgattacactgcactctagcctgggtaacagagtgagaccctgaggaaggaaggagcaacctgttagctgtaaattctactttatcagattgcacatggaagtaggtggattagacactccaatgaaaatacagagattgacagaataaattaataatttggctgtatatgcaagagacacattttagattcaaaggcacaaataggttgaaaataaatagatgcaaaaagataataccatgcaaacagtagtgaagctagagctacagtggctataccaatatcagacaaaatagacttcaaagcattactacatctctacatggtggtgggcgcctgtaatcccagctattcgggaggctgaggcaggagaattgcttgaacccaggaggcagaggttgcagtgagccgagatcgcaccactgcactccagcctgggtggcagagcaagactccatctcggggaaaaaaaaaaagaaaaaagtgttactacagactaaaaagagcatttcattgtaataaaaagtaaactggtcaggaatatatcacaattataaatacatatgacgtatcaatggggccctcaaatacatgaagcaaaaagagacagaattaaaggggagtaatagacaattcaacaaaaatagttgaagacttcggtacccctctttcaataatgatagaaacactagacagttaaaaaataaatggaagacttgaatggctttcgtctgctagctaatggacaccttttttgtgatacccttgtttcttgtgtataattttaaaacaactacataaagcaataattaaaatctgactgacattagacttaataatagagttaataaccattaggcttaaattagacctaatagacacatctataggacactccacagaaaatgaaaagacaactcacagaatgtgagataatatatgaaataatatatttcctaagggtcaagtatccagcatatgttaaagaaactcttacaactcaacaaaaatacaacctaatttaagaaagatcaaaggatatttatccaatgaaatactaaatgagtagacatttattcagtgcaatagtcaaagccactgaggctgggcctgatggccgaaacctgtagtcccagcattttgggaggctgaggcaggaggatcacttgaggccaggagttggagaccagcctgggcaacccatcaagacccaattgctacaaaaaaatttaaaaattagctgggtgcagtagtgaatggctgtagtcccaactcctcaggaggctgaggcaggaggatcacttgagcacaggaggtcgaggctgcagtgagctatgattataccactgcactccagcctgggtgatggaccaaaaccccatctcagaaaacaaaaacaaaaaactaagaaaactccactgaattctgtactttaaaaagataattttatcatacattaattatggctcattttttaagtataaatgcttgtgtccaaaccttcttatatcttgaattgttcagtgtgaaaagagatctaggttgctttttttttaaaacaaagcttcctgaattgtctgttgtgaatattgtgttagcaaacatagattttgaaaatcagcgaaacaccagaacttgaaacgcactctgggcacttaacttgaaagtactacatatgctatttttataattattttttatctgattttccccccgcccactagatttatctcaattgatgaagcatttattgtggcttcttaatagatgtctatttagaagaattataaacctttttaaaaaataagccagctttattgaagctgtaattgacatacaaaaactatatagtttaagtatacaggttgataggttgagacaagtttgtacactcatgaaaccattccgacaatataaagaacatttccatcatttgtaataggctgcgttttgttttgttttgttttttgcccctctgcagttcctcccttacacctcagcttcctctaacctccaggcaaccactaatctgatttgtcactatggattattttgctcactatttaattggattttttaaatgttgaattttgagagttctttatatattccagagataaaagtactttgtcagatatgtggactctaaatgtaagagtggtttccaatactcttaacaaggtattttccagcaaaaaaaaagtttttaattttcatacagtctaattttatttttcttctacagctcatgtttttagtgtcatgtccaagaacatttcactaagcccaggaccctgaagattttttcctatgttttcttaaaaaggtttatagtttaacattcacatttaagtctgcaatctattttgagttttttttgtgtgtgtgaacatgtgaggtttagttcctttttttttttttttttttttttttttttttttttgagacggagtcttgctctgtcgcccaggctggagtgcagtggcacgatcttggctcactgcaaactctgcctcgcggattcacgccattctcctgcctcagcctcccgagtagctgggactacaggcacccactaccatgcccagctaattttgttgtatttttagtagagatagggtttcaccgtgttagccaggatggtcttgatctcctgacttcatgatccgcccatctcagcctcccaaagtgctgggattacaggcatgagccaccgtgcctggcctagttcctttttttatatcgatgtccgattgctgcagccccatttgttgaaaagattgccctttattatccattgaattgcttttgcacatctgtcataattattaggctccacttcaggaggtctatttctagagtctttattctgtttcatttatctatgtattaatccctcaactaataccacacagcctagatcactgtaaatcttcaaatctggtgggatgattgcttatattccttctctttcaaagttgtttcagctactcttttccttttgtctttccatatacattttagaactatcgtatgtatatcaacaaatatattacagggattttgatatgattacattaaacctcgataccaatttgaggaatgttagcatatttattatattatttcagtttgtgaatatgtctgtttatttcttctttgattcctgtcattggtgtttgtaattttcaatatacaagtcaagtacacacttcgttagatttacacctaagccatttgatatggattgtcccctccagatctcatgttgaaatgtgatccccagtattggaggtggggcctggtgggaggtgtttggatgattggagcagatccctcatgaatggcttgctaccctccccagtataatgagtttatacaagagctggttgttcaaaagagcctggcacctcctcctctctctcttgctccctctttcaccacgtgacacacctgctccccttcaccttccaccatgattataagcttcctgaggcttcaccagaaacagatgctggcactatgcttctcgtacagcctgcagaactgtgagccaaataagcctctttttttttttttctcaataagtcagtctcaggtattcctttatagcagcacaaaatggactaacagtaaattggtactgaggagtggggtgttgctataaaagatacttgaaaatgaggaattaattttggaactgggtatgggcagaggttggaagagtttggaggacttagaagacaggaagattagggaaagtttggaacttcttagagactggttaaatggttgtgaccagaatgctgatggcaatatggacagtgaaaaccaggctgatgaagtctcagatagaaatgaggaatttattaaaaacgagtaagggcactcctgttacaccctagcagataactaggctgcattgtattcatgttctagggatttatggaaagttgaacttaagagtgataacctagggcatctggcaaaggacatttctaagcagcaaagcatttaagaggtgacatggctgcttctaacagcctactgtcagatgcaggagcgaagaaatgactcagagtttgaagttacatttaaaaggggagcagagtgtaaaagttagaaaatttgcagcctggctgtgtgaaagaaaaagcattttcaggagaggacaataagcagattgtgtcaggagaggactacaagcactagtggagcaacttctcccaaaagagatttgcatgactaaaagggaggcaagcactaatagccaagacaatggggaaaaggccttgaaggggtctcagaaatctttgggacagaagttcccatcacaggtccagaggcctgggaggaaagactggtttctgaggccagagctgaggcactgctgccctgcacagccttaggacactgcatccgtgatcctggaagctctggctccagtcatggcacagagggctccaggtacagcttgagccactgcttcagagaacataagccgtaagctttggtggtaccatgtggtactaagtctgcaggtgcacagaatgcaaaattgaaggaagcttggcagcttttacctagctttcagaggatgtatggaaaacactgggtgcccaggtggaagcctattgcaggggtggagctaccatggagggcgtctaatagggtagtgctgaggggaaagatggggttggagccctcacatggagtccccaccaggtcactgcctactggagctgtaggaagggggcaaccatccgccagacccatgaatggtagagccactgtcagcttgcaccctgagcccagcaaagctgcaggcagtcaactccaacttgtgtgagcagccacagagagggcacactctccaaagccacagggtcagagctttccaaggccttgggagctcacctctcacaacagtgtacccaggatgcgggacatggagtcaaaggaggttatattggagcttgaaggtttaatgttggccctgctgggtttcagacttgtgtgtggcctattgcccctttcttttggctgatttctccctttaggaatgggaatgtttaccaaatgcctgtaccaccattgtttcttgaaagcaaataacttgtttgtgatctaacaggctcataggtcaaagaaatttgccttgagccttagatgaaactttggacttttgattgagttaatgctggaataagttaagacatttggggactatttggaagggatgattatattttgtaataggagaaggacaagagatttaggggaccaagtgcagaatgatatggtttgggtatttgttccttctaaatctcatgttgaaatgtgatcctcaatattggaggcaggggctggtggaaggtgtttgggtcgtggggatggatccctcatgaatggcttgctgctctccccactgtaataagttcatgcaagaactgggtgtttaaaagaggctagcaccacttgccctctatcttgctccctcttttgccatatgacacacctgctccccttttgccttccacaatgattttaagcttcctgaggcttcaccagaagcagatgctggcaccatgcttcttgggcaacctgcagaaccagaaaccaaataaatctctttcctttataaattacccagtctcaggtattcctttttaccaatgcaaaagggactaatacattggtcttccttcattgttttccttcttcctgttcccattttctcccttccttcattgtcctccttcttcctgttcccattttctcccttccttctttccttccttcttattgttaaaaattgtaaatgttaatgtatatttaattttgatgtccatatgctcattgctggtgtatataaatcaagttgatttttggtatgttaattttgtatcctgcagctttgctaaactcacttattctgtttttgttttgtttttgtggattcttcgggattttctatgcagacaattatgtcttctgcaaacagccagtgttatttctttcctttccatctgtatgtgtttcattgccttttcttgaacttactgcactggctaaaacttctaacagtataacataacataacatagtgttagaagttttagccagtgcaataagttcaagaaaatagaataaaagtagagagagcaaacgtctttgccttgtttcctattttaagaagaaattattgattattttactactaaatataactgtagctataactgttttgtaaatgctgtttatcaagttgaggaagtttgcctttattccgacttttttgagttttataatgaataggtcttgaatttcgtcagatggttttttctgcggctcttgatatgaatcacattattaatattattattattattattattattattatttttgagacagagtctccctcttgttgcccaggctggagtgcagtggcatgatctcggctcactgcaacctccgcctcctgggttcaagtgattctcaggctcccgagtagttgggattacaggcatccgccaccacgcccagctaattttttgtagtttcattagagatgaggtttcaccatgtcggccagcctagtcttgaactcctgacctcaggtgatccacccacctcggcctcccaaagtgctaggattacaggcatgtgccaccgcggctggccagaatcacattatttgatatgaatttttttgtgtagtttttcttcttttgccttttctatttaagttttatattgattgattttcaaatattaaaccagccttaaatccctggaataaaccctggtttggtcatggaacataatttttttgtatatattgctgaattcaatgtgctaacacttattatggatttttgtgtctatgagagatattcatctatattttcttttttatactttctttgtttctgtaagcagggtaatactggcttaataaatgaattgagaagtgtttcctctttcaaattgtggaagcaatggtgtagaattggtgttaaaattattctttaaacatttgatacagtgaaatcgtctgggcttagagactttatttttaagagttttaaaattacaatttcagcatctttaatgttataggacttttaaaattatttattttgtattaggtgagttgtaatcatttgtcttttttgagggatttattcatttcgtctaaatcgtccaatttatgagtgtaaaattcttcatagtactttcttattatcctttgatatctgcaggatctgcattcatatcctctattttagtcctcatgctgcttatttgaatcttctctcttttttctttattagtctcgctaaaggtttttcaatgttactgttctttttagagaaccagctctttgtatcattgattttctctattgcttgctttcaatatcattgatttctgctcttacctctattttttccttcatccttcttgctctctgggaaatttttttttctctttttgtaggttcttcagataggagcttatattattttttgagtcttttccttttttctcatatatgcatttattattgtaaatttccttcagcattgcttgctttctatctcacaaattttaatatgttgtattttcatattcaaaatatatttttaaaaattatcttgattctttctttttgacctacagattacttagaatgtgtgttttttcaatattttagcctttggatattttcctattattcttccattgttaatttgattccaaattatactttgtgttatttcagttattctacatttttgagttttatggtccagagtatggcacattttggtatgtactccatggccacgtgaaaagagtattttctgcttttgttcattggggtgttgtgtaaattttagttatatcttgttggttgatattgttaagtttgtctgtatccttgctgattttctgtctctttctcttttaaattgtggagagacaaagtataaacatctccagctataattgtggatgcttctgtttctcctttcaattttgtaagttttgtcatctatgtgttttgaagtttgatgacacacaattaagattgctgtgttttcttggcagattggcctgtttatcgtcagatattgtctctccctatctatggtaattttctttgctctgaatgctttatttgatattatatcaggccacaacagatttatttagattaaggtttacatgctgtattttgttctattgttttattttcaaatcgtgtgtattgttttatttgatataagtttcttgtagacagcttatagtttggtcatgcttttttgttgctgtttttagtagattttatttttagagcagttttaggtttacaacaaaattgaacaaaagtacaaagatttcccacatatcctgtgtcaccccacatgcataatctctctcattattaacatccctgaccagagtggtacattgttacgattgacaaacctacactgacacatcattgtcacccaaaattcatagtttacattagtgtttgttcttggtgttgtacattctgtaggttagggtaaatgtataatgacctgtatctaccattataatatcattcagaatagtttcactgccccccaagtcttctctgctccacctagtcatcccttgctccacccaactcttgaaaacccttggtctttttatagtatctataattttaccttttccagaatgtcagctctgggaatgtatggtcccacagttgggagcatacagaatgtagccttttcagatttgacttctttcacatagtaatatgcatttaaagttcctccatgtctttttatggcttgatagctctttttttttttagtgttgaataataatccattgtccagatgtaccacagattacccatttacctactgaatgacattttggttgcttccagttttgggcaattatgaataaagcttctataaacatctgtgtataggtattgtgtggacatatgttttcaaatcctttgggtaaataccaaagagggcaattgctggattaaatggtaagagtatgtttagttttgtaagaaaatcctagactgtcattccaagtgcctgtaccattttctgttctcaccagcaataaatgagaattcctgtttctgtttgtccttgccagcatttggtgttgccagtgttctggattgtggccatttcaataaatgtgtagtggtatctcattgttgttttactctgcatttccctgatgacatatgatgtggaacatattttcatatgttgatctgtatgtcttctttggtgaagtatcagttaagatctgtcttagttcatttagtgttcctataaaggaatacctgaggctgggtaatttataaagcaatgagttttatttggcttacagttctacaggctgtggaagtatggcaccatcatctgcttctgatgagggcttcagtctgcttctactcatagcagaaggtgaaggaggaggagcatgtgtagagatcacatgataagagaggaagcaagagagaaagagaaagaggtgacaggctctttttaacaactagcactcactgctcttatgggaactaaaacagtggtaactcattaccaggaggatagtaccaagccattcatgagggatttgccccgtgacccaaacacttccccttaggtgccacctccagtgttggggatcaattttccatatgagatttggagggatcagacaaactatagcaaggtctttggcctatttttaaattgggttgcttgttttctttttgttgaattttaagcactgtttgatgtttttgtataacagtcctttatctgatttgtctctttcaattactttctcccattctgtgacttggcttctcattatcttgaaattttcttttgcagaggagaagtttttaattttaatgaagtccagtctatcaattctttctttcgtagatcatcctttggtgttacttctaaaaagtcatcaccataccaaagtcatgtaggttttctcttgtgttatcttctagttttatagttttgcattttacatttaggtctgtgatccattttgagttaatttttgtgaaggatgtaaggttgtatctacatttattttttcgtatgtggatgtgagttatttcagcatcatgtcttttaaagactattgggacctgtttttctagtctctgccaacgtgtattaaattactttatttaaaactagaaaacctagaagaaatggttacattcctgaacacatacaccctcccaagactgaacctggatacagtcaaatccctgaatagaccaatgacaagttctgaaattgaggcagtaataaaagcctaccaaccaaaaaaaaaaaaaaaaagcccaggaccagatggatttatagcttaattctaccagaggtacaaagaggacctggtaccatttcttctgaaactattccaaacaattaaaaaggagggactccaccctaactcatttcatgaggccagcatcatcctgataccaaaacctgtcagagatacaacaaaaaaagaaaacttcaggccaatatccctgatgaacttcgatgcaaaaaccctcaataaaatactggcaaaccaaatccagcagcacatcacaaagcttatccaccatgatcaagtcagattcatccctgggatgcaaggttggttcaacataggaaaatcaataaatgtagttcgtcacatacacagaactaaagacaaaagccacttcattatctcgataaatgcagaaaaggactttgataaaattaaacatcccttcatgttaaaaactctcaataaactaggtattgatgggacatacctcaaaataataagagccatttatggcagacccacagccaatatcatactgaatgggcaaaagctggaaacattccccatgaaaaccagcacaagacaagaatgccctctcccaccactcccattcaacatagtattggaaattctggccagggaaatcaggcaagagaaagaagtagagggtattcaaataggaagagaggaagtcaaattgtctctgtttgcagatgatatgatcctatatctagaaaaccccgttgtctcagcttcaaatctccttaagctgataagaaacttcagcaaaatctcaggacaggaaatcaatatgcaagagtcacaaacatttctatataacaacagacagagagccaaatcatgaatgaactcccattcacaattgctacaaagcaaataaaatacctaggaatacagctaacaagggaagtgaaggacctcttcaaggagaactacaaaccactgctcaaggaaatcagagaggatacaaacaaatggaaaagcattctatgctcatggataggaaaaatcaatatcatgaaaatggccatactgcccaaagtagacagatttaatgctattcccattaaattaccattgacattcttcacaaaattagaaaaaaaaaaactactttaaaattcatattgaaccaaaaaagggcccttacagccaaggcaattccaagcaaaaaagaacaaagctggagcagcatcactctacccaacttcaaactatactacagtgctacagtaaccaaaacaggatggtactggcacaaaaacagacacatagaccaatggaacagaatagagaattcagaaataagaccacacatctaaaaccatctgatcttctacatacctgacaaaaacaagcaatggggaaaggatttcctatttaataaatggtgctaggagaactggctagccatatgcagaaaattgaaactggatcccttccttacaccatatacaaatattaactcagggtggattaaagacttaaatgtaaaaccctaaaatataaaaacctagaagaaaatgtaggcactatcattcaggacgtaggcatgggcaaagatttcatgttgaaaacgtcaaaatcaattgcaacaaaaacaaaaattaacaaatgggatctaactaaagagcttctgcacagcaaaagaaactgtcatcacagtgaacagacagcctatagaatgtgagaaaatttttacaatctgtccatctgacaaaggtctaatatccagaatctacaatgaactaaacaaatttacaagaaaaacacaaccccattaaaaaaatgggcgaaaggcaagaacagacacttctcaaaagaagacatttatgtgggcaacaaacatatgaaaaaaaagctccacatcacgaatcattagagaaatgcaagtcaaaaccacaatgagataccaactcatgccagtcagaatggcgattattaaaaagtcaagaaacaacagatgctggcagggctgtggagaaataggaatgcttgtattctgttggtgggaatgtaaattagttcaaccattgtggaagacagtgtggcaattcctcaaagacctagaaccagaaataccatttgactcagccgtcccattactgggtatatatccaaaggaatataaatcattctattacaaagatacatgcatgtgtatgttcattgtagcactattcacaatagcaaagacatggaatcaacccaaattctcatcaatgatagactaaagaaatgtggtacatatacaccatggaatactacagagccataaaaagaaatgagatcatgtcctctacaggtacatggatgaagctggaagccattattctcagcaaactaatgcaggaacagaaaagcaaacactgcatattctcataagtgggagctgaacaatgagaacacatggacatggggtaaagcagggaacaacacacaccagggcctgtcgggtggggtcctggcagtgggagagcatcaggaaaaatagcaaatgcatgctgggattaatacctaggtgatgggttgataggtgcagcaaaccaccatggcacatgtttacctgtgtaacaaacctgcacatgtatcccgaaacttaaaatataaaattaaatttgaaaaataaaaataaataaattactgtacttagagtatttacatttaatgtaattattggtatgttaggggcttatgtgtgccattttatttctgtattttgtttatcttttttatattttacctgctttcctataggctatttgaacatttttaagaattccatttgatttattcatagtgtgtcccagtggaactctttgtgtatatataaattattccaatgagtaatactctattgtttgaatattagtcgtttttctaggtattatattatttatgaatagcttattcctgtctactaatgttattttaccagtttgcatgcagcatagaaactttacctccctttatcctctcctgtagttacctttactattttctccacatacattaaaaccatctcagacagttttatactttttccttcaaccaacaaacataacttagaatactcaacaagagaaaaaaagttccattatatttacccatatttttacttgccatatttttccctgctttctctccactcttccttcttttaatgtttcctttcaatctattgaactttagctattcttctgaaggtagatgtggtggcaacacaatcttttagttgcctcagtctgagaatttcttcatttttctttcatttttgaccaatatatttcactgtatataggattctgaggtgatctttttttcagcatttgaaaaggttgtttttcttcattctgaactctgtggtttccaatgaataatactttgtcatttgaattgtttttgcagtataggtaatgtgtcatttttctttctctgtttttaaggtgtttgtgtggtccttaatttttagaaatttgactgtgatgtgtcgtggtggagatttctttggatttatcttgtttggggtttgttcatttctttaatctatagatctgtgtcttttatcaaatttgtgaagtgttggtcattattcatgtactttttcaactccaccttcttcttttatctaggactccaattatatgattattagattttttttgtagtcccataagtctgacttttttttcagtttattttacctttgtttttcaaattgagtaatttctattctatctttgtgttcacaatctccacctgtaattcttagtaaagcaggttatatgtaagatgagaatgttttagagaacaactcagcatgaaaataatcagatcatatttgtggcaatacaggatgtaaaatatggggatcatagaatagaacttaacagttctttcaacagttggataatgcaattagtacaactttatgcaatgtcttctttccactgtatatcttatttttaatatgattattttgaaaaaacatactaattatataatattccattttatgtataagcaatgatgtattgctgggcagttaactttgttgataatattgcaagccctataaataacattataatgaacatctttgggtttctatttttgttaatgatcactgttttttagtataatttcttaaatgtgaaattagtagctcaggctgggcatgatggctcatgcctgtaataccaacactttgggaggccgagacaggtggatcactcgtggtcaggagttcaagaccagcctggccaacatgatgaaacactgtctcctactaaaaatacaaaaatcagcctcgtgtggtggtgcacacctgtagtcccagctacttgggagaatctttcatgataacctgactttctataaaatataaattaggacaaatgtattccttggtgctatggtttaaatgtgtcccccaaagttcatatgttgggatcttaattcctaatgcaacagtactgggaagtgggcctaataggaggtgattagctaataatgattaatattgttattgtaggagtgagtattgtgagagggggagataaattatctcaagagtggatgtgttaaaaaagtgagtttggtcccctcttgctctctctcgagtactctctagcccttctgtcttccatcatgggatgttgtagcaagaagccccattgccagatgccagcactttgaaattggacttcccagcctccagaactgtgagaaataaatttctttataaattactcccttcatgatattctgttacagcaacacaaaacagaccaagacactttatcaaattgcaaagaaacattgttgttctaggttataataaatgtaaaaactagtgcaaatttattttgggctacatgtgaagggatgagataaggagggtggatggtgtgggacagaaattcaactgttaactattatatagattcaaacttggacgtcatctacacatagcaatttattcctagccagttcagggtttataatgaaaaaatatttccctgacatattaagtggctcatatataacaaaaggtcatttatgaaggaaggaattactttggaaatttatgcaaactatttaatcacttaaattatgaaaaagttccaacgcaatttggttcctgattttgtgataggaacatttttcttggtaattggtgtagtggcctcatgtcaggagtcacttcattctccttttcagaagaagaaaagggtttatgaatggtctgtatttgattttttagcacctcactattcatcagtataagccctagattagatgggcaatggaattttgggctgaagaagggagaggtatagttttccttgtgttaaaactctgtttgattaattagaatgaactgccaaggtgtttctggacaccagtaatttattatcttcctacaagtctataagagaaggattagagcctaaaagtctgtatggaactcgctatttataaattttacagaaaaacaaacatgttggaaaactgcaagtttaatcagattctacaggacttcttagaatccttgtgacagcaatatgaactaagaattggtaggaggggttatagttctttctgtttaatgtctgtaatttacatagggctctcttagaccatagatttagggtgaccccagcctggtttcacaaggtaggacttccattgaattctctctcaccagtgtgttcctcgtttggagttcagcactggggactgactgggcggcaatgtgcatgagcacatacagtctcagaacatgcactttgggcaaagagcagagcccctttaggtcagggttggatttaccgtggtggctccagtagaggactgaagctttggcatatcatgttcaatgttccttcctctccatcagatatttttaataaatgtgcaagtctttaataaatgtgaatcaccagtggtggacattttgtccaagaattgtcctgaagaggaagacagtttggaccagctgccctgggaaactcctcaggctactttactcgagtgcagcctcgctgactgctcatgctagtgcattagaaggtggccacgaggacaggctggcgctgcctgcacggcctgcactcatacctatgctcatcggctgacctctgactcttttttttttttttttgagacggaattctgctcttgtggcccaggctggagtgtaacggcacgatcacagctcactgcaacctccgcgtcctgggttcaagtaattctcctgcctcagcctcctgagtagctgggattacaggcacccaccaccacgctcagtgaatttttgtatttttagtagagctagggtctcagcatgttggccaggcctcgaactcctgacctcaggtgatccacctgccttagcctcccaaagtgctgggattacaggtgggagccactgcacccggcctccccctaattcttatatttcagcaacatgtccctgtaggtcacttctagtagtctttgctatttaaataagcttaggagcatctgcaaacttagaaagtttcctgcctttgagataatttataaaaatatcaatgttgattctggcagaaaccccccatgtaggccctttatcccaattaatgtttttcaaacattagagtgcctgacattgtgatagatcattagccgtctctgctactttatatattttctgtatctttatccttatgcatacaaagaaacttagcaccatattccattcattctaagatgcacattagtttcacattttaacttttttatttaaaatcgggcatgtcttacagttgaatagcatcttagatttgatgacatgtgaaactagaataaatgcttagaggattaacagtggaattggaattatcccttgagtgtatgttaaaaataacctgaaaagagtttgtatttaaaagtattttcagagtttcaattatgctgactccaatttttgtatcccattcttctgaattcagtttctccttccaggaggacacctgatagtaattactccaatgaagtagtgtcagtaatgacattgtctttgtttatctgaaaaacgtttttcttttaactttactcttggacggcagtgtagctggtcttagattccaaagttgaagtccataattactttccataatttgaacatgttacttcattgattcctggctgctcttattgtggcttgccatctgctccctggccagtcgttgttaccctgtggataaactgtttgattctgtacttttaagatattctttttcatattctatcgttttactacaatgtgacttagttaattttaaaattataaataaacatattataaataaactcccttgtaatatcttcaagttttctttaaagataaacacttttggccaggcacggtggctcacgcctgtaatcccagcactttgggaggctgaggcgggcagatcatgaggtcaggagatcgggaccatcctggctaacatggtgaaaccccgtctctactaaaaatacaaaaaattagctgggcctggtggcaggcgcctgtagtcccagctactcgggaggctgaagcaggagaatggcgtgaaccctggaggcggaggttgcagtgagccaagattgcaccactgcactcagcctgggtgacagagcgagactccatctcaaaaaaaaaaaaaaaaaaaaaaagataaacacttttatttttcaagtttactttaacagctatctttaaagaaaacttgaaggtactgcagggagtttccctggaggccacacagtttcccctgtgagtatcctcttgcatcagtatgatgctgtttgttacaattagtaattggatattcatagatattttaaactgaggtccgtactttattcacattttattggctttttaaatcccatttcctgtttctgttccacgatcccatccaggagtccatgtagcatttagtccttgtgtctttttaggctcctcttcattgtaacagtttttcagcctttccttgtttctgatgatctcgacagttttgagtagggcactggtcagatattttgtaacatgtctcttcattgggatttgttggatgtttttatccaagttagaatggagtaatgtgttttggggtagacagacagcagagtattatatgttatcatatcatatccagggtgcataatatcaatatgacttactgttgctgtgggccttaatcaaatggcttaaaatggtattcgtcaggtccctcgactgcaaagttactctttttcccctatttatatactgtactctttggaaggaagtcactatgcacagcccaggaagtcactatgcacagcccaaattagggagtggaaagtagtgtttcacctccatgaaggcaaagtgtctacataaattgaaattcttcttcatggagagtttgcctccttcaccccatttatttatttaatcatttatttatgttagtgtggactcagcagtatttattttatattttggagtgtaatccagtattaccttattttgttgttcaaattgtttactgttttttaccactaggtacttgttaaatttgctgcagtatccctctggcttaacagcactggtgttattttatttttttcactcattttccttctttctggctctacagtatgttccaggttcatctggtatatttcctgcccaacacctagaatcagccctttctccagaaatcctggttccttgtattggtgaatgattagaaagcaaggtttgggtgctaggtgggttcattgccattggggcgtcatcatttctaggccctttctgacagagcaaagagttatatgtgtatatagtagttcatatatacagaaatatctgtaagtatttctgtatgtaaccgtatgtatccttattaagctaaacgtgaattcatgcttaagtctccaactctcactctaaagtgagaaaactgatttctacacatggcatccatttacttaactgttcgattgcaatatacatgtacagtagtttcagaattggtaacttacaactctgtgaggagcaacttcatcaagtagagtgcaatgctgatacacagttccttgcagaatacacccagtttcaaagttacttagaccagcacctttttctcccagtcacgtcagtaaggtcgttttatacttttgtaatgcatttgaatccttttgttacattttgtattccattctggatcaccgaatctcctaagtatttgttttgtattttgcattcattttgggttactctttgtattataaagttctatgagttttgacaatgcttaatgtcttgtattcaccattacaatatgatacagaattctctgccctagaagtactctgtgctccatttgtctactcctaacccccaccactggcaaccactgataaatttacagtctctaaagttttgccttttgtagaatgtctttttattggaatgatacaatatgtagccttttcggcctggcttctttcacttagcactgtgtatttaagaatcacctatatctttcatggcttgatagctcatttcattttatacttgaataatattccattgtgtggatgtgccatggtttgtttttccattcacctgttataagacatcctgattgcatccagtttttgtgattatgcattaggctgctataaacatgtgcaggttttctgtagatatgtgtttttgaatcattgggtaaatatctaggaatatagttgttgtatcgtatggtaacactaggtttagttttgtaagaaaccgccaaatcgtcttccaaagtggtggtaccattttgcattcttaccagcaatgaacgagccttcctgttgctccccatcctcccagcaattggtaatgtgaacttttcagattttagcctatccgataggtatatggtggtattgcattgttataatttacatgtccatgataacatgatgtgaagcatcttttaatatgtttatttgttatctgtacatcttctttggtgagttgcctgttcatatcatttggccattttttagttaggttgtttgttaatgtattgctggtttctttcctatattttgaatataagttctttatcagagatgtattttgtaaaattgtatcccagtctgtagtttttcttttcattcttgtaacagtatcttccatagagcagtttttaattttaataaagtccaacttactaattttttctttgcatggatcatcatgcctttgctgttgtatgaaaaaccataatcaccaaacccaaagtcacgtatatttaatcctgtcttttcttctagtattagaattttatattttacatctaggcttatgatccattttgatttaatttctgtgataagaataagatctatgttgaattttttagacatttattttacttggtgtctactgagcttcttggatctatgatttgtgtctgtcaatggtgttgggaagttctcagccattattctttcaactattctttctgctctgctctcgcttttggtgattcaactatatatgtgttatacctttcaaaattgttccacaatttttggataatctgttttttttttctttttgcaattcagttttggaagtttctgttgacacattatccagctcactgattccttgcttggctgtgtccaggctcctcatgaggccatcaaacgctttctttcttttttcttttgaaactttacaaggcttaaatttcatttaacttacatttttgacacaacatgttcaaattgcatacaggcattctttatttctgttacactggttttgatttctagtatttccttgcaattctttctgagagtttctgctgatgttacccaactgcttttgcatgttgtttatttttcctttagcacctttagcatatttatcacattattttaaatttcttatgtgataatttcaacatttgtatcatatctaagtcctgttctgatgtttgctttgtctctgcagactgttttttcttgtcttttaattgccttgtaatttttctgtaataaagcagaaatggtcatgacattatgaatttagataagtagctttttagtgtgcgaattcatgtgacaggtagtagttgggctttatttgatgtttgctatagctttaactgccagagccttcaggttcttctagtgttcctgtttttgtcttccctcttgatgtctgtcttccttaattaagtactctttctcagagaatctacagctttttggactgtagttcacagtagttatactggacccctgttggtggggtggtaggtggggatgaggggaagaagtgttctgtaatcctatgttacatggtagcattgtagtaggcctgtgtgtctgggctctgaccttcacaagtgtttctctagtggtatagcagtggtatagctttttcccttcttaggtaagacagaaaggctacaggctgctggagtgggaccagtgtaatttccctagcagggataagctctgagaaaccctggagagtaggcttttttgtggagaaggctctgggtgacctgtttcccagtgattacttctccccttctcttgctggagccacaaggagatcttccttgcacatttactatgagaacctggtggagtttctagacataaaacccatgaaattgtagagacctcagcaagactgtggctgtctgggggcttctcactctcattcattgctggttcacactcagcaaccagagattcactgaaattaccatttaagcattaccacaagttcatagctccagtggcttctgctttgagtgagcagattttggctgtgccctgaatttcatgtctctccatatttcagtgtggtacttaccctgcagcagcagtccctcctgagtccaataaatgtcattgatttttcatttcattcatttttttttttctgttgttatgagagtgattaattctaagctatttacatgccagagctaaaaaatgatggaggtttgaattagtctttgatttatacttatatttttgaggaactcatacttccttaatctgaggaaaagttggccaattctggaaatttctcagccattatttctttaacctttcttttatgaaactattttatacacacattgaatcttttcattgtgtccttcaagtctttcaagcattcgcattttccatctctttatctttctgagttacattttaggtcattttgttgagtctgtcttcagcttactaattatcatttctgttctttccaattcattgtttaacccacccattgagcttttatttcagttactaaatttttcattttgtaaagctcttacttttgttttcttccaaatctgcgtttttacccctagaatatcttattcttttactatgtttttgatttctgtagtgcatttaatcacgttaaacatatttattcagtattatccctctgatatttctcttgtctgtatttttgggggcttattcctcctgacttggttttctctctttcactcatggaaaatgttatactttatgtattttgtatttttgatcaggagggtataatcattgtgttttctatgcaacaattttttattattattttctttcttttgtcttttttgtggtttgctaatttgtttgttctcattgcgtctgtctgggtcctcaagttttactggtctagaacaacttctaagctaatgccatgacttgcaaagttcctaggctttgtgaattggttacatttgaattctccatcagaaagaaggctgatacattttcaggaaatagagtgtaccctgacctggttctccactttcagcccagaatgacacagactaacttgcttctttcttggccaatggtctcttcaaatttcctggaccatgctggtagaagtaggtggggggtttggttcagctctccacctacgaaagagaatcttttctatagtcccacttaggcattgtttaggctctctgtgaataacactggccactggtctccatactcctgcactctgctatggtgtcagctcacgtacttacaatgttcttttcaatttcctcttggattttgttgttgttgttgttttgaaggatttcttgtgctttcttgtgagccaaaatcagcatttaaaaagacatttgtttgattttctccagaatttccaggtgtttgtagcaggatagtattaacattatagagtctcctgttttctaggaccagaagcagggcccccatgtattatcctggcatacttaactagtttctctgtgttgtagtcaccatttcagctctagctatggcttctttgtttcacttccatttccaacttctgtaatggatgtaatctcttggtgtgtttgctctgcagacactgtgattatcttacaccgtggttatctcaggtcctgccttcatgccagtaacttaattttttagctgtgtctgttttgttcctttctgtttctcatctaactacgtaataatttgttttggttctcagtttatttgtttagctctgcaatgttccttttattctgttattttattagctcatctttgaaatcatgcttaatttgatccaagacttatatagtataatataaagaactcatgagaagcatgcccttcttatttgggcttttttccaggctactttgtatattagttgtgtgtgtatgcctggctgcctttcttctttgtgcttgttattttaaaatttttatttatgtatatatttaatcattcattcattcatactcatacttccttcttgtggctgtcattccaatttgttttcatctggcccatgcctcattcgtattttctgtgatgtagtagagatgcattatttttatgttatactttcctgattcgtggcctgatttatttttgtctttgtttcttaagccaattaacctatattatttatagaagtattagaaatatcaaataacaaaaacaaaaccaagaaaaataaatgactgcttctaaatcctgctcctaacttccattcattcatcttatccccttccctttctattggcctttggaacccactttgcaccggttccataccaagggctctgttggggtctccttatctctaactcagttccttagaggaccccaattgtgatgagatttgttgcagctagctttttgacaattcattgaaaaagcctgatattgaaattacagaaattttgtaaccaaggcatttgtgggagtctggctgtgtgtataggtgtttgcttttagtccagagagatacaacttgtaaacactcaaggaaattcctgaaaactgattcagttgggatgatggcttaaacttaaagggagatttatcctttctgttcaagggtagttcagatgaagtttgattcctgctccactcagtatgccggaaacccagcatctctcttcctctttctcctctactccacaatcttcctatcactacccattgtcagctctgctaattcaagatcgattccttctctgttagggtctgctctcatgatccaccttccaggcttcattccccaagaggtaggtcctttgagggagatagggggccctttctcatagaaggaaaggaaacctttcagttgcagtgaaaagtgcatgcttgaactcttcctccctccctgagaaggatggggcagctctgggcatgggagtccacccagcgagaaccaagtggacatcaggttgggtggggctcacctcccccgggcaagctctcttattcctgcacacacaggcagctgaacaccttggtctgccttgctcccttcaatctggcattgggcaaattggatctggatttcacaggggaaacaaaaatcagtggtgttgcccggatccaggtcctaagctcaggaaacccacctgcctctgttcacctggcatttattctccctaaaggagccaggctgatcagccagttttccatcttgtcatcatgggtctttcctgggattatgtctcaaggaatcacatgctgacctgttgggaggaaaaaaaatatgtatataaatatacacgtattacactgtggtctgattttttaaatcccttaagccttatacgttgcattgttcttgaaatcagtgttctcgaactgtgcaggattaactttggtagttaaaaatagaatcaaagagttcagaatcactctgctgggggagttctagaggcagaagtttttccaaagactgcagtctctgcctcagtggctctttggagcaacatctccaatctcaggatcttcggggtgctgtgttttaaagcataatgcatttcctctgtttgtcaggtttaacggtaccgtcagaaataagcatatatctgtaaacagttcggctgtgattaaggagctccagaatcctagaaatagtgaagttccttagcttaaccctttgccaaggtggctagctggtggatgaggccaggatccaaggcttgaaggaagtcaggttgcacacactttttgaaaagattctcatctgcacattgatgcatcgcagaataaccatgaacccactgggaatattaaatgctgacctctagacacttaattcctaagccttaattttcagtgggaaccaaaccaaccaggtttcaaagatgagccaataaaataacagaataaaaggaacattgcagagctaaatgaataaactgagaatcaaaacaaattattacacagttaaattagaaacagaaaaccaaccagtaattatgtgccacccctaaaaataggcagccgcagatagtgaggagatattgccagttcgggccaattctcttagccttttcagtacctttctatcaaaggaacttttttccgataatttaacagtggagaattttgctatattttaggcacttttctttttctttttcttttttttttttgagacagagtcttactctgtcgcccaggctggagtgcagtggcacgatctcagctcactgcaagctccgcctcccaggttcgtgccattctcctgcctcagcctcccaagtagctgggactgcaggtgcctgccaccgcgcctggctaattttttgtatttttattagagacggggtttcaccatggtcttgatctcctggcctcgtgatctgcctgcctcggcctcccaaagtgctggaattacaggcgtgagccaccgcacccagctcttaggcacttttcttcctgctacctattcagtccttgcagcatgctgcagagagagcaattgatagccattacccttgtttttacaaataagggaactgagtctcagaaaagttcaggggatgggactacccctagcccacatggctagtgaatagcagagcccagagcctgtgatatctatagttttcacattgtgtccccaacaaacagaccctgagcaatcccaaaatgtgagcagaggtagagccgagctctgtatcccgagagggccaggccctgtggtacgaggaccaggatggtcctagaaatgccaagctccccatcagcagctctcagacatccaggcttcaggactccgttgctctccttaacgttattgaagatcctctaagttttgtttatgtgattatatctatcaatatttaacacattggagataaaactaagaagcattttaaagttcagtaattcacttaatataataaggccattccataaatagcaagatgttaacataaatagcattttatggaaaataaccatatcttcacccaagaaatcagtgggaagggtggcgttgctttttattgttgcaaatctccttaatgcctcatgtaatagaagacatctggactctctgaccagcttctgcattcagtctgctgctggtccctatgtcctgtagcctccgcaaacctctatggaagactcaagggaaaagggggatgaaagagggaaataacgtctaaccattatgaaaaaaagatttgactcactggtcctctgaaagcatttcagaaacccaggggttccaagcccatactttgaaaacttctgtcttgtacaattaccaaagggaattattttccgtgatcgtaatcacagtgtttgctgttacaacaaggaggacagaatcacatcatggttcaaaacacaagtgttgaaaactaaactttatgaaactgaaatccaaccccctaacctcttaaacaggtttctgtacttagctgtgtgacctagggccaggagcttgtttgtttcataattgatatatttatgcattcctcttctcctttgattataaaggtaatacctgctcatagcaaagcattcaaacagaaaagagacatataaaattaaatttggggggtctcccataatctccattattaaatgagaaaaataatagtatttattttgctggattattgtcgtgaagccaaaatgcgttgtttgcgtgtgcatgtgacatttagaaatgcaaactctgtttaagggttagctttgttattttcaggtatcgtcaatacctgatacctgatatttattgatatcctcttggtaaagtacttgttcatcttttgcccatttttctattggattgcctgcccttttctgattgattttttggagtttatttcttattctggatatgagtcttttgtcagacctactatcttgctgactcagggaaaacctcagtttgttatgctgtaaaactaagaaaaaaatatggttggtgtaaagattaaattagataaaagaagtcaccgtttataaactttagactgctacacaaatatgaatttatattatccagctattttctctgcaaacaagaatttagaaatggtggtggttaggtctattgttatgtttttgcttttttttttttctcagcatctacacaaaggaaaaagaaataatgtgatgggagctctgtaaaatcacatggaatgatgttacccagtaattcacgaaagaataattgctgcagaaatgcaagatagcacattacgcattaccacgacagttgtactctaaaccagatagacgattattcagagagattgattttaaaaagcacgatcacttaaatcaaagcatgctctcaactgaagagctcagatggaaaaagaatgaagggagttaggcgcgttgactcgagggtgccttgccacaccggccttctgggattctgtggcgggctggggaccctgcctcctcctgtcttcatcccagagggagaggggagtgtagatcttgcaggagagccgtgtgtgtgagtagccacgtggtgacagccattggcactgagtgacatcgcacagattgcagcatgctcctcctcttcccacctgctgtagcagacagggcagctgtttgcatccctgtttcggaggagagaacattgaaatgcacagaagccaattgcctgctgagtcgggagcccccagggtcttttgcctgtgtggactctgctcctccatgccctcctgcccagttggggagggcaggaatagccaggggggcagcttgaggatctggaattgctgaaacccactttcacagtgcaatggtctgaatgtttttttcccccactaaatgcatatgttgagatctgaatccccaaggcgatggtattaggaggtgattagtccatgacggtgcagtcatgatggatggtccccatatatacaaggccccagagacctcccgcgccccttccaccatgcgaggacacagtgaaaggtggctgcctatgatccgggaagccagcccccaccagacaccagggttcaaccatagtggcaggttaatcatggacttccagccgccagaactgtgagaaacaaacttctattttttataagctacccagtgtatgatattttgttataagcgtccaaatggaattaaacatagagtctgtgctacttaattgcaggcccctaggttcctgtggaatactgttcttcgggagactaaatgtgcatatttattcacaggcctctgggccagggttggatgtttctgtcccctctcttgcaggaacccccttgtttgactcgggtggcctccaacttgggagggagtgactgctgtaggcagctctgcctgctgattcatggtttcaggctcaagtgctgcatggcaggctgggggctctggcagcagtgaaggatatttgggtgaaagagaaggaaacttccctcctggggtgaggaactggattttgtccctaggtaaattctgggcagtgggagtggagcccctgcatacctgccctgaatgtccttctgccgggggccagagggccatgtgggaactataattccatctggggactttccacactcagaggtgtggccaccatccccaggtctcccagttcacctgcagcctgtgtggccaagtacaaatcccgaggcaaggaagttgagtgcagagctgaagtcctcccccaggtcctctgtgcagaagcctgtcaggaagcagggggctgagctcagctttagtgcagcagggtcgggacgtgcttgccaaggatcgaggaaggaaaaggctgtggggaaaggggaggggacagatggactctgaacctgcttttggagcagcctctggggagggagggcttttcttgccagccggtcaaggtcttataggagaagacacggcacctgcagacctattgctgccagagtcccacagaacctctttgagaagggggaaaggggtcagtcaagagccattttgcaaatgaggagactgagtcctgcagcaactgcctctcatctgtggtcacaggcgtgggggcctggagacagtaatgcctggatagagccttggaaagcagagctggtggtgggaaccgagggataaaggctcaggactgggtgcacatggtggatgtgaggggatccacatactgtggtattgcaggatcacaggtggttaaagcagaggctcagccccaggacgccaccccttgtcactctgggtgaagtccatgtccttgtcttcctccttgtagggaccctgttttccctccctccgtgatccttgttaccatttgttgttatatgttgttataagtgtatcattattgtgttgtagaatcctacctcatccccccccaccaacacacacacacacacacacacacacacacacacacactttttattctaggagctcaggagcaatattaatttccactgcacacatcaggcaagcataatgctggggacaggaggtgttccataaatgttgcatgaacgaatgaatgaaaactcggctggaccatggcttgtagcaatggcttgtgcacttcactcaagattcttgacttgatcctttgggcagtgcagttggaggagggtgatctgatcatatggatggtcagaaagtccggtgtgaagatgagtagaggacagcctctgtgtgtgtgcacctgcgtgtgcataggggcagcaggctgcacagtgggaatgggaaggaggtgagggaccttgtcactgcaaacagagagccaagagactcagaccgtgtgtggcccggacaggtgccaagaggagggagattgttctgggagcatggttcctcatgccctcctctctccctcttgagtctttgtggggggttcccctaacgggtatccctgcatgctcaggtggtggtggctgctgcttgttgattacagtttgaaaagctgcacttggtcccaagttgccacacaccactgaaattcagtgttctctaatggggtttctgttagaatgttggaaagaagaaagccttttaattagattcgtagtaattgagctcccaaaccacagaagcctttctctcagcagatgaagacacaaatgcaattaaaagaaggaaaggcacctaaatggaacccttgctaattttaagtccattaaaaacaacaactccttaataagttgaggcaacagatacacgttctgaagagttttaacagtgcttcccaataatattggagcttgaactggaactggagtgctccagccacttaaatggatagctctgttggggatcatttgctcagtgcagagtacagagacatgttagctctacagcttttcccaccaaaaactcctggcacattttattaggaaaatgggatatattttttcctgtaactgaataaatgttcagcatcttgtggacattgcctctggcctggggtcccctgagacatcatcccatgtccctccccaggcagccctctcctctctgtgggatttgccccacctggcccatctcaccccagaggtgcccaacatgtgagcaactgggctggggcactgatgtccctgtcaactgcttacatgctgaacgcattttcattttaatgagaggcagcattcgtttttcatttgcatccctgctcactgacatgccccagcagatgccacgttctttctgcctttgggtctttttttttttgaaacttcccatcggtgaaccaggccaagtagattctattgcgggagcttgaggtttcagcttctgggaacatcttcacaggggcattaattaatattttccctggagagggtgtcaattgctaattcacagagtcctttacgttggagttgattatttcatgctgaatcacaacattctcagtatgactattgtacagaattcactcatttgcctcctttcactgggcttggtcagccgtactaaaacgcaagttgcctcccatttggaaaggccagtcttgacgggtctcttctctgtacgtcctgtgctggagcaaagtcacagctggtacactagccaagctccctgattagtgcataggcttagctggaggcagaactcagggaggtgttttggaaatgtaggaaaataagctctggagtcagaaagatccaagtttgaatggctgcttctaaagtcacctcatctttctcacctttagtttatcacctgggtaggctttaccttcaggtgtatttcaagagcccgatgtgcctcctagaagttagaggttgagagaaaagcccagatctgcagggacaaggcagagtcatggccctcatggcaccactcacacagggtgcagcagctccacacagggccatggcccctttcctgggggagggaggcataacatacttgtatttgtttaaaagcatatatattttggaaacaaacctgactttaaaaacttgtattttcacctacttttatgtttttttttaagcatatgaattatttaaaaatacaaagataaatagctaaatcattagcaggcatcatttctggatggtaaggttgcagagttttaattttcttctttatacttttccatcttttttaagtgctgtataataaatgtgtcttactttggaataaatagaaaagcttaactctagggaaatgctgcttgcatatattggaagtgcttggtgcattctaatttccacacacaacaacgctctcgacagtcagatccccatgtgaataattgtctcattctttcttttgtaaaccatattatttatgctgctgctttttttttttttttgaaggatgagaagaaccaagttttaaccaccaacatttggctgcaaatggtaagttaagagaatgacaatctctcccatgggctgcaagatcttgcacccaagattcttgttctgatacctgagatgcttgcttctgagaggtcctgtttaggaaaaaaaaccaaaaaaacaaaaggccatggctgtcacaccaactccacacctgccaacaatgaatgctggctgtatgacactacagtctgcagtgctcaacacatgcacaagatcaacacataggacaaggtaatgtggggacacttcagaagcacttcaggcaagacaagaagatacagggctgtgtgtagatgtccacaacctgcaccacagccagtccccaggactcagaagctccatccctgccctctgtggcctccggagctgcatgtttgaatcaggtggagtgttccgaaaccagaggccctcgtactttgtgctctagcaatgcttataagaatcttgaaatgctacctatcatttgtagatttttaacttgacatctgcaatactaatctaaatttgattaattgcaaatgatgccacttaacatccaattgtaaatattaacactgaaaaatgaaacagtcagtctctattttaaatggaattcaaaataccataataatttggtgcccatctcattcaaacaccatatgaacaagcctttttttaaactgtcagatatttaacgtagtcccttttttctctttgcacatgcatttctattctagtttctatacggaattttatcctaatgtaatataattttatgtttgaaagtctcttttttgtttgtttgtttgtttgttcgtttgtttgtttgagacagagccttgttctgtcatccaggctggagtgcagtgcagtggcgcaatcttggcttactgcaacctccgccttccaggttcaagtgattctcctgcctcagactcccgaacagctggaattacaggcaggcaccaccacacccggctagtttttgtattttttagtagagacagggtttcttcatgttggccaggctggtcttgaactcctgacttcaggtgatccacccacctcggcctcccaaagtgctgggattacaggcatgagccaccgtgcagggccgaaagtcttttattaatcgtgccttggttttttcaaatgtaaatatttacacaagaattattcctttacaccgtaagtattaaattttgtttcttttggattgatttaagtttgctattgttattggtattataattcatcaaggtgacataaattaaaatttttaagtaattataaaacataaatttttattggcaatttatatctctgcccaagatgagtttgttttaaattagttcatgtatccacagatgactttttattacttgaatggagagaatgatagttttcacttcaattctgttgctgttttttaactaggtgtagtaacatgagtagttggacatgaaagccactttgttaaagcaatgttactcaatctttgaacttcttctaggttatatgccaaaaataatgtagtttttatcaaatgtatcagctgacagcttgattagtttctccttcaattttgttgaaaacaaagaaaagaatttaaacccacctgacctttgaaagtatttgccacccaatttgtaaggtaattcacacagacacaaacgctgatacttgaattgaccatttgtttggttcttgagtcagtgtcccaagatgggagttgaggtaagataagagaaatgtgcccttctttataaagttgaatgggagaagtgaaaatggaggcaaaggatagtcccatgtggttcttgggcagttgagttatcctgcgaatacacgtggagttgagggatagaaaatggatctgcatccagcctggccaacatggtgcaaccctgtctctactaaaaatacaaaacttagctgggtgtggtggtgcacacctgtaatcccagctactcaggaggctgagccaggagaatcacttgaacctgggaggcagaggttgcagtgagctgagattgcaccactgcactacagcctggggaacagagcaagactcaatctcaagaaaaaaaaaaaaaagaaagaaaaagaaaatggatgtgcttaaagccattgctaggtctccaaggtgcacccatagctacatgtgagactcctgcagaacctaacattagtcaggtgagagcccttgagatattcccttgcaggatttaaagcagcatacttcagtgagcatatcccttgccacctactctagcttccctccttttgcccaggacacatgatctgtgctctcctggaaggcccaggccttcttcccatggacagactcatctcctggcccctgctgagagcctggcattaatgattgtcctcgctgccagtagcatcaaaatagtgtccgtgggtcattctcactcttgtctctcccacagacttttcatttggataaatgttaaagccatggatccattggctcaaaccaaaaaccttgaagtcacccttaactcttgtctcgcacacctcacctctgatacatcaacaaatcctggcagcttgacctgcaaaaccgatccaggatctaactactgggcatcaaccatgatgctttcaccctggtctacatgggtgtcatctctcacctccattattaggagtccccatccagccttcctgcttcagtgttgcctcttctggtggtgtcttgtcctcaacatagcagccagcatataccttcttggcacagatccctccaggggctcctgtctccctggacagcataggaactgaagtcctcgaagtggccttggattcaattccctccttgcctggctcctttttcctctcccctcccctctgttctttgtttcctggctgcactcactgtccacttgttgggtgacacacacgtcacccgagcccgtgcccccccctcagggcctttgcactggctgctctccctgccaggaagactcgtccctaagaaccacttgatttcccccttacttctcactgatctcttcctaaaggtcaactcttcattgagtcttctttgagctccgatgtactgtcccaaaccctcccctccacctccagcccactctgttctctttatcctgtttcatttttctcccaaaggcttctcaccatgtaacccgctttgtgttcactcgtctatctgttcattggttctgagtcttcatcacccttagaatgtgtgcacagtgtgggggacagggctccaggtgcattcggtcactgccgtacccacagcccctagttcactgtctcacctgtagcgggcaccaaagaacttttgccgaatgagagaatgaagcaaaaactcaaggtgaaccttgaggtgcttgggtagcgtgacacaacataaagccatctcctgaatggccgtgcagcactttcgtactgtgtgtataaggccaggctccggagaatgaggcaagtgcttccctttttaattaaagttggacgtttgccatgccctctaaggaacaacgctgctgttgacatttttcttacagagagaaatgcatgttatggagaggtctctctccctggtgcctatcttccttagccctcagtaagtgactggtcttcagcaatgtatatgatttggcaattttatttaaaggatggtggtttccaagaaaaatgtaactggattattacttccagtatggaattcagatgctccacaaataaacatccttgcttcagagggtgtcaccagagacctctaaatttatttcaagcacagctaattttaattaaggcttacatttgcagaagcatctgcagcttcatttgtttgaaaactcaccttttaactcacctcctcttggagcaacctactctgtggaaggtattaaactgggccaggtgaggggacccagaaatacataacccagtttctacctttaagccatttatgatcaggctgtgtaattaacacgtttagaagaaggaggcggaggagaagaagaaggaaaagaggaggagaaggaggaggaggaaaaaaggaggaaaaatggaggaggagttggaggaggtggaggaggagaaggaaaagaggcggaggagaaggaggaagaggaggaggaagaggaggagaggaggaaaggaggaggagaggaggaaaggaggaggaggaggaggaaaagaggaggaggaggaaattaaaatagcaagaacaagtatctccccagggatattacagatgacagctggtggtcagatagtagaggccagacgtgggagaaatctctgctttaaagaaatgggagagaaggagaggcacaaattctcctaaacgtgaagatctgggagcactggcatttctgagtattttgtcattaatgtttacttttaggtgcctaccgattgagaaacatgctggattcccttagaaggtgtgccctcataaagctgggtgataacatttatctggaaagcggcacctgtagatgatctagcagttgtaacactgtctcccaactgaatttttaagggctcacaagaatcctgggtttaaaacaaaccttaacagtcatctagccagtgcctgtgtctctctgctccccgcccccacccagtgtttcagtctggaagccctggcatttctattcatgtccacagcatggacatgaggaactcaggagtcaccagagcaagcttggatgctgcccagaggccacttctaagcaaccttccattgattgctgttcttgtgttccctggctggggaccagcctggcttgacccagcacgataatggacatgcacaagtgaagctgggtactgaaggctctcagggccagggttctgaggggggtgcaaatgtgggccgggggcagagagccataaaaacggctctagcaatgggtttttctcctcccgagtttcatgttgctgaattcctgtccagaaaatctgaatccacataatcttttctctagggtatttaaactctgcaaatgatacattttctgtttattaaaaatggaaaaggcagaaaggtaaaaaaaagaaaaaaactctccttgacctccagtttgttggttttgttattctttctcccagttgcccttgattttgatcattcagaaacgtgagggaggagaaagaggcttcatctctctgttcacctcttcatgttccgaggaggaagcagctggttcctctgcagccggttcctctgcagccagttttctctgcagattagtttttatcattttgagagggttgtcagacataatctgatttaatctatgagaaaaaaatgacagaagccatttcagtttctgaagagacatttgaaccatccagagacttacatttgcttttaaaacacctgtcttctgtcattttgcaattgtgaccattctcctggcatttgatgtcccagccttcctgggtccttctctaactttaacctcctaattctaattatggtactaatagcattcacaccatagatgataagattttaagctgttattttttctaaaatatttacctttttaatttctgcattcatcatcacttgatctctgacacatggaaatgccacgcttcctgtttacagacaagccggctagtggcttgcttagggctgtgatggcatctcaaggtgaagagcgatgtgtcaatcattatgtctcaccaagagaagaaagcgtcagggtcagtggggtggaaaggctgctttcctccactaacaaaataatggacgggaataattttgaaaagataagtgttttctgacatcaaacgtgtgatgacttttctagcaccaacaaccaattttccaccagcaactgggggtccaccaattcaattcatttctcacattatctacctggagttgcatcagatcccacaggttaaagggctcagtctcacttcagataccagctgcaaatggtgtacccaggctacccacatgtctagcaggtgactgaaaattcgagggttcccatacccttctcccccaggttcaataactttctaagatgactgacagagctcaggaaaatactttgcttacttaataaaattttaaataatatacaaacttatttaatatatttataaataaaatatatttattaaataaatatttaatatctacttatataaaataccctggagaaaagattacatggattcagagtttcagaacaggaattcagcaacatgaaactcgggaagagaaaaacccatgacttaggtttattggcttattctaaaggatgcagctcaggaaccaagtggaaggacgcagcggacagggcgtcgtggccgcaagggtgcgcggagctgttgtcgtaacttctcgccagtggccaccttccctgcaagtggatgtgctgaccaagagtgtttataaccccgtctcgagcccctttctcacccctccccagagctgtgagtgcaatgggcagaaagctctttactccagtcactaggtgaccagcccccatgaaagctatctaggtgcccaaccctaagtcacctcatcagcgtaaactcaggcctcaggcatggtcagaaggggctctgtatgaatcacaaaagacactcctctcactcaggaaattcccagggctttggaagctctgtgccaggaaaaccaaatctattttcttattataccataatgtatttttttaatgaaagataactttcctttttcctccctcccttcccctctctcatccctttcccctcctccgccctccctcaatgcttccatgccactagcatccacacacatttagagtttcctgtgggctcgaagcagcacaaatagggcccaggtgccagagccatggaagaattgggattcccccagtgccttttagatcaatggccccttcctcccttcccttcagtgtcccctcacaactccacacactcttcttttgaagatttaatgagaaggaatctcacaaaaggagggagagaaggaagagcacacactcctctaaatgtgattgtctgggagtctaggttcattgacgcttcttttcagatccccactctgtggaaaacgtgtcaggtgctgtctacaaagattttgtctgatgccccctgttcccgagggacctaggaaccaagtgctttcagagaacaaccttttttctagaagtttgttgtttgtagggccttattccatatccattcttgggaaaccgtcatgggagcctgtgggggttgctggtggggcccccgggctcaggattgtggacctgggctccagggcacacagcatgaggttcccactgcatgttggcactcagtcttccccacccttggctgcagctatgttatgactgttactacagctcccaagtccagcaggattttgtaaaatggggaaatctctctctctttttttaagccaccattcatcacttgcctgccagggccatatgactttaatctgctgctgcacacattatctcatctcatcctgtgaggcagggtacatgtaaggaaactgcagttcagagacaatgatttacctgaacaagctcacgccgctagtctctgccagacccttggtgcaaacccaggtctgtctgatgcggatgcttttggcagctccccctaccttttctgccactacggttacctgaaaagggttccgatccagaccccaagagagggttcttggatctagtgtgagaaagaattcagggcgtgaaagtaagtttattaggaaagtagaggaataaaagaatggctactccatagagagagcagccccgaaggctgctggttgcccatttttatggttatttcttgataggctgaacaaggggtggattattcatgcctctcttttttagaccatgtaaggtaacttcctgatgttgccttggcatttctaaactgtcatggagctggtgggagtgtagccatgaggatgaccagaggtcactctcgtggccatcttggttttggtgggattcagccggcttctttactgcaacctgttttatcagcaaggtctttatggcctgtatcttgtgccaacttcctgtctcatcctgtgacttagaatgcctaaccatctgggaatgcagcccagtaggaggtttcagccctgctttacccagctcctatttaagatggagtttccctggtttaaatgcctctgacacaatggtcagcctggtttggggcaagggaaaacagcagatgggcagcagcatcagggagattgagccagaagaaccagctctggtagaacccaaagatcagtttgcttaaagtcaaataacacaggtaagccctgacccagtgactgactaaaacatcctagctttctgaaccctggcgtcctcttgtaaatggaagcagtcatatcactgacccccccgaactatggtgagtctgctatggtgagtctggacatacacaggacactggactagcataaaggctgtgatctggccggggaggggatgagcccgtggtttacgcagtggggtgtgcggggtgtggggaggcagcgtacagctctggctgtgccttggacgaggtctgggtttgaccatccaagcactcccattcccattcccagttcctgtctcccctccctctctggccatcattcagcaggcagaggagaaggagagaagtgccttggcctaccatgcccactttccagggcagttcgtggaatcttggggccctgacctgtgtggtaataatggtgaacgtgactggctctgtgataattagtgaccgacacagagaagcatcccagggtgagatgcaagactgtggcacagaaagcacaggtgttggctgtggcagggccttgtgcccagggcaagggagagaaatgaagggaagcacagggcagaggtgccaagttggagcaagctgcaggaagcatggcttggttggtgcccaggcattcctggaagacaactaggacaagacccaccattcctgggtgtgcccctcctgtcccctccccaaccacttccatctcattagagaccccagcaggcagctgtcgatcctgaatgccccagaggatacttctgcacatcacccattaacacatcctcattcctggaggtccctggctgcaaaatgatgtcactcacctggatagttcctctcctttgatgtcagattagatccttccagacttgggaccatctttctggatgctgcctgccctcctcagagaatggttggtctgggacatgccctttgcttcccttgttgtatcaatagctctaggcccacagcccctcatctgcaattcccaaatctcagcagctctgaaaatttttccccctcctttgatgttgttttcgtaactttgcgtcaaattattttggtctaaaatcaaattgaaatctatgtgaattgaggcatttatttgtctcacttagtgcaaataggcatgttttgctgcagaaattaccatgtatttgattgtgaggagccaccctggtcccaggttggggtggtgcatcacatacctttctggatcttggaaagcctgagcttcagagcatgggtggtaccagggggacagaatacaggataatggtgcaattataggagcttctgggctcatacttgtcagccctgagcctcctgtggggtggtgctggttatgtggcagctgcaggtgggatcccacccgagcatcctctgcagagcttgtgggctccaggaagggctgtttagcacctgatcctcggagggatgaccccagacgtgggtattcctctggcaaaagtcactcgataacctcaattaaggcctggccgtgagcttgtgtgagtgcttcctgagtcttcacctgcctcctttcgtcctgactctgcgtttcaccatcagggctcaggatttgcattgtcgggtgtcggaagcactatccctgtgacaaaataaaaattcaaatctgaaaacattcctttagaaattctgagaggttcccatgcagctgcacagtattgctttatggaaataaatattccacatttctccagcctggttcttagtccagtggaaataagtgaattccttttttcgaagtattcttacagtgaaaacttctaaggcaaaacagttattcatttggctagaagtaacccatctactgcaggaggagaaggctcggggacatgcagagggttggaattaactttaatgataccatctgaatgtgttcatggtgacagcagaaccttaaatgtgagttttatgctcttcacagtcattttggaaaggatttttgaattcccattttcattatattttataaatagcaattcagttataataaatgtctggaattctctttggttttgcacttacctaataatcgcttatgagaaatattagtagccaaggaagtgaagtgctgctaatgtcattgtgtgtgtcagtcttggacagatcactatttacagtggaatgtgtcagaatatccaggggtgaagactgttcgtttcccagatggccagatttggaaaccagacattcttctctataacaggtaagcatattgaacaaaggaaaaaaatgattttatgcttgcatacatgtagctatcacgtatatttgaatatttcacagagatgctggatatgttatctatgatctggggccactgctccctacacggctttccgagcggccaggcctttgagaagcagctctgtccctgtaagccagcattccctggtttggcatgcacacgtgcacacgctggctagcctgctacttaagacgcccatgaagttgtatgttctcggggcctagtgttgtttctgtgcatattggcacatggagtattcttgcataaggcagtacctttgttctctgaatggcagcagttatgaccaacagcaggaagtgctggcctatgggatgcactgctggagcccacagtttggacccacatcctcgtctatgttccctgttgtgcattggagagttctgtggcagagatggctgcaggtgagcgtgaggactgtcatctctagctgcatgcagaaacttcccctgcagggtatatacctgatttctaatagtctttctcctgaggtcaggaaataagggacacgtcggtaaaccaagacagtctgacttgcagaccagatgcctaaaaggcaattattcaggcagggtaagtttctagaagcagtaaaatttctcgttaaactgcatagtcaaataagggatcccagaacatttctgactaataaggtgtcagacctcataaataacatcatgaaaagaaagttatttcctaatcatgaccgctacctttggtcatgaagaaggaagcccaggctttcctgatgcagggaacagtgtgaccaaattgccctccatggtcactcggtgatcccgctggacaagcaatgtgttgtcctacatggctacttccagaaggctgggcgatgctatttcttgtatggacttttcattctgcctctgtctttgcatctgggggccggccacatttcacttgaatcattgggcccgtttctagaagagtatcctcttctcatttgctgccacttttctgcttctcaaattagttcagacaactgagctttgaaaaacgtctaaaataggagtaagtggtcccctgttgaatggatcaaacatgtgcctttccatgcctggactttgggtcttctgtttcttggggggctgtattagtttgccaaggctgctgtaacaaagtgctacagactcagagccttaaacaatagaagttaccctgtcacaattgtggaggccagaagtctgaatgaaggtgttgtcaggactggcttcttctgagcctctctccttggctggtagatggctgccatctcactgggttcacgtgaccttcgcttgtctctgtccgtgccctagtctcctcttcctgtaagcactgcagtcaaattagagtagggccccatgctcatgaccctcttttactttaattacctttttaaaggttctgtcttcaaatagagccacactctgaggcaccaggtattaggatttcaacatgtgagtttgagggagatgcaactcagtccataatgagggcattgtatctgactttttgagggcaaagggtcagggttgaagaagtctccgtgttaattttagctgtaatatttacagtctgtataacctttgagtctcagatttctcctttgaaaaacggggaaagtgccggcttcacagagttcggaggatcgctctgtggatgtgtgtagcacacttagtctggcacttggaaaagagcacacattccgtaaaggcagttgtgtgtttacaggcagaatgatgaggattcctgcttttagaacaagatggtaatttaacaatttagaaaaaaataatcaatgtttttcattttccaattcggattttttaagtttgaaatcaagaataaattttataacattcagcctgagcaatgtacgagacccccatctctaacaacaataacgacaacaacaacaaaattagctgggcatggtgacctgcacctgtagtgccagctactcaggaggctgaggtagaaggatcccttgagcccagcagtgagctttgattatatcactgcttgccatcctgggtgacagagtgagatgctatctccaaatatatatatatatatatatatatgtatatatatatatatacatatatatatatatacacatacatacatacacacacacatatacacacacacatacatacatatacatacacacacacacacagagagagagagagagagcaccccaccatattatatgtataacatgttggtggaatcttattaacacggttacaagaggcagtttatatggcctatgtgtaggatctttaactccaaaatgtaaaatgtttgatgattccaaatgctctggctaatgaggaatttccaagttgtaattgaatttcaaggagcaaagatagagcagtctctacctgacaaatgttaccagggtccaggcccttagaaatgatccccacctccacatgcctgacccagctgccggtgcagaaccccatcgctcacacatctgttgagctctactgaaggatcctgctcgttcctctttcccatggtggacatagaccacgtccgccaggcttcatcatggaggatgtagaggctgcttcaatttctgcttttgttttcctgagacatggaatgtaggactttctttttgaagtaactactaaatatattttgaagtaactgctaaatatatggcccgcaggtccacatgaacccaacgtggaatgaatagatttcagagaatatttaaaccactcatagacacttatctattgctacagaacaaactcctcagaactgagtgacttaaagcaaacaactcagattattcctcatgatgccgtgggctgtccaggcccatgtggctggttgtctctttcacgtggcattgggcacagccatgggctggggctccactgggccgatgtgctgaggggtacacttccacagcggggcaggtctgggctgagctggtggggacgccggccctggcaggaagctcagccattcagctggggactgtgcacccaccccttctgggccttttccacaaggctcggtgtcccccagcttggtggccagcagtgctctgacaggaaggaaggagaggctgctgggactcttaaggactgagcgtgagggtcccgcaacagcccttctccacattctgttggtcagagtaggcaggagcccagcttggagtcaagaaaggggaaatcagcacccctatctagggcaagagggaggccacagggtgctctggggacactagtgatcacagctaaggaaggaaagcggtggaactgcaagggtcaaagtaaagccccaggaaaccgaaagaccagaagaggcgtgcattgtgaaggggaaggcacgctccgccatgtgcctgctgaaattggcaatgtgggaggagaagcaggcaggaggagagagcttctaaacaagacagatcttgtcatctctgcccccccttgctggctggcttccccttcctgcctggacacactgtgcagcccccaggtatgtgctgaccagcctatccctaccctgtagcctcgtccactctccagccctactgcttgtcctttggctcattgatgcaccaatgcttccaggcagagtgtttatatgagcgtcttgcggggcgaggaatgcccaccccttaactcccagttagcaagggaaacctccctgacaccctcacccctgccaagtctagaacacatttctctgtcacgtagaaaaggattcctgtccacgatggcacttagggtctgctacctcttaggggcacctagcagggcacttgatacacatttatgcaaagacaagatggagagaggaagggagggtgcaggaattattaggaggaggagcgaagaagatggatcagtgtaatacagtgcggctaagaacagccagagaagaaagaaagcaaaggaaagaaatcatgtaggcaacctagaaaacattcaactgagactgagtccaaaaattcacacaggaaatagcaaaaatagtcttcactactaatatcctaaccctctgatattctgttattggggattttgagagataccgaatttaatgctttctgccagcttctaggcgtggaaaataatatgttctgcttagtagactcatctgttagttcattatggtctgaatggagtcgaggggcttttcctaaaggagggggttaaatgcatcctgtgtaagccccagttttgaaagcagtgttgatgtagctcagctgaagcctcccaaacatgtctgtcctatttctcactctattctcgtttgatattggagtccccacgtgagtcactattgctttttgagatataatgcattttccatgctttaaagtggctgggtcactgcaaaacagccatctctgcatcatttgtggaatgggctgctgtatttccttgatgggtgggtaacaagtcatgctgctgccagccagctggccaggtcgctctgaggagaggatgggcacgaataaaagcgtctctgtctggtgctgatcccagtcatttctttgttgctttattttgctttactttaagcctgcggctcaaggagttttctgaacaccatcttgcctaaagtgggtagcaattatggatggcttgccgtgattttcccctttggatggaattaaaggccttgctgggatcagcagtccgcttgcagaaggacagtctgaatcccgcaactctgcggatgcccctacaccgtgcagagacaggcaactgcctcaccctctctgggcttctctgtttctgagttgctcggtcagaaaattctattgcaataatggaaatcttttttgatgaagatatttaaagatgtttttgttggctctgaaagtttagaacagcatggggtttcagccatccattttcattgagtgtgcaaagctgcatttgtcatctgcagggttgtgtctttcactcattttcctgaccctgtggctgatagcagaggctggagaggggacctctatgcaggacacacttgagagcagtgtggccaagcctgtaagcactcataattgtgctcatcattgttgccaagcgtcttagggaacctgggggagccaacccaggacaaggattcctgagcatgtagcttatttgggaagggatcctgggaagcaggatgaggggagggggagtgagatagggagggcaggcaagccgttggagtgagcattgaaaagcaaatcatactgcgggcaaacagagcccattcctactggggagctctgggagactgtgtatagcacatctcagccttgttctgaggaaactgggatgcttatctgccagctgccttccatcataggctgagagctgcttccaggggtgtcagctccctggcacctctggcttgcctgccccatgtgtggatcaagtgcagagctgcagatgcttgcagtaggcagctgtcagggccttgggcacaggaggatgattgtcgacatggtctgctacagcgcagatgagccatccactcaagttctagttgctttcaccctgctttgattgtagatccaatctcagcttctggtagggagcatagcaacaatatgggtggaagggagagagtcctaggacttgagggtcctaggggtgagggtgttctcagccagagcagaggaggcaggcaggtggcaaatttcactggactaaagaagagcccaagcctgcatcccagcaaggggtgcctattctacgtgggctgcgatgtatctattatggagtcatggcagtgcacacatggaatggcatcttagggagtgaatctgtgagatgtagtgttgtcatggttaatagctcctgaaattgtggtatccctcagcctaaccgagattggcctgctggtgctcaaaggctcataatgcagtcatggccaggctcttggagggcccaagggcatcactggaaggtgatgtggttgctatagtttgaatatttgtcctttacaaatatttgaatatctgtcttctccagaatttgtgttaaaatttaacccctaatatgacagtattgagaggtgggacctttgaaggccaactgggtcatgagggctctgccctcatgaatgctttaatctattcatggattaatggatcaataggatatcatgggaatgggactgataacttgataagaagaggaagagaggcctgagccagcaccttcaggcccctccccatgcgatgcctggtaccaccttggcactacagagagtccccaccagcaagaagccctcaccagatgcagctccttgacctcggactcccagcatccatactgtaagaaatgaattcttttctttataaattacccagtttcaggcatcctgttataagcaacagaaaacaaactaagacagtagtagttccaggtgagcagaggtaattttgctgctggagatctcagagaaggagttttgaggatgtgctgttacagcttctgtattaatcagatattcacacctgagctggagggaggctgtttctaaatcatgtgttgtgggaagagggggagcagcagcttgttttaaagcagtgagtggagccagccaacctatgtttgcatcttcaaagtcatcctccgaactgtccatctcactctcccaggtctcatcatggtcgctcttgctgtttgtttttaatttgttcattcactcaaccaatatttagtgaaggctccctcagcataatcacacactgttctgggaactaaggattcagcagtgatccagccagacccaaacccaccagagaaacagagatggggaagagaggagggaggcatgggccagattgtaggtgatcccagaaaaatgaagcaggaaagggaatagtgagggctgagccagaggtcagggagagaccaggagacagactagagggctgcaaaggaacaggccctgtgatatcaagtggagagagtgttcctgacagaaggaacagccagtgcaggggccctgtcaagaaggcttgtgaaagacttcgaaatgcaaaaaaaaaaaaaaaatagtgagggaagagaaaaaaagacacctcggttcctacagaatactaggcatggtcacaggcaccttcctggtcatctgagtctgtagtggactgtgcctgtcatggtcttcaaactagttttcaactctaacttctagaaaactgatggcaaaaccaatgattctagtccacggagaagcaaatgtgttttgctggtggaccaattcccctgttgacagattcagatcagtgtgcctggttgtctttgtatgtgtctgcttttaggatgctctgcagaattggttttaacattttcctggttccttccttcattaatgacttaagtagtctttgacacacgatcactttatatttgtgcaagtgtcatgattttatcttttaaaaaatccatcaattgccctgaggcgggaacatgctatccaggtctgtcctaggagcaaattcagctgctgtggctggagagaattggtggatggggaagccagggttcagagagagggtcagagacatgatgggaggagctggggaccaagtcgtggaggccttggctttgactgtgagacaggagaggccctgatacctttgacagaatttttgtttcagttcctttttgctttgaacattttaaaaaaaaatatttattcatattctcctcttgacttgttagcaattgattcccatcaggtgattttgtccagaagttattatctgttcttttctgcttgtacactcctcccagcctgtggcagtgggcaggttttgcttttgttgtttcttctgacatctcagcaagaggaagggaggaagggcaagtgcgtgtgtgtccttaatcagcctctgatggcccagctgtttgcctcgggctaactcggagcccacctgtctgcaccagagtgagtggactgtcgctggctgactgttaatgctgtctgcctcatccggtgcttactgaaggtcccatgcactgcgttcagcctacttgcccgcagctcctggtcttcagcaccctggagccaagccccctttactgggcactcgcccagtgccagcagatgatagccaggaaattgtggctttatgccttctttctggactttatgaagtctgtttgagtgtccacaaatctcagggcgggaagctggtgctcagagaggttcagccacttgcccgaggtcactcagctgggtctgcctgactccatagtctgactcattactggccagtctctcgacacatcaggaaagagctcggtctcttgtgctttattttctaaagttaaaaagcagagagatcccctttccctccctctgagctggctccactttcgcacctgctctgggctgctctgccaggctcagccttccacttcctaaaaagagtgagtttgttttctctgaagctgctgtggggttttcttttcttttcttttcttttctttttctgaagctgctgtggggtttactgtcgcctcttgactgatttcactcagcatctgacattttcttttctttgaccaaatcccctgccagccagtgtgggccacagggcagtgccacagcagagcgtggaatgacagaacccaactgctgtctgtgcaagagtttgagcagaatttcaagcagaggacaggtgctgcggtgaatagaattttgtggggatggtgttgcattgaggtggcctgggtgaggctgtcttctggcatgtggcaacgggccagtccacggagcagctccccaaccccctgcacccccaagggccctgaagctaatcgtgcccaagagcacggcttttggagatgagcttattgatctttgtgatgtggaacacagagccagcacggttgtaagggctgtgtgataaatacatgagacaggaactcaatgggcggttcagtcttcatcatgagctgcctgagggagcagtgcgggcagccaggtgagggccagggtccgccgccaccccgccccttcccgagcctgctgtggggtccctgcgcgtgtccactgcccactagagatgcgctcttcagctgtctgcacaggaggagacttaggaagttgtgtgtgaggcatcagaaggcagctgggcctccccagcatgctaagacctcagcagtgcagggtgtggggcccgagctggatgtgccccattgcttgtatcaaaacctggagaaacagagctttccttgtgggccagggccacatggtcggtggagctgatgctgtcagtcggccgggtggtattttctggggacctactctgtgtaagacactgtgcttctaggaagacgcacattcactgccctcgaggcatgtgtaatcagtagcaaatcagtttaccgtgggtggtctcatctgacgtatttttgtgtccttcagtgaagtcatctaaaattactctgcttcacaattgaggaaatggttcctgaaattaaatggcttgttgacgcagttctgaggccttgactccacatcctcgtgcctttcccagtccttgacaggctctttgtggctgtaagacaagggcacaaagtgcatcttgcagagcagaagatgacgtatgtcagggacataacatcttagaaagatctggaagagagagagcctcatccagtgggagggtgtgggcaactgttcacggcagggtggccatacgtcttggtctgtctgggacagcccgggtttgtgcctgaggtcctggcactgctgttaatggtgccttttttcacttttaagatggggcatttcatggaaagatatgtaagttaggtcatatggcacagggcccttagcggggagggggagagatcaccttggaagggactaaatgtggcaggatcctcaatgcatatgcttggaatgaaagggagagggaaaagaacagaataatcaggtcagggactagctataatctaaggaattgccaccagtccaactggacttctctggaaatctgtccctgacgcctggccacagtcgcctactctgggctgctgtgtaccttggaggactctttgtaaacatcacacgatgctgcggatgtgagtttgatactcttgtttttccccactgtccagtgagctccttgggagcaaccaagttctattcacattttgtaatccccccaagttagtgtgacaagtagcacatggcaagcagcacatcgcagtgggtgagggactagtggggccactaccctgttccaggagggagttgctggaggccagaacctgggcagaaccttggaactcaggctgtctggatcaagagagccatcttctagcacccttagattaaaaataagtaagttctgattgtgtggggcagggatgtagggtatgggtcctatcccgagaagcaaattagtctagaaatgattctcctttctcctccactacccataccaatctatcttgaaggattatgcatttgaaattactctagtcatcttttcacattatttgtggtctttttttaatataaattttacatccttagctaatcacatttttgtgttgtttcctttatggatcctttatggctttggggtcccagaccaggagactatccatttattctactaaatagtttgttttttattgtgtatggttttttttccctaaaatgtttgtgtatgctatgaggtaagggtctaactttacttttctttaagggatagaaaataattctaacagcacttattgagcaatacatctttctccccatggcattgaagtgggatggttatattcatttatgcatgtgccaataccatactgagagctaagcagggtgaataaaaagagacatatgtcttgaatatcttgctgcgattttaaaacactcatgataaaggcaaaacccttataagctctcaaagcaaaaaaaaaaaaaaaatcacaatagcaagaaacagtagcctagtagaggactactttcaaatattgaagggcaattatttttaaaataaaatattttgttgaactgaactttctgggcaaaaatgaaagcagttttaaatatgtaaagactcaagtctgaaagaattactcagaattgtattccagcaaaatgagaagaaaccaagaaagaggcaaacctggaatataatcagcactcgtgagtgatggaatcactaaaaggcatagttcagtctaattatttgatgatgttgttaaatggtttttgttggcaggggactaagaagtagaagaagtaacagcagacgtttggtgtcggccttctttggttcatgcatgataaagataaacctcgttaaatgcacaaaatgaaaaaaagtacaagtaaatatgtatgttaaatatttgaatagctatcagagtaacagaaatagtgtcataacttccagaccactagagataaaataagggaccaaaacctgaagtcgatacctctaatgcaagaacagaaaactgagaaacagtgtaagtatgaggtctctcatggatccctggcatgggtatgaacattattttaaactgaagacatttgagattaaacagatagggaaagaagctttttcagagcttacttatcagactacagcaaaaacttctgggagcgagcctggcataaatctcctttctaggggagtctttactggctggaaagaagatggaaaagaccagttgcacctgcataaacaaaactttcccacagaccttcttatctcccatttgctcccctagaaaccgatttgttcttttcatagaagcccttcctctcccctctctctccgctgtgcagtatataatctcacctttagctgtttgaagagttgcatttttctttgtgcccctgtgcccatgtaggcataaaagtcagttttctcttgctcatctgtcttttgtcagtttaattcctaagctcccccccgccaaaagaatctataagggtagaggaagagcatttcttctctaacatgagaaaatctggccaaaaaaaaaaaaaaaaaacagcctacaaaaaaccagaaaacaaacctactagcagaaacgagttaaaacaatcactaatcacaaaaattcaaatggatttaaatcccataacagttctcaaaccaaaacagactcctagatgggtttcaaaaaatcaaaatccaactatattgtatatacagaaggtagattttaatcaaataatccaaaaggttgaaatgaaaaggatcgaaaaaccatgtctgccaaatgccataagaagaaacagatttagcattgttcttatttcacaaatatagatgaaagacaaaatacgtaaaaagggacaaaatgaatattttatattgattaaaggaaaatttattgagaaaacaaagtgctcatgaataattatgttgcagtgtgactgcaaaaaatacagtcaatgctgatgaaagtcaaaggagaaattaacaaaaaccaggatctcaagaaagggtaagtatgcttacatggaatgaaataaaacagtggttaaaactaacccagaagatatatagaaagatttgtatctaacaaatatttcccaaaagtagtaatattcacaaaaaataaactaagactggaagaaaattcataagcagataaatattactcagaagaaaactggcaaacaaagctgactgttgaaaagtcaggtgaatccacctcaaagtcagagataaggcaaagatgagaaatgttagggactgaatgattgtgtcccctcgagaattagtatgttgaaatcctaacccccaaggtgatggaattagaaggtggggcctctaggaggggattgggtcataaaggtggagtttcatgaatgggattagtgtccttataagaagagacacaagggctttcttcctgtctctgcttatttggccatctgaggacacaaggaggagatgtgtatctgcaaaccaggacagttgccctccccagacatcagatccgtgggtgctttgatcttggacttacaggctccagaactgtggaagataaatgccagaactgactaagacaacagctatcactgctttcaactgccgggtggatgccctagccggagccctatgacagcaagttaaagaaagatatctaaatattacgagaaagaaaaaacactatcattacttccagttggttagtcacctaaaggcagacgcagctgacaaactttgaactaataaaagatttaagaaagaagacaatagctgagctaggtgtgagtgaagaacagtgaagtgaaatggaaagaacagacctcatttacactcatgatgataaccataaaataccaaagaatcaacctggtgcccatgcaccaaacccttctgaggaaaacgataaaaattcaccaaagcacctgaaagagtaaaagagtcaggaagcagcatgtggggtctgccagctctccttcccctgcagctgggccatgtgttggaagcctggagtagcagcagggttactgcctggggtcccagagtcaaggacttagaactgctgtgcccgggctgcctagtagactctagagacgctccgctgcagtcttctggggtcaagaggggacaatcggaaagagctttaaaaactctcaggctgctcagggagttcttagatagtgctttgggctccatgtgcaggatctagatcctgcttgcctggtttgctcttctgattcgatgttccaatatctgctctggctaagaagctgccgagtgattgttaacaatggaaactgcatctttacctcctcagggtctgatacagcaggtgtggagtacagctcaggaatcggtcatacatggtccccctggatcacttgtgaaagactctgtcctgctgggcatgaatgccagcttgcattcctttaattagatggaaactaggaggtatttggtggctggaagtcatgaatttcagcccatacacttccttcaattacatgcttgtctccctcctgctgtccagagaaaaccaactgaatgatgaatagtgctctcaccattggtagctgatagcaaaaaaaaaaaatgatccagaacttcattttgacaaatgaatgcttctccctgatacctagtttgtgcttctcattttcccagggatgcattaatgctagagaactttagtgaatcactacagaattacttatgcattttgtagttaataggcaaaatatgttgtgcctgtaacatagctcctttgatgttcttagtaagcagaacgtagtatggattctactttattgacttccagatggtgcctctaaaggttatgactatgagctagttaaatgttttgtccctaccagtgggttcatggcttcataaagacctgtggtaggtagcatctgagtttgtagtttgcatttatttctgacttttaagtctacattgacacaatctctttatcttggctttgttgaactctgcctcatttattatgaaagctgacttcaggttgagggcaaggcaaagaaagaagccttcgtatttcaaaagaacaagatgggtagccacgacacagtcaaattggttaatttctgttcctcgctccctaaactgctaaatttcattttatatatcttccttcagtccatctacttaatatattttatgtggttagacggactgcatttttcactcatcctgttttccatgggtttttctcatcatcattttaatagtgacataattcatagagatgatactttctagttcaccattgttggatttagtatgtttctaacagattaataattataggtcataagaaatggaaaaaaaattatagggaggtacattttcatattcctcctaatattccccagcagtaacaccttaaataactctagtgtaatatcaaagccaagaaattaacattggtatattccacaaagtttattcagatttcaccagttttacattcatgcatttttgtgtagtatatataattctaagcaaattcatcacatgtattgattcatgtagccaccaacaaattaagataaagaactgttccacgactgtaaagatctcttgcactatacccttatagccacatcccgcttgtccctaactactggcaaacactaatccatctctgtcattgtggcatttcaagaatattttatgtgtagactaatatagtttgtaaccttttgagggtggctgagtagtggtctgtggtatggatgtgccacaatttgtgtaactattaatccattaacagatatttgagatgttttcagtttttcgctattgcaatcatagcttctataacatccatgtccatgtttgtttgtttttgaagatgtttccattcgtctggtataaattacataagcacgcaattgttaggttgtataataagcagatgcttcattttataagaaactgccatactcttttccagagtggccgttcccacctaagtgatcaagtaattccgcatcctccccagaatttggtgttatcactattttttttattttagccacgctagtaggtgtgtagtgataacccattgtgtttttaatttacattctcctggtggctaatgctgttgaacatcttactatgtggtggttcgtcacctgtatatcctcttcattgaaatatatgttcatgtctgtttgcccgttttctagttagattgtgtggggttttgtttgttttatttttactcttgagatttaagagttctttatgctagatatgccttttgtcagatatgtgttttgaaaatatagtttgtctttctgtagtttatctcttcatcttctttacagggtctttcacagagtaaacatgttctttttaaaaattacagtgaagttttttatcaaattttactttgatggattgtgtttttgatgtcaagtcttggaactcatagcctagagtgctgaagatttcctcctatgttttgttctaaaagtttcacatttttaagtcttacatttaagtctgttctttaagttgatgtcaatttttggtatgatatctgagatttacatcaaagtttatccttttgcctgtggattttcagttattccaggtccactcattgagaagactatattcctcttctgaattgctttgaaaaaatcagttgggtatatttgtgtgggtctactattgggttctcaattctgttttattaatctagatatctcttcctctattatagtcttttgctttcatcgtatagtaacgcttaacattgagtagagtgtttcttcccattttattgttccttttcaaaattgttttagctattttagtttctttgtttatataaatttcagactgactttgtgtatccatatgtacaaaactcttgctgggtttttaatgggaattgtgttaagcctacaggttctcgtagggacaattatgttgaatcttccaatccatgatcatggtatgtccctcttatttcaatcttctatgatttttccatcagtattttgtagttttcaacatgtgagatttatgcttgttttgttaaatttatatttgtttcatttttgaccagttgtaaatgatactgcattttcagtaaccacatgtttactgttagtatagcaattattttatgttgatcttgtatttctgaccttgctgaacttactcattaggtttagcagttttttttttaattgtttttgttttgagattcctttggattttccacatagaccatcatgtcacctgaaaatagtaactttttaaatttctttctgatttctaggcctcttacttcctttactttcctggctaggatttctagtattatgctgaattagaatgttaaaagtgaacaactttatcttgtttctgatcttatggcgaaagcatccagtctttcactattaagtatgatgctagctgtaggttttttgtggaattgcttttatcaggatgaggaagtttccctctattccagttttctgagactttttaatatggatgagtgttgagtgttattacttgctttttctgcatcaattgatataatcaggtgatttttcttccttggcatcttaatatggtagattacattgatcagttttcaattattgaactagctttacactcatggaacaaactctacttggtcatgtgtgtaattccttatatatactgctaagttgtattgccaatattttattaagggtggtttatgtatatttatgagagaatgtggtctgtagtttttgttttgcattttataaattttttctactgtctttgtctagttttggttatgaggttaataaaagcctctgtgttttatccttttttatttactgggagacagttatagaattgatattaattcttccttaaatgtttgttaaaattccccagcgaagccattcaggatgtggagatacctttttaaaaaacatttaaaattatgaactcaatgtgtttaattgttttagggatcttcagcttatttatagcctattggttgagttgtggtagtttgtacttttcaaggaattggtgcatttcatttaagttgctaaatgtatgtgttaatttctatgtaaagagttgttcatagctttcctcatcattcttttgatgtctacaatgtctgtgtagtgacacatagaatacattcgtggtattagtttgtcaattttattgatattttcaaagaagattttcatttcattgatttttttttcttttttttctcttctccgtgtcagtgattttatacttttatatttattatttacttccttctacttgtggggcttgtcttctcttttctagtttcttaccgagtgagcatagatatagacttgaatctttttctctttcttaaaataagcagtactataaatttattcttagcactaccagcatgtcatacatattgatacattgcatttttattcagttcagtgtatttttttccatttccttgagactttctctttgactcatggattatttagcaatttggcattcagtttccaagtgtttggagattttcttgtcatcttaatgctattcatgtctagtttgattccattgtgggcaaatatcacactttgtgtggtttcacttcttttaaatgtattgaggtttttcttaggctcaggatatggtctatcttggtatatgctccatgagtacttgttggtagacagtttcctaaatgccaattaagtcctgttgtttgatggtgtaagttcttttatatccttgctgattttctgtctagttgccctgtcatgaattattgagagaggagtgttgaaacctccaaatatagttgtgaacttgtctatatcttttgaaaatttccatcagttctggggtcatgtattttgaagctttcttgtttgagaaaggatttatgattgctgcatcttcttggtagactgagcttttatcattatgtaaatttatatctatctttcataattttcttttctctaagatctgctttatctgataataatatagttactcttgtgttttttgagtaatgtttgcagggtatgtgtgtctgtgatatatatatattatatatatatattcttcgttttttctttcctgcctatgatgtacttaacttttttttagaatttcttttttagaatttttagaatcttttttatttatagtgtttttgagtatgtctctttgtacacctatttcatggttgctcttgatattacattttatgtatgtaacttattacgttactgactactgatataaacatcttactggttcaagtaaagtagataaattttctcttccttcttttattgtttttttctctctttcaagaacttccttgagccatacttcttgggtgattctgctggtcactatttctcttagttttttcttcatctgaaaatgtcttgacatttcttcattattcctgaaagatattttaactggatttagaattttgagtgtacagtaagttatttcagcattcggaaactgtcataccacctcctgctggtctccgtggttactgttgaaaattctgctgtcatttaaatttgttgttgttgtttagttttgtttttcccccttacggatcatttttctctggctgctttcaagattttctctttgtgtttaatttttagatgtttgattatgatgattcttggcattaatttttttgtatttatctggtttgggttttactcagcttcttgaatctgtagatgtatatcttttgctaaatttggaaaatttttaataatttcttcaaacatttttcattctcattttctttctcttctttttctgagactctcatgacacaaatatcagattttgttatggcttcacacccctgcaggctgtgtcgattttttttcttttttttggtctattttacctttgttgctccgattgcataatttctattctgtcttcaagtcagattctttcctttgctatctccactctactattgagcccagcctacatgttggtaatcccagttactgtatttttcagttctaaattttcatttagtttttctttatatcttctatttatttgttgagactttctattttttcactggtttcaaacatgttcttaattgcctaccaaagcattattatgattgaggttttaaaatccagagaattccaactttctgaattatctgttttggcatctgctaattttctcttctcattaaagttgaggtttttttcttgattttggtattacaggtgatttttaaaattatatcctggacattttgggtattattgtttgagactccaagtcttatttcagtgttccttttcactagacctcctctgacactgtgctagcagaggagggaggacaccacccctgctgtcgtgtggttcaggccccccactcagcctctgttgacacctgggagggatggggaccttggtactgctaggtgggagtggaagtccaggctccccaagtgttctccactgaaacagcaggaggcggctgggtcaagatgaggtcactgcttggccttctctgacatcacctcttgcaagtatggggaggagtgtctcccttttgcctggggatgtttgaatctagagtgctccctgggcctttgctgatgaggctgctggtggagtccagctttttcctttggtgtttccctggggcagcgctcttggctagacacggtccagctgtcaggctgcttctctcctgaccatttggcgagagagggcaagctttcctcaggacttctttggtctgtacctgttggggtttttttggtgcattcttctccagaacccagtttggaataggtaagataaatagtaaacctagggatgtcagcaccatgccgttctgcctgtcacaaaggtgtgatcccttctgccttcttctctgaactgttgacagccttcttatgtttatttatggattatgtgaagacttcttagtcatatttagcaagagtaataatgattactcaggtcagcctgtcataacaaaataccatagactgggaggctttaaataatagaaatttattttcacacaattctgggagctgagaagttcaagatcaagggtctggatttggttccctgaagagaactctctctggtttatggcttccttctcattgtgtccttacatggcagagagaaagagagagggagtgggagagggagagagaggggcacgtgctggcttccctcttcctataaggccaccagtcctatcagaatagggctctacccctgtgacctgatttaaccctggtcagctcttgcttatcgtttttagccgtattacctccttatcgtttttcttgtatttatgctgtcatagcaagtggcatttttctgaaagcatatgcttagtttatttagactttatatttattcagattaaggttggtcaatttcttcactcaatctgaaggaaaagctctttaaaaaatcagcctgatcatttttcaatgaacctctggtgtggactttgggcatccgattgtgtaggaggctctcaaggctggctgtttgcccagtcagcattgtcactgggggacgagctggcagggtgcaatgttgttcccttcacctttgtgtctccaagtgaccctttcctcatagggatgaatttccacccatgatgaatagtccttgtgtgcatagtaatcccagtgtcagaacatcttctccttccactgctggggataattagcttcctttttcttttgtttcatacatctggagccagaaaaggcataacaggtcacatagtttagaaatggacatactttttaaaaaatttcatgagctccttcacgtccatttatctaggctacgtaaaactgttagaaggaatgcccaggctacaagctataagcaggcaggagggtggggcccgtggagcccagctctctcccacacgaggccctgggagttcagtcaaccatcctgggtcgcaaaagtcattacccaagaaggcgggagtaaaactcgtgcttctgccctcttgccctgtacgaggtgggttggaactgagaaggccaggaccttcaaaatgctgcattctccctgagaagttggaattgaaaaaaataaaatctaccatccagtgcaagacgatgaaaaagaagcatgactgttttaggctgtgctcagtcagggctcagagtcttccatgggaattcacaacagatgagggaaggggtgcctcctggtgctggtttgatatgtccagcagaacccaggaaattccagcaccaattgtagtggcatgcaaagtggtctgatctgtgaggctctgggcacctggcagaatggagtgcagggcacctggagagaagtccccctccggccaggtccacaggatctccatagacacggtagcaacacaggttggggattcattccagtatgtccagtcagcaaggttcatgtgccatgaacatgctctgcagatggtgattggggtttgagacatgggttttctgcagcctgacaaatattccatgctctgataagtgtccaggtgtgaggccaggtgtgcaggcaatgctgtgagagggcagccaagggctctgcccctttctctcctgcgtcctcctccctccacatccatcctgtcccacccctgtgactacatgtgggtttttttgtgtgttttttttttttctgagactgagtctggctctgtctcccaggctagagtacagtggcgggatctcggctcactgcaaccttcacttcccaagttcaaacaattcttgtgccttaacctcctgagtagctgggattacaggtgcccaccaccattcccggctaatttttgtgtttttagtagagatggggtttcaccatgttagccaggctggtcttgaactcctgacctcaggtgatccgccctcctcggcctcccaaactcctgggattcaggcgtgagccaccacacctggcctgcatctatatttttaagctcttgtgccatttagccttcattaatttttttaagaaaacattacagatgaaaactgtatgaggaatgaaacactataagaaataatatggaaactcaatttttaaaaatcagctaaaaatgaacttcaaattaaaacacatacagaaacatctcactttgagcaagcattcacaaacatagcaaaaggcaggtttggactcttaaacacttaagacaatagaaactgacaaatgatttgaaaataattacactcaagtaagaattaaaaacacaaatgagagaaaccctttaaaaagcaactttgaaaagaatcaagtaaaattaagagagatgagaaataatatagccatcaaaattaaagacagtggaggcatagaatgtcagatgagacacagttgaaggagcagaggcagtttcctgcgtgaatcatagaaagctaaatagatggaaagtaggaaagaatgatttacggtcgtgcaataatatccaacacttctgtagtgcttctgtgcaccaggtcctgtttcaaatgctttacatatattaacaaccttctgaggaaagcgctgtgattattttcagatatgacagctggagcacactgtggccaaggtcatgcagaaagcaggtctggaagcctgcaccccccaggagaggctgtgcctgacaaggagggctgcttcctctcatgccggggataggtgctcccatacacactggctagaatagtagaaggcaataataaattgcatgtgggagaaatattaaaagattattttcagaaaacaggtaaagttatggctcacatacagatataaaaatgagcatgttgaagaatctatttgactcatatcacatgaggaaacaaagcagatgttctcagttcaatgggaaagtcaaactagtacaaatttatatagagtaaaggaatttcgagatgaattctaaatggacacagaacttgtttatctaaaggggcaggaagtcaaggcactaccaattaaatcactactgggcgactgagaacttccgcatctatcagctgcttacggtccgcgcacagtggcaaagcagctcagacagtgaacagggcgagacttgctaagtgagatctatgtgctgtaggggacacatcgttttccattgaaatacaatgatttttttcaacagaagccatgtcccaaaagaacagctgaggatgtaataatattgatgaaaaacatacatcctcagcttcaggagataaaagtctgaggaaagatatgtgataggaaatgagcccaagacatattgtgcaaaaaagctgcaggaatgtccaaagccaaaaaaagatcctagaagcgatgagagaaaaatagatagcttgctaacaaagagatggcaattagactgactgcagaccttttaaaggcaacagtagaagccagaaaaataaacgaaaataacgtcttttaagtatgaaaggaaataattgtcaacctagagttttatcctgagctaaaccattctttacctgatgggcaaaatcaagacattctcgggaaaacatatactaaaggagtttaccgtgcaggggctgtgctactattttaaaaaactaccagaagacgtttaggaactaggcatgagaagcagtgagcgaagcaattggcaaagattcaggtacatgtaaacagatttggttatataaaataataatgatgaatttgagagtattaaaaacaaagtgggacagggcgcaggggctcatgcctgtagtcccagcactttgggaggccaaggcaagtagatcacctgaggtcaggagttcgagaccagcctggccaacatggtgaaaccccatctctactaaaaatacaaaaattagccgggcgtggtggcatgtgcctgtagtcccagctacttgggagggtgaggcaggaggatcgcttgaacccaggaggcagaggttgcagtgagctgagatagcaccactgcactccaacctggaacctgagtgacagagcaagactccatctcaaaaaaaaaaaaaaaaagatggaattaaaatactggaaaatatagcatgaaatagtaacttggacagtgcttggaggtaaaaccctcaggtgtacttatatgactctggaaggccatggagacgtcagctttaagtgaaatatacaaggttaaagtgtgagaataaccaccagaccagacacattaagaatactatatttaacttccaaacaagtaggggtcgaatggggaagggatgaagaaaacaggagaaggccggcgcggtggctgacgcctgtaatcccggcactgtgggaggccggggcgggcggatcacgaggtcaggagatcgagaccatcccggctaacacggtgaaaccccgtctctactaaaaatacaaaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaagaaaaaaaaaagaaaacaggagaaacctaaatgcaatccaaggaggaagaagtcaaaagcataacattagatggtagaaatgaaaacaaatattacagtagacaagataaaagtaaatgggatggccagctggttaaaacacagatctccccaatatatctctatgcatttaaatcgaacgatagactgtttagatgaaactaaaccatatatacgtaaaggatgaacgcaaaaaaggaaaaacaaaaacaggaacaaaaataaaatgtgagtggctatgtttacaacaccccccccccacacaaacacagtaagaaaaacaagtataattaaggttaaataaggtcaggtgatagtgattttttaaaactaaggatatataacaaatcttacatgtatatatctaataaaattgctttgaagaaaaattggtagaatttaaagtttactggataagtccacaattacagtagaagattttaatgtacctcttttagtaattgatagtgtaacaaggggaaaaaaaatgtaagtatgtaggagttttgaacaacacagttaacaagtcttacccaatatatagatatagatacagatatagaaaaaatgcatcctcattccactagaaaataaatatatggaaaactggatatctaaatgtgaataaaaacatttagcatgtgtggtgtgagtttgtgtgtgtacgtgtgtgtgcacacatgcactcacatatgtataggaatgcaggcagacatacatagcctttaaatgcttatgttagaaaagatacttgtctaagcatctttaccatatgatccaacaattgtcctcctcagtatttacccaaaggagctgaaaacctgtgttcacacagaaacctacacacatatgttgatagcagcatagacatcttttttaggaaaccctaaaggcttttaatatcttttttgggaaaatgtgtgagataattaccaaactcaagaagttataaaatataacattaactccaatgaaaaaaagaaggaggaataaagataaacctagaaatgtattaaataagaaaactaaaatagagatcaacgaaggacaaattggttttaaaaaagaactaataaaatcaacatacctcaggaaataattaccaagaaaacaaagaaggcacaaacaaacatttactggatataaaaggggttttcaactacagaaaaatacttaaaaatagaatattgtgacacaattttatgccaaaattttggaaacttagatagatttaatattttctagaaaaatagaccaaaaagggaatagactagcaaaaaaacagactttgttttttaaagcagtttgaggttcatagcataactgtgtggaaggtacaagttcccatgtcccctcccaacccccacccaagcacagcctcccccatcatcaacatcccccaccagggccgtacaattgaaatagatgaactgatgcagacacatcattaccacccagagtccatagtttacatcagggttctctcttggtggcgtatgggttctgtgggtttgcacagatgtataatgacctgtatcgaccattatagtatcattcagaatagcttcactgccctaaaaatcctcggtgctccacctattcatcccgccctctctctgcaatccatggcagccattgacctgttatgttttgttttgttttgttttgttttgttttgttttgtttgagatggtgtatcgctctgtcgcccaggctggagtgcagtggtgcgatctcggctcactgcaacctccacgtcccgggttcaagcgattctcccacctcagcctcctgagtggctgggactacaggtgcacgccaccacgcctggctaatttttgtatttttagtagagacagggtttcgtcatgttggccaagctggtctcaaactcctgacctcgggtgatccacctgccttagcctcccaaagtgctgggattacaggcgtgagccactgcgcccggcctgatctgttttgctgtctccattgctttacttttcctagaatatcatataattggaatcttacagtctgtaatcttttcagattgacttatttcatttggtaatatgcatttaaggttcctccatgtttttttcatggcttgatagcccatttctttttagcactgaataataatccattgtttggatatagcacagttagtttatccatttcacctactgaaggttgcttccaagttttagcaattatgaataaagctgctatcaacatatgtatgtaggtttctgtgtgaacacacgttttctgctcctttggataaatacaagggaaggcaattgttggatcacatggaaagagtatgcttcgttttgtaggaaactgccaaactgccttccaaagtgactgcaccatttctcatgcccaccagcagtgtatgagagttcctgttgctctgcatccttgccagcatttggtgttgtcagtgttctggattttggtcattctaatagatgcgtagtggtgtctcagtttttttttttttaatttgtattaaatatgacaatgtggaacatatttctatgtgcttctttgccatctctatattgtctttgctcaggtgtctgttaaggtctttggcccattattttaattggattgtttgttttcttattgctgagttttaagagttctttgtatattttggattacagttcattattagatgtgtcttttgcaaatattttctcccaatctggaggtcatcttttcattcttttgatcagtatatttttaaaaaagaaattcaaaaaggtaggtttacaggcaagttccacccagcataaaatatcattatgaacataaatgtataagccttttttattattatactttaagttatagggtacctgtgcacaatgtgcaggtttgttacattaggtgtacatgtgccatgttggcttgctgcatccattaactggtcatttacattagatatttctcctaatgctatcccacccccagccccccaccccccgagaggccccggtgtgtgatgttccctgccctgtgtccatgtgttctcattgttcagttcccgtctatgaatgagaacatgtggtgtttggttttctgtccttgtgatagtttgctgagaatgatggtttccagcttcatccatgtgcctgcaaaggacatgaactcatccttttttatggctgcatagtactcatggtgtatgtgtgccacattttcttaatccaatctgtcattgatggacatttgggttggttccaagtctttgctattgtgaatagtgccgcaataaatatacgtgtgcatatgtctttatagtagcatgatgtataatcctttgggtatatacccagtaatgggattgctgggtcaaatggtatttctagttctagatccttgagaaatcttccactgtcttccacaatggttgaactagtttacactcccaccagcagtgtaaaagcattcctatttctccacatcctctctagcatctgttgtttcctgactttttaatgattgccattctaactggtgtgagagagatggtatctcattgtggtttggatttgcatttctctgatggccagtgatgatgagcattttttcatgtgtctgttgtctgcataaatgtcttcttttgagaagtgtctcttcatatcctttgcccactttttgatggggttgtttttttcttgtaaatttgtttaagttatttgtagattctggatattagccctttgtcagatgggtagattgcaaaaattttctcccattctctaggttgcctgttcactctgatgatggtttcttttgctgtgcagaagctctttagtttaattaaatcctatttgtatattttggcttttgttgccattgcttttggtgttttagtcatgaagtctttgcccatgcctatgtcctgaatggtattgcctaggttttcttctagggtttttatggttttatgtcttaggtttaagtctttaatccatcttgagttaatttttgtataaggtgtaaggaagggatccagtttcagctttatacatatggctagccagttttcccagtactatttattaaacaggaaatcctttccccatttcttgtttttgtcaggtttgtcaaagatcagatggttgtagatgtgtggtgttatttctgaggcctctgttctcttccattggtctatatctctgttttggtaccagtaccatgctgttttggttactgtagccttgtagtgtagtttgaagtcaggtaatgtgatgcctccagctttgttgtttttgcttaggattgtcttggctatgtgggctcttttttgtttccatatgaactttaaagtagttttttccaattctgtgaagaaagtcattggtagcttgatggggatggcattgaatctgtaaattaccttgagcagtatggccattttcacgatattgattcttcctatccatgagcatggaatgctcttccatttgtttgtgtcctcttttatttcattgagcagtggtttgtagttctccttgaagaggtccttcacatcccttgtaaattggattcctaggtattttattctctttgtagcaattgtgaatgggagttcattcatgatttggttctctgtttgtctgttattggtgtataggaatgcttgtgatttttgcacattgattttgtatcctgagactttgctgaagttgcttaatcagcttgagatttttggctgagacaatggggttttctaaatatacaatcatgtcgtctgcaaacagggacaatttgacttcctcttttcctatttgaataccctttatttctttctcttgcctgattgccttggccagaacttccaacactatgttgaataggagtggtgaagagggcatccttgtcttgtgccagttttcaaagggaatgattccagttttggactattcagtatgatattggctgggggtttgccataaatagctcttattattttgagatacgttccatcaatacctagtttattgagagtttttagcatgaagggctgttgaattttgtcgaaggccttttctgcatctattgagataatcatgtggtttttgtcattggttctgtttatgtgatggattacatgtattgatttgcatatattgaaccagccttgcatcccagggatgaagccaacttgatcatgatggataagctttttgatgtgctgttggattctgtttgccagtattttattgaggatttttgcatcaatgctcctcagggatattggtctaaaattctcttttttggttgtgtctctgcccagctttggtatcaggatgatgctggcctaataaaatgagttagggaggattccctctttttctattgattggaatagtttccgaagaaatggtaccggctcctctgtacctctggcagaattcggctgtgaatttgtctggtcctggacttttttgggttggtaggctattaattattgcctcaatttcagaacctgttgttagtctattcagagattcaacttcttcctagtttagtcttgggagggtgcatgagtccaggaatttatccatttcttctagattttctagtttatttgtatagaggtgtttatagtattctctgacagtattttgtatttctgtgagatcggtggtgatatcccctttatcattttttattgcgtctatttgatttttctctgttttcttctttattagtcttgctagcggtctgtctattttgttgatcttttcaaaaaacccgttcctggattcattgattttttgaaggtttttttgtgtctctatctccttcagttctgctctgatcttaattatttctttccttcagctagcttttgaatttatttgcttttgcttctctagttcttttcattgcgatgttaggatgtcaattttagatctttcttgctttctcttgtgggcatttagtgctataaatttccctctacacactactttgaatgtgtcccagagattctggtacgttgtgtgtctttgttctcattggtttcaaagaatatctttatttctgccttcatttcgttatttacccagtagtcattcaggagcccgttgttcagtttccatgtagttgtgcagttttgagtgagtttcttaatcttgagttctaatttgattgcactgtggtctgagagacagtttcttgtgatttctgttcttttacatttgccgaggagtgttttacttccaattatttggtcaattttagaataagtgcaatgtggtgctgagaagaatgcatatcctgttgatttggggtggagagttctgtagatatctattaggttcacttggggcagagctaagttcaaatcctgggtattcttgttaaccttctgtctcgttgatctaatattgacagtgggctgttaaagtctcccattattattttgtgggagtctaagtctctttgtaggtctctaaggacttgctttatgaatcttggtgctcctgtattaggtgcatatatatttaggatagttagctcttcttgttgaattaatccctttaccattatataatggccttctttgtctctttttatctttgttggttgaaagtctgttttatcagagactaggattgcaacccctgctttttttttgcattccatttgcttggtagatcttcctccatcccttcattttgagcctatgtgtgtctctgcatgtgagatgggtctcctgaatacagcacactgatgggtcttgactctttatccaatattctagtctgtgtcttttaattggggcatttagcccatttgcatttaaggttaatattgttatgtgtgaacttgatcctgtcattatgatgctagctgattattttgcctgttaattgatgtggtttcttcatagcatcgatggtctttaccatttggcgtgtttttgcagaggctggtaccagttgttcctttccatgttaagtgcttccttcaggagctcttgtaaggcaggcctggtggtgacaaaatctctcagcatttgcttgtctgtaaaggattttatttctccttcacttatgaagcttggtttggctggatatgaaattctgggttgaaaattctttaagaatgttgaatattggcccccactctcttctggcttgtagggtttctgccgagagatccactgttagtctgatgggcttccctttgtgggtaacccgacttttccctctggctgctgttaacattttttcccttcatttcaaccttggtgaatctgaaaattatgtgtcttggggttgctctttttgaagagtagctttgtggtgttctctgtatttcctgaatttgaatgttggcctgccttgctaggttggggaagttctcctggataatatcctgaagggtgttttccaacttggttccattctgctcatcactttcaggtacaccaatcaaacatagatttggtcttgtcacatagtcccatatttcttggaggctttgtttgtttcgttttactgttttttctctaatcttgtcttctcacttcatttcattaatttgatcttcaaacactgatatcctttcttccacttgatcgaatcggctattgaagcttgtgcatgtgtcatgaagttctcatgctgtggttttcagctccatcaggtcatttcaggtcttctctatactattcattctagttagccattcatctaaccttttttcaaggttcttagcttccttgcaatgggttcgaacatgctcctttagcttggagaagtttcttattgccgaccttctgaaacctacttctgtcaactcgtcaaagtcattctccatccagttttgttccattgctggcaaggagctgcgatcctttggagaagaaggggtgctctggtttttggaattttcagtttttctgctcttctcctcatctttgtggttttatctacctttggtctttgatgttggtgacctacagatggggttttggtgtggatgtcccttttgttgatgttgatgctattcctttctgtttgttagttttccttttaacagtaaggcccctcagctgcaggtctgttggagtttgctggaggtccactccagaccctgtttgcctgagtatcaccagcagaggctgcagaacagcaaacattgctgcctgatccttcttcttgaagctttgtcccagaggagcacccacctgtatgaggtgtctgttggcccctactgggagatgtctcccagtcaggctacacgggggtcagggacccacttgaggaggcagtctatccattctcagagcttgaacgccgtgctgggagaaccagtgctctcttcagaggtgtcagacagagatgtttaagtctgcagaagttgtctgctgccttttgttcagctatgccctgcccacagaagtggagtctatagaggcagtaggccttgctgagctgtggtgggctccactcagttcgagcttcctggccgctttgtttacctactcaagcctcagcagtggcggacacccctccccaccaccaggctgtagcctcacagatcgatcacagactgctgtgctagcagtgagcaaggctccgtgggtgtgggtcccactgggccaggcacaggagggaatctcctggtctgctgatcgctaagaccgttgaaaagtgcagtatttgggcgggagtgtactgtttttccaggtacagtctgtcacagcttcccttggctaggaaagggaaatcccccaaccccttgcacttcctgggtgaggcgacgccccaccctgctttggcttgccctccgtgggttgcacccactgtccaaccagtcccaatgagatgaaccaggtacctcagttggagaaatcacccatcttctgcgttgatctcgtttggagctgcagaccagagctgttcttattcggccatcttggaagcaactcctatgtataagtcttaactaaaatatcagcataacaaagtctagcaataagttaaaaataaatcctaacaagtttaggcttctattaggaatgcacagtttgtttaactttcaaaaaagtccattaatataattcattctattaaaagattgaggcagaaaaaaataaatgatcattctggtagctggagaaaaatcagttgatgttatttaaaacccatttgtaattggaagaagtttcacctaacctgacataggggtctcacttaatgctgaaacattagaagtttctaaacgtagaataaaataagaatatcagtgtcatcactttttaaaaatatcttagtgactatatgaatttcagtagtaatacaagtaaaataataaaatgtttatgaataaggaataaacctgttatcatctttataggccatatctgttttttacatagaaaatccctagagactgtctagaaaaaatatatctgatacaaaacaagatctatcgaagtatcaaatgtgtttctatattcttacaacagacagttagaaaatgtaatttcacaaattttattttcaatatctgcaggtgttgagtaccaaaaaataaatttaagaaagaacaacataaatgttgagttgtatcacgtttatgcctgggaaaactcaataccagatgccaaatttttccaaaataaattgagtgtgattaatgtgattccaactaaatttaatgtgattccaactaaagtcttaacagggacttcatgagactgtacaagtaaatttaaaatttacaatgatgagcaaaggatcagtaatgagcaagaatagtaaaacaagacaattttaaagaaaaagaaccaagttgggggactttctgtgccaaatgcaacactttcataatgctgtaaggattaagatgatgttttgctgggtcagggatagacatgtaacacaaggaacaaaaatagggagtccagaaactggatatctgctgtgttaatcttctcccatgttacttatagctttgctgtaatccgtcctatgccatatccagttgttataatatcccatgttacattcaatttaatatgccaactagtggctaaagaaaagatttctgagtgggagctaaacactgggtactcatggacataaagatggcaacaacagacactggagactactgtagggggaaaggagaagggggccaggattgaaaaactactggatactctgctcactgcctgggtgatggaatcaattataccctaaacttctgcatcgcatgcgatatacccatgtgacaaacatgcacatgtatgtcctgaatctaaaataaaaatcaaaatatgaacagatagcacgtgcctgcagtcctagctgccaggaggctgaggaaggcggatggcttgagcccaagagtttgaggctccagtgagccacgatcgcaccactgcactccagcctgggtgacaaagcatgaccctgtctcaaaataaataaataaacaaataatataaataagtaaatattttctttttttaaaaaaaggaaatattcttgaatgcatttttctggaagcctcctcctggtacctcagaattctgcttcctggaatctctggcaggtagaaatgaccataaaagtttgattctactcaagacttttttggtcatggactatgacaagccacattgctgattgcagaccctcaacattttagaataaaatatagaactaaaaagatttatgacagggtgtgtctctccctctgtcttctgttcagaaaatttacccattctcaacagccttgctttccctctgcaatctgggcattgcttccgtcagtggtgtcttcacatggaattggggaattggcagctttttttcccctttcttcagagatttaaagtaaatgacaccttagatcagatagatgagcatcatccttcctcctcccttcctttttggatagatttcatcttcatctctcttgcccttctctctctcagtctttcaaggttgctgagagctcagagggaatgggattgatttcacatgagaccttactatttagggtcatcctgaacccatgcgaagcattttctttgcagcaggacagagtgcctggatttcttcttcttattgttattttattattattcatctttacctgaatgcagaggctcattctggtgaacacgtgccctattgggagttggtcttgctggacttctttgatggctggacccctggctttttctctcaaggttataagagccgggcttctgggtcagatgatgctttctctgtggaggcacaatcactctcttcttttctggctcagtgttgaggcctcccgtgctcagccgtagaggtcaatgctacagagctgactgaggcaggaggcaaggctgagcctaggatcagagggctcttgttccagggccagcagctctgcaggaatgagaccaggcaccattgtgtgaggatcctaggggatgtggaggaaggaaaggtgtgatctcagacccacccacagggtccacctgtgccccatgggctccccctgcctatactgccattgacgtctgaaagcacagcttgtaatcccataaggattgggcttctgaatcctgcctggggggccaagcagtggtttgctcccaagccctctttcagcctcactgcttagggcaacatggtgtaagcaaacaccatgatccaggcaagccagaccttcctggagcctccttcgttctggcttatctccaagtgtgtgatcccaccatgccctccgccaggggcctgtccacatccgtttccgtctttgggagctctggctatcctttaaagcctatgcagacacctctcctcctcctacccccgctaaggacacgtagcttgcgtcctacatgtttgagttacatttgccccagtcaccccctccgtggtgagggtagggctcagagctctcctcacaccaagagtgggccccagtcattgctggctgggggaggacaaaggcagccagataaaggcagctcctgcaaggacggagaggccacaggccggcatcttcacaaactgtggatgtactgtgtcttccagtagtcaaaataaagaatatatttggccattttcagactatttaatacagaacagtttacacacagaagaggagtgaggaggagaatgaatccctgcagccctacccctgtttccacggttatgggtgtttgccagcacagggctgcccagcactggtgagggggtcactgttggctggcatctgtcgggcatccccggggaagctgcgccggtgctgtggccactgaggtcctcataggggttctggccactcacatttccgaggttcttcatttcccacctcagatcactgttttcaaactcagttttcagcaacagggcctttcttcaaactcatcttatctccacccctaatgctcaaaacagataaagtagtattagcacaaatccattacaagagtttacttttatactatgtacttataaaatcaatttgcctatgggaaagaagcgtaaaactaccatcatgggtattaagatttggattttgataacatttatgtgttacaatttcatgtagctcaatattctgtttggatgaaaaacattcagaaatcactgagtcacaaatcactgagtcacaggtaagctgttgctaatagcaacagtttttttatcttgtttttacctgtttgccttgtgatctcaagagtctcttcaattaaattgatccaaatgcttgaaagaaaggcttgtaggaactttttttttttcagagttgaatcactgatctaacagatgctcagtcttgattataaatatgaaaatcagacaggaagaaacccaagcttaaaataagcaaaactttgttccccataacatgcatcaaaccacactattcttaatttttaatttatttttatttcaaaaatatttatgtttttattttattttattagagacagggtctcgctctgtctcctaggctggaggacagtggtgcaaacatagctcactgcagcctcaaactcctgggctcaactaatcctcctgcctcagcctcctgagtagctggaaacataagcttatgtcactgcactgattaattttgtcagtgttttgtttttgtagagatggggtcttgctttgttgcccagtctggtctcaaacttctggcttcaaatgatcctcccctctgggcctcccaaagtgctaatattataggtgtgggccactgtgcccagactatagaccatgctttctatgttgctgctactgagggtgattgatgggggaacgcatcccacgtctggtgcgggttagatgccatgtaattggagggacagactttaattttttaaaagcaatgcaaagctgaaatctcatttggtgactcctttataagagattcaaatgcgtgcaaattcatggccagagaggctttagtttaacttccatgcaaaaaggagttaaacaggacacataaattaacacaacggtagtctctaagagttaaaattttgttaatagtcatttgagtgtgtgacttttattaccattttcaaattcaaaggaactaaaatattggaggtaaatatttccagaaaccttgaggcgcctccatagggtctcagggctccagagaacctagcttgaagatcatgatactatccagagtgagcttgtgcaggtccacattttcagctattttgtgcccaatcaccatttataatgtgactcattaacagtcagatacagactacggtcaagcaaagaatatttacatcttgatcctacctcctcctctctctttccctatgtgtttttggaagtaagggggggggatgtgtcctttcatgacaacttggctctcgccttctctccctctctcctttctctcagtctccccctttttcccccttatccccctttcttccttcccttaaacttcatcacgtttttgcttgtttcatattcaaatcacggctttctcatacaattactacttttttcctagagtttctggttgccttttcttattataagaatgtttaaaactgtgtccttaatcaagtccatgatgtttttcagctcattatatctcctctttcttgctctgaacccatttggttctgtcctcagtactttaacatcttgctgggatttggacccacctttttctaggcctcctgctcaagtcatcctctaaatctcttttatcgatctccaggtttaatctaaaagtgtattctttctcaggtttcactctcattgttccaaagctgaccaaggaaatatatgttgggaacaagctcttcaaggctttaatgttcttgaaaacccctttttttttgccttcatgcttgggtggtttttctgctgtgagaagtgtcttcgtgttatttcttaattttttccctcccactctccctgatggagcttctgtgagtgaggcgagttcccccagccttgtcctctacgctgtcttctttctgtgttacgtttgatctctgtgatttctatcagccaaacctcccacctactcataaaaagttatttcataaatcatacctttaatttccatttttctctcttttttctaattgctatatcctcttgaatgttgtgaggacattacttttttaagaagtgatttttccttcttttcattgactcattctttttggatcttttttggtgtgtatcctccactgtgtgtcgcatgctgaagactgtcctccggtatctgtgattctaagtttccccttgagaaatctcagacatgggagaggctgcctgaggctctgtagtcatgggcagctcctgcaggggccatagtggccaaaatgaggggagctttactctggggtgctggtactttgactggctgcctgtgtttttttgaggtggtttatttttctttaccagtagggctgtgttttaagggtacccagggttggttttaatcaggcatggtgagacacttagacacagaagtgactgtcctgaaggaaagcagttttactcactgttcttagaagcagaaggacaggctaggcgcggtggctcagcctgtaatcctagcactttgagaggctaagtgggggtggatcacgaggccaggagttcaagaccagcctaaccaacatggtgaaaccccatctctactaaaaatataacaattagccgggagtggtggcacgcacctgtaatcccagctactcaggaggctgaggcaggagaattgcttgaatccaggaggcagaggttgcagtgagccgagatcgtgcccctgcactccagcctgggcaacagagctagactccatttcaaaaaaaaagggaagcgtagcacatgcagggacacagggaggcaccagggccacgcgggaggccgagagagtgcgggaaacctgagcaagggccgtccttcattgtggcttctgcaggaaggaagggaggagcagggcacgcaggcttaggtttaggattagctccttagaataattgcagtaggccctggggcatagggactcttcctggttgacttttacctggtcctgcagtgatgagagcaggactggtgtcaaccccagtgtgacagcctgataaaggatgtgtttgggtgggggtatgggttctggattgattgatttgtgtttgaaaggccagagttgtttactatctctccaaggggcctccagagtcagcaaagccccagatgtcaacacatcagaatccagaaaataaaagacaaggctagtacaggctgttggtgtaattgctgttggggctgtgtgtgtgtgggtgtgtgtcctttatcccagttgttaactcctggctgcaggaggctggaacaggggacggagaggggcagtggtgcatccgtctaaaactcgcacttacttctgttgtcttccctcactctccttcttttcatcgctaactgtggagctggaagccctctggggttgtggtgtccagctccctcctgcacctgcagttcagtcattcaagatatatatgtgggccgggcacggtggctcacgcctataatcccagcactttgggaggctgaggcgggtggatcacaaggtcaggagatcgagaccatcccggctaacatagtgaaacccccgtctctactaaaaatacaaaaaaattaaccaggtgtggtggtgtgcacctgtagtcccagctactcgggaagctgaggcaggaggatgacatgaacccaggaggtggagcttgcagtgagccgagatcatgccactgcactctagcctgggcaacacagcaagactctgtctcaaaaaaaaaaaaaaaaagatatatatgtgaagcacaaaccaagtgtgggtccgcttcaagaggctggaactagagctttggacacagcgagtgaaaaccctgccccatgaggctcacagggtggcagcgtgcctcacccaccctctgttcttctagacaccatgaaaatgtcacatctgccgatgtcctccagagttgtttacaggtttcatttggttaagagcttggttttatatacattgtgagaaaaatcaccagttcggtgtgaaaattgaaatgggggtagacactggcccttccaagctgtgcccggggaagacctcccaggccagtcccagtggtgctctcaggcagcgtgtggggttgtgaggacagacaggggcccctctcaaggtctttgctgctccatcaaagacagaccccagggcttcgggaaatccacagcctggtggcactggctcatgcagtccttttcctgtttctagtgctgatgagcgctttgacgccacattccacactaacgtgttggtgaattcttctgggcattgccagtacctgcctccaggtaagctgcacctcctttgtcctcttccagttagaaaactgaagcgagtttgggtgtcagtcagtctggccggtgcccccgtgtggtggaccagctctttgcttcgcctttgctcactcccacctcttcctctctcttctcttctgtgcttctgtgtgctttctacccccagaagtccatcctcctcttttgtctcaatcaagccgtctttgccactatgtccttattttctgccatgtgtgccttaaagccaatgtacaaatacagcgagtctcctttgccgggcagtggccacctcaccttccagcctggcaagccacctctccaggctctgcttctcagttccagcttgccatcctcctccctgcgggactcagtgtcttggcaggtgcagcgctccagctgccgggggtgagatatgacagttccaggatcctgagtgcgtgcgctaaagagcacacgcaggttacaggcaaggtctggtggtttcaagggagagctctctagcggctgacttcttcccaacagtgtctcacctccaaggctaagtgctccctggattggttctttcccaccagtccatcttttcagtcgattcacagggcaagggaaatgggtttatggcctaaaggtgcatgcagagtgcgcactagcatattgataggaacagctggggtttttgatcttttagaagatttttaatgtgtttattccagggtgatctcccacactgcagctgtttaactttctgctcagaggcaacctgcaattacctccacacctaactaccactcacacatacgactcacacacacaccactcacaaccactcacacacagccactcacacataccacacaccactcacccctcacacacaccactcacacacatcactcacataccacccacacgactcaacactcacacaccactcacacaaccactcacataccacccacacgactcaacactcacacaccactcacacaaatataccacccacacaccactcaccactccacacataccactcacacaaaccactcaaaccaccaacacacacacaccagacacacacacacccctcacacacaccacttacacaccactctcacacaccatacacaccactcacacacgactcacaaccctcacacacaccacttacacacatgcaggcatgcactctcaaaccagatacactattcacaccactcacataccacacatactggctgtgccttctcggttgctgtctgagtgccttccctgtcagcaggtgacaagcatctgggggcacagtcagcctttgctcaccttagcatttatccctgaatgaacaaaggagcgagtgaacctgtcaatggtagacacctcccaataatattggaagagattgaagaagtccagctgttcaggcttctcgaagcatccgctttcctgctagccctggcatttcctcctaccagcaggacccttgcaaacaggggtagtggggggagccttccatcactcccgaggtctttctcgccaggcctgcgtgttgcagcttctgttatgagggctattttagaaaacagcctccggtagtcaccagtgtagaatatgctgctgcaggttgtttggaaggctgaggctattttcagctgcaggaccagcactgcaagcctcgagctgcctgagtgcagcagccccctctggagctccaggcctgtgtccccactgcagtggccctggattccggtcaggacaggacacgttgtcttgtgaccatgaggggcttccttacgctggcaggaaaggcccagggccgcctggattgggaaacccctgcctgctccctgggagtgtagaacgagtcccaggatgctgccctgtctgtagttagaggggcatggataggaaagaatgttttgagttcaagctttgaaatagagacttgaccataacatgactttcccccccatttcatgtgtttattttttaacagctttattgagagagaatttacatatcatgcattttaagtacatgattcaacaacttttagtatatttacagacttatgcaaccattaccacagtctagttttagaacattcccatcaccccacaaagatcccttttgcttgtttgcagttaattcccattcctactcccagcaaccactgatctgctttctgtctctagaaattctctgtctgtctcgggccattatttcgtagaaatgggctcatgaagttacaaagctttccaactaactggcagacaaggtgggttttggggggatccaactattaatggagggggattgtctgtgatgattccagattcctataaacatttcatgtaaggacgcaaagcatacttaaaggaacttcaggggacaaaatgtgtatcttttcccaactcggttgtggggtggggtccttgtgtgcaaggctgtggaggcccttcctgcgtgcactctttctgtaactcagtaacagaagtttgcagagtgccagccctgccccaggaacacctggacaccgagtctgtgcctgtcttcttgtgccatgcagccttcctctgggcagggaagagcacatgagtgtaaataactggagtggcctctatctggtttcctccccttggccctctgggaaatccacttccaacctgtcctagcctggaatagctcttttcagcggaaactcttccttcaagcaccatctcttcagcttaaacctatctatctgttcttgtttttgtttgtttgtttgtttgtttgtttgttttaactttttttcttacagacagattctaggtgtgttccccaggctggagtgcaggggctcgatcatagctcacttcactttagcctcaaactcctgggctcaagcaatgctcctgccttagccttctgagtagctgggactacaggcatgcatcacctcacccagctaattttttttattagagatgtctcactatgttgcccagtccggtctcaaactcctagtctcaagtgaccctcccacgtcaatgtcttagagtcactgggattacgggcatgagacactgtgcccagcttgttctgttcttcatctagaatttaaattagttaaaattctagctttaaccagaattctagattgtatttctcgataatcatgtgttcttcccatttttaacctaaagaaaatgcctacctcaccccgcaccaaacagacacacacacacacacacacacacacaccttttagattctatttctaacttcatcatcagggttatcaacttctctgagatattttgcattctttacttttattatttagagtctgaagatgctcatggtaaatgcagattatagagctaactttttgcacaaaaagcccacaaaacagtctttgagagagcatgtcagtgttacgtttggattttaaaagacagtgaagcttagctgagattctgttttacagattttgcgaataaataaaaagacagattccatttgctctggactgtgttagctgcagtgcggagggcggaaccggctgaaggaactgctgtgtattttcagcacatctcagtcagcttccgtttcagtcttctgtttccatcacccacacaggcatattcaagagttcctgctacatcgatgtacgctggtttccctttgatgtgcagcactgcaaactgaagtttgggtcctggtcttacggaggctggtccttggatctgcagatgcaggaggcagatatcagtggctatatccccaatggagaatgggacctagtgggtaagccatgggactaaccgcctggaagaaagctttcctattcctgggcaagctttaaaagtttgggattttccactgtcctttccggtgcgagcatttattgaattttgcagtagtctccataatttactgagagctacaggaggagaaacagaaaacagttaggatatgccatgctttccaagaggaactggcaactgcagtgaggatgcatttaaacaaaccagtgtgaggatagatctctctacgttatgcagatccactccatttctaaaagcaagttgaacagcaaatttcagttgatgggaacctatatttgattattttaaaataggaaaacagtgattacatttataacagtgtaaaattggtaatgtattatttataattattataatcatgtgtttccaatccaccaaaagaatatgtaccaatttggccaactatcactaaaatactcttaactctatagtaaatcaacaaggttttattcaagctaattacaaccccccccttttttttttttagcactttgcaaactttaggactgtgcttgtgtgtggtatacacattgaaataaacagggtaatttattgtattctaacaatggctccttctctcctcctccctatggaggaatccccggcaagaggagtgaaaggttctatgagtgctgcaaagagccctaccccgatgtcaccttcacagtgaccatgcgccgcaggacgctctactatggcctcaacctgctgatcccctgtgtgctcatctccgccctcgccctgctggtgttcctgcttcctgcagattccggggagaagatttccctgggtaagcgccccagtgtctggcgggagtctgagactggagaccttctgctgagatcagctctggagggctcacagcagacagcgcaggactccatcagggttcctggggattccctggctcatcccatggacctccgagcccacggtggctccaggacaccagaggtccctgattcgggctccgtgctggacggctgtgtaatcctgagaatactggaggaccctcagaggatgggggatgcacagggagggggccagctccattctgccttgagaggcctgtgctttcttccctcctgccaccccacctgttcctcaatggcgactggtcatcgagggaacaatttagcttagtatcagcttgcatttgtatgttacagtacccagtgtaattcttacgatcactcccatacgaagctaaggaaaccaagattttgaatggtggaatgagtttcccaatgtcttaaagagttgctaaacatcagatgtagcatatggtagaaatcattcccaaacccatatcttctgagtatgaggttcagaaaggttgaatgttgtatctaaggtcacatagctagttgagtagcaaacgtaagacctgaaatcaggtctcctgactgcatattttctttttcctgctacgtgaaactacttctcaataatattttacagagaatatgagagataattgtgccaagttaaatttttcagtttgtgttgatgcttttaaaattctgggtcctaaacttgtctccataagagactcctttgggactctggtaagtggcatggaatgtcccctggaaaatgcacacgcccatacatagggaaaacgtgcattccacgacattccccccagcgcctccctttcttttgagtgtcaggttaggagccctcgttagacagaattgaggccttcttgtctgtttttgtctgaggaaccgctgtgtgtttatgttttagggataacagtcttactctctcttaccgtcttcatgctgctcgtggctgagatcatgcccgcaacatccgattcggtaccattgataggtaaggcaagagttgggctcctctcttagagatatggggttagggttagagtgtgcccaggatttcccagcagatgaaactagaagaaatagggctgcactgcccccattttctctggaaggtgatgatttgctgtaactattcagagtcacccaggcccaagtaaggggaaggggatattcagctttgaggtttgacttttatctcacagaaatgccccccttcccctcataattctcctcctcatgcttgctttgaagccagatatttcatcgttagagatgcatcattttagcttaagatgttgttttcccacaaagcctttgttaaaatgggagaagcacacagttactgtgtcctgagataactcaatgtctctgtataaaagtttctagggaaatatgaatgagaaaaatatattttgcacaggtataaggcatgatcctctacccagggagggacaacaaaaacaagtctccactcccactgggcagggaaggttggaaggaggtatacagactgtcattacacctgctggcccctgctgtttgaggacctatgctgtgtctacctgggggtgggctagagggagagccctacctggatacccccaggctttaggaaccaagcagcaaaggcccttctttgtggaactccctgtatgtgcagtattttggccagagaaactgttggtatgaaaagcctttgtgggtatcatttttctcttggtaccatccagacagggaagaaccacctttccacctgattctgactccattctttctaccttccagcacactgctttcagtagagatttgcagcctcccttccgggggcagttgtcaggccttctctctctggactgatgacccgctgggaaaggcttggttggtgcatagcccacatctcgaaggatgggatgttgatggccccagggacatcagctttgctgccctctgttgatggaaattcagtctgggcaatcctttgacccccatctctccagaggtggttggtctgctcaggctgccgtgacaaaatactatggacttaggggcttaaataactaacagaaatttattttctcacagttgcactgctgaaagtccaagaccaaggggccattagggatggtttaacctgagacctctccccctggcttgcagacaaccactttcacaatgctttgtcctcccctggtagttcctctgtgcacctgcatccctggtgtctctctgtgtgtccaaattttctcttcttcattaaaagaacaccagtcagattggattagggcttaccctgatgacctaattgtacttaattacctccttaaagaccctatctccaagtacagtcacattctagggtactaggggttggggcttcaacatatgaattctagggggaagcataattcagctcataagggtcacggtttgctccagtctccttccttttctcaggggccctgatgctaactttaggtctcaaacttccagctctggcagagctcctcccaggtacctcttggtctttgtaggaaggcagtgagttccttcctggcgtgagggcctgtgagggctagctgaatgcttagcgccctgtaccctgatgctttccgcttagagttcagccccttgagtggacagccacaccaaaggtttaataattagagctgcccactaaagaatgccccctcctttctcctagacatcttggcctgtgtaattgctcatcattgcacaaatcctgcaaggaagaagttcctattttaatggaggctaccgtaacaaattgctgtagtctgggggcctaagcaacagacatttatttctcagagttctgcaaggctgcacgtcctcgataagggtggcagcagggctctggtgaggggccactccctggtttacagctggccctcttctcgctgtggcctcacgtggcaaaaagagagtgaattagctctttagcctctttttatgaaggactctaatcccattcatgagggctgcaccctcaggacctgttgaaggcccctgagaaaatcactcaccatttctctacttacacaacacttctgacaccaaagcggggcgtttctcccacatcgaccaattcttggaaaccagctgggcgtcctacagtgagttcacttcagtcctgacaccacctggagttagcacagcactcacagattaaggctcacaagaccatttctacttgagatgccagttagaagttccggcttcccatgcttctgaccaagtgtctataaatcggggagttcccaaaagcacatctttgagttcagccatttactagagtgactcactctagtaaactcagggaaacattttactgatatttattcattaattataaagcacagatgaatagtcagatgaaagaaatgcatagggcaaggtatttgggaaggggcatggaactgccatgccctctctgccctccaaacacctccccgtgttcagcactgggaaggtctccacagaactccatccttttgggtttttatggaggcttcactacataggcatgattgattacatcattggccactggcgatccactcaaccgtcagtacctctttcctccccaggggtcaagggttgggagaggggacagagcttgaaggttccaactctctaattacttggctggttcccctggcaaccaaaccccatcctgagggtatccaggaacctcagccataaatcatttcattagcatataaaaagacactgatgacttcagagattcaaaggttttaggagctgtgtgccaggaaatgggaggaagactaaatacatatttcttattataaatcacaatctcatacctcccaaagccccacctccagataccatcccagttaggactagggttttaacccatgaacttcgtggggacacaaacgtcatcctttgtaccacccccattggagagctgaggcccgaagaggctgagcatccactccaaactcacagccagtagctagtggaccaggatggaagcactcagatgctccatgctgcccctcacctgggcccaggtggaaggacacccatgacccattagaaccaaagctgagactgaagttctcgtcctgaaaagtccctgccactgaccccttcctcaggctggacagctggcagccaggtggtgtgcaggtttgccctcattgtgcccctggagcacagtagaggcctgcatcatgaacactggatggttcccatgccctcacatccagtatttacccacaggaacaagcttatcaccatcctgccaggcgatgctagctcttattgactgacaagtcggccagagtgcatggaagtgcaatgaagtgagggaaggtcactccgtgggcgggaagtcagaccacactggctggttttgcccacccagaatgtgggctgcaggcctggacacatgggcatcactgcaccctgaggccctgacggtcagagaacctgatcagggtgtgcctgtcctgtgacgtgcagtgccacaggatccccgggtctcaccctgcatctgttctctccacagcccagtacttcgccagcaccatgatcatcgtgggcctctcggtggtggtgacagtgatcgtgctgcagtaccaccaccacgaccccgacgggggcaagatgcccaagtgggtacgttcctcccacccccgatggagtcggagcccccctgtaaaggaggctcctcctagggtttatttttaaaatcacacaaaaaatgggcattcctaaagaaatagctttgggttttttgtttgtttttttgagacggagtctcactatgtcacccaggctggagtgcagtggtgtaatcttggctcactgcaacctccacctcctggattcaagcaattctcctgcctcagcctcctaagtagctgggactacaggtgcctgccaccacacctggccaatttttttttgtatttttagtagagatggggtttcactatgttggccaggctgatgtcgaactcctgacctcgtgatctgcccacctcagcctcccaaagtgctgggattacaggtgtgagccattgttcccagccagaaatagctttgtttctgtatttcgtcacctattgacgtgtctttgtgtagtgtgcagtcatggtgcacgtgttcccggatgccccgtggcactgctgtctaatctaactgcagagtagagtaaggctctcaaactggctgccctgtgtgttctatcaatcagcacggtgttttgagaagctagtttgttttttgatgcatgccgtgaagcactgtgctgcagttggaagcaacagatgagacagatgcgtagcaacatggttgaggcttcacaacagaatgaggagcaaagagtaagaaacggaatgagctgtgtacaaatatgtacgttcagtacatctagggatatcatccaaccagaagtctatgaaacaaagactaattgtcaccagtgcagaagggggaagggataaaaggaaacggatgaaaacagaaaggatggcatcccacagcctgtcagcttagcctgggccataccactcctgccccagctgctggcaccgtgcccggccacatctgcggatgctcacccacccagggatcctctcctgcacggtgtccagagctctgcatccacccttgcctggcagtcaggaaaccttgatgagggcctagggagggcctgagcttcttcccctcttcatgtgagctttgtaaagcttccccgtcctcctgtctagagagcctggcctaaggatttggggagctaaaaaggccctcacattccaaaagttgtctgtctttggagagcacttgtgtcccagttcagaagggaatctaggaatcaccaacaagctaaatgcagctgtagggggtgagatgctgtcaggcaccctccaggaataggggattgctgggcctcctgaaacagtcattgtggagttgttacctgaatgctcacttagcaaagactgcttcttaagaaatgctttacaaaattactgtttcttctcagagtttcacccacatggcccattccccttatacactatttagtaaagacttacctgtgagcccaccacagtggtgtgtggctgtagtcccagctacctgggaggctgaggtgggaggatcatgtgagcccaggagctccaggctccagtgagctatggtggtgtcattgccctccagcctgggtgacagagcaaaactccatctcctaaaaaaaaaaaaaaaaaaaaaaaaaaaaaaagactgacttgtagctcattacacaagcagtaatgtgagctcagcctacatggtgatgtctcacacacagaccacatcactacattccctgaggcttgttttgtgaaggcccccccttaaaacactggggtacatttgcacacattcacctgtatttttgtctgatttccttataacgctgacccacacttaagaaaatgcaaggccagaggtgagaggcctgagagctggaggcttgttggtttgctgctctttctgtctgtccatccatcagtttgaagcaggtaatacatttacctgtttctaaagtcaaaataaaattaaaattatacataaggaaatcctgctcccattccttcccctttaccctgcatctaccgtcaatactgataaccgttttaatgaattccttatttttccttctagtatttatttatgcaaatacaaaaatctaaacattctcatttcttgtaagtattttgactgatgagaagataagagaattaagacattgagacacaaaaccatttttaacgacctggagcactctactgctctagaacaatcttaattaagaacatatgctaattattcacctctcagcataaaagcttattaaaaccaattggctgcaaatgaaagatgaagcttatgcatttctctcgctttatatagcacactgcatttttctttcattccatgtgtatgtgaaacacaaacagcctccgagggacttttattatgatctgttgctatgaagaagatactgccgggtgcagtggcattatgtgacatttgcacagccagaaacaaaactgtagcctaacagaagaggtcaagagcacagtttgaggagtgccaagaggataattttatcttttaaatgctttggctttgaaagttaatgattcaggccatggaattcaaaatggacttggcagagtgtatcgtatgagcttgagatgtgcactgggggacgtgtagaccctgccatggagggagaagtgcctggtgctgctcgctccctgtgtgcactgctgccactggatgcaggcacactcactgccctgcagcctcccaggagagctggctcaggctttctggtgccttcccagaggggtggggttgtgcgagttttgaagagaatcttacagaccctttgacagatgagactgggaaaggctaaacatgtgaagtgacataaccacttacttactcattgtacatcgttgggccagtttattagcctctttgaacctcagtttgttggtctgtaaagtgaggggattatactcatttcaccggaccctgaaaggcccaagtgagatgacttgtctcatgagccttgtatggacggcccaactcacccaaggtttcacctggggccatatgtccctgctccttactgatcataaaaaaccctccaaggtcagcagacccaacctttccaggacacgcagagtgccgcctgcttgtaaagtacaatgggaaacaaagggttatttttatagctgcaatgaaactggtcttgtgcttccctgttcttgtccccagacctgtttgttgcagttatctttgataagatgttataaaaagatgaccaagaatgaaagctctgcagatacgaactgcacaatttactatctgtatatttatttcctaaagataggaaataaacctgttaggttactgatggaatttccccaaaatcataaaacaaaatgtaaatgaaatcaggatctggataatttcagggaaaaggcccacttttcatacactttacatggatgggcttgcaagaatgcttctttacctggattgaggcttcagttgtctctcttctttccatgagaggcaaaaccaggataaactccatggtgatttttctccagcttctttcatgcactctaggacacactttagaccagaagttagcaaattatggcctaggtggccaaatccagtccaccaagtgtttttgtaaataagttattttagaaaacatgcccatccatttgacgccttcaatgtgtgctacatcagcagaagtgagtagttgcctggccctttacagaaagtttgccaacttctgccttcaacttttcaaagtactctcccagacatcatcttattcggtcttcattgaagcctactgagttaggttagaggttccgaaactgccttggttcacagcacgttagtatctcaggaaatttttcacagagcccctggccaaaagaaataatacccaaggctctctttttaaatagatcaaaacactttaataagtatttatgccttaacaatgtagcacctatggggcacggcaccgcctctcaaatcttgggatcagattggagaccactaacctagtttctgtttcacatgaagttccttggtgtttgctttttatcagggtactttgaaaaacagctttgcaaagtggtcacgtcatcacaagagatgtggtaatctgatgttggaagcctgaagtgcttcaagcttcaagtttacctggtgtctcatggatatcctgggattgcatttgaaaatgtacaacctcccccaggcactctttgcgaatttgcagtggccttccagggcacctaacaggtagtgtgggagccagagttagatctgaaggtccccgggttacagatgaggaaggatcagagagggaaattgactttccctctttacacagctcagatagccttccccttccacgaagctgtcctccctgagattgcagtgtgcctgccccggagaacaatttagcttgttcccagggtgcatcagttttagtcttgcctcacgttgaactcgactgcttgtcatacgcaagcactgcttgcctgctaaaatcatctgggaggcagtggaggctgctacccccaggaccaatgaagcagggcttgtattgtaggatcttactgctgttgggatcagcccgtgtccgcctcagggctgctcttaacgttctgttgtctccccagaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggcgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaataattgactggtggaaggaaaacaaaaaacaaaaactaaaaacctcttagcttttctgcaattcaactttttatttttatttttatttctatcaaagacggtagagagaaacagcttgatgctgtttctacattaaaaaaaaaaaaaaaagacagactgttggtcttactaaggatgtttttaccagcctgcctgacttctgcaaacctaccctgtcaaggagatcaaagggacgcaggtttctgtttattctgaacaagggccaggccccgcggagtgtctttggtggatcccagataactcctaggtgctgctctcagacactgaggagttgagcaaatctgttctattctgcagaacccacaggacaaataagagttctactagaattaacagcccaaaagaatagctacagctaagtgaagccacttacgtgggctttaaaaaaataatgtgttagctgattcacatgcactggagttaattagtcttagaaatgtgtgcatccatacaaatgcacaacataaagtgaacatattcctaggccctttctgcctgtgtcagggccaggaagtagaggctgggaactcttctggtccccagtatggcaggcgccagggaggggatggtgtggcccatcccttctctggatacctggccagtggcaggcagcagggaggagctggccgaccctcagtgactgacaagccagcaattctgagttctggcctttgggagtctgcctgctccaagccagtccaccccagctgcagccccaaaagctggctcaaagtccttgggtggattcactggagatgggcaacttaaaacaagagaaactttaatttttaaacctaagtgatgatacagctcttcccttagattatcgcccaggctggagtgcagtggcatgatctcagctcactgcaagctccacctcctgggttcatgccattctcctgcctcagcctccccccgagtaactgggaatacaggcgcccgccaccatgcctggctaattttttgtatttttagtagagatagggtttcatcatgttagccaggatggtctcattcttattctttaatgagatcagagggtaattcaccaagaaagacctctcctgttccattgtgtcatccaacaactgctcagagctcaaaattatagaaggcttctgagcccctagagatttttaatttgcttctaatccctgaggtgggaacatcatgagggaagatttgattttcagagttaaataaattgtatgtgcttttccagccatctggctcactcatttctgggtaatgcacatgactttgtttgcactggaggaagatggaagcttgcgtgtgtgcggtgtgtgtgtgtgtgtaagtgtgaggtaccttgtgtgtgacaagagacctcacttacgagaaagttggtggatcaggacattccagcctcaggcggcttggagcaggatcattcctcagcaggcattccttccacatgctatggatgaaccatgcacaagattttcggtttttttttttttttctgttacagtgtctttagaaacaagtagaagtgttttgatatataaaaggaatgcttcatttcttatcattatcccaaaattgatccctcccacatttttgctttaaaaagaaacctttttggttttgtattttatacaggaacacaaaatgcaaacaagttgtgcatattttggactctcaaataacttctctgtcctttaataaagtaataataaggaatagatgtgcacatagttagaaaagtatgagtggttaaaaacaacagtctcccatactgcctgttttctctctcagaggggaccactaatgagcttctaagggcatttctagaaaggaagaaaagaagataagaggccaaagaaggagggacgggggttatggagagagaccttccctttccagcactaacgctctgtgaagggcgctgcaccttgcattcttcatgtggtgttttgtcttagaggtcgtcccataataacatataaagatctacctcattcctcctagtagctgcttagcattccattatctcagcggactatcatttatttgaatagccttttattggtgaacatatggatacttccagtttttatttttatatacaaatctataattggcatacttgtacatacatcttgacatagttttgtgactaaaacggtataaattccaacttagaaatggaattgctgggtttaaggctacatgtatttaaaattttgatagctattgccagattatcttctagaaactgatcgaaggatgtaactccatcaagagtacaataaaaggcccaatttctcagctttctataatagcactgggtattttcaaacttaatgtttttcccaatataattggtgaaacatgatatttacgaatattattctgattttggtttattttgtgtataaaatgggacatcttttaaaatttttttgtagttttaattttgatacatttatatattttacccagttcctaattgggttatttggctttttcttaatttgctcatgcactttgggacatttttgtcttatgtctttaaaatatttttatcatttgtctttcgatgttatttattgatttccttatttattggcatagagtttaaatttttatgttgtcaatttgtgagtatttttctttgtcgatcgtgggatttgtttccagtttttaaaagccttcctcattctgagattataaatagacttactcgcattttcttctgaaactttatggttttattggtttaccttcacatcttcagactccctggaattcatttgttgcaggacatgagggaaaaatccatactttttcctcgaaatggtggtcagcagtatcaataaatatgtaataatgcatttctaaaatacagtcatagtgttttccccagttgttcaaaatgcagccttatttgtaaactaaatttctttaagtgtttggttctgtttctgttctatttatctctatgaatgcctttcatttctaaagcattattcatactaatatcagtattttcaagtcaacactcccatcaactctgaatctctctctcatatgaatcttttttcaattagagtcacaatgaatttacagattgagtcttcctattcaaaagcatgaaatcttgtgtttaagtctaattttatgtaacttagtagtgttttatgattttgttcactaaggtgctttgaatttatagtttatttctagatgttttatcatttggctatcattttcaatagaatgatttattccactttattttctattttatcccattgtataagaaagtagttggtttttatgtatgaatgttataatcaaccacaaattgtgattcctacttgtttctaaggtatacttttgacttctcctttccaatgtgtctcttatttctttcttgtatctagttgatttgagatcagtgttgagtcacagtgattcaggtggcatgcttatcttgttcgtgacatcagtgggacgttttaatgtctcagcgtttaacttgtatgaagacatgtattttccttgccataataaaaaagtatctgtgtgttctcaaactattaagactctctggggaaaatgtagatgttagatttttgtcaaagccttctcagtgtccagagggattatcagaaggtcttttcctttgctctagtagtatgtttaattatattaatagaatacttaagaccaaatcattagtgtattcctgagatgttctttacttattagtatcatgactttggttatcaatatttataattaagattcatcattctacatcttgcttttatgtgttttttgtccagatttaactttatgctgacttaaaggaagaaatattataaaacaaaaacctctatattctacaatcatctattggttttggattattttctgcttaagtgtagaagaactagctggggctgtctgggcctgccgtggtatatttctggattttgctcatcaggcaagttaggtcctcgagcccttctagagtccattttaatgacacttttaaaaataaaattaattccatccacttttcaacata

SEQ ID NO: 51 - DNA, 495961 bp, Homo sapiens
  source 1..495961: mol_type = genomic DNA
aaccaaccagccacccgtcagagagggacatgcgcagtgagtgcctcccgtctcttctacccgaaccccccctcccccccaagcagagagaccccagcagcagcagcagctgatgatgaagagagaggcagtggcagagggggggcaccttttatttctatttttaaagggacaggacactaattctaccccacttcaaccttgaattcaggggggtggggggaaggcggctgagttccttcccccaccctccagccctgagccctgagagggggattgagcctgagagaggagaaggagtttcttcttcttcgaaaacccccatccacgactcctaccccctcacccctccaactcgcctccctccctccaccctcctcctctttggccgtgagaggaggagagaaagaaaccaaaagcctcttagcaacacagaccctttgctgctgctgttgctgctgctgctgctgttgctgctgctgctgctactgctgctgctgctactgctgctgcttggccctggctggagacatctcactacacccaggagcagccacttccccagctctcctcctcctccttcgcctcctcctcctccactccccccctttattaccctttgtgtcatcctccacagctccagggaaggcactcaaaagtggggggcaggaaaggtaagtgtgtctgtgggggcttcattgccttcctctggctctgactttcactccggggcaacagtagcaccaaaccacatacgcagtggagctccggggtgaggagggggtggtgctggggggggtgaaggaggggttggagtagggaggggtgtgtgaggtggggtgcccatcctgtcaggggaggaagggcacttttatttttatttgctgttgtcaaaagtggtttctctcctccatctaacatctgattgtgtcttgctccagtgggggagaatacaaaaacaaccccctccttcctccaatgaggcgccagggaaagagacagaaagaggcacactttctagatgtcacttaaaaaaaattcattggagagctctttttctccaggaaaagctccactgcatttgtttctgagtgggaaaatgtcgggatctggattgtattggaactgcttatccatttgtagacctgagtgttttcccctttttggtcctgtatgagatttggatattgacttcagtgttggaagacttgattggtttttgctttaagggtttcattttccattttttcgttttgtctgacttccatggaaaatttcaaatttttagttggtagaggcctttggttaggttttgacttgcattattgctttttttttggttaaatgtctgtttcatatatcagtatataaagtccaaagctctaaaatgcttaaagtttaaatgccactgctattgtctgttcccacatacgttcctgatacttattttccatatgatgagaatattagctattttataattaatctgggtatatttgtaatctttgtaacttgtctgaacaagtaatccccattgaaaactttatgttgttctggctgcatggaaggccaaacctctccatcaatagtttgctggattggtaccactttcagttttagctgaattatttatttactgttgtaaattgagatgagtttttcatctcaatttctcttggggttctgaaccaaattgcccactgtatgtaaaagtacacaaatttctaaaatatgttttcatgagtcaaagaaatcatgaacttatagttagtatattaatttcagttagctataaattgaaaggtaaatccagatttaagtttatggaataacaatattgataaaaatcacttcatttttgtataatgtgttcttagtgcatagctttaaaattcagtgctgtattttatttcacaaatgttagaaagtatgtttctgatgtaggccttttactagggcttatattggaaagtgttattttgtttcatatatacatttctttattctttccttgaagatggatgcacacatgcatatacacacactctctttcgctcgctctctctccctcacacccttttttttttttttgtaactgcattggtatctctgatcccataatttatgtcagcaaaaaatattcttctgtaaagcagcaattttgtgatcagactggcaatatgaaaacagcaatttgatcaactagaaaggattgaagaaatataaatctagaaggatatttggcaaaaatattataaagacatgataatacttctaattttttattttcttgatggttaaagctaaaacatatattttagtgacagtgaagcattgcatatgtagaaacttgttctgtaaaattttaattatcaactgtgtgcaaaagtagacatttacataccgaaataaaaaagctttatagcagtaaacaatatgatcttatttcccttctgttataaatttgaacaattttttacctttctctgagatgtaattagtgcacttaagcagaaatctgtgccaagttcaagtttttctcccaacatcaatactgccattccaagtccttgtaaggtttcttgttctcaccttaaaacctcagcaactttaaaggtaagagagagacagtagaacttactgaagaaattaattttaggtaagggaattatgtagataattggggtggtagttgcccagtaggcagctgagtaaaaatttagtcttgagtttaatgtctttccttattttgtttcttttttttttttaaacatttttttatcacacccctcaccctcacccccatgatcctttatggttagaagattgcagactttatctaagttggataatgatttatgtttagaaaacctttttaagtattaagaaccattgatactttaggattgtaattgttcaactgggtggtatcttggaggtcactttatccaactctacctattgctgaagttctaagaacttgaacttgcctgaggttccaaggcctggaagtgacagagcagggaccagggaactcaggtctcctgatgctcactatgctgcactacctcatttcctttgtcagaaatgaaactattatgtacagttctgggtataccacttgagggtttcatatgggagcatgttattgtaagaatattaaggtaaatggctttaaagctattattttgtctacttaaatttagtaatttgttaattttttaaagtactaattgcacttattgtaggttattactattttgaaaataatttcagctttctctaatacttattttcctcctgcacttacaattaatcagtaaatatacttactgttgtattaagggcccatacttataagaataaatggaatgcatattctcttataaatgcttacttgtgagtcttgccctatgaactgcctaaaaacaaacatttttgttttgttaacacatccttctactcttggcacaatatctggtacacagtagttcctactggtagcttgtcataatccatgttagttttagagttaggcatatttgaatttctttacttccatatgtggaattcctttcctctccttttcttgtcctcccttgccacaattttcactatcatgaacattttttctttatctctactgtggctctcattttatctaattaacagccaaattaaatactgttaacaatatggtactcatagtaacaagacatattcccttcttatacaggaagcagtttggcaaaagtgatatattatgaataagcaataatgatccaacacattccagttaaaaatatacttgtaaaaattgttcaggatgcacttaaatttcattgaccggtgcaataggttgttggaatgattaggccgcttttaccagctctataaaacaagtgctacttaggtgacatgtttccctgactttgtttttttggtccttacccagacaattatcaactttccagttttctatggatatgaagatttactcctagtcatcagtgggacccccatgaagtcagccagaaagcctatatccaacttatgtacctttgcaaacttgtctggattttgactgtatgtgcaaaacagattgtacttagcgattcattaaacatcttttgatcatctgctgtctgccaggcactgtgctaggcatctgaaaaacaaagatggtccctgcagtttaatgtgaagagctatcttaattgtattccacaagtgtattggtcgtatctttgttttggtgtttctacctaaataaattttatattaactaaatggatactgttaggtggaaaaatgcatgtttaagaaagatattgctgttattttattaaaatacaaatatataaagaaaaattttccacttaatactgtattctagggatttatattctgtatatagttaacacattttagacaatgaaaatagcctatgtggttgcctttgctggatttttattgctaaccgtaattcttttaagatgaccaacaatgttcattaagttatctcattaaatttttccaaaaaaaaaaaaacaccccaaaccctctaaacttaaatctttttctcaaaagtaacttttttcttttttatctcatataacagattatcattcatgattcattggaagacattgtacattttcattttgagttttcagatattttctaccaaattttagcaaatctaacagcatgatttaattattctgcagtaattagtgtgcactatttaggagttttggaatttttagtatgtagtagaaatatcattgcaaaatcctcataagaaacttcccaattctagttctaagtcagttgtaatttttaatctttattaagtggtataatctctatagctttagtaaaatgatttggaattttcttagtagatagatgtttcaaaaacaaagaatcttatctcagttcctgtcatggctttcatgtgtaatcgaaaagtatattagaaaaagtactggattaaatttgcctttcttaaagtataccttttacaaaagtattgatttgcagttaaaaagaaggtggggatgcctctgctggtgcagtatcttgtgaagataaatagactcctgagtggtgaattctgatctctttcacgttcattcttaactttctattttagtaataatcatagttaccattgattataagtacccagcactgtgataaattgaattcacattacatttatgacactttctaattcaaaacacagtcacagtagagtttttatcaatctgtacactggtaagcgatggtaaaattatggccctgatagcttcacagactaatggaaaatttctgaaagtttacaagtacagaaaaacaaagaaaaaaaacccagtcttttataaggaatgtagatacagaccattgtacaatttaaaatatacataatgtcagtcttttctttgtatggcaaaaatgacatttgggaactgctcatggtgactcaacgcttgtaatgtaatcccagctactcggaggctgaggcgggagaattatttgagccccagattttgaggctgcagcgaactatgcaatccagcctaggccacagagcgggaccttgtctctaaaaataaaaaataaggtcaggtggaatagctcaagcctgtaattccaacaactgggaggtgaggtaggaggatttatcacttgaggctagtagttcagggtcagcctgtgcaatgtagtgagatctgatccctacaaaatcaaaatagtagctgagcttggtgtggtgcacactgtagtcccagctactcaggaggctggagaggatctcttgaactcaggttgaggctgcagtgagccatgatcatgccactggactctgtgctgagcaacagagtgagaccctgtctctaaataaataaataaacaaataaaaaaacagtaaaaaaaagttcagttcaatccttatctgtattaaacttcctttaacttgtgtggagttacatttaatattttcttatatgaagttcaaaggttataacaatttctgatccaatgaatatttactataaaatttttaatataaatgtgttgatggtgtaaaagcccataaaaaatgggaagtttatattgtcttgtgctttggtgtatgtatacacattaccttctggactctatcatacattttcataattactacattacatatataggattaagtttaatgtactctttttagtactaaagtcagaaatattttggtataagaatgatcaacttgttgggttctctaggtgcctaaattatttcatatttatacttaaaagctactgaattaaaatactttttaatacagttctctttgggtagttgagttttacatcctttacttttaagagaaaaaaaattaaaaactttttttcctgtttttattacttaagtaacttttgtgtctcttctaagtaaatacatgttcatattataaatttatacaggttgagtattcctaatccagaattccaaaatccgaaatgcttaaaaatctgaaactttttgagcactgacatgatgctcaaagaaaatgctcactgaagcattttggattttggattttgaggttagggatgttcaatagatatataaggcaaatattcccaaatctgtaaaaatccaaaattctaaatacttctggtccacaaaaccttttgaataagggatatcaacttttattgactctatcgtcctgcaaatattatgccagtacataatgacctgcagagtttggaaacatttttaaatgctaaagaaatattctttatcatctgttatatattagaaaagtttattgcaaatgttttgttgcttataagaataatccgaataatcagtagtgtgatcttaaataatttctttaaacaacccaaagataattcagttaaaagtaaatattctaactctaacacttagagtatttctgtttgaggtatttctatgtcatgtaagatgtcagaagctggaatgactcactgtaactcactataactcttcaaagagacagtgagatccaggcttaacttatattatggtataatttattcaaagttggatatcacaaattttgatttgtatccttatttcagttgacctatataaccttttattagagaacctgtaattaagttcagtgtcattgagtagattattagaatacattgttttaaaggactaatatgagttatgtaaatcagtcaccaaccttgaaatggtgaaaagtttttgtacacatatgcttcactgaattcttctgctaaccaatcaagattctagcaatgggaggaaaattttctgtgtggtgctaatgttaaaacttaagttcatgtgtagcttttaaaaaaaaaatttaatatctgtatctcagaagttagaagtaatcccaaagtgttttttaagattgactgtgtgctaaattatacttagggttatccttgtattcacaattactgttttttatacaccatgagtccagaagtatctactaatctgttggccatcaactaacttaatccatacattcttaatattattaggatctaaaaataataatttagactgtataagtacatttactgatgttgggggagggaaatattccacattcaataaaagcaaatattgatttttaaatagctttgttacttgggatatactgacctaaaaagagttcactgtgtaagatataaaatattcttatttgaaaagttataaagtatcattaatgagtattaaataacataaaaatatttaggaaatcaaatacgtgctcctgtaatattcagaggctatttttttagtgttattccaaaatcattttccttctatatttgtcacactggagtttctgctgaaggatttcttggccattttagacaatgtaatctagttaaaaggtttgtttatgcttcccatctctgttctgctgatggtattagaatgcaggccagagccagacatctaactgtttataacattcaaacttcaattaaagctacagtgttcagtttactatgtatcagaaagctcttactagctacaaatatcactaatagtgatgagagtgatgttgactagctataagctttcctaaatcataccactcattaagaatactttttttaaaatttaggtgttaacctttaattctttcatagaagtataaaattaagctttttttttttactagaagtaatatagtcttttcctttaacactttttataataaaacctaacagcatatattattgcatgtattatttaaatggtccaccttagttgttttgaaattaatgaattctgtagaaggtgttactttgctattcaatttattcgaattttcttcctagcttgaaaaatatagcaatatgttgcccactagaaaataaacctaacagtcacattagtcaggtgttcttacatgtatgaaaggagtctagtcccacataacacagattctaatttaacatatcgcttttctaggctgctgttcttattgttttaagtattttggtaaattgttttagaagggttttttgtttttaaaaattatttagaattctttgaaaccatttcttcaacagcttctgtttttgtacagtttacctgggccagtcagaaaaggatttgaattttatgtgtgtttaatttttctaattagtaggcaaatttgctatgttacattggtttctttttttacgaaaccaaattttagtttttattaattttagaccttgaatgactaaatctacacattctttatgtatgtacatgtaatttttattgacatccaagtttataagaggtataagtaacagatcatttaggaaagatggaaaatcatattaaatctaatgcattgctggtaaaatgcttttaattaaaaaatactacgatggaaatattaaaagaagctaagtaatataaaaagttaggggccaggtgcggtggctcatgccttaaccccagcactttgggaggccaaggtgggtggattgcttgaggtcaggagttcatgaccagcctgaccagcatggtaaaaccccatctctattaaaaatacaaaaattagccaggcttggtggcacatacctctaatcccagctgcttgggaggctgaggcaagagaatcgcttcaactcaggaggcagaggttgcctcctgagtgcagagatcatgccactgcacttcagcctgggtaacagagcaagactctgtctcataagaaaaaaaaaagttgggaaatactctcaagtgtatctgaagataagaatgaaaaacaaccatgcaaaacttagatttatagtttaaatccatggaaagatctctaagataagctaggttgaaaagcacatcacaaaataatatgcacactatgatttcatttatgtaaaaaatggacagaataataagtatgcaatgtttatgaatgtatatgtttacatccatacaatacatttttatactatttataccataaagacataaagtatatgccatatatattagaacctcagtacattaagaaaaaatctggaagataggtatcaaattccatgctttgtatacggaaagtatatatgtgggatgtgggaaggttgacgaattctttttatttaatctttagcattacttggatttatttgtagcaataagcttatattcatgtaatgatttttgatgagaaaatatacttacgtattgaagtaaaaaatgacccaggaaaattgcagttctagtctaaatagtcacatgaatatatccctagaatatcttgaagagaatatagtattggctaacagtcatcatagcttgatagagaataaagtctgtcagacttatctaacagggtgaaaagcctagtcaattgaggaaggaacaatggatataatgtagtttttaaatattttgcttcttactgaaaaatgcacttctcactgtcctggaaaaatatagactgggctgctggtgataaaggatggcagttataaagtggtagacaatttcaatctgagataagatataatatatgggaataagatgaactttattattttaatcagtgatccaaattattatatgttcactcaaaatacagatagtataatcatgtaatatttttgtaatgttttctataatcaggtactggtttgaatagaggacaaaaataaaacagaaggtttgaagactaagtacttctttttaagtgactgaaacatgtacttgaaaaacactttaagaacctttgtaaaataacattaaactgagtgtgtaaatatgccttgtaaaaaaaaaagcaattagaattctgtagagttaatcacagtgtgcttttggggaggacctgagttaatcagggtttaggtggagtttagatactagtttgtcacagaagagggtaattcaggtaaagacaaagcttccaatgggtgagaggattgggaagcttatttttactagtttgaaagctgggattaaaattcagagtagcctggtaaattagggaaatgatttgaaataatataccgtacctttacttttatggttctaaaattttatttccctgaatgtagtttcgaaaagaaagaagtagagaaagggggaaaaattatttgcacaaaaaataaggaaatgaataggtccttgcaattatgactagagagtccattggagtctgaagtgttttctgaatatgagttggaaatgaaaacactagttaaggcagcaaacatgcaagaatactagctaaggttcttttttctttcacaaataaattttttacccaggttgatccctaggatcaatagtaaatagtacacaattaaaactataaatcatctataaatgctgaaagtaacaaaggatgcagcttatgttttctccattttctttataagttttgtttgcatctaatttatttccaggtacccctatgatgtaaattaccatccagtcttcacctactaccagaaattgaacttttttatttcttctgaaagtttaaagagttctaatatggctctgtattttttttagctaaaatgtcatagtgaatttctttaaacggtggttattgttgactcagtgtttatctctttttcacaaagggtttgccagtgtctttctttgacaaacatgtgttgttactattatgtgctcactgggatagtgagcaaaaatagacataggtcttgatctcccggaacttatatctaaagatagaaaaggatattaatgaaataatcatacaaataaatgcaaagttggaactgtttcagttgctgtagagaggtacgtaatatgagggcttttagaaggagaatttactcagtgcgatcaagaggaatttttttttggaggaagtgtttatttagctgagatctcaagtaagttaatttgatcaagatgaagaaaagagttttctgggaagaaggaatagcatatacagaggttctgaggtgggaggaagcatagtaccgaatattaaacaaaggtcaatgtggcagaagtttagagcaagagtttgcatggtaagtgatgatgctagggagttatgtaggagccaaactgcagaactttgtgtaggccaagctttcctttatccttaggtttaatatttaaacttagactaatgttccttaggtttaacaagaaaaacctactattaattataaaagatttgtgttatagaagttcatttttatttcagtttaaaaccaataatgctttttcccatagaatcatggttacagtgacaggtctcataagaaacccttttaacagaaataacattggaaaccagtcaacgtagtgtcataaatataaccaggtagaagttagaaaagaaaaggaaggagattaaaagttatgtctatatgtattcaaaagagaatgtcctgggtatgattgactaagctgtgaataatgaagaaaaaagccttacttcaagtgcattaggctggtgcaagagattctaacaaatgatggtgagggacacattcagctggacagcttagaagatccttagctggcacctagatatagaacagagtgataatgtcgagcaaaccaaggtagaaggagagtagaagtatcacattcataatttgttctgaatttagcacatattcgtgtcagttgttagaatataaacatttaaaaaattatatactggtaagaaatgcagagctaccaaatgtcagcaatacagatgccaactttattttgattatattgagagtgatttcatacagttagaagtgattataaattgctcagttgtactattttaggccataatgttagctttgaatatcttagtgtgcatcacttggagtgatactttaaagaggaagttgaagaaatttaattttttaattcttatttttcttttaacttattgtcaataaattatcttcatttcaggttgatcttaagttttaagcctctttggacactagtttctgtctgtattaagtaattaacaatctaataactgaaaattcaaggaatgcccaaaatattaagagcattataaaaaataattgattaagcaacttttattaagaagaaaatatcacaaagatgtaataaattgtaagagacaaggaagatatgtacaagtcttcattaaataaacagcgtaccacataacagttgatgaattctgccaatgcttgaagttgaaaattgatgaaggtacttcatcaggtgatcttgaacttaattttctcgcattctcaggtacagcagaccatgcttttacagcagattggcatctaaaaataagaactatagaatttagagcttatttatttgtttacttatttttaaaacattccaattgagaaaataccagcattgattcattttccatgcaatatctagcaggctacttttaattaatagaccaacagtgttcggaaagcttattagaatgtttgacagcctgggcaccatggtgaaacctcatttctgcaaaaaatgcaaaaattagccaggcatgggggcaagtgcctgtagtcccaggtcctttggaggctgaggtaggaggatcacttaagcctgcgaggtcaaggctgcagggagccgtgatgatgccactgtactccagcctgggtgacacagtaagaccctgtctcaaaacaaaagaatgtttgaaaagacagtttactaaatttatctaataattctaagaggtcagtgtacctcttaaatagaaatgaagtttcacttgtgcatttttcagggattgatacgtttcttctattttacagctttctactgttgtttagcgaagcgtattccaaggtcctctagttctgtgataacttaataggtatgattatcctcgcacctgaaaaaacccaaaaggctgcttcatcaaataaggtttaaaaaccatgattatgattaacgaatgctggataaacatttttactgcaatattttttcaaggggtcttaatatgtaattcttctgaacttctaataatggtcactaacatttattgagtactttgcgccactcattgtgctaaaagtcttgtagacattatcttattttatcattataacaaacaaacattctgaggaacatacttaatgaagtgtttcttcatatttcactgcttataaacacctacccaaaaatttaacgtgaagaatacaaaagtgagacaaacatcattttcttttgttgcatccttagcggctttgagaaagaaaggtcatgaaaattatttttaaagttaagtgctgagcttatcaatatgtttttacactcttctaattactattactcacagatgaccaatgataaacattataccctttttattaataggcgacaacctgtagagctttcagagacattcctgggtttgagcattggctccatagactgaatactacaatatagaacctttaacgagctgttaaagttctgaactttagtttatcagtaaaattagtatggtaatgcatatctcagagttgtcatgactatgaatgatagagtatgaagtcctagaatgttgtggacattcactaaattttttcattttccttctctcctattactaatagcatctactaccatagtagatgaaaaaaaatgaaaaaaatggattgttacctttattaataacaaaatatcacaaagatgaattaattctaagagagggaagatatgtgcaagtcttcgttgaataagcagggtgcactattagtaatagtagaaggcgagaaggaaaatgaaattatattactattaataactgttctataatctgtatgttatgcgttaaaaattttttctttttttagaaataaaattatctgttaatcttaaagctattttaaagctttcttgaactcctacatttttctgaggactgatatacttcatttttgtgctgttctgcactttgccaacacagtaagacccacaaagtggacatctgtaaacatgaaactcagatggtggagaaatttgaataaatgctccccaacttggttaatgtaaatattctcataacttacagcattggttttggtgattgttattaagtgaacaaatatgtaaatatattttctttccttgtctttgtttcctcacattaggtaggcaatattgcaaaaacgttaagagcacggaccctagagccagactgtctggattcaaatccctgctccaccacttaactagctatgggatattctgtgcctcagtctcttcattagtaaaatgggcctagtcagttgtgtccacctcagggttatttagtgagtttagatataatcaatgctttagatatatacaatgctttaaaaatgcctggttcatgctaagtgacacaaaagtattaactgttatagtgattatatgtgttgtctttatattagttgtactatagaaaatagtgactagtatattatggtaaatctttaacttggtaatatttcatttggtacaataaaacaaattctatttatagttctttgaaatgtataccagacttttcaaatgacacttttatgtgtctttttacatttgccagattctttacattattgttttacttcttgttgagggagatagtgggaaaaatatctttgttgtttctcataaagaaacagacatacagagtgtttaggaccttttaaagtatagcaataagaaagtcagtggaaagactaaaattagaacccaacatattccatgtgccaatgtgttgagccaagctatctgttctccttattgagaattcaaacaacaaaactattagttgacattctcctcattgagaattcaaacaacaaaaccattagttggcaaagtaaatgtaaagatatgttcttctgttgtttaaaattgtattagcttgtgtctgctttggatatatcctcttacttaaggttggttcactcaaagattacttgaaaagtttgatttaaatgggtgtagacaattaaagttaagtattgggctagccatcccttaggacatttaagggctgaatatcttttttagccatcaactggctttttctccatctttgatgaactaggtcaaaaactcctatttctcatagtcagtactctagtactatatatgggctcagtgctcctgtgagccatcctagaaacttaactgtcattcttagtatttcatttctattaagtgattccaagtttcagggaataaattagtgagcaatgaggttttgaacagcactagatttataaggtgaacagtatctatgttttaattttcatattaaagaacattttaaataggtttttattttttcttatttaaactattacagagtgtgtaactcataagtttaagaaactgatgaacagtttggttgggggacccagaaaataataaatattggcaatcaaaacactcagaagcatttttaaagagataattataaatggttgcgtagataacaaaagtaatttcaaatttataatttatgctcataattgcttaagacgtagggtttttatgtaaaggcagaatgaattttctcttccaaaataaccaaacttaacatttagtatactactctaaaaattgcaaacacttaatggagatttttacataaaggccacttttattgtagaaaactaaacaaagataatttgtttgtttcaaataaccaagtattgactggattctggtacacaacatccctggtatttttcatatgaaataatgcttaaatgttataaacaagttctacaaaatgttctaaaatcttttttggtattttcatatattcattctgcatagaatcaggaaacctaatcacccagtaacccagtttgaaaactcatattattttgtaaatcctgatgtaattaaaccactttaaatgtctgctaaaaaatatcaagttatatttacatatgcttttttaaagttatgccttgtgaaaaatattattatctttaaatgagacagttagagacatcttaaactattaaggttaacatcagctgctaagagacatcaaatcctgattcaagagaatagtaatattttcataagcagaaatttttctcaaagagaaaaaacagaatgtgcagtgtattcgcattataaatgcagttaggaaaaatgcatttacagaaagtcccaggacttgagaagcaagctcaggtttttcatagtgatgtagagaagcataaatgttcattaattcagttactcattctaaaaatattaagtacttactgtatgccagttattcacctatgaataagacaggcaaggactatggagcttatagtctttccactgaagaccaatactaaggaaatatttatgagtgatatacattacaaaagaacaaacagttcttttcagctatttagagaatgcagatacaagttgagttgtaaagcaaacatttctaggtgataataataaaagcattaatttttcattctctcaatgttttggatcaggagaaagagacccagaaaaggtctcttatccaaggttatataacaactggtatatctggtacctcggtcccctgcctcctagtgtaataatatctgccataagaaataaagcaggaatgtgaaagagaagaaagtcaggcaggatgcctagaaagttcaaccagacactggatttcagtgtagtctatataacaggaggaatcacatttttaaaacttcttttatgcttgttttatacatttcttttcagtttcttttagcatttactaaatctttcaggactttgctaagttccatacatctacaaaatttctaaacaggagtcttatgtccctggaagcaaactatgttggtactatggttcctaaatctcatctctacaaaaacttttcagggttgtatcttttttcttttttctcggtaaagaaggttgttttctttaattaccttgaatttaataagtacagtcttatgattgctgacaaaaaaaaaaaaaaggaaaagaaaaagaaaacttgaggattggggaaattaaggacacatttttttttcctgggatggttttgatgtaacaccagtttgtaatcttcttactgtgaattaatcttcactgtatctgataataaaagagtttataataagttagaaagcatatcccatcaatcacatgtaaggttttgactaaactaacggataaagatttgtaaggaagttaggtgattttatcttactgtccattgtatttttttaatttggtttttgatgttactgtttaaattataccaggttaacgaagggtttgatttttgtttcaaaaatatatattaaatagaaaaactgagtacacatcctaatacttactttgacttggggacagcaaagcacaattataggatcacactttgagaagtaaataaactgtttgaaaattgagtctgcaaagctagacatagtaacaacaggaaacatcccacctacaatgcatatggcaaaggagaaagatagtgcagcagactacagacaaaaataatagctgagagctgaaaacaagtattctgctttacaaccttagatctgtcatctcaaaaatagagataatctttcttcaaaatataatatggtgatgtgagcatattttaatttataagaaaaatctttttctttaggtatcccatatcatatttttgcattctttatagtggagggtacagtgtctcctgtatgttttaaaccttattatttttctggtgtatatttgttgttttgtcttctagggacacatactatttttactttactaatgtgccaaattttaagaaatttaatacttaaaaaaccgaatatgcaaagttcgtaaagtaaatggtgagaagatttcactgaagaattgctttaaatagaaagctcttctgatgtacttaagtgtttgtaaagtcacttcctaccctgggctaaaagagacacaagaaaactcgaggcttaaaatgttggaaatcactgttgcttgaatagtaagcagaaatgagggtaaatcatttctgaaattttaagtataaactaatgaaaaattgctttgctatagaaattgcattttcatctaattgaatatattcattttattaagtgggttactactgtgtattctttaatttcattatcttcaagattaatttatagagtctatatgaaaatactacgtggaataggagttatattttataaggagttgctgtgttttaaggagttatgttaaaatcacattatctggtgagtatcagttaaccacaagggtactggccagtcagttatgtttcaaaatacctgttacttagtttgagaaaaagtgactttgggcacatattcctgcttcttattttgtaaaagggaatgctgtggtttgtaatactaggctattgtctagtttgattcaaagcaccctactccattcagcctgggcaagatagtgagaccccatctctacaaaaaatttaaaaattaagggcgggaggagggagaggatcaaaaaactatgtattgggtactatgcttatttcttgggggacaaaataatctgtgcaccaaactcctgtgacatgcagtttacctatctgacaaacctgcacatgtacccctgaacctaaaataaaagttaaaaagtaataactaaataaataacaaataagctagacatggtggcacgagcctgtagtcccagaaggaagaggtgggaagaccccttgggccaagaggtcaagactgcagtgagccatgattgtgtgactgcactccagcctttcataaaaaaatccctgcaaaagtaccctactggtagataatatcttctttaaaattataaataatgtcatgttcattaaatctgagtgtgtatactatatggacagaatagattatccagccttttgattctttaattctatctctctgtgatctaattaaataaaactaagttactttgatgtatatatgggtatttatatcattaattcataataaggcaaaataaataattgctgtaagtgacaatgatagctttttaaaaaatatagccaacattatttctgttatatttattcaaactcccaattttgataacaaacacaatttaatctttatcatatatgtgtatccattaatttatttttggccccatccttaacagttaaacatattatggcagtagtttttgtttttgcgtgcgtttttctcctaggtctggaataactattcttggccctgtgggtgcacattaaaatcatgtaggaccaggccctaaattttaaatcaaaatctttgagggtggaggccctggtattttttaaagcccctcacgtgatggctttacaaaataagccacaaaagcactggtagatgttatctaccagtgatatgcttttgtggagttttgtttgtttgtttgtttttgagtcaagatctagctctgtcacccaggctggagtgcagcagatcgatcatgggtcactatagcctcaacctccgggcttaagtgatcctctaacctcagcctcctgggactaaaggctcatgccaccatgcccagcttatttattgaagtccagccagtatcgagaattactgtgctagggctatgatcccctgtgttaacattttcttaccttgctcttgaaggatcgttaaacaccagttcagcgggagttggagggctgacgacactacagaatctggactctatgacttgttttgggagtaacaggagggtgtgatgaggaatttctgtgaaggtgacttctggatcctcagcttcaattactgaaactatggagagacatgaaagcaccccaccctggctcaggtcaggaaagaattaggaaaggggacttctgactggttaggtgaaattgaggaagggttagaagttcaggaaagtaatacttaaaagtagcagattgtatagacactcttgttctgaagtaccttgaaatggatttggagaagaaccaccatcaggccatcatggatgatctttctcaggagaaagatgagaaccagtttacaacaggccatctagtttaacagctttcactcttgtacctgtacacacgttacacacttatgcatactcatgtacatcatacacacaaacactcgttattctaaagcaagtaagatgatgcagagattgattactggggcaaaagaaggttctgccttggtcttcactgcctttcttctgctttccacccatctttcctctctccaaaaacgtaaaaatcctttaatacctacttgcttgtacttgaaattttttaaggggaacaaactttcttcttaaacaaataagaaagtcttaacatggaaatatacacagaaatcttctcagagcattgtatggtcttttaacaagttaaagccatctttatcctttcctatattttaatctgagagagagtgataaggagagaaaagctctggccacctaaaggggactgtcttctacttcgttgtttactatttacttttaattgtgaagaaaacctaaaaatatatgtgcaaaagtacttataacctaccaaacctctgctgagcactttagttgcagatacctcattagcatataatactcttgctttcaagagatgtggaatttctcttttataagaatctatgtggatataaatagtggtgatcaaggcactcttacactaagagttcagtgatgatacatctctgtcctttcttggcaatttttgctaccacttatttttagtgcctatataacattttaaagttgcatcctcctttttatgactgatgagaagcatatgcctctatgaggaagaaaaggtatttatgacttacagaaaaaaatttctcacagctatgagtaagctatagggaactgaaaacaagaggccaaagaacctttttttttttaatggccttggttacataaagatatttagaccagctttcaaaaataacaacagtttttaaaatttaccatatcgagcctcagtacgttactctaaaacacagctttataattcctctataatctacattaaatgaagagtaaaataaaactacaaatttaggaagatgaggaggaccaaaaaaactacaaataaggtaaataagaaaaattgcaaacctcaaatctcttacaaagaaaattatgatattaatagtttccttactcacatttggtaattgtataaagactgcagagttactacctgtacatctgaaaaaggagaaaaaggacctaaccagtgttgctgaaagaaattttacaaataaagggatcgatctggtagctagtcaggtttatttttacctgggatttagggcttcctgaggcaatgtagcctttacccttttttaggtcttagctccctttgaaaatctgatgaaatcattagatttggggggtaggatgtcttgtataaaaaattttgtatgggcttgtttatgtatttcagggagtttgtgagtgctctgaaaacgaatgaactcctagaccacctgtatcggaatcacctgagttgcatattaaaattgcagactattggactccaccctaatcttattgtattagaatttctaggcctggcactgtggctcacacctgtaatcccagcactttgggaggccaaggcaggtggatcacgaggtcaggagattgagaccatcctggctaacacagtgaaaccctctctctactaaaaatacaaaaaaaaaataaaaaaataaataaataaataaattagccgggcatggtaacgggcacctgtaatcccagctactcctgaggctgaggcaggagaatcgcctgaacccaggaggcggaggttgcagtgagccaagatcgtgccactgcactcctgtctgggcgacagagcgagactccttctcaaataaataaataaataaataaataaataaataaaagaatagactttctagttacttgggctcaggaatctcgattttaacaaggattgcctgatggttctctttccatcactaaagtttgagaatcactgctctagagctttatggattacaccagttctgcctttggcctagaagcaggttttcttattccctgttcagtgatacttgactcaccatatgttgcctaccaatttcttacccatctacaaaatcaggattgtaaagaaagatatttgtgctgggttgataattttagttgaaggaaataagtcattagaaatacatattttagatcctgggtctgtcagtacctatgatttgcaaaataagtaaatttaacttatttccagtcttttgtaaaacatatttatttgctctaaaaatgtatctgcagttatttaagtgtttaatacatcagactgggattttcaattatagctacttgaaaatactgctaactcagaataattgaggtcggatccagtgtaaattttggggaagcatgacttacagaattaaattaaaaatatatgcagtttaacttcagatgtacgtagtgatatgaactgtctccaagaagagtcatctttatatctgaataaagcttatttgtaatgcatatattaagtggtgttatgtaaatcaatgcttttaagataatttaaaaactgcttgaaaataatatgcaaaatttgaccaaacatttccttgcaaatcttgttatagtcttaatttatttttgctggtttacttcacagataaatttagaattgaactttagtctagtagggacatgccattatctcatttccaattattggatctggattaatgagtgagtatgcccatggggctgaactatttagtattaagcagaaacatttttataccatgacactgagaaccaggttacaagtctagtattcctgtgacttttttaaacacagaagaaaaagtttcctagacaaggattatgcgatgtattttagtcaactttctcatcaaatgtgttgttgggagtcacgggagaccaggtaaaataatgtagatgactcagtgaaggatacttgttgctaagaggaaataaataaatataagatgatgagtgggtaagtcagaaataccttttctgtgtgggaaaaatatatgctattgttattactattcatttgtataataaaagtgcctgttaatgtttatctgtgtctttcttaaaagcaaattaaaattagttcagtaaatattatgtaaaatctgttattcctaaagtccttatttctgagaaactacatgaaaataccttataaaaatttttcatgtctcctatggtcatccaaatttatgtaaagataatagttttggtaattactctacaaagattaaaatttagttggtgatttccctgctgcctcttattttcctcagtaaaaatttatgttttactataagatgatactgatttttatggtatattgtttggtaactgttgaattcaatttcttggttccctttgactttgtcctcatgtattcctcagtggcgcacacgtgcacacatgcacacaaatacatcattatgtctctgtaataagaggtgtattatattttcctatttgacaaaatggagtataatggttataatagcagcttacttttgataagcgtactaactggtacatagtaaatacatactgtgcatgcattatgtcatttatatccacacagtcaccttcaaattcagtacaatttgtattcccgttttacagatgagaaagcatattttggtgaactcaaccaaggttacatgactagtaaattttaaatgagatttaatttcagtacttactaaccattatgcattgctaaatttgaacattactttaaaatataacttctaaagtgttcatattagaaacctataaatatacatagatttgtctcctctcttacgaagaacacatgaaggaaagaaagatattaatttggtggcttatcatatgccagacatagatatagatgcttgtatgtatggcatttaatccttatctgtgaggtaggtctttttatgcctttctatagatttaaattaaaggttcagtttagtaacttgctcgaggttatacagaatgtggcagaactaatatctgaccccatagtgcttataactggtaaataaacaacttggattaggtcactttctcaagtgtactggagactaattgctccaagataaaaggcagatagactgttacctactagtaaatgtaaagaggaaatgtcatttctcttctttctccattgtctttatgctattaagtatgttagaatttgtatatagcaatctagaaattttgaaaacttcccctcttaatcctagaatggataataaaattgtttcctaatttatgtacacaatcatggttcacactagtcaaacagttcaccaagggcttgttgttagtattgtcttaatgaagtgccttttttttttttttttttttttttttttgagacagagtctcgcggtgttgccaggctggagtgcagtggtgcaatctcggctcaccacaacctccgcctcccaggttcaagtgatcctcctgcctcagcccctcgagtagctgggactacaggcgtgtgccatcacacccagctaatttttgtatttttagtagagacggggtttcaccatgttggccaggacggttttgatctcttgaccttgtgatccgcccaccttggcctcccaaagtgctgggattacaggcatgagccactgcacccaaccttaatgaaggctttttatacactagtgatgttatgaaagaaataaaatacaaggttttcgaagttttgtgattggttgagaaatctacttaaacacatcaaaataattcagcatatgattaagttgtagactgagtggttagcagtataagtccctgaggtctttcaaactgagtatttatgtaattactcattaacatctcccacaaacctcttttgcttgtatttactttcttggatggtgctgtccctgtctaccccaattccccaagttagaaatatcatagtcctcttccaccccttctttacctccatagtcagcctatcaccaaatcgtatagaattgttttccttcctaattcctaagtccgctcagttctatctttgtgttatgcacattgctgctagtttagttcattccttgactagagaatggtagtaagtaatctccttagctaattaatctgcctctgacttttctgtactctgggccatattctgtcttttgctgagttgttaccaaacataaacctggttatgtcactaccctaattaaaaaccttgtggattgttcctttttattggtttatataaaatcctattttcaatctgaagtataagcccttcatctttatatcttatgtcaacttagacctccagcttcatctcccattacttttccccttatgatgtctttcatcgcagctaaccaacccacttcctcttcaagattatgttgtgctccttcaggtctccttggctttattcacatgctgtcttttgtacagtgcctcttgccttatccactgtctcccccaacatagttttactgcaaatcccaaatcaggtgtcacttcttatcaaatcatcctggccatcctcaattttccccttcttagttaatgatgcactcatttaacttttatgatcatataagatggttgtttttttacttctagtgtcagtcaccaagattatcaagttcttgctttgttttcttttgcatcttcaaatctagctcaagccataactaagaccatgacctttactaagggtcatacaaacctgaattgaagtaagggctctgcaaccaaaagaaatggagtacattttgcgtggagacagaggaagttttaaaaaggatcatgggcaatggcaattctagatgttttttacatcctgcttggccagaattaagcagataatacctgaatatacgagaaggccaaattgggagatgtagaaattgttaaccaatatttttaccaagtgccttgataaatgtttgtgtttgtgccacacaggcactaggggtacaaagatgaataagaaaggaactctgcctttgaagaaatttagagtgactaggggagaaagacatgtaaataaatgtataaggtcatctagagtattcatttaatgaagtaattgtaaagaacagcaagcaaccacttaggatgagaatacctcctttggcagaatggccctaagtccaaagtgataccttagctaaattttaagttatgagttggaattctacaattgcataagatggtaagggcttcctagactaagagaacagcatgtgcaaagacacgagttacaaaagcagcaaaactagagaaaccattgtttgtgagatctcatacatagagttgtttattttagaaagcctcacaaagaagcctctagtaagatactgtagataattcccaacttaaatatgctgtcttgaaacaatcctcttatatcaatttattcattgttctttccctttgaagtctaaggtggataggggcataaactttggtgatgattaatttaagttcagatcctgaaacattctgtctctgtaaagcatcattttacctgttcaaaaaaaggttactaactacctccttctcatggtttttggaagattcagagggataatgcatacaaagttgttgacacaatgcctggtccgtctcagtaggactcgagaaatgttaacatatattaaggctcctgataggccttttttggtttcccacccatttatttaagaaattgttttttaaatgcttactacttattaggtgctggaattatgaagatgagtaaacacaacatctgcctttgaagaatttatagtttagtgaggatatgcacatacctatgttgaaaatcaacaataataatacaacctggcaaatgctttagtggagagttttgtgagaaaataagaactgagaaaagaagccgccaaatctatttttggacattagcaaagtcttcttcagggagcactgacctgaagaatgaagagcagtttgctgttttggagttggagagtagagaagagtaaggctttccaggaatgaggaagaacatattcaaaaggagggtcaaggtaacatgacttgttcagtaaaagacaaatgataagaaaaccactaaaagagaaaagaatggagtagaaaacagaggactgaatgtactcaggggaaactctgtggttgaaaagtcccccagaaggcctaaagttactactttgctcccttgagaaaagaagtgaataaatttcctagggtgggtatgagataagcctctctgtgaaaaattgccctgtctcatcctgggatgttggaatagtctagtccactcttcttacatgaattcttgtgtactcccagaaagtactgcagtgctcaaagggtgaggcaggaggagcaaagaaatagaatttcattagtgatgttagtgtctgagaagtggtgccagcaagagtcatattgaccacattgtgggaaatggtaaaaaagaagcattttcctgtggttgctgggagtttctggtaacatgtgatggattgactggactgtagcttgactagacagtggcatcaacctgtgtattcactggttctcagctgcccagtgattgtacccagaaactggacatcaccttagctctttagaagctagaaatcttgtggcaagtggatttcgtgcaccatccattcttcactttgctttgaaccaagggaggaatttggatagcactagaaatttatggaaatctgtcagtgggagctagccatagaataattgttatgctgtggttttgcactccagctgtatttctagctagttaggactatggcaatatcttttgaacaagaaagcaaacaggaaaaataactgaaatttgttgagtaattactgtttacctagtactgtagtacttgctttctgtgggggagaagggtggctttcattttttattgaggtaaaatccacatagcatgaaatttacaatttaaatcattttagagcatgcaattccttggttttcagcatattcacatttttgtggagccatcaccaaatctaattccagaatatttctatctccctgaaaagaaaccctatacctgttagcagtaacttccaagtacctccctccttcccatatcgtctggcaacttctagtctactttctaactatatagatttgcttattctggacatttcatataaatgaatttatataatatgtggccttttgtgtctggcttctttcacttgaataaggtttcattcatatgctaatgtgcatcagtacttcaatctcctttatggctaagtaatttttcatatgaggatgtaccacattttgtttatccattcatcagtatttggtgatggacatctgggttgctttcactttttggttatggataatgctgctgtaaacatttgtgtacaagtttttgtgttaacatatattttaacacattcctaggaatgtaattgctgggtctcatggtgactctatgtttaacatccaaggaactaccaaactgtttttcaaagtagctgcaccattttcattagcatacgagggttccagtttctcagcttccttaccaacacttgttgtgtcttttttgttacagccatcaagtgaggttgaaattttatctcatttggttttgatttgcctttactgatggctaacgatgttccaaatgttttcatgtgcttattagccatttgcataccttctttagagaaatgtttattcaaatccttttccattttagagaaatgattattcaaatccttttccactttttcgtgtttgccttttcattatctttttattattgaattgtaagagttctttatacattttggatactagacccttatcatatatgattgcaatattttctcccattctgtgtgctgtcttttcactctctataatgtcatttgatccacaaaaattttgtctcaataatttttttcttttgttactttaacttttggtgttaatttaatagattattgcctattccaaggttatgaaaatttacattatatcttgaagagactatatccccccattgaattgccctagcactcctgtcaaaaatctgttaatcaaagacatgtgggtgtatttcaggctttcagtaatatcctgttggtctgtacgtctctccttatatcaatactacactgttttgattactgtagctttgtgtagtaagttttgaaatcaagaagtgtgtttccttactatagtttttttgtttcttgatttttctaagattgttttagctattcagggttccttatattttcatatgaattttaaaatcagcttgtccctttctgaaaatgaaaaatagactgttgaaattttagtaggagattgtattgagtctgtggatcagtttgggaattattgccatcttaacagtagtaactcttccagtccatgaacagtatgtcttttcatttctgtacatttcctttaattttttaaacagtgttttgtagttttcagtggacaagtcttacacttcttggctaaatttattcttaagtattttattccatttaatgctattgtaaacagaattgttttcttaatttcatttttggtttgttcattgctagtttttagaaatacaactgctttttgcatattaattttgtattctgcatttttgcagaccttattagctctaaaatattttagtggattcttccgggttttttatacataagattatgtcatctgcaaatagaaatagttttacttctaatctggatgtcttttcatttctgtttttcttttttttttttcgcccagtttccctggctggaatgcttagtacaatattgaatagaagaggtgtgagcagacatccttttcttgttcctgattacttaggggaaagcttttactgtcttaccattatgttagttttgaggttttcacagatgttctgtcaggctgaggaaatttccttctgttctgtttgttgagtgtgtgtgtgtgtgtgtgtgtgtgtgtgtgtgtgtgtgtgtgttgtcatgaaaggatgttatattttgtcatatgctttttctgcatttgttgagatgatcatatggtttaatataatcacaattatgatataataattcttctagattaaattttatagtattttgttgagtattcttgaatttatatttataagagctattgatctatagttttcttgggatttctttggcttttgtgtcaagatatgctggtcttacagtatgagttaaggagtattctttcctcttctgtttttttaaagagcttgataaggactgacattaatttttcttgaatggtagaattcgccagtgaagccatctagtcctgggctttttatttctataaggtcagtagtgacattcttgttatcattcctaattttacccttctctcttttttttcttgggtagtctagctaaaggtttgtaaattttgttgattattttaaagaacaaacttttgcttttgtgggtttatttttctcttttgttctagcctcagttttgttatctctgttgtaatgtttattttcttatggtataagactgttattgagtttttttttttttttttttttgagatggagtctcactcttgtagcccaggctggagtgcaatggtgcaatcttggctcactgcaacctctgcctcccaggttcaagcaattcccctgcctcagcctcctgagttgctgggattacaggcatgtgacaccacacccagctaattgtgtattttcagtagagatggggtttctctgtgttggtcaggctggtctcgaactctcgatctcaggtgatccacctgccttggcctcccaaagtgctggtgttacaggcctgagacaccatgcccagcagagatcttttttattgtgggcatttacagctataaatttccctcttagcactgctttttctgcatactataagttttcatatgttatgttttcgtcttaatttatctcaaagtatatctaactttccttctgatttgttctttgacctattgattatttaggagtatgttgttgaatttccacatattcatgaattttccaaatttccttctattaaattctcatttcattccatacagtctgataaacccactttgtttggtttcaaactttaaaaaatatatcggtgtttgttttctatgccataaacatgtgacttatcctggaaaatgctgtgtatttactttagaagaatgtgtattctgtcacttgagtccaggaggcagaagttgcaatgagccaatatcacattactgcactccaacctgggcgacagacccaagagttcgtctcaaaaaaaaaaaaaaaaaaaagagagagacaatgtgtattctacttggggtggagtctcctatagatgtctattagtttctaggattgttcaagccttcttttttcttgctcatcttctatttagatttgtatgttcattatcaaaagtgtagtgttgaagatgccaactgttattgttgaactgtctatttctcctgcaattctgtgagtttttgctttatgtatcttggggctgtattgttaggtgcacatatgttgataactgttatatcttcttattgaattgacccgtttttcattatatgatgcacttttctttcatgacagctgtgtctcagtagcactgtttttacaaaatactttagcatttacatttaaagttttttattgcctaatatttaatacaaaataaaatacacaacatggtaaattttgaagcttaataataaaataaatatctatgaacctgtaataccataataatgagaatataaacattttattattctgtgttgctctcttatcctatctgcttgactcctcccagaggtaactactaatgtgaattttgggtttaatcatctcttgctttttaaaaaatagttatatagtctatttatctttaacagtatatttagtttggcctggttataaaatttatacaaaggaacttacaccatatgcattctctggcttatttcacccagtattatattatttgagattcatacatatgttggtgttggtgtgtgtacttatagtttgctcatgttcattgatttgaagcattctatttaaatgtattataatttatttatccatcctactagtgatgggtatttgagttatttcaagtttatttatttgctgttaggaatactgatccaatgaagtttttttcttttctctttttttctttgtatcattttatctttctttctttttttctttttttttttttctatgacagggttttgctttgtcatcctggccagagtgcagtggcacaatcacagctcactgcaacctcgacctcctgggctcaagtgattctcccacctcagcctgctgagtagctgggactacaggtgggcgccactacacctggcttatttttagtttttgtagagacaaggcctccctatgttgctcaggctggtctcaaactcctaagctcaaggcgatcctcctgccatggcctcccaaagtgctgggattacagacatgagccactgtgcccagcgtgatccaatgaacttctttgattatgtataaattctcttagttcatatgttcaagaattactctgaggctacactactacaacagtagccactagccatacatcacgacttacatttaaattttatttgatttaaatgaaattttaaaagttagttatttatctcttttatttgtgcttaacagcccacatatgacagtggacatagaggacaacgcagatatagaacatttcttttatcacagtaagttctttggataacactgctctagaacaatactttctaaaatgtgtcccatgaatcacagtggtgatccgtaagctgtcactggtctgcaacaaaataagtacaaatatggagactttttagaacattttatggcaacttcacgttgctgcaacatccaagtacatgatcacttttacagtcattttagaaatttagtattttagaatttagtaattcattttcattgtattttacataagtattaattagcaaaagattagaaagaaagaaaaacaagagtttgctcacagtgaatactttgagaaacactacccttgggtatgtttaggtggaattgcaagatcacagtgtatgcttatgttcaactttattggataaattcactacgttttccaaaattattgtgtcaatattatattcccaccatcagagtatgagagtttccattgttttgctgtttctctgtccctggcttttgtgtccctcattttagatttaaattttgccaggtgatggatgtgaaatggcatcttataattttaatttacagttccccaattgctaatgagataaatatatttttatatgtatataatgcattcatgattctactttagattcatagggattctttttatgttctgatactgatctgcttcttaagtgtgttgctaatgtcttctccaaatttgtgatttgtgttgtctttgataaatagaaatagttaattttaacttagtagaaattttcttatttttgtatgtgtgtgtgcgtgtattgtgtttaaggtctcctagaattcttttttgtctgtttaagttttaaagctttatctttcacatttaggtctttatacccatctgcaccttgattaaatttccgttcagggtttgggataaggatctaattatttttgccttctttgattaacaatcccttcactgcttattgaataggtttttcttttttttttttttctttttttattttgagacagagtcttgctctgtcttccaggctggagtgcaggagtgcagtggtgccatcgctccctgcaacctccgcctcccgggttcaagcgattctcctgcctcagccttctgagtaactgggactacatgcgcgtgccaccacgctcggctaattttttgtatttttagtagagatggggtttcactgtgttatccaggatggtctcgatctccagacctcatgacccgcccgcctcggccttccaaagtgctgggattacagtcgtgtgccaccgcgcttggccgtttattgaataggtttttctttaccattgattttcagtgtctccttggtcttataattgtatttccatatgtgtatgggtcagcttctgaactcactattgtgttgcattggtgaagtagttctgaatcttcccttaattgctgtaagtttagataagtcttggtagttgataatgtaagacatgtcacatagtactctgttagaaatttcataatcagtttggcatgttctataagaaatcttgtggggattttgatggaattgatctaattattataatttaattttatgtccaagaccatggaatacctctccttatattttactctactttaacgtctctcaaagttttgaaatcttccctgtaactttcttatgtgtagtcttggtactttaaaattcattttctacctcttgcttatataaagaaatgcagttgtcttttgtacatttttttatatatttgtttagaaagcttactaaacattctttttaaatctgataacatatttgtggattcttgggtatttttaaaagagatgatcattctcagcaaataataatgcttttgtttgttcttttccaaaccttatgccttttatttcttcttttgctttttgtgggctagaatctacagtgctgataatgagcattttcttgtaatgttgccagtcataaaaggaatacgttccaggtgttacctttaattattactctttttttcttgtggatgccttttattatatttagacagctcaaatttttgtataaaagtttatatcacgcacaaatattgagttatattaaatgtgtttattgagatgataactgtatagttttttctcttttaatctgttaatgcagtgaattatatttatatgatttcctaaatttaaccaaaacagactttgtcatgttatcttttttatactttctggattagtttacagatgtttagttttggcattttgcatttctgtttaggaagtgagattggcctgtaattgccctttttaaaaaatgagtccatacgttttttctattctctggaagttttgtataagattagaattgtgtttcttgaatgcatagtgaaattcatctataacctattaaggttgctttttgtgtgtgtgagagcatttttaacttttgatgtaattttttttttagttgtcaaaggattatttagagtctcagtttattctttagataatacattgtatttttctacgaattcatctaagtcatctgtgttttcacattcattgacataaagttcttaatattctcttatttgtttaatgtatgcattatttgttgtttcattttaaatatttaatatttttatttatgcttctcttgttctcgaataaccctgtaataagattagcaattttattaatctttttgaaaaggaaccagttttttgtattactgttattttctattgtgtgctatttactattccatttatttttgtaactgtcttttctgccttctacattttaattttgctttattcattatgtattctgctgacttttaacttttaaatttatatactttctcattaattttcagccttttatctttttaaactttaagtacttacggccattaattatcctttaagtactgctttagctatatttcacaggctttgttatataaggtttttgttttttttagtaagtgtcttctaatttctattgtgatttttttttcagtgactcctgagttttttagaagtgtttttgccccaagcctgtgaggatatctttttttattattgatttctatgtacatttaatggcattgtggtcatggaatgtggactgtatgaagaccttgttacttaattagtagaaagattataattcttagaaacccatactgcaatactagaataaattttttccaattttaaattcaatgtgctagaaaatcccacaacaatatgctttagggtttgtaatttaaccaaatgaatttgcagtactctcattacttaggtttcttcctttgaatctgagatcttaaagtttagcagctgcatgaagagcatgtccacaaaattcttttcttagttaaaaaaaataaagttagattctaaaaacttactgagttgttgttgttttattgctgctttgtaatttgtttgcttttgttttctgggtcatgcaataagcactagtgtaaatctggttcaagtttattgattttaaagaacagatattaaaatcttcaatgtgattcatagtttattccagaatacattacatcaagaatgatgttttttaccctgtacatttcaatactttaaacatcgcaatgaatactgtttttatagtgctgtttttcaaaatttctcacctccctaccctttacttcatttggggtctgcattttctttgtatttccccttgcccttactttcttcttataatacgtattacatttctgtagcatttaaacttttgatgaatactttcccctggtactatttcttggatactcacagaaaccctacaaattaagtaatgtccatcttttccagatagtgaatccagtactgaaatgttaaattaattgttcaatattccttagctagtaagtgggaagagccagaattcaaacctatctcatcgctttatacttaaattttttttctatcggtcttttttcagtatttgcgattttattaagaaggaagtttagaccatgggtggcttaacatgccctaataggtgaatttttttttggctttccagatggcttttatttatttgcattgcaaatgctttttttttaaaaagagattttctgaggctcttagttgtttactacttaatattctccactgtcatttctctttaatgacttcattaaaaataattgagcaaagtgttataaagtttgattctatctcctaacatatttttccattattgctaactactatgtaggacagaaaaaatgcttgaagtttcctcaaatagattttattatttaattctgtctgactttaaaagatttgcttcaaaaatgtctgttaagcaaaaagtatgcttgaattactaatttaaacacttcctgccagaatgcatttttttgcgtattaaacatggcattccagaagaacatagtggccttatatgagcttggtcagaacttcttttggctatctgaatttgtaaattgtcattggaacacaatgaaagtgttttatgaagtgtatttgatggataagtgagtaaatcaatgaaaagcttgcacatagttttttttacaataactacttacttgaatgtgtacctttgtgatgttgctgatattttagaggtaacaacagaacaaagacttctagatgaagaacactgacaagaactttgtataaattgtttattgtgatatttgcttatattaaaagtcatgtatctatttctgtaatttgcagatagtctaacatcatttataaatatttaactgaagagttggcaatggcttttttaatatgaaaatattttcaaatgtgtgaaagccggttctgacaattaaaaaaaaaagttttctatttagtttctacacatacaataaatatacacacttggtaattttgtactggtaacccgtaaagaattttcctgtcctattgcggttaccgttactgttaagtttgcatacagtaaaacaattttaccttaatgcattagtttattggaaatttactgttagctatgtaaatatactagcataattaaaatgttatttgataatctgaatgtaaatacacttaaaaattacttttcaattaagaaatgtcgaaggaggccgggcgcggtggttcatgcctgtaatcccagcactttgggaggccgaggcgggcggatcacgaggtcaggagatcgagaccatcctggctaacacggagaaaccccgtctctactaaaaatacaaaaaattagccgggcgtgtggcgggcacctgtagtcccagctacttgggaggctgaggcaggagaatggcgtgaacccgggaggcggagcttgcagtgagccaagatcgcgccactgcaccccagcctgggagacagagcgagactccgtctcaaaaaaaaaaaaaagacaaaggaaattcttctagttcctttaaggatttctctagcacaggatcagagaggatcttggttattggtgactggtgagattctgttgggtgtttggaagcttcaaatgcatggagccaccccttaaaaatgtctcactggaggcaggcacggtggcttatgcctgtaatcccagcattttaggaggccgaagcaggtggatggcttgagtatatatacttcgcgagcaccgtgggcaacatagtgaaaccctgtctctacaaaaagtgcaaaaaaaaaaaaaaaaaaaaaaaaaaaaaagccaggcatggtggtgcaggcctatagtcccagatatttgggaggccatggtgggaggattgcttgaacctgtgaggtcaaggctgcgatgagctttgaacacacccattgcactccagcctggatgacagagtgagaccctgtctcaaagaaaaaggaaaagaaaagtctcactggagaggcatactttatatatcttttaattgtatgttttgtaaaaaaaaaaagaacaaattttatcatacattcttgtgacacttgataaattttcaccatgtttccttaccacaatagtgaaggttaattgtatttgtctgcttgcatgttgcatacactgtaaactgattatttcaggacttaactgaggcatggactgttctcacatattccaaaatatagtgacatttttaaacttgaaagatatttacttgtttttagtattcttaagaatgcccagaattttgttacagaattaaacagaagacttcacaggagaattggaaaaagcaattactttcaagtttcctttttttatagtgattgatagggtatgattattttgttctataaatatatttttgccatttctccctaaatgccttactttagtcaaatcatatctatgatttttaccattcttcacagagatatttcagaattagagataattctgctgtttatctcattgcctgaccatttcactatctgttcattggctaaccaaagaggctctatatgtttccagtaagattgttaaaaagttagataggactaattctggtgctgatgctatttatctcttgttttattcttcatattctttctcatacattttcttctccattgtaaaaagttttcccaatcccagaatgactcattttttgaaatagtttttgcggtttaattttgccaaggtatttaaaaatcaaatactaataattattactgattttttatttttttgagtttataatcaaagaggattttattttgatcgttattcctttacaaagtgttcttcccctgtatcataaccctgctttgctgttcgtgatgttaagtctcactgataggtaagattattgtaattatcagtaattggtaatagcattcaaatgatcagtcgctcagtggccatttctttttttcttttagtgtttctctttttaagtccactttatgcttactttagcaaatctaggaaatatttaaaattagaagagtttggcacatttgtctttcctctacccttcccccaactctttccctctacataattgacatcatattgtgcatctagtttttcttactcattgaaaaagggaaatctaccatatcataaatatgttttcatattattaaaaattgtcaaatgtaatattcctttatatgtgtacatcataattagccattcccttaatgttgggccttaggttgtttacagtatttcattattatattacagcagtgagtgtgtgtgtgtgtgtcatctgtgtgtgtaatactttgtcaacatctctatttccaaagactagaattcttgaaaatgaaattcttgaatcagtctatgaaaacttttaaagctattgattcatatcataaacataatttttaagaaaagtgaagttgatttatatatcctagctggcagtatatcacaatatctagactgtatctttagaaagctttagattttctcctctttaaaatctttaattttttcaggtcctcaggattttaaatatttcccatgggttttttttttccgtttttatttccttttgtttgagtaaaatatatattcatgtaccttttctttacatctatagagggcttacttttttattcataaatatgtaaggatgtattttatagtatgcatagtaacattgcattgtcatgatgtctgaaaatattttcccattttgtttacatattagattgaaagcagaattattatagaattgctcaactaattctctttttgttgccatcttaaccttaagatgaatagatgtaaccatatggatatacatacatgtatgtatatacatgtatcattttagctttttttttctgtcagaggaaagctgcaacatactaaagtttgacagtaatccctagaatcttaatttgtaaaaagtaaaaaactacaaggtttctactttcaaaacagttatagtctttactcaaaatgtaaattaataaatgtataaagtttgtaatagtataataatgtataataatagtataaatgaagttgcataacctgcttttaaaatgtgtgtaattttatgtatttgacaacttaagcatgataaacacttaactgtttatattctacaagctcagtgtaatgtaaaaaatttgctaaagtcattttgttttaacttcaagtaaacaatgttttctgaattttttttggcatatgtgtgattactgttacaggtgattaaatatcttgtttgaactttggtttaggaagttttaataattaatagtatttgaatcataaaatcactcctgagtttcattaaccatggtggtatgattctttggatgttatttctcttttctttgccaacatactgttttatggatttctcaggttttactgttgtatttacaactctaaaagtaagaaaaaaatcacactctttttctagaaagtttcttaaatgcatatagtggtattaaccaaatataaatgcagtcacttatatttcttacatagctataaccaccatcctcattaacacaataaagtacaaccaagacgaaaaataattacaaattatcttggagaatgtcaaaatttctcagcacatatttgcggattccttgagatctatgacccagtttgttaaacagttcacttaaccactttatgttttagtattcaaataaaaacattgctaataatgatatctcctcttgcgtactaattaataaagaaaaactacaaatgtttttcaataaagttgaggtacatgttacttttataatttcctttaggagttgtgggtgggttgagtaccaatgcagcttcatcacaatttaagtcattagttttgaatttgtctttcctgtgatttcaggatctttactcatttattgtcttcattttagtataatttgcttttgaaaaacatccaaattttaattgatgcaagaaattgaaataaaataaatggcagggatagaagttggggatcgttagggttctttccagattgtgttactctaatgcaagtgtcagcacactttttctgtaaaaggccagatagtaaatatttaggccttaggaacctggctcaactctgcttttttagtgcaaaagcagccattgacaatacataaatgaatgagcattgctattttccaagaaaacttttttttttttaatacaaaaacaggcagcaggtcttagtttgctgactcctgtgctacacatattttggatgacactgcctatgtgaacaagggctcacttatttatttttttaagtggagatcttaatggcctctctattggtggcctttcccaccactgtacaatttacacgtcctgaaaagcctgttaatataccagttataatattgctgttttcttattttccaatatctaagccctttgacctgtggactctgcccaacctgttcctgagccaaggtatttaataatcctattcttggatggggattaatctgtctttttagtccagtaatcacgtgcctatattgagtccataagtgccaacaagctctagttttctcctaccattgccaccctgtttgctcagattgaagattgataatatgtctaatactagcaaacttgtttctcctgggttctggtgggactatagcttcttacacccaagcagggagtctttatgctcttgctctttcatatatagggtgaatctaaaggaaacatactattcccaccagctgtcttttttctttttttttttttttgagacagagcctcgctctgtcgcccaggctggagtgcagtggcgcgatctcagctcactgcaagctccgcctcccgggttcacgccattctcccgcctagtagctgggaccacaggtgcccgccaccacgcccggctaattttttgtatttttagtagagacggggtttctccgtgttagccaggatggtctcgatctcctgacctcgtgatcccctcgcctcggcctcccaaagtgctgggaccacaggcgtgagccaccgcgcccggcccccaccagctgtctttaagtaccgccactacacaaagattctttccatagtgtgccttctaccagatgagattatctagaaactggtagtagcctggatcaaagctatattcttcttcataaccccttgaatactctaatttggctgctagatacctttctttgaggcaaaccgattctcccagccccaaccctgcctattcccagctattaattattttgcctagggcccatcagtccttacacctgaaatcaatcttctcttactcaagacacaaacaaattaaaggagcaataactttaagataacttcctgaaaaataattggaggctttatattggctcattttcttccccttcattgtttcttactttcttccttacctttcttctttccttcttttatttctttagtaattgatgtatgaaaaacagaataattacaatcttgaccgttctttcttatatatagcccactacttttatattaatgtatttctgataacatacctgagagctgaaattatgtattacagtcacttcctaaaattatggttcctgcttgtgtcctacttctttcaggccccatacaccagtagtcaggggagattcttccctgctttggagtctgatagagatggagttgcacagccagcatccggagataataaatttagaattaccactttctaaaaggaagattaggggtttgatagctgccgactttatccacagtcttaaatatgtaagcccaacctgcttgggtagtactcagggaaaggcagaccatttctgctttcctctggaccatgtatcaagagggacctagcagatcttttttcagtctttgtgatgagcctctcctgtcttcaaatagcctggtattttccagcgttgttaaggtaggagggggaggaacgttttgtgagaacagctttaagattggaggaggctggaccagtagacctgtgtgaaccataggttcagttaagagagcaaacccatgagtttgtgagatgcttctgtgttctcctagcttgtgagcatgctctgttgtgtggcggaaaccagactatttcctttaacagtaacagctcagaggcagtattatgagcatttgaaatcatcattcaacaaaatatgtcaaaaaaatcaaactcagaaaaggaaattaatataggatatcatagtttaatgaaagatcatatgagttgcttcaaagttgaatgtgttgaagttaatgactgcctatcaggtaaaccatagatgacatggaaagtagggaataggaacatcacaaaataaaatgctgaagtttgatattctgtgaattatagacttttcagtaggaaacacttaaactctgagccttatgtgaactttcttaaagataggaagattatttatgttcattgcctggaatatatacaaaacaaagctaaaaagatgaactcagcatttagttgatgtgtagttaataagacatatctgtaatttgtatgttccaaaattaagcttatgctattttaaggtttcgggttgaggaggagacaagggacatttctagctttattttcactgggtagatttataagcattaattttaaatgccattgttgggccaggcacggtggtttccacctgtaatcccagcacttaaggaggcaaagggaggaggatcaagacaagcctgggcaatattatagtgagacttcatgtctccaaaaattttttttaaaaaaatgagccgagcatggtgttgtgcgcctgtcatcgcagctacttggaaggctgaggtgggaggatcccttgagcccaggaggcggaggttgtagtgagctgagatcacaccactacactccaaatccagcctgggtgacaaagcaagaccctgtctcagtcagtcagtcaatcaatcaataataaatgtataccattgttttactaggtaaatattttatatttatctcctgatgaagcctcattttttcttacttcctcactatagtatttagtgttttcttcagcagtactaaactatatttagatctaccgcatataccatttttttcttttttttttttttttgttgagacagagtctcgctgtgtcacccaggctggagtgcaatggcataatctcagctcactgcaacctccacctcccagtttttcctgtctcagcctcctgaatagctgggagtataggtgcacgccaccatgcccggctaattttttgtattttaacagagatggattttcactgtgttgcctagcctggtcttgaactcctgagctcaggcaatccacctgccttggcctcccaaagtgctgggattataggcaagagccactgtgcccagctaccatgtttttttcacctcagcacctttgctcaagctctttcttcaatgcagaatgtacttcatttacctgcgtttgtctcattctaacttaagacttggcctagacatcctgtcagaaagacttcttttctcattctttagtgcacccacccaattttgtactctctgtcattgtattagaattttgagagaacacctggaaagcaaaagtgatgttcccagtacctaccacagagcatggcacatagagatattcagtaagtatttgttgaactgagtgtagatttaaggttagctatgtccattctggttaatgctaagaaacactaattgatgttgataaaagttttggttatgtaggtaatagctgtgcaaaatagaatgcaaaagtacagtctctgaatgttcatcaattcagcagttctattgaacacccactctgaaccacacgctatattagacattgaaatgtctatgatctttaaatgtgtctacatcaaagaaccattttgaactccaattaacagccactcagcaattgttagtgacaataataactacgatatttttgtcataattgattttctttacaaattatcgttagacatagagcaagctaaacaaaactttaagattttagtaaacattttatttgccaagacataaaattttcttaagttctgatacctctaaagctgaagaggtaaatctgtattttatagattcattctagatgaattatttaaataaaatagtctaggacctcactctacttgcttacaaaataaaaacaatacatttagatctatttttattaaactgctacctagaattaaagcaagtagaaataagatgttgttcagagttacaagaaaattttcttcgattcatttcccttgtcttacattatccccagcctcctattctcaccctaccctcagccccatcccctaagctggcttctaacatctcatagtaactgaatggtcattcttacctcaactcttaaccagtgctataagaaagtatattgccctgtgtgggcaaaagttttaacaaactcttttccttcagcatgagaatttgaccttcttttaactctagctctgtttccttggtaatctgataagggtagtatgtcaactgtgttaatagacaacattgcttatggtagaaataacccctaattggtaagcttcatctgaactggtagcactacaaacacctggcaggaagccatatctttgggtctctctgtatgtggtgacttataagtggacatgtcccttgattctggcagctgtggccattgagttgttacaagaaatattggctctggtggggcatgaagcctctaggtcagtgcagctccctcacctgcttgatgtaaatctcaagttgtacctaagctgcgatctaagaggccaggaaaaaaaagctcctagatagctatgtgaaccactacatggaacctgcagagactcctgcagaagaggaatacctgattctgccctactcacatgcattagttcttgtcctgtaatattctgggtggacaggtgctcaggatggcctatggttgtcccgtgaatttgcacattcagttgaacctaaggagacctcttagtgggcattgaagatctgactaccttttgtttcttggatcttactgagagagaaatgtaatgaaagaatggaagcaaagatttttgattggttatttcacagtgatgctgtctctgtgtcatagtacccatatgttctgaatctaagagctcttgtcacacaggattgttgaaggaatacttccagcaggtaacttctgtggcaaaaagtctggtgtggctgtacactacagtatttgtgcattcatcaaatattctcctgatcatgtattgataggttccttttttctgtttttatgttttagagactatcttaagaagtcaggaggtgactggtgataattgtaactaattagcacttagtggatacattatttcactcttcactatattattgttctctgtatcatgttgataagattcttctaattttactaataatttgattcttttgtttaagattggacctttaaggtcatttataaggaagctattcagtccttgattataattttaagtaatgcattataaccaataggtgagagaaaatatcacagttttttaataattgaaaaacacttagactaaaaccagtttttctagtagtacaggattcattcatttaaatttttgtctgtgttacagaaacaatgtgtcttctcttttggaaaattaaaatgtatggatacatgagaaaaaaaattcagaatatctgattcccttactcagagatacccagtgttagcaagcatgttttgcattccaaaccttttgttactctgtgtgtataaatggagagaaaggtgagggggagcaagtaagacagaggagggatgtgtttatttatattatttttgtaatgggatcaaaatgtgcatactgttgtgaatctttttttcacttgatccatcttgaatttatttttatgtcaatacatattcatcaacattgttttaaaatacagaatagaaactaaatggaagtatcataatttatttgatcaatccactattgttggcattcatagtttttttttaatgataggaatctctcttcaacagctcacaataaatgatcatacagctattgcttttttctagatttaacatttatattaaatatcatcttatagtatgctactgtatttagaagctatgtcacaatgctgggtaataaggagtttgtggggaactagagcaggcagtttttgtctatacaagccgctgttaaaccacttttccctgacctttttaatgtcttaattaattaattaattaattaaaatactgagtaaaagcaaaggacaaaggtggactctccctgaacacctctctttacattggcatagcactctactttgagaagcaagattgttaagccattggtgattcttttttaattttttaaagtgatacacaatatttgtacctttttatgggttacaagtggtatttttttacatacatagacagtgtaatgattaagtcagggtattcagtttagccatcatcttgagtagttatcatgtcaatgtgtggggaacatttcaagtcctctcttcaagctattttgaaatatgcaataattgttgttaactgtagtcaccctgttcggctgtggacattggaatgtattccttctatccagctgtatgttaaggcccatttaccagcctctcttcatcctctccattcccccaccacaaacagcctacttagcctctggttactatcattctactctctacctccatgaggtcaacttttttagctcccacatatgactgagagcatgtcatgtttctctttctgttcctggcttacttcacttaacataataacctccagttctatccatgttgctgcaaatgacaggatttcattcttttttatgccaagtagtattttatcattggtgctatgtgatagtagacatttagtgatttgatattggtagcatgtttgctactagtagggcagagagctaatccctactattttttccaaaaatattacaaccattgttaaaacataaatcattaagagagccactataaaaataagtttaaaaaattctcaggcaaaatgaccattttgtttttatcatggtggtaccaagattacttaatagagaaattggtaggatagagggtataaaactctgagggccatatctccagtttatatttcactgttttgtccaaaggtatatgttggaaatccttggttcattgctttgttaaacttcatgccattctgatactacctggcacattttaggtttttagaattatagaaaagcctggcaacttctctagtgtgaaagttgaaaatgcagaaataacattaaacaggatcttaatactattttatttacacaacagtctatttaaaatggaagtgtaaaaattaactataataataccataaattaagcattataccaagttttttgtttttttttttttagatggagtctcgctcttgtcaccaggctagagtgcagtggcacaatctcagctcactgcagcctctgccttctgggttcaagcaatcctcctgcctcagcctcccgagtagctgggattacaggcgcccaccaccatgcccagataatttttgtatttttagtagagacagagtttcaccatgttggccaggctggtttcgaactcctggcctcagatgatccacctgcctcggcctccgaaagtgccggaattacaggtgtgagccaccacacccggccaaattataccaagatttaacaaaataacagacatatattaaaatattaagaatcattttgttcaaagtcaaaaatcactaatacgggcctttttctttctctctgtgtttagatatatctgtatatgtgtgtgtgtgtgtgtgtgtgtgtgtgtgtgtgtgtgtgtgtgtgtatgtgtagatatgggtttatgtatatgtaaatgtgtgaatatttagcaggaagccacaattattgaggcaggtattgtggtaagtcactttatattctcatttaatccttctaataatctagtgaaataactactatttttatccccatttttgagatgagaaaagtgacttctagagagaggaagcaacttgtgcaggattacgcagtcattaaattatagactttggaacttacataagatctctcagtgctttatgatattgtagctaacagatatgctcaatatgtttttacctgttgtagaatccagatcattaaaagaaaagatatttgctctgtgataattcagcattacgtttatcctcttaagttttctccggcttccctctgtctttagaatgcgttctgtgtctaaacttttgaaaaacaaagcccattgcttttgtcctacaaatatttcatagaggatgctacgttggctatctctctttttaagttgaaaatagaataagaatttaacttcacatgagaacataagaataagaatgctctaggttttgtaatcattaagtttagtttttaaaaaatgttcattgtgaatcataatcctaaatttgaaagatcatgtgaagaaaatgttaaaagcttattggacagtacatttaaaaaagtcttgcatgttcagacattttcatcctctagaggaaatcatagctaaatatacgtatctgtacttcttgttttagcctttgtatactagtgtttattcacctagagaattcagtattctaatttgaagataggttctaccctgctcatactattcaatataataatagcacttatcgtcatagatatactggcttgagacttgaaattcaagtgaaaaatacctttgggtaattagactacacaaacttatgtagttacctgaaatctgcatagtaaaaatgaatcatcatttagtttaaaataaatttactaaattataacatctgacacaatgccatccagtaggataacatatttaaaatgtatgggccgaaatgtagactttagtatttataggtaagacttctattatagaaatcatcatcatggtttgctttgtatctaaaaacaaattctctatgtatataagttatatagtgtaaacaaaagtagtagatccttttgtgaattatttaagcttagaattttttttctgggaatagaacatatataccaaccaaaggtttgattcagcggtaaattgaatgattttagatttaatacgacgtgcctcttcagttctttaggcacatgtgaattaattgttgcatgaaaactgaataaagtgacacttgattgcccctgataatgagatccttagtttctgtaagaggctgctgtgttatgaatacatcagatttagttattaactaaaaagtttttttccaaattttcatgtcctaggaaggctagatcaattggatctgactgggggtaatatttcttttcaacagtggtaaatgtttatgaatctttccaataagctttctaaaccacagtgatttggttgagaaatacagatttctggttgtattttgttaatgttctggagtacctatatccagctctaaagtttagctttttaacaaaaaatgatataggagatgaagtgatagacagctggtgggttattcccaaggccttaggcaccctccaccccaccccaccaccatagaactggctgagaatccttagatagaaatatttcaggtttttttgtactgatttaatctaaataacttgcacttcttagaagtgtgagtttctcgctgtgatgtttttctattactgtatgccaaggagatagatcagcttaagacccctactgtggtgatgaagtcaatgtagaagagaaaatgctcaccattgtcttaattctagatttatcatttggggtagggggtagcaggtataggcaatcacacagcccaataaacattttctcctgatgtacaaattaaactcttggagttatgcggtggggatattaatataaggggtggttttgaagttgatgttaaaagtcagtgtcatagtttttcatggatcaaaactgtataaatgattttatcactcttccttccttgctcttacatttaaaagctttgcctcagtggaaacaacttaaatgtctatcagtaggggattatttaactatatatggtacattcttataatggcatactgtataaccattaaaaatgacttctacatacatacaagtaaaagttattaatatttatcaagcacatacacttaatgtgctagacactattctaggaaatgaccatggaatgtctcattgtatctacacaacaaccccatgagagaggtactattgttatccctattttaaagatgatttacttgagattgagaaaaataaatcacccaaggtcacacagctataaagaaatgccaagttatggacctaggcagtctgattctatagcaagtgttactaactactgtgccatatgccataactactatgtggctggtatagaaatgtgcattttttataaatcaacaggtaaaacagcatatcatgtatagcttgatactgtttacataaaattgttgcccctggttattttgggcttataggataccagataatcttttttttttcttttaagattttttttatcagtgaatatttagaatttttctaatataaagatatcaataaaacttttgtattttgtaaacaataagtaaatcactgctcaaactaatttctcctccacttctctcagttaagtgtttcttcctttccctatcaattttggtgctttgacttctatgaagcagcaattatactgcttagtctgcttaccttcagcaacactctaagtgttaaaaggaccttctacatttgtaatttgtttgtatcttatttgtaattcctttggattctttctctttcctttgtaaaactctatcatatttagcttggtgttcattggacttccaataaatattgatgaggtaaaaacaaagtctaatgtgagcattctggtttaacagttttataggttatactatttccttttagaaagagttttggatataaccggaaactagtaccttcaaaggaatagtttgttttttttttgtttttttttttgtttttttttttgagatggagtcttgctctgtcgcccaggctggagtgcagtgtcgccatctcggctcactgcaacctctgccctccccgggttcaagcagttctcctgcctcagcctcttaaatagctgggattacaaggagcctgccattgcgcccagctaatttttgtatttttagtagagacggggtttcaccatcttggccaggctggtcttgaattcctgaccttgtgatccacccacctcggcctcccaaagtgctgggattacaggcgtgagccaccacacccagccaggaatagaattttacatgaggatgtggcagtaatgatttggaaatgatcatatgtggctagaggaatgctgttcttctctttcctccaaactctgttatagtattattcgagggtcttggagaataaagacctcctctagagaggaccaccagagaaaagcatcctctgggtttctgttaagacagaggtgtcaaaaagcatttttgaagacatgaggcatacgggattgtcaattgttaattatgaaatatagcagcagtaatagagatgcagtagaaaagctttgtgggaagagattattggaaagatggctcagggaagaagcagcccagaatagaataaggcaactaaggaagactgtacatgactgtggaagaggggtctacatgtcagagtgtggccaaagatgacagggctgtaagggagaaactgagacttaaatattcagtcagttttatttctttgttttttgataatcagaggcaaaggtaaaaacgtatttactgtttgaaaccagaatgagggtctagaaccctgccaccatatctctttttccttgcctcatttccatcctgtggcccatcttacatcaggcattagcctgggctaagagaaatggaaatagttttcctaaagaagtcatagcatcaagttattaaaacttttttcatccgtaaatatttctgtctgtatatctaaaagataaggactcaattttaaaattactacattatcacacttctaaaaaattagaaatactccttagctatgagcattgcaccagtcagttttcagatttttctgattgtattataagtgacttcttgtgggtctttttttttttttaacagttgtttgtttgaatcaggatctaaataagatccatatgttgcaattggttaatgtattcttaagtgtttctgaatctataggcgtctcactcaggattaataattgattagacttttataagtacagtttctgtaactgtagtgattttaaaaagtaataatttatattgcaagagttaaatataccagtaagatctattctcagtatgggcttaaatataattaaaattccacagcttggaatcgtatccagttttttattcagtgcccacataaatgtattaatgatcaaaataattagtttgcaagaaatcaggagccactagtaattggccaacttattctattgtaaataacgtctgtatagttattttcttaatttgccctaaaatcatggccttagaaagtagtagtatcctgattatccaatgctagttaaagaaaacatatcacaaaaattaaatgtttagagatttttcctactttaccaataggaactaatttgaaaactcaaagtcgtcgttttttgttgttgttgttgttgttttcttttgcagagtgataaagatgtttctgtctttctgctttgtactacagcccaatattggttttaaaaaaggctccatgtagcctgaagaagcaataatgattggtagtatatcagtcaagatgggctatattatgaagtaatgagaaataaccacaaaacctcagtggtttaaaaacaacaaaggtttatttcttgctctccttgcatgtccatcatggtcagcagcatctctttttgtaatagtcacttagggactttgtgtagcagccaccatttcaatcatttctttcatcatgctggaaagaaagacaaaaaaagaggcctcagaggtctgacatctgcaattaaatgttccagcttagaagtcacacattcaatcacaaggaagctgtgaagttagtcttctaggtgccagtgagagaaagaccagctattggtgagcagtacagataactaacagaggttatcattgtaataataggttaagtgataattctattactagcttctgataaatctgttcactcatttattcatttactcagttattcatcaaatatttattaagtaactgctatgtacaagttactgtactagacagtgggaacattgaagtgaataaaacgcatccatccctcttctctaagttctcatagtctagtagaggcaaaccacaagtaattttatattggagattggcaaactattgcctacaggccacatctgccctgcagcttgtttttgtgtgtcccataagctaagaatgtctttcacatttttaaagggtcaggaaaagaaatgaatgaaggggactatgcaacagagactgttaagtggcctgcccacagcctgaaatatttactgtctaatcctgcacagaaaaaagtttgctgacatctgttctataataactgtacttaaatttgaagctcttcaaactaactgctctctagcccattgtcaaaagtcacagaattgtcttgtaagctccacatatctcttaatagtgtgccttttgtttaatctgatactttatttcatggaaatataaatcttttcctgtgtctttggaatggcaattttattggcatcttgagttgtcttgttactgggcattgtaggcataggtgactatttgatttgttgcatagttaggtagctgtgagatggccagactcttaaatgtctttatgcagatattaagtaatgacttgttttggaacaggaattatagcaaccaagaggatacctgcttccttagttttagaaatcaaagtcagagaatggaagtacatagaagtagatttttatcttctctactatggactgggtaactctattgaggataattttaaacggagtaagagactgtggttcaaagtgtatagaatgtaaaaacaatatatagtgtcctgctccatatgaagcacttgttgataatacctaaggacgtgtaagaatcactcatggtactcaaattcataatagaggaggagggtattttgattcagactgagaggagtgggattgtataaaacaagtctggattgttctaaagcagtttttgaggaaaaatctgcaaaagatgtgacttttatagcatgagggtagggtgaacaacaggaaggaaatgatgccttgaacttaatacataatatactctcatattgaccatcagagctcaatttatgatagagttgggagactcgatagattaaagaagtctgctaaattccacaccaactttaggatctacttaaggtgtaaggggttctgttatgtggaatgtagaatgtcaatgccaaaaacacctgttcagcaacagtttgtagaattctagatggccttggtaaaggacatttcctatgccgttgagttgcttataggaactagatttttatatttttgggaaaactcctctttcagatctgttgcttcagagcttgtatccttaaccatcattctgaactcttataaggattagaatcaatttccttaacagtgaacaagtgtatttttccaagtgattcctaaggttctttctagttttttggctgattatgacagtcaaaaatgacagccctggctcaggtctgtgactccagtaactctaaccagattctgagcttatatactagatgtcctatgtatccagtgggtgatcatttacttgtatgtcagattgacaaagtattttaccagtcttctatttgtttggagactaccagatacacacaagatatgccagtgcttactatggattacatacagtccacttctcctggctattgactgttaccatatgtaattctgagattatcatttaaaatctccttttccttgtatagtcattttattgttaatttccataaaatgaactgctcgaccacatagtccctgcaaatgtaccattatataacaaggtcgtatgactgactgctctttctacagtagctaaaatagcgtaagtatatattatccattggaacatctaacatatattctttgactctttcagagctgatatctacattacaaataaagtgtttttgttggtaattgtgggcttcttttggttaatgataattgcaaatgtaacttcatgtaactggatatcatagccataaagtaatttggattagccaataatcctgactttatgttggaaaatttaatattgtaaaagaacaagtgtgttaattattttattaattgccccattgttcatggagacaagtgctacagactggaacaaatgaccccatacccaacttttaagacatgcttataggaaaatgtttaatattgttcactcatctccctatggtagtgatcttcttgatgcatagctttatagcttccctgtctttattttgactgtccactgaaatgtatttccaggtcaaaaacattacagttttaaaaacaaaatttaagtggtgaagtgtctaaagttattcattgccacctaagccagtgctaattcataaaatgctgacctgggatctcagcagaattgtgaatagtttgcttctatcttccaatttcaaaatgactgactttgtgtgtttggtctagcctcatccagccttaagcaatggttttcaaatgttttacaggatgatagtagtattggcagcaagctcaatcgatgaggatattgttatagttatagaatcatagtcagttttgataatacaaactagagaaagtgaagcttcatataatcttcttggctagtgagcatatagagaaaatacaccatctatatgtgcctgaaattctcaagttagagaggcagtctctgccagtccactgcatctccatcccacttctacttgtgtctactctcctctcttaaaacttgcttttggcctagtgcggtggctcacatctgtaatcccagcactttgggaggcctaggcgggtggatcacaaggtcaggagtttgagaccagcctgaccaacatggtgaaaccccgtctctactaaatataccaaaattagccaggcatggtggtgcacacctgtaatcccagctactctagaggctgaggtagtagaatagcttaaccccgggaggcggaggttgcagtgagctgagatcgcaccattgcactccagcctaggcgacagagggagactctgtctaaaacaacaacaacaacaacaacaacaacaacaacaacaacaacaacaaaaacttgcttttacccattttccataaagtccagaacctcaaggctagttaatttaataaagtgtgttgtcatgatgttaatagattctaatttatctctatcaggtaaagacattgaataaaatagtgactcttctggaattattaaaacaaaacaaaatcgaaacaaacaagaacaatagaaaacccttggtcttattgtgcaaaggaagtttaggattaaggtgaaggtgatgttggaaggcatggaaataggggcagcaggttaatctttccctcaattacagcaggcaggcattcatgtactgaatgtttgagtcagttttggtacaatggaagcatttctgtctcaatgtattaaaatcataatccttcaataaaattagtgtatatggaaattcattatatttcatatttagtttcagacacatctcctatagatagctagtttccaagtaacttcaaaaaatgatctaggaatattaaattgtaagaaaagcagagtttattaattttattcaacagcaaatttgaagtacatattcatgataatatgaaaacaactttttgctctatatataataatgctttttttaaaaaaaatctggcatccacttttgaaactagcattgtttaggcttaaatcttttagtattggaccctaatttaaagactagttaggtttaaatagacattttatttccattcttaaagtttttagatggcctgggggaaagatgaatacacatcttgctgttttgctgatttgtgaatctactaaatttaaaaggaaataaaattatgaagtagtgaaaaatacataacatacaacctaggtcaaaggtatttgaaattattatatattatgatagcagctatgtaaatatgcaatggtttaaacatttaaaaagtattagaagcaaatgtatggaaattctgagtgattgtattaaggtgctaagataagagccttttttcttctagattctgatttttctgtaatatggttgtacttttatgatgagaagaataaatacgttttaacaaaatgcaatataggaagctaagattaaatacggaaaaccatttgctgcttctaattatggaaaatgtttcaacggcacttatattaaatataaggatatttcatgtacccaaaagactatattttctatagagtatatttcagcataagaaccagctcacagctcagagtgtcagggtgctaggcaatcttcaaaattaatgtccaataaattttaatgtaaaagggtctaaataaatgttaacttgtttattgtctcctccaaacttcttcattccctccaacagtttgaataaagtacaaaggtagggttcttgactgtcttttaaaattgttatatctttagcatttagaacagtttctgggagaaagtaggagcttaatggtatttgttgaatgaatgaataaataacagatgagggagataatgcaattaactcctaattgtatatgcacagatatttccagtataaattgcttatgttctctcaccatctctcctggtttcgactacaatactagagaaatattaaactttttacaaggattaaggataccttgaactagctgagaaagaatatagcaccttggggccaagcaataccagccgtggtaaggagttacatcccatcactcatatcaccctgactgtaataaggaataagagtacagtagatagggaagagaggtaagaggagcatattgtaagttctggtctcctttttttcaaatggaccctgtgttgccgcagaacccatggtgccacccactcagaaggcttcctggatggctctgtgcatgcttaagatgaacgggtctacctttctttgttccttccccattcttattctacatagtacctactgcactgtaacttatggttttgtgggagaaattccaggtatcttagaatacagaatcatataaaagagcagtaactactcatcttgagagtgattgcatttatttcataggtaagtaatcttgcccatagctaatacacttattatttccttttattcacttccgcatgagtctatataattcatttttaggctcttctgaatcattctgcttccattctgtagcatcattctttttggttgctgttttcttccatacttattcctctttgaggaaatacttcgcacttcatatgcaaaaccagaggcatttctcatgaatcctttagattatgagaaagcaaaatttcttttcacaaaccccacacctttccacaattttaggctgaaactgctctctacaagaccttttgaatgcttatacaacagcatcttttatctgaaccctgagtttttcaattcttttcatttattcagtgtcttctgtggtgtcttcccttttccagagcacttatccttctctgtcaagcttctttcaagtatctttattccttttgactgtaacaggttctctgaactcttcaggtctatgccatttgcccagtactaccagcatctcagtctggattattcatcatcttagatggtcatattttctattattcacctttttgtccttctatttcttctctgattggcattagcatattcattcactttttcagttattcatcagatatttactgagtcactaccatgtaccagagctctgctaaatgttggaataagtggtaaaagaaacaaacatggtcctagcccttacagagtttactgtccacttgaggaataaaacagtaggctcacacatctacaactcaattatacctccgtgacttaatctgcatgtgatttcagaggaaggggttttttattatggaactctcctgtttatttgcaactcagaaagtagtaaaataatcttacctttttgctggtggccttggaacaaattcaagatcatctggtttgtttccaacaaaatacgtaggttatcctctataaaagtattattaataattataaacaacatttattaggtatcatctcattgtctttcttgcccttggtaggcatgatctcctatagtccttcaataaacctgtgacaaaactggggcccaaagaggttggcatttgcccaaagtcattcagatactaagtgagagaggggatttaaatccaagtctgtttggtccccgaatctgagctctgttgtcatgtttgccagttttcatcactagtaaaaggattcaaaagctgaatgtctaaaacctgtgttcttcttttgcgcttattaaccatccaatatttctgctatataaaatgttaatgaatcttcattgcaaaaatcaggatatcaataaaatccattcacaaagcaactttatagatggttaattggtttggcttattaatgagattatggcttttgaaatactaggaaatatttactatcaagtggaaaatatttttgcgaaaggattgattacagtttagcgttatttattattttaaatcatagcctctggttaactgaaaccaaggaacatattttctttgttaaaaatgaaatttttaaaaattgagaagataaaaagacatatacatggtccatccaaaatataatatgtatattattttaactttatgctattaacatattttattcaagaataagaaatagaggatcgcaatcaaggtcctatattacaccctgtccttactcaaatagtttcattttttatttatttttattttattttattttatttttgagacggagtcttgctgtgtcatccaggctgtagtgcagtcgcgcgatcttggctcactgcaacctctgcctctcgggttcaagtgattctcctgcctcagcctcctgagtagctgggactacaggcgcacgccaccacgcccgactgatttttgtatttttagtagagatggggtttcactatgttgctgagaatgctgtcgatctcctgacctcatgatccacccacctcggcctcccaaagtgctgggattacaggcatgagccactgcacctggctgaatagttttatttttattctttgtttacatacttgattttaaaagtatttttgtacccttcacattttcaataccagaagacttttcctcctcaagatgtagtttacacaaaaagattgaaaacttgatgtagaaatgctttataaagtctctcgttttgctgtttgcaatacaagacgaactttcacatggtagaacacagatctgtgtagtacttattgcatttaaagtcaaatactaagatcttatgtcaccattaatattgggcagatcacttagccttttccatgcttctgttctcctacggggatgccaccaactccttgtgacatgtctagttagaagatttaatctttacattaggattatattatgtaattctgcccaactagaattaaaaatattctaacatgaaggacatataaaaggtattgtattatgattgacaaaataaaacaattttgacagacctcaggtaatatctattctaattatctgccttttaaaatatagttttaaaaatacttcagtacagtgtttattgatttccaagtcattatttcaatatagatttttcagcattgttacattaatctttccatggaaatttaggccaattgagatctttgcctcagaaacaacacaatatctttaataggttctgcctttttttagggctaagtaattaatctgcagtatgtgaatatcatatacttttggttatttaaatttagctgatttttgcttttctttttttaaaacttttctggacattaaaaagtgcattaccatgaaatttttgggaaccagccattatgtaaatacagggtatcatgtaaaatatttttgtcattttcatttagtgatggctggtttttatcctgaggcatttgcccacattcttaagaaatccactccctaactctgtacctctggctaataatatttccttgttgccatcattttttcttaattcgtaaacaatagaaggtggagtccaatttgaagtcaaacaattccatcaaggcataaatgagttgactccaactactgagatagaaaatgtcaccaaaggggttagtaggaagaagagagaaggaaacacccatgcagattgacccagaaatagcatcccctgtgccacatttgtgttggtctgtgtaaacaacacagcaggttatgcccactgaaacaagagcagaggtgaacaacattgctcaggtccagggagttttgcttgagtgagaggaaacaaggaatggtgggttttgttggcagtccgtataaagcaaggttccccacatcactattattattgttactggtaattgtggttgattgttgctaatttaagattagaaactaatttaaacctcctattttgaacaatgtcattttctaacatccaaaacaagagaaattttgttcttttcccgttactgagactcttgaaacttttacaggaatccttgggcaccagagcaattacttccagtgcttttaaaagttttggagcggccgggcgcggtggctcacgcctgtaatcccagcactttgggaggccaaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacatagcgagactccgtctcaaaaaaaaaaagttttggagctagttagaaagccccaaatttctcttttaatggtaatcatgaaccatccatataaagacactgagagaatggaaatactgatataaatgttcatagtcctttatctataattgtgaatttgcaaaaagatctggaggggaaaatctactgttttatttataagaaaatttacgtaaatgtatacgtagttcacacagcaaaacctgacttgaactaaactcttggtggaagtacagagctcaacttccatgatactgtttatagactttatatttcctatatgtgactattcttatatttcactacagagatgctgatgcgtgtgattctcaagtgctgcctcagtcacttctgggctattgcatcatatatatagtatatgtactatatagcctttctaaaattaaatatatacatggtatatattttatgtttaaaatgtgtttgtgtgtgtgtgtgtgtgtatggtttctgaaactttactggccctgaggatttctagagagagatatttgtataccattagtagtatagtcatgtgactctggagtcacatattttgtaactgttaaccataatagattccatcatcctgaagagacaatacagtcaacctccaatttgcatatcagttttgtcattcagaatctgttttctcatagaattttttttacatggtggttatgcatggtgatattatgtttatttaatgtacataaggcataatattagttctatggaacttatgacagtgttttaatgcaaaatatttttaaagtatacctgtctccttacctgaccctggctcatccccaaacataaacaaacccctaccacagcctttacataatttctgagactcacttatcccactcgtgcaattagagtaggaattggaacaggctcagactactgctagagttacatttacccaacaggatacagaataggggtgggattctttttgtatttcctgtcttcactgttctcttcattcttttcttctttagatcttaggaagtgccctgtctaaatcctttcctctttatgctacccgtagttctggtatttatttggaagtaaatgggactagacttccatctgtctttactacctcgcctttatctttaattttgaattacccatttgacccttctctatctctcaatcttcctttcataaggaaggctaatggtttttgccacaataatgacagaaaagaggaagcaaaaatacatgataggtgattgcagttattaaaaaaaactgaggctagaggtagagggaagatgacagataggagacagggctgacctgcagctcccactcggatgaatagaacagcatatggagactcacaccatggacttttgctccaggaaccaccacaggagtataccagaaaaactgaaagaaatcaccaatcctttgaaagcagcagcaggctgctgcaaattctgtgagactggcaaaaaactctggtgctgtctccaaattgccaccttctggctggaggccaaccaactcaggacattatagcaactcatgaaccaacaaccccgctccaaggaaagagaagacaacagtgaattctgctgcctgcaacatcctggctaaccagtgatcctgagtttgtccatgtgactgtcactgctactataaccagcattcgagaatgctagcacactaaacacttctacaaccaattacagagtctacttcactccctgccacctctaccagagaaggtgctggtatccatggctgggagaccggagtatggattgcatcacaggactctttgcagacattccccagcaccagcccagagtctggtagccccattcagtggctagacccggaagagtgataacaatcactgtagtctggctctcaggaagccccattcctaggacaaaagggagtgcaccatatcaagggattgccccatggtgcaaaagaatctcaacagcagcactctagttccacatttttccactaccatagtctacccaaatgagaaggaatcagaaaagtaattctgataatatgacaaaactaggttctgtaacacccccaaagaccacactagcttgctagcaatggatccaaaccaagaagaaatctctgaattgccagatgaagaattcagaaggttgactattaagctattcaaagagataccagagaaaggtgaaaaccatctgaaataaattttaaaaaaatacaggatatggatgaagaatgctccagagaaatagatatcataacgaaaaaaaaaatacaacttctggaaatgaaagatagacttagagaaatacaaaatgcactggaaatttcaacaatagaatcaaacagaaagaagaacttcacacgttgaagacaaggcttttgaattaacccaatgagacaaaggcaaagaaaaaagaatttaaagacataaatcctccaagaaatttgggattatgttaaatggtcaaacttaagaataattgttattcctgaggaagaagataaatttaaaagtttggaaaatatatctgagggattaattgaggaaaacttccctggcctcactagagatctagacatccaattataagaaattaaaagaacatctgggaaattcatctcaaaaggatcatcacccaagcacacggtcatcaggttatccaaagtcaagacaaaggaaagaatcttaagaactgtgagtctaaagcatcaggtaacctataaatgaaaacctgtcagattaatagcagatttctcagcagaaaccctacaagccacaagggactagggtcctatttttagcctcttcaaacaaaataattaccatccaataatttcatatccagcaaaactaagcttcataaatgaaaaagaaataaagtttttcagacaaacaaatactgagagaatttttcactaccaagtgaacactacaagaaatgctaaaaggagttctaaatcttgaaacagaatatcaaaatgcacaaaaatagaaccttcttaaagcataaatctcacagaacctataaaaaataccacaatgaaaaaaatctaaggtattcaggtgacaactagtatgatgaagtacctcaaatctccatactaacattgaatgcaaatggcctgaatactccacttcaaaggtacagaatggcagaatggataaaactccaccaaccaagtatctgttgtcttcaagagactcacctaatgcataaggactcatataaacttgaggtaaagggtggaaaaaaatattccatgcaaatggaaacaaaaagcaagcaggaatagctgtccttatattagacaaaacagactttaaagtaacaacagtttaaaagacacagacagacattatacaatcataaaaggatcagaccaataggaaaatattataattgtaaagatacgtgcacctaacataggagcctccaaatttataaaataattattactaggcctaagaaataagataaacagcaacacaataatagtggggggacttcagtactccactgagaacacttgacaggtcatcaagacggaatgtcaacaaagaaacaaattacaccctagaaaaaatggacttaacagatatttgcagaacattatacctaacaactgcaaaatagacattcttttcatcaccacatgaaacattctccgtgatagaccatacgatagaccacaaagtaagtctcaataaatttaagaaaataaattatatcaggtaccctctcagaccacagtggaataaaattggaaattaactccaaaaggaacctcaaaaccatacacatacatggaaattaaagaatctgctcctgaatgatctttgggtcaacaatgaaaacaagatggaagtaaaaaattatctgaactgaatgataatagtgacacaacttatcaaaacctctgggacacaggaaaaatggtgctaagaggaaagttcatagcattaaatgcctacatgaaaaactctgaaagagcacaaatagacgatctaaggtcagacctcaaggaagtagagaaacaagaacaaaccaaatccaaacccaacagaagaaaagaaataacaaagatcagagcagaactaaatgaaattgaaacacaaaacaatacaaaagaaaatgaaataaaaagccagttatttgaaaagataaacaaaattgatagaccattaataagattaatgaagaaaagagatgattcaaataagctcaattagaaacaaaatgggagatactacaaacaataccacagatatacaaaagatcattcaagcctactatgaacacctttacacgcacaaaatagaaaatctgaaggagatggataaattcctggaaatatacaagcctcctagattaaatcaggaagaagtagaaactctgaacagaaaaataacaactagcgagattgaaacagtaatttaaaaattggcaacaacaacaaaaaagtccagaaccagatggattcacagctgaattttatcaagcattcaaagaagaattggtaccaattttactgaaaccattccaaaagataaagatagagagaatcttccctaaatcattctatgaagccagtatcatcctaataccaaaaccaggaaaggacataacaaaaaaaagaaaaccataggccaatatctgtaatgaacatagatgcaaaaattctcaacagaatactagcaaaccgaatccaacggcatatcaaaatgataatacaccatgataaagtggggtttcataccagggatgcagggatggtttaacatactgcaagtaaataaatgtgatacgtcacataagctgaattaaaaacaaaaattatatgattatttcaatagatacagaaaaaacatttgacaaaacacagcatttttttatgattaaaatcctcaccaaagacagcatagaagggatatacctcaaagtaataaaagccatgtatgacaaactcacagccaacatcatatggaatggggaaaagttgaaagcattcttcctgacaactggaacaagacaaggatgtccactttcaccacttctattcaacatagtgaatcagacccataacaatcagacaagagaaagaaataaagggcatccaagaggaagtcaaactatcgctgtttgctgatgatatgattatatacctagaaaactctaaagatttttccaaaaagatatgataaatgaattcagtaatgtctcaggattcaaaatcaatgtgcacaagtcagtagcactgctatatgccaacaatgaccaagctgagaactcaacttcttttacaacatctgcaaagaaaataaaatgcttaggaaatctacctaaccaaggtggtgaaaggcctctacaaggaaacaaaacactgctgaaatgaatcgtcaacaatataaacaatggaaacacatcccatactcacagatgggtagaatcaatgttctgaaaatgaccttactgccaaaagtaagctacaaattcagtgcagttcccatcaaaataccatcatcattcttcacagaactagaaaaaacaatcctcaaattcatatagaaccaaaaaagaacccgcatagccaaagcaagactaagcaaaaagaacaaatctagaggcatcacattacctgacttcaaactgtactacaaggctatagttaccaaaacagcatggtactgatatccaaataggcacgtagaccaatagaatagaatagaacacccagaaataaagccatatgcttacagccaactgatcttcaacaaaataaacagaaacataaagtggagaaaggataccctattcaaaaaatcatgctaggataattggcaagccacatttagaagaatgaagctggatccttatctctcaccttatacaaaaatccattcaagacagatcaaagacttaaatataagacctgaaaccataaaaattctagaagataacattggagaaactctactagacattggcttaggcaaagagttgatgaccaagaacccaaaagcaaatgcaacaaaaacaaaaacaaagataaacggatgggacctaattaaactaaaaagtttctgcacagcagaagaagtaattagcagagtaaacagacaacccaagagtatgagaaaatattctgcaactatgcatctgacaaaggactaatatctggaatctacaaggaactcaaacaaatcatcaagaaagaaacagtcccatcaaaaagtcagcaaaggatataaatagacatttcccaaaggaagacatataaatggccaataaacatggaaaaatgctcagcatcacttattatcaggtaaataaatgcaaaccaaaaccatgatgagataccaccttactccagcaaaagtggccataattaaaaaatcaaaaaataacagatgttggcatggatgtggtgaaaaggaaacacttttacactgctggtgggaatgtaaactagtacaaccactgtggaaaacagcgtggagattccttaaagaactaaaagtagaactaccatttgacccggcaatcccaatactgggtatctacctagagggaaataagtcattatacgaaaaagacacttgcacatgcatgtttatctcagcacaatttgcaattgcaaaaataaagaaccagcctaaatgtccatcaaccaacaagtggataaagaaaatgtgatgtgtatgtatataccatggaatactactcagccataaaaaggaatgaaatagtggtatccacagcaacctggatggagtggggaccgttattctaagtgaagtaaccattattctaagtgagtaacattgtgtgttctcacttacaagtgggagctaagctattagaatgcaaatgcataagaataatataatggactttgggtactcaggagtaagggttggggggtgagggataaagactacacattgggtacagtatatactgctcaggtgataggttcaccaaaatctcagaaatctccattaaagaacttttctatgcaaccaaacaccacctgttcccccaaaacttttgaaattaaaaaaaaaaaaaaatttaaacaaaacaaaacaaaaactgaggccaggaagaaagaatattgaagtactgttgccaagaagttagaaaagctagcttcttatctatcatgacctttttttttttgacggagtatcgccctgtcacccaggctggagtgcagtggcgcgatcttggctgactgcaacttctgccttgagggttcaagtgattctcctgtctcagcctctcgcgtaggtgggattacatgccaccacggccagctgatttttgtatttttagtagaacagggtttcaccatgttggtcaggctggtcttgaactcctgacctcaagtgattcacccaccttggcctccgaaagtgttaggattacaggagtgagccaccgcacctggctggtagactgcttttaaactaatatcctagaaactatctatgcaaacaggcaacttacaaagtaatctcataggaggctatgcactatgtcattaatgctgctttgcttaaacactggaaactcctaaggttgtcttcagagactttgctgttattttgaatgttatttgtattatcagtcatttttttgagggttatgtttgatttttacagacagctgtctttgtgaataatgtctgatgaggcaggtttttgattttgtgttttgtttgttagatttttggtcaaaagcaagtaaaaattaaaaatagatttttgtggagctttaaaattcattattatactgggtatagaagagagttcaaagctgttttgaataattgtagccctgtgatcttgtactttaaatgcagcaacatctatttagtatataggtttttatatattgatttaaaatacatgctcattattattcttaactatattagtgtacaagtgtatttaaatattcagatattgacacacatataatatatgttcattgagatgttgaggctatggaaatttcagtgtaaaagaaagaattttcttaaaaacctagcatgtatcagtgtatctttgttgttttgagatgacgaatctatctggaagagcagaagaaactgaattggaataacataattattacaagaactacttattaagtacccacaaaataacaggtaatttctgaatattgtgtatttgttatcatatttcattttcataacaattcttggagaaacttgttgtgttctcttttatagataaagaaactaaggtacagagagctgaagagacatgcccatgatcacatggttataagtggcagagccttccatgcctctgactttttttaactgccctaaatttcttagaccatgcttaatgctactggcactgtacttcaactaactgaatgtatattgttacttgtatgttgagaccttgtttttgtaaatacagttccaacagattaattgtagtgctcattatttgtactctactggcagtattttaaagtgtggtgtattggagctctttccttgcataaaactctacaaattatttactctgacccaaaagacatgattgatttggccaccctcatttataatccaaattgacttgccaattttggacacaccaagcttgtttccacttcagatcatttacacaaattgttccctctgcatgttattactttcagtcattcaatgtctgtttcctgttagatctcagcttgaatgtcaactcctaagagaagttatcatagaagacttgaggaaatcattttcataggtaccctttaagtagtatttaactatagttagtggtatgactatataaagcagttccaaaaaatgaatgaagccagggtgttatctgtattgatattttgaaatattgatgtttttcctatcaggcacagtactaaaatccttattttgtaaaatctggatgagaatgttattaaaaacaaatcacagttaattttctaaaagcctaattaaatatttaagaagaagaaaaataactcatggaatgccagctacaagccaggtacatatagctatacatagagataataggtatagaatctgctgctcagagagtaagataagtgacttgactaagattctgcaggtactttgctgcacaacaggatttaaacctaggtgaatctgatttcaaagctagtgttttttctatactcagtgctgcctcataactccagcgtataaaaggccaggtgaatcatcctgaattattggaagctagcagggtataaataataaatgaataaataaaactgtggcaagtgattttactttgttcactaaatatagttaaaagattgacattcccagcatatgcctaatcacttggaaatgttggatcacttttagtaaatccagattcagcagccctatttaacaggtggaaaaatgttacttgttataaaaatgcttattttcaaattcctaaaagaacacagtgaatattcagataacattttttaaagtacttgaaagtgaacatttttcccttattctgttgcttaataattaaactacttctttgtgatatttctacattagatattataggaaataagaaatataaatctgctcaagaaatgatttatagctgaccacctcatattttgtattattggtttcattatttaatccctgtaatacacatgcaatctgtatgtaagtaaaaagtgtatatgatttacttagtaccaaagtgctatagtaatatagggtgtattttgaagactttatttttaggttcatactgattcctctcttataaaaggtggaaacaattaacaattagatttaacattataaagtattgtagggtgtgcagaataaagcagatgtgcacatttatatagattacttatgagcaatacatatctttatgtataatacctattttaaaattaattaagttattctgagttagttttttttttttaacttttctggctaccttcatcagacttgagaaaaatgctatgaacgagaagcattttgagatgttctgtgtttggaatgttaaatgttaattgggttctctgagctataaagccaccttaaaccatcttatgtggggagaaggaagggaaattgaggtacaattttctcttgaaagagaatatagaaaaagtaattgaaatgctattgaaagttaaaagtgatattattaatttttaattttctaaggacaaatcagttgtccttgtataatcaatgtaatatttacatttttccactttctttttctggtatgcttttgaccatttcaaagcaaattataagaaagcacagaagaaaaaggaaatgacacagactataaacatttaactggaaatttattaagcattctggaaaaagctagcagataagttgctaaaatgacaaagctgtagaatcatacaatagtcttattccttactgcaaagcagcagttctcaactgggagtgattttgtccctccaggcacatttggcaatgtttggaaaaattttgactctccagacctgagtgcttggggtattgctactggcatctagtggatacaggtcatggatgctgctaaacatcttatagtgcacaggacagctctcaataacaaaaaattatccagtccaaaatgtcaacaatgtgaggttaaaaaaccctgccatagaaagtgatgtacatctctcattttgaaaataacagaaatacagagatatgcttgaggccatacaactactgagtgaagtggccaacacttgaacctggatgttctgacaccaagccattgtgctttccttggctctgattgttctgcgaattaaaacctcagttgtctttgaagtattatggggaaaaaaataagagagagaaagaatcattaaaatcagtgctatgtccccatttttgttatgtttcttttaattgtactgtcattggatttatattttgttcaacaatgtcttcttaatacaacacccagaagtaccctttgttttgaaattgatagcttcattaaaaatataatacatattatcaatgtttattcaattcaaggcacctagtgaggcatattatagagatataacaaaatattaagacaaaattcaaactttcaaggaaaccagggtaaaaaagaaaatgaaacctttgaaatatgggggaagttattcaaaatgtaagttgaacagggatagaaacaatcttgcatctgaaattgattgcaggaaactacctaaatgtccaagaatagggaatatttgggtacatgacagtatttctataaaaaggaatattatatacttattataactgatatttatgataaatttataacagcaaaggtatatgtttatgttaagtgaaaaaaataggatacaaagtttacacagctacttttagctaagatgaaaagttatagaaaaatactagaagataaactatttggtgtacagtattacttataaattcaaagtggtggcactactgcattgtactaaacaaggtaagttatattgatccattcattcatacagtgaatagtttctcaacgccttctatgtttcaagcacttgctagatccttgtagtcttattagggaagacaggtagcaacgagtgtgctaagtaataaagaagtcctgtgggagtggaaagctgaagccatatattattagtaagaaccttcataatttatcacacaagttatttgtttttcattcaaataatatccaatttgtattaggtggcccttatccatcttgcagaagcatatggtttcttaggtctccaagaaagaggaagggagagtttgagaatcccacaggatgttttgaagggccagtcttgtaagtggtttgtaaatcagctttatttccccaaccaaactggaagccagcctgggcaatgtagacgaggtacatttgactatttggtaaataccaactctgcctctggtctttaccacagattgaacaattcagaaaaggtttccccagaagccatagcatttaaattgagacctgaaaaataaaaggtagttggctagagcaggaaggaggtaaaaagattctttcaggtaagaatgttgtgccagtgcctagagtaagagaagaatactaccttctaggaacttcatgaacgtttaaaacttgaacattgaatgtaggggcacagcaggcaggggcacagtcctgaaggactttataaactgtgtaaaggtgtttagaaattaattctgatggcagtgggaagtcacttgcaggtttcatgtgtgataaagtttgagtaacgtgaggagagtaatgtgataaagtttgtattttagaacgatcactccagttgcagtgaagaatgtggattggaggagagcaagacagcaggtgggagaccagtttagaagttctagcatcagtccagttaagcaatggtggtggcctgtataaggaatgggaatagaaacagatagattggagaggtatttaagaggtatagttattggaatttagtattcttttggattggcagtagcggaaagggttacatgagagaaagggagtgattggttgagtttggcacatgtttgagttggaaacattcaagatatcaaagtgtttatatccaaatgagacaagagatcctagctaaatatatagatttttcagcatatagatccatgctgtatgctgaaagccatgagagtacatgagtttgcacagggggaatgtgtactgagagaagagggtgtatgacggagcccggtggacagtatttaaggaagaggttattaactttcacattgcatctgaatcacctggtgagcttttcataaatatcatacctaggtttctcactccactaattgcaaatcagttggtctcaggtgtgtgctaaggtattctactgtttcagaagtcccgtggtgattctatgtatagccaagcttgagaaccattgatgtaggggttaggaagaagacgaagagaggccaggtgtggtggctcatgcctgtagtcccagtgctttgggaggtggagactggaggattgcttgaacccaggagttcaagacaggcataggcaacatggcgagaccctgtctctacaataaaataaaataaaaattagccaggcgtggtgggacacacctgtggtcctaggtacttgagaggctgatgcagttggatcgtttgagcccgagaggtcgaggctgcagtgagccatgatcgtgccactgtactccagcctgggtgacagagcaagacctcatctcaaaaagtaaaaataataagacaaagataatacaaaaaagactaatgagaagtggccagtggacaggaggaaaactatctggtatttccaagacaaagaaataaaagttacaaggcgtgagtttttagctgagtcaaaagctgctaatgagtaatgaacttacttataattagtattgaggaatggaagtaaaaacttacaagaattagagaaagtaatcttggaatctttagttagatgtgcattattttatctccaaaaagaaaattgtgatacatcttatagaatacttttgtcaattcatgaatgtgtttatatatttttataataatattgttatttcttatagtttcagacttaattaatgaaaagggaaaaaagcaattagtactgccttgaaatgtaccaagtgcatgatcttttaaatatgggacacttttaatggcagctctggaaaagttcggcaattttgggcattttggaggttatcatgaggttctacagacttgggtaataaaagaaaagtgagagaaagtgtcaggaaagaaaggtaaaatgagctgagggagaactgtctgatatgtaaaattttctagaacccaaatcagaatgttttaccactgaaattcatcagatctgatgcctttggtatattttgggtgttcttaattaggaaggactcatttggaaggatgctaactccagtttatctttgttcagttctaacctactgaatttctgaatatctacttcctccagttttccaaggtctactttttcagtccatgtatctttcagcagggtataggtggaaatgatcattcattcacataaaaatattaatccaattgatatttattgatcatctagcattatttgatgctaggtatgaaatggtaaataaaagtcatgccctcaaggagcttacagcctagtggggtagacagataattaaacaactggaatataatgtgttgagtttaccaaaatctgatagacagggcacccaaatccatcccttagaagtcagttgaatcttctaggagaatgtgacatttcgagtgagacctaagatctttaaggagagtaggaacttgccaagtgaaggtcagagtgagtgttgggtcactggggaggaagaatgtgccccaggctgaaggaagagttggaggagaatgttcttgaagcaagagaaagcaaagagccatgcattgactatgaaaattagatcacattaacttccccttggcttctctaactcagttatcaggtatactcagattttcctataagttcaaacctctatttatagccttcaaataatggcaaataataactgaaccttctttcagttatctcctgctgcataacaaattaccccaaattagtggaatagaatagccattttatatactcacagattgtgggtcagaaattcagacagggcacagtagggatggctttgtctcactttcatgctgttcggggtctcaacttgaggactaggaggctgtgagggctgaaataatctgcaacattgtttattcgtgtgtctagcaattgactgtgtttggctagggagctcagttctccaaaagggcctgtgccatatgttctctcctcataggctagtttatgcttcttcataacatggtgatcagatcccaagaacaaatatgtcaagaggaaggaaactaggtggaagctttatcctttgtatgacctattgtttgccatactcttttggttggagcagtcttaagcctttgcccacattcaagggatgggagcatacaacttacttcccctctcaatgggaggagtgtcagtcacattgttagaagagaatgtgggataggattgattgattgattgattgattggcatctttgtaaagtacaacttgcacactcctcatttcagaatgtttacaaataacaaatctatattccactgcatgggtaggtcactaattatcatttttagttttagcttacctgttggttattcatccataatgtctttgaccttacttttaaggtatattgtaaatttttttgtggccccattctctcttaatatttgcaaaaacggaaagaaacctaaaactggtaataagaaaaattaggtcaggcacagtgacttctagtgctttgggaggctgaggcaggaggatcacttgaggccaggagttcaagaccagcctgggcaacacagtgagaccccatttctaaacgttaaaattagaatttaaaaaaattagccaggcatggtggcacatgcctatattactagtcattcaggtggctgaggcaggaggattgcttgagcccaggagtttgaggttgcagtgagctatgctcactccactgcacttcagcttagatgatagagaaagaccctgtccctaaaagaaaaaaaaatcatatggttccaatggaaatcaaaaatatttttaattaaaatagtgataaaactactgcttatgtgttgtcactttagttgtcacatatatataaatggacttcaatgaacattctttcagaaactatagggatttcaagtagaggacgttcagtactattttatcatctttacaaacatgctagctagttaggacagtgtttttttaacttcatcttattgcactatgctgtctgctagcttcagctggtaatataagcagaatattaaactagaaaaattgtgttctctcagtaaaaataggtgctaaaattaaaaacacaatatattacacttctgtttgttttgtcttttggttggccctgatattcttgtgcatagaattgtttaatatctatgtctgtgtgagatatgtgtgtatgtgtgcatgcatgtatatacatacacacacataggctgaacaatttgaatgtcatacttgcatatttagccataagtctcaaattaatccttttcttgtttctatcttaacccatcactgactctttcgatttaaaatgctccaggaaggcctgaattaaattgaaaggaaattttttaaaactcatatctgttcctgatatcaagttttctgttctaatacatcctatctgcccttctcctgcctcaaaatactgtaagaacaaggttgaactgtaagaagttaaacaggatgttattttcacctactttgtccaaatctcagaatcacagacctgaaaacggctttccaattattttatcaaaacctaagttaagattttacaaaggcggtttcaaaaaaatcaaaaaacaaaaaacctagtttaagaagatggtagtgtccactgtttctgtcaggtgctttacatttgttacctcatttaatcctcacagttcataggagtgtgtgttattctctatgtcacagagaagaaagctaaagctggaagaaatgaagtagcttgtctgttacacagctgtgacatagtgaggttacacagtggtgacatagtgatgactgcagaattctaggccatatctccctaattccaaatactgtgttctttcggtggtatcagtattggttgcttttctgtaatatttctcagttattttgattttgatttcacatttatatgaggagtcagaattaaattgcttattttacacacacacacacacacacagagagagagagagatcacacacacacacacacacacacacacacagagagagagagagagagagagagagagagaggaagagagagagagagagagatccaaatcgtttgtatagggcatttgtaggagcagtagaagacttaggaaagcagaacattggcactaccaggagctcacagtctgttcactggcagatcaaatgttttgtggggaatttttttttagctctttgttatgaccaaaaaagtatacaaaagaaactatgaaaagcataatttattatatgttgtacaagaccagaacattctaactcaccaagaaaagatagatgaaaaaatttaatcagaacatattgaattgtctgtaaaaatatatataacttattctgtaagaaatcagactgttgtcttagaataaattcctcagatatccatgtaagctacatgaggaaaattaaatgtgctttatctgcttgtattatgtttttctttattgttcccaagccaaagccggctccaactacgttgctacttactgactgatccttctgttattttgctttccatcaaagtctttttttctcttcagggtagcatatactctaacactggggttgcatttctaacagatcaaaattaatctgattgaaaacattgcagctttgaaaatattttaatatttactgtagtgtctcctgggtaaatatttctggggccatagaaaagttaagataaaagtagtggtatgagatactctctccgaagctcatcactgatagagggagagccaggactgtggccttagtttagggaacctttccaggaagcaacgcaacctgttgatgttgcgatacatgctacatgctaagtaggcaaattggtgcatatggttttgaaacagcctcagaattcagtgaagtgccctttctttgttctagaccagagatatacccaccttttccatcccatcatagatcccctggattttttcatacagtttctagccatacagtgcatagaaaactcaaataagatggatgtgattttcttaaaaaatttcattatattttagtcaaaaatgaatctctgaagttttatttcaaattaaataaaggtatctgtgccagagctaggagaataatttaaaaatattatataattcatattattaaaacttgttttgggcattattcagtagtaaatttaaattcctactccttaggaaataatttttatagcaagtaccatgcttgaccaaggcagtatggcatatgtgtgcatgatgaggctgtgagaatatgagattttgcagcattaacctgagtaccctactcttccctttcccctgactaactctaatttattcttcaataaacagcttagaagtcatcctttcaggagataatctttgatctcttcatttaagattaggtatatctcccctgggaacatctgtagtgccctgtgcttgcttctgtcatggtacatctgtttattctctccccctcactggaccataagactgtttgttgtaagctgactgtttttcatcttgtatccttagcagctaatcttgtacctgatacttggtaggtactaacatctttgttcatgagatgcatacatgaaaaaaatgaacatgaatagatttacaggtattttgtgaagcacaaattcatagaagatggtgtttgcagaggaaaaggcctgaatttgttacccatgaaacactaaaccagtgtctttattatgcttatttgtcccaacctgcaatattatttttgttcctttggatctttaacctattgcattaaacaaaaaatgattgtcatttaagttaagttttacaactttgtcagtaatgttttaacacccaatcttaacagtttaaaaaatgagtgtttaaaaattttcagcattctcgatttgcagttgtattgttaattttcttcccaaagaatgtggccttagttagtgcatgccagtagcaaattagatttgccttatcatgaaaacttgacttttgggtggactctttggaatatgtctttgtttagagttatgggctttctgatttaaacctaaaattgggtgaataatattttcaatttttgtgacactttcatgtttacaaattgccttcatttgagtattacattaaaaagtaatactcaaataataagctcatgagatatttaatgcttgtgagttaatataataggatattataatatcccattttttgaataaataaatgaagaattatagaggttaaataacatcctaaattgtacagctagtcttggaattttatctgtgggtagatatttactgttgagcccatttctttcatagtattattcagatttttctatttcgtcttgagtcagtttcagtaagctgtatttttctaggaatttgtccatttcatctatgttttcaaatatattggcatgaatttcttttaatattttcttattatctgtttaatgtctgcagcatctatagttatatagttagattataacgtttctttctttttttttttttttgagacagaacctcactctgctgcacaggctagagttgaaaagctcaatctcagttcactgcaacctctgcctcccaggttcaagtgatcctccagccttagcttctcaagtagctgggactacaggcatgtgccatcacactgggctaatttttatatttttagtagagatggggtttcaccatgttggtcaggttggtctcgaactcctgacctcaagtaatctgcccggatcggcctcccagtgtgctgggattgcaggcatgagccaccacgcccggcaagttatatagtttctcatgttagcaatttgtatgtgcctgcctcgtttcttccttgttccttactgctttttgtaaatctctccaaaagtttgtcagttttttaagacttttttcagggcccgcttttagctttcttgtcagtttcattttatttttattttctatatcattaatttatcttattttgattatgtcttttcctttgtttcattttgtttttcttattaaacctattctattcaattctccgattagtaactttcatccttcttttccatatgaagcatttacggctataaaattaaaattctcatcaaatattgcttttgctatatacaacaaaattgtatttagatttttgttttcattttgagatttttagaagtgtgctgcttattttgaaaacaattggattatttctagttatatttttgttaataaattctaacttaatctcattattattagaaaatatggtttatatgtcaattatttgaaaattgttcagttttacttttttgtcctagtacataatcaagttctgcatatgtttcattttggaaacatacttaaaaataatgtgtattctacaactgttgatgcagttttatatatatgtcctttatataaggataattgttgttcagatcttctgtattatggaattgtcttctttacctttcaattactgacctacattaaatatcttccattttggggtgttcgtgtagttcttgttaaattttgctttaggtattttgaagtgatgttattatttacatacaagtaaataaatgaaatcttttatcatttttaatgatactcatatctaggaatgcctttttccttagagtatatttgccttagactaataataatatagtttttgctaatagttttcatgaaaatctttttctactttatactttatgttatgtaattgtctcttgaaaagaaaaacatataactaattttaaaaatccaacctgacaatttttattttttgctgtatcatgatacatttatatttattgtatttgctgttatatttgaatttatttccaccactttgtgtttttattttcctattattttttacttttttctcctttattgccttctttttgtattactcagtattcttattatcatttgttttcccttctactagtttggaattcatgcagtctatttgtaggtggttactcaagaaatggtatcatgtgtacttttcaatttatgtgcatacttttactatctaaccaaacaaaacaaaggccttaatgcagaatatttttattacatttttccaatttatagatttctgttttattcatttaattttgtcattttaacaatgtaataaataattattgttttataacatttatattccttaggtttactcacatatttatcatattttttcttgtcattcctttggcattacagatcttctatctgttattattgtccttttgcctggaaggatatcaacttatcctacttactctatctggtattttagttgttttaagtggtattcatccaataatatcctgtgaggatattagagtagtaaaacctctcaatccttatttatctccaaatgaccttatttcactgtgattcttagaagttattttgagggggcatagaattttaggctgtgaatgaacttcttttagtgtgttgaagatattattttagtgtcttcgggcttctactatttcttttgaaaactcattagtctttcagtcctttgaatgtttccctttgagatcttttacttttccttgattttctgcagtttcactatggtgtgtacagtgtgtattcttttttatttatcccagttgggattcattgggtttcttgactgtttgaattgagtttttttttatcagatatgaaaattatttctcccagtatagcctctaccttctctctttgctagcaatccaacttagatatattttacatcttgtcatgttatttttcatgcctcttcctctcgagactatatttggtataattttttatttctcctttccagttttctaattctcttttcagctatattgaagttgctgtttaacttattcattgacttttttgctttaattatcatgctttgcatttttagaaatttttttttgagttcatggttatttttgcattatttcttgaaatatatgaaacagttatattgtatgtatagtgtgtagtaattctaatacctccatcttcttaggattgattctgtcacatatttttgtttgtatgttttacatataatgtcttatttttaaatgaatttaaatgattttttatatcatgaactactcatttttttaactttacatgtgaagagaatgtttctgtttctgttagatgcctgagaacagtattagtacaatactattaatgtaggatcactttaaattgttagcttgaggttttgtggatcaaatgagtagtgaggattcaaactacagacttcaatgaaggctctcttgtggttacaaattctcagagaagatttatatttcctctcccccgagttccaaacttctgtacagccaattttccttgcatttccttagggaaaagggttgggggtgggtgggaaagtgagtactgtgtcatagtgctttaaaagcatagtctctagacacagagtatcagaatttgcattttggatctaatacaaattaatactaatctaatactaattaatactaatttaccatgagcaaattatttaacctttctgtgcttcactgtcttgacctctaaggtgaggattataatggtaccttttttataatttttgtgaagattaaacgagttgatatctttgacacactgaaaatgcggtaagctctataaatgtttgctactgttattatgatcaatgtggtgtgtctagtttatgcttacactaagtagccttttgtggtcccagcattatggatggtcggctattgggttgtcccaccttctgaagcaagaaaaaaagaaaaaaaaaaaaaagctaacgctcaagttcagctgattcagcaaatattctcaaggtgaaaaacgatttaagtgcttgccgtaccactttcagtaccagtcttaacttaatcttgtcctcagcatttctttttttgctagctcctgggtacatttaagagtttttgtttgtttgtttgttttactctatctggtattttaattgttttaagtggtactcatgttacaggacatagaagtctatcatacagcttgtaaatgccaaaagtaaggctaaaatcccaaccgattatgaacatgtgcttcaaaaaatagctggacaaagaacatatgtagacacttcctaaagaagaaatgttgcatgggcattacatttgcaaagtcactggtaataccaaaacaataccattttcttatcaaattagggaaaaaaggatggaagggatggagggagggaaacagaatttgaaacccattattgaacattcaagaattcaaatgccttcgtatcttttactaacaagaatgctaattgcaatagctcctatgcaaagcagtttggcaatgtatgtccaaattgttaacatacttatatttggccaggtgtggtgactcatgcctataatctcagcactttgggaggctgaggtgggaggatcacttgaggccaggaggtggaggctgccgtgagccatgtttgcaccgctgtaccctagcctgggcaacagagtgagactctgtctcaaagagaaaaaaaattatatttgtgacatagatttcaaatctaagaatttataaaaatagataatgtgcaaagctttagcaacaatatggtcattgcatcactttatagaaaattagaattttggaaacataattatttcatcataagagaatgggttgatttgactattaaatagccatgatatatagcaattttaaaagatgtctttgaaggataggtatgccatggaagaaagtgcatgataatttgtctactagaaaaagagatgattgcaaatgaaaatatacaaatgatcaaaaattttttaaaagccacgattatatataaccataattaaagagttaaaagtatccaagctcatcaaattgtgtacatttaaaatatgcagttttgtgtatatcagttataactcaataaagctgtaggtttttgtttaaatggttacaagtaacacctcttgggaaagtggcttgggatgattttcaaaacattctcattttgcttatttgtattttctacaatgatctgaacattattaaaaatagataacataccatttaataaattcctcaataagttatatggttaaaattattttgtatctatattttataatctgccactttcttggcatgttctaagtacttttccatgtttcttcatggttttggaattatcccccgatgaccacatcatattctatttcttaaagtactaaagttaatatattttcaccattggtgtaaatatttactttgttgtcatttactatgaatagcatatcaattaaaataattctgaagataatagtaacagttacaatttactaagtgcctttttgttgctccacaaaagttatcacatttaattcttggaataattctatgagttagatattattagcctcttattaaaaatggtgacactgagattcaaagatgcaagtgattgattagagctagtgagacgttgagccagaattcagtctaggtttgtcttattgtttcttgatttgtctaaatcttttctggtagtatttctaaaactgttttgtgattgttgacaggaaatgtggtcaggaatgaaagttagtttgcattaattctcttttcaggttcttatctgtatttccaaatgtttaagacttgtcttttcctttagagtattgttattaagactgatacctttcagattctcatcttgtgcatcagagctcccctgttgaatctctagaagcttttaagatctttttccttagtgttgtattctttcttaatgatacaccttcttttttctattttcatcctttggcctggaaattaagtaaacttcttccatttgggaattgttcctgtttgtttttttttaatatactttcttgtcttctcattttgtttgtggtgttgttgctgcaggatcgttttttagctctcatcttatttggatgctggtcctctcaggctggtcctctaattgtcttacctttttcttttttttcctatggttgatttctctattgttttagttctaccctgtaagagacttctttagctttgtcttctaaccctctttttataaatttatgctatttttatcatttctcatgaatctttcttgttctctgagtttcatttctatagcttctgattcttgtttcctggatacaacagtttcttatttctatgaggtttttattttaaaatttttttgaagtttcttctgttctccaaatttaatcgggggatattttggcttctgttttcaattagttcattattttttaatgtaaggacatgctcaaaaactgaggagacatgtccaaaggacacagaagctagtttaaaggggattccctctggaatatacttactaattaaaaaggaaaaggtacctttaaaatagagaaatctggcagatattgtcttagccagaagactaaatttcacagcaccaataaagcacagcctgatatcctgtgccttcaactgtggtaaactccagaaggaaaagatgccacttttgtttctgccaataatgtttagcctaagtctaaccacggggaatttaccagacacattcaaactgaggaacagtctgcaaaactactgacctgcactcttccaaaatgttagtgatgtgaaaaaccaaacaagattgtagaattgctgtaggtgaaaggagaatgagagtgaattatcctaaattgaaaggaaaaaaaagcaaaaacaacaaaaggttgtctaggacactttgcaggcaaatggaaaaatgcaaatatagattatagattatatcacattaaacataaatgttaaatgtcctgaatttatcattatattatcactattatatgtgagaatatcattgttcttaggagatatctactgaagtatatattttcacagtgtgtgcaactaattatcaaatggttcagcaaaaattatagtatatatacagatacacagaggtcccactttgtctgtgggggtaagttccaaggtcccagtggatgcctgaaaccactgatagttccaaaccctatatatactatgtttttttctatatgtacatacctataagtttaatttataaattagagacacagattaacacaaataattaacagtaaaatagaacaattataacaatatgctgttataaaagttatatgaatgtggtctatctctctcaaaatattttattgaaccatactcacctatttttgggctgcagttgactgcaggaaactgaaaccatggaaaaggagcaacaactgtacatatacacaaacacatacccagaaataagggaaggcaaatgtgactagagcctagaaattgcttaaacgagatgaaaagtaaatgttctgtgggaatactgttattggaacttttcttaggtttgaaatttttcaaagaatttatagttctcctagcctatataagaaattatgtgaatatgtgtttgtgtacgcacacatgcatttttgagaacatttagggtatttactaatatcctatttcccaaggaatctcctcagcatatgtacattttattagtagttctgctctgtcataaatatcctaaactaaaatgttctgttcttctctataaaattataccatttataaggtttcttgaaatgttttcctaaaatggcctaacaaacctttgtaccaaatactttatacttggtgcaaaacgaacgtctttatgaatttttaacactttgcaaagtaacataagcatgaggaattatcacatgagcctctttgcagttcatggtttacagtacttaatacaaatagtcttaggtgctatttcttctcccaacaaatttagttttaaatgcttattgttgaatcattatttcatttgttacccaattatacttacattttatttaaatctaattcccaccatattctgttaatggcttgtccatctcatttggtctactatggtgctgaaattggaaaaaaaaaaattcaatctggactcagaaatcccaggagtcctgttctggcacttactacttctaaaactcaggcacctgtttgatcatctaaaaatctcattggccaggcatggtggctcatgcccgtaatcccagtactttgaaaagctgaagaaggaggattgcgtgaagccaggggtttgagtttgagttcgagaccaacttgggcaacaaagtaagaccctgtctcttaaataaataaatcaatgaataaataaatatctcattagaccagttacacagatagcaatcaccagtattacttctactttagcgtacagtgagtcagccatgcccctcattattatgtggcttctacagctattcactgacaagctatggctaaaagcttgctgcttttatcacacaaactcctaatacttgaggtgcagttggggttataaataggtggtatgacctgcagtttcttcttaccctttgtaataattcattctatgatctagtgatcaatgcttcctttttgttcataaagttaaacttttgtgtaacattaggtgcattgtgtttcatctcctgggaatattaccttgtcaaaaactttttttttaacagtacttactctctaacttatactattgatatttttggcatttactgttaacagattccaatcttgctcactaaaatgttgttgacatccccagttttgttggaggactagaagatagaggagcttaaaataacatgtgtagagaaatgatttcattgcttcttctgttccagaggaatgtgagtagtctcaatataccttagtctgttataaacagctaattttcagtatgaaagcagttgttaggaaaagttaatcagtaggacagaatgctgaaactggaaaatgatgtgcccatcactttgcctttcaactccattttttttcctctttgtaaataatctgaattatgtctactaagtggttaacataacacacaagtttgattcttttatatttttaaactaattttctgttacaaagtaatatcttttttagaaaacatagaagaaaaagaggaaataaaaatcacatgcagagataatcattttagccctcattcttccagatttttgagggatttttatttttttaattagtttatgttatattgttacctgattcttttcatcaacagtatattgtgaacatctttctaggtcatttaattttcttttgcactgttattggctgtataatattgtatatttggctgtataatattgtgtagtttttccatgattatttaaacagcttcccattattggttcaaatattttatatactagtgctctgattacattgatgaaataaatctttggacacaatttcttttgaataaaaaatacagttgctaggtaaagagtattcccatggccaggcatggtggctcacacctgtaatcccagcacttttgggaggccaaggcaggcgggatcacaaggtcaggagttggagaccagcctggccaacgtggtgaaagtccgtctctactaaaaatacagaaattagccaggtgtggtggtgtgcgcctgtaatctccgcttctcgggaggctgaggcaggagaatcacttgatcctgggaggcagaggttgcagtgagctgagattgcaccattgcactccagcctgggcaatagagtgagagtccatctcaaaaaaaaaccagagtattccaattttaaaatttttcatccatattgctgaactactttctcttaaggactctataccaaaatggtttaatttaattgttagagaaaaccagtaaggggtgtggctggtttaaatactgtctgagaattccacataacctctcagcatgctgaaaaattgttggttaaaggtctggacgtgagaataagttacttactgtgtgctgtcattagaaataacatattaggaattaccagtataaactgaaaggaatacttatgtaacagcacaggatattttaccaatatataaaagctatgagctataagataggtttgattaatgtagtttccccttcttttttcttaaattggaaatgtctttattgctgattctaataacgaaaataatgtgtacattgaaaaaaaaagtctactagtatacagagaataaaaattcctacctgtaacagtactccttatagataactactgaagtttgtgtgtatgtatatatgtatatgcatatgtataaagtatctgcatatacatacatatatacaattatgtatatttaattttttaaatttatgaaagtgggatcatactctaatcgttctgtacaagttgctttttaaatatctatcaatatactggtaacatcttgtcagattactacatatagatttatttcctatagataatcatttagatcatttttcttttttctttgttacaaataatgggtgtattgattatcatatacagacatctgtgtgctttattattattttcacaaaataaatatttctgcaatagtggaattgttattggtgagcagtgataagactctgagctctgctaagagagcttgcatcccagccttcgccactgacatgctgtgtaatttcgacaagctaattaacctcattataaaattgatatgattcttgaagccactttacagaatcgttgagaattctgcattctctattaacaagaaaatgcatgtaaggtatttagtatgggtacctggcacagaagaagtactaaaatattccctattgttaggaatttcctcctttagcgaattttctattttttctttcatttttcttttggatagtttatgttttttattgattataggagaattttgcatactaagaatagttactattttgtgagctatacatatttttcctaatttatcatatcttttgctgcatttacattttatattttcatttactcaaatgtgtcagtcttctatggttttttgcctttgtgtcatgttaacaaagaacatctctactgcagtattataaaatatctttctgtattctgttccagagatcttatcatttttattttttacatttattcattcatttgagacagggtcttactgtcacctaggctggagtgcaatggcatgatcatggctcactgcaaccttgacctccccaggctcaggtgatcctcctacctcagcctcccaagtagctgggactgcaagtgcatgccaccacgcccagctaacttttgtattttttttagaggtggggttttgccatgttgaccaggctggtctcaaactcctaggctcaagccatccgcctgcctcaacctcccaaattgctgagattacaggcatgaaccactgcacctggccccattttctacatttaaatatttacgtttacctacatgtttttttaatgtggctagtactgttccttccccccaccaagagacatattggaaatatagagttctttataggttatcaccgtgactgagaagtcactactggtattcattgctcagaagccagagatgtctgccagagtcctgtagtgcaggggattgtccctcaacaaagaattcctgagtccaacatgacgttgaaatgtcctgccagacctcagaatcttactattgctttctgccaacaacaaacatgtgaaaactaagcatctaagaattctaagtaacaaacaatgggattcatctgttgcttctcagattaactgagcttaaaaataattatacctcaggatgtggaggaattctgaatttcatgtaccagggtggacgtgtaggttagttcaactctttttggttgttttattattgattcctccttttctttagtagtatagttctgctttattgacacaattcctctccatataactgaaaacaaagttagaaaatttcagtcaccattcctgtttcttgcagtatctctcttcattgaataccatttatactgattgctcacattgatctttctcttcttagctgctgattctacttttatatccagtattccttattcatgtaggtctccactaatagtattgtttgctttcttgcccttctgcagcacataggtaagtctgattgcaggggttccctggaaggagtgggctagggaacaatggttttaactactgattaagtgtatgatgaactggtagaatggaagttcattccttttctatacattaaggtagatcagtcattccttgttattttataccttttggtttaatatagataatgtacagtaatttgagtttatagccttctggtagtaaaagtttatttaaaaacagtattaaaaggttgataaagatataactaacaaataattttccataataccatttttctcagtgtttttttaaaagcaattacccataagagaagctgaaaaaaggcatctctagaatgtggaagcatctttagagattatgacgaaaagttagatagctatagcttttatagaatttcaataacaagcacagtaatagatctcttatagttctttcttctttcctttttcaataaaaaaaaaaaatggagtttcctcagaggactaagacatgtgtagcccaaatttatagccttttggaaattatgttttctctaacaatagaacttacaatatttagaataatgaatgaattacatcaccttaaataatttcccacatctcatttttctctgctagatcttgcatagatattgtatagaaagcagttgtttgtagatgccagtccaggacatacctatatatttttttaagccagatgaaaaaataggtaaagttaatatccttttaaaataattagactaaccagagcacatacctggatggagaaaaaatttgcctgtgtatataagagaacaagacagctgccatctccatcatcaaaattatcattattatgtttattaagtatttaactgcatggcagacaataatctatatgccttcaatggattatctcatttaattcttgtaagaatccaatatagtacatattattatccccattttgcaaatgtagaaactgagacaaggagatttaggttacttgctcaaggtctgatagctagaataagacctaaactgcctgaattaaaaatgtatgcttatagtatcatcttcagtgaaaaagagtttttgatctgctccagcacatggggtaaaagttttggctgagtcctggaaatctgcactacaaagcaccataaagcatcttgtcctgtgtcttactagagtaggtattaccagtattccactatagcccttaaagaatggtcgccaccattacccagaacttatcacagtgccaagctcatagttggtaagtagtaaatattaacagagaatgagagaatatctgtaatcatgttcccatgaactgactaaaatgatggatgacagagtctcattctaccaaataagttagtgtcaaaatgtgccccccaaattacaaatatgaattaatttgccatattagcttattgctgtaagtcaattatgttattaagaataactattagcctggcacagtggctcatgcatgcagtcccatctacttaggaggctgagattggaggatggcttaagcccaggagtttgagaccagcctgggcaacataaaaaaaaatatatatatatatatagtttaaattaggctggaatggtggtgtacacctctactcccagctactggggaggctcaggcgggagaatctcttaagcccaggagttcaaagttgcagtgagctatgactgtggctctacactccagcctgggtgaaaaaagaaaaaaaaaaactattaaaattcatcattttggcttgtattacccgtcacaaaaactctgtatccattagtgatcactccccattctcctctgaccctactcccagctctaggcaatcactaatctgttgtctttccctaaagttttgcctatccttgacatttcatacaaatggaatcataccatatatggtgatttgtcactgacttttttcatttagcattaaagttttcatggtttatccatgttgtagtatatctcctaacttcagtactttttattgacaaataatattccattgtatggatatataccacattttgttcacccatcagttgatgggcattcgagttgtttccacctttacttttatgagtaatgctgatatgaatattatgtacaagtttttttgtggacatatgttttcacttctctcaggtatatactcattattggaattgttgggtaaatttatatttaacattttgaggaacttctaaagtatttttaaaagcagctgtaccattttacatttcaaaaaacataatgggcattccagtttcttcatgtccttaccaacatttttatctatctttttttattgtcgccattttagtgaatgtgaaatggtatctcgttgttttgattcacatttccctaatgactaatgatatttaacatctttttctgtccttataggccacatttataacttctttggagaaatgtctatttaaatcctttgtgcaatttttaattgaattgtctttttattactgagttttaagtgttatttatgtattttgattacaagttttttaatcctatgtgatttacaaatattttctcttatcctatgggttttcaccttcttgatggtgttctatgcagtacgaaatgtcctagttttgatgaagtcaaatttattatttttttcttcttttacttgtgcttttggtgacatacctaaagagttctttgcctaacctaaggtcacagagattgtttcctgtgttttcttttaagatgttatagttgtagctcttacataaaggtatatgatcattttgagttaatttttatgtatggtgtgaggaagtgatccaatatcattctttttcatgtagctctccagtttacccagcaacatttattgaaggtgattcttctgattgaatgttcttagtacccttgtccaaaaacagttgactgcaaaggcaaggatttacttctgactctctgttccattaatctatatgtctaccctatgccagtaccatcttgtcttgattactatagctttgtaatttgccttttttttttttggagacagggtctcactttgtcacgcatgctcaaacatgctcaaataaagtgacacgaacacaaaagctcactgcagcctcaatgtccagggctcaagccatcctctaatctcagccccctaagtatctgggactacaggcgcacgccaccatgcctggctaatttttatatttctagagatggagttttgccgtattgctcaggctggtctcaaactcctgggcccaggcaatccttttgcgtcggcctcctaaagtgctgagattacagtactccgcacctggagtgtatacattttgaattgtaaagtgtgagttttctaactttgtttctctctttttaagatggttttggttattcctgcatttccatgtgaaattctaatcagcttgtcagttgctgcaaaatcgccagcttgagttttgatagggattgcgttgaatatgtaaatcaattttgggattattgacattttaacaatattaagtcttctaattcagaaatgtaacatgtcttttcatttatttaggttttctttaatgtcataaagaaatgctttgtagttttcacagtgtaagtctaacacttttggttattcataagtattttcttttacatgctattgtaaatggaattattttcttaacttcactgtccaactgtttattgctagtgtgttgacatattgttaactttgtatattggtcttgaatcctgctaccttactgaactcatttattacctctaataggtcttttgttgatttcttaggattttctctgcataaatcatgtcctctgcaaataaagattgatttaattattccttttaaacctggctgtcttctatttctttttcttgcctaattttcttgtctggaaactccagtacaatgtttaatacagacagtgaaagtcttgttcctgatcttagagagaaagcatgtagtgcctcatcaataagcatgatggctatgactttttcatagacgcccttgatcagattgaggaagtttctttctattcctagtttgttggatgtgctgattaagttattgatttaaaaatactcacagcatttttacaatagattcgtcattttatattttagaatccagatcagatggagactaaagtagccaaaatatctttcacctttattaacagcattgtctagtgcatccgttttctagctgtgttaaattggacaactttaacttctgttgacctgagtttcctcatctgtaaaactgggtttgattttagtgcctacctcttaaggttttgtaaagatttaactatttacaagtaaaagatttagagtagcagttgacacttgttagtgctaatataccttggtcgttattaagaatatgcataatttatgcatggattacatccaatatatttttcacatgtatagcctttttacaaaggcatgcctaaaaaaataagattttatttaaagctttatttctaacttttgggttttttttttctttttacaatgatatgcatttctctcagtagtaaaatattcaagcaaacttctctatggctatatatctagcacctacaaaagcaggtaatgtaagattcaagaaaccattattcaattattggaaacttttaaagtccatttggtttgtttttataccttgcctgtttttacagaaaacttcagtttttcaggtcatttttcttttaaaaagccatgcaacatgtctgaaaagcttgagagacatcgtcctggttttgatatgtagttagctaaactgattcctttgagaacctgaatgaatggatatgaaaagcaacacatcttgccatgaggggttagattcattaaggatactctaaaagctgaaaaaactacatttctaggctttcttatccacgtttttaaaaaaattattttgtacttagagaattcctttggatataagttaaaagaaagaaaggagacagatattatattttcttattttctaatgttatgagttagacatataggtctaagaagaaattttaaaaagaaattctttggattctttggagtcaactctcagtttcaacatgttaatttctttacattatggaaacccttgcatatgatttactatcatctgataagacttgcatcctgtttttaaatcattcttttaaaactctagatttaactgacctccgcatttttggtcagaaataaatttttgcacaagcgaccatttgagcacaactcctaatacagaggtaaaataacgtaaagatccagagccctgcaaataattatcacaaaactgttgttaaagcagttgcctttctctttacaccctcactaaatttattgacttttaacattctaattgtctggtatataaaagtttagaaacaatacctgattatagagatttgtggaagtattttggtagaaaagagattgccttaattaaaagaggaatcttaaaaatgagagacacaaatgacatatgagagtgtatcttaatagatggactagagttttcaggtaaagttaaaattattctttgcctctctacttacgaaggcagggaggtacatgatatgttttagaatgcttttcttccaaagttgttaatgtttaaaaatttgatatttgaagaggtagagttacttagaaaattggttatgtcaaacacttcattttctaaaaactgcataaaagaagtattttattttcttaacattttcctcgaggtggcttgacgaaactaacggataccattacccattcaatatgttgactgtcttttgcctatagttagtaaactatgctatgttgcatttaaaatgtccagtaaacagtgaataagcgaataattatgttaaatgcagtggatgtgaaaatagcctttgtaaactgtgaaatgctttatagagttaagtcttggccatttttatcaccttcaaagctacattttattttactttcactgttgccttcttctgtaagggacataggatagtgaatgagaggccatatatgaggccaaatgacttagccaaaggcagagatgactaaggatagacaggctggggtgagcaatgaagaggtgggtggatgtaatgagagctaagaacatgtaactttgtgttctcaccaagtgctgctcttcctatcttttacctccaatcctaatggttttctgaagtctttctcctgtttagtcacatatgtgggcacacaatgagtacttattaaatatttgtgaaattattaaaaactgaagagtttgagctctatcattatgggaaacttttcaaatttttggaaacttttcaaacttttaagttagaaatgtcacatgaacagatatatgtcttaagaaaatgactatgatatgaattgacatgaagagattagaaacataatgtagaaagctattataatccaagtatgggaccttgaaagatggggaaatgttagaaaacaatataccacaatggtggtgtaaatttaacactttttggtgactgttgactgacttgattgagagccttgtaaaaaatatagtcagaggtgattctgaaatttgtagcatgaaagtttatgattgtattaaccaagatgtagaacaagggtcaaagtaagatgggggatggataatataggttgtgttttgaatgtgttctttgtatgtttagtatgtgatatctgcctagaaatgttcaccagacaactggaaatttacctctaatattcatacatgagaggttaggattagtgaacagattctgaatagttatgagttgacactattaaaataggtgaagtccccaagggaggtatctgtgcaggaagaagactgctgagatctaacacttgcagcaacatatgtaaaattgagcagaagagtatccagtaaaggaaattccatagaacacataggaaaacaagaactcagaagagcaaaggatcaaaaaagacaaaggacagattacttcggtggtgatggtaattaataaaaatatctgtagtgatttttttaaaagaaactttaatttcaagaacatctcattgtgttgttaaaaaatcactgcaggtcactgtggctcatacgtgtaatacagcactttgggtggccaaggaaggtggatcacttgagggcaggagttcgagatcagcctggccaacatggcaaaaccctgtctctactaaaaaatacagaaattagccaggtgtggcagcacaagcctgtaatcccagctacttgggagactgaggcacaggaatcacttgaacccaggaggcagaggttgcagtgagccaagatcgcccactgcactccagcctgggtgacagggcaaaactgtcttgaaaaaacaaacaaccaaacaaacacacacacacacaaaaaacaagaaaaccctgaaggttgggcacatttgcttacactgcttgggcccaggagttcaagacctgcctgggcaacacagggagaccttgtctctacaaaaaatctaaaaagttagccgggcatggtagcacatgcctgtggtcccagttactcatgagactgaggtggaaggattgcctgagaccagtaagtcaagattgcagtgagctgtcattgtgctacggaactccagcctgggtgacagagttaaacccattttcaaaaaagaaagaataattactgagggttttaaaagatagaaagtgaaagataagtgtctctctcctaagttgttcctggagtgttaaggttagattttttctgcatatttttaaatccttttacttgcatatatgagcataactgtattttccctatttcaaaatgcaaaattttttgtattttcatatttctgaaatctggagtatcctacaattgatgtatctatttaatttaatggaatttttcagaaagattggtatttaatatgatttgagaatcaaggaatagttatacataaagaataaaaatatatgtacatatatttataatgtatcaaagaaaatatagtaaataagtataagctatatatgatatatatgtaaaaatatatataaaagtgggatcaggattatacatatatatttatttatattgagatatattattctagaacacactttttaaacgtaagatttaattatatctaaaattactgtatttcatcaattctaagacgaactttcttcatattttgacatctctgaactcaggttatatttaatcattccagcatgtagacgtgaggaaaatagttgttattctttctctttgctgtatattattctgtatgaatctttcataatttttttaaccagttctttatttaggagctagggatttttctgtttattatggtttttggcttatgttttctttttgtttttagctttttactattaccaaaaatggtttagtaagcattctttgtctacctcaaatgttgtatttatttcattttatataatgcttacaagctaaattactattaaatatacattatgaaaatggaatcatggttaaaatcatatttttacctttttaaatttattcctcatattaccttagttgactttctaaaagataaatatgatcataacaaacatataattcagtatataaattctgatgatattccctctgctggaaatacccttcccaatttttcactttcccattcatacttcagggctcatctttggtgtcatcttggaagtctatctacaacctctctggtttctccagcacagcctgatggcttcctatgcttaactccttttaatacttatcactgtgtagtgcaaatgccttacttaattttctgtctctcttactaggcttccttgatgtctgggactgtgtagctaacacaagggctatggctgccacttaataggtcaataaatattgaaagaatgaataatgctataaaatgttttgtttctaaatatttttttaaaggtggctatgaaaagttctttgctatgctgaaaaggaaagtaaaaagaaagatttgtagagtcccatgattagcttagaaggaaatgaaaaatacattggtagtataagtacatgctttcttctctaaaaatccctctttaaaggaagcagcaattattaataaaataaagatgtgttcaagagatctgtttactagccagccagtgcatcatggagaattgtaggttaagaagcaggctgggcgcagtggctcacacctgtaatcccaagccctttgggaggccgaggcaggcggatcacctgaggtcaagagtttgagaccggcctggccaatgtggtgaaacctcgtttctactaaaaataaaaaaaaaaaaaaatttagctgggcgtggtggtgtgtgcctctagtcccagctacttggggaggctgaggcaggagaatcgcttgaacccaggaggcagagtttgtagtgagccaagatcgtgccactgtactccatcatgggtgacagagggagactccatctcaaaaaaaaaaaaaaaaaaaagtaggtgtctttacaaaggaaaagttactaaagattttggatgaggaaatacaattttagttattagatggctacatattaccttccagcatttgctgtatatggtaagtgttttctcccaggtgttccccttccatattctccatacacaccaaaagggaaaaacgaagcaatccttgtttatacttatatttttcaggttgtggtatcatatgaattacagtattaagaggaagcccctaatctgggcaatttgaataatagaaataatgacagtaatgccatcttttcccccctggctctttattcttaaaaagcagttgggaatctcttatccaacatgttagatagtagtcatatgtacaacacactgcttacccaaaaaagcatgtcagaatgcacttttattgagagagagaatatgattcatagtatactgatagtcttgaattctccttaaattaaaaatatgtaagatgttttgcaaactttagcaataaattattagtaacaaagtactgttgggttgttttcttcagctttttttctttcttttttttttttttttttagacggagtcttgctctgtctcccaggctggagtgcgtggcgcgatctcggctcactgcaagctccgcctcccgggttcgggcgattctcctgccccagcttcctgagtagctgggactacgggtgcgtgcctggctaattttttgtatttttagtagagacggtgtttcaccgtgttagccaggatggtctcgatctcctgaccttgtggtccgcccacctcggcctcccaattttcttcagcttttatttcaagttctggggtacttgcgcaggatatgcaggttggttacataggtaaacgtgtgccatggtggtttgctggacagatgatcccatcacccaggtattaagcccagcatccattagctattcttcctgatgctctctctccccgcagctcatgacaggccccagtatgtattcttcccactatgtgtccacgtgttctcatcattcatctcccatttataagtgagaacatgtggtatttggttttctgttcctgtattagtttgctgaggataacagcttccagcttcatgcatgtccctgcaaaggacatgatcttcctttctacgcctgcatcgtattccatggtatatatgtaccacattttctttatttagtctatcgttgatgggtatttgggttgattccatgtctttgctattgtggatagtgctccaatgtatatacgcatgcatgtatctttataacagaatgatttaaattcttttgggtatatacccagtaatgggattcctgggtcaaatggtatttctgcttctagatctttgaggaatcacccacactgtctttcacaatggttgaactaatttacactcccaccaacagtgtaaaagtgttcctttttctgcacaatctcactggcatctgttgtttcttgactttttaataatcaccattttgactagtgtgagatggtatctcattgttgttttaatttgcatttctctaatgatcagtgatgatgagctttttttcatacgtgtgttagctgcatgaatgtcttcttttgagaagtgtctgttcatgtcctttgcccactttttaatggggttgtttttttcttgtaaatttgtttaagtttcttgtagactctggatattaaaccttgtcagatggatagattgcaaaagctttctcccattctgtacgttgtctgttcactctgataatagtttcttttgctgtgcagaagctctttagtttaatcagatcccatttgtcaatttttgcttaacacagtgctgttaactccctggttaaaagaccctactttaaaaagcatgtctacatatattactttttatgcatataatatatatgctatacagatatgtattattgatccttataatagccttgtacttttagtagaacaggttgtagcatcctgaacccaatgacaaacagttgtccaaggtcacacattaattagagttggagcaaaaactaagtcttaagtttctttgtgggactgtccttttttgttcataccacatttctatgtcatggactgtaaatgacagcacaaaaaagcaatgcataaatctttatatgcacatttgcatatatacacatatatgcatgttttttgtacttaaaaagcagttggtaatctccaacatgactatatggtagatagtagtcacatgtacaatatatgccttactcaagaaagcatgtcagaatgcatgtatgcatgtgtgtatgcatgtattgccagtgagccactctttaagtgtctgaaaattgctctatcagcaagcatataaggctttacttttgcctccatcttagaaaaaaaaacttagttaaaagtactggatttcatgtgcataaaatgtttctacttattcagtataaaatgacaattcttgtttccttaagaaaatgatctggcatctgattgaatgtttctatcagcataactttgcaaagatctagtgcaaaggtgtgatcgctaagagttgaagctttagtctatttattttaggctagcgatttcaaattgcctttcgtcttttttataaggacctttaaaatactatccaaccccaattttaattattttcacactcccaggaaattaaaagcagcaaagaaccattagcagtcttgatcaagaaaacagaacacaaagatgtctgagggaaacttaaggaacttcttaagcaaaatagtgacccagaccgggtgctgtggctcatgtctgtaatctcaaaactttgggaggcagaggcagtggatcacctgaggtcaggagtttgagactaccgtggccaacatggtgaaaccctgtctctactaaaaaatagaaaaattagccaggcgtggcgatgtgtgcctgtaatctcaactactcgggaggctgaggcaggagtaatcacttgaaccagggaggcggaggttgcagtgagccaagatcacaccactgcactccagactgggcaacagagtgagactccttatcaaaaagaaaaaagaaataaataaaatagtgacccagatatactctatctctaaaaagataggctctgtgaaaatacagctgatacattgtacaaagaaggttgtcactatattgaaagtgccactaagcattaaaacaaaaaacattttattggtagtaagttttaagagtatagcaatttaggaaaatgttgaaaatctggggaagaactattttatatctacttgccattttgtggctttatagtatattaattgataattcagacattacaaatatagttcactgaataagtgaatagacaaaggtagatttggtattcatatttaatttgttattatagaacatgggcctttaattttttaaactttctgtactaatttccatctacacactacttaaacaaaatttattagcattctgaaatttggattacctccctaaataacatcatcaaaatgtttgaattaataaaatttttctgttgttccaaataattgtgattcaaatacagttttcaaatttaagcaatttcatgacatggcagacatttagctgacctctgtaggccttaaaataacttcattatagaaccatgaatgtagaaagtgtctttgaacatttaggaaaataatagcttcaagcccatgcattttgtcctaaaagagaagactataactatcatcattattttgaagaaatgttaatacaaattttaatttaattatttaaataaactttatcttccattttctcctgacagcgctcaatttttcttacatagcagattagaactactgtacttctcatagctgatgcagtatagcaatgaccctgtacatctcagatgcccctagagtatcattcttttatggaatggtacagcaaatgatgaactaggtcactgaaaccatgcaaaattatttttgtatgctgtcctttatgatggatatttctgttcattactatataaacatgtagaaacaagcatgtagagaattttcaccaagtatgaaacatttgtattggatggtctaacaaaatactggctgtgtgatattaaaaaaaaaaaaatgcactctggggatcagaggaacctatctcacagaccggttaaattacaataccaaagaggttcttatgactcctcatcaggggagacatgcctgtgtattaaaacactgtagaaggaaaaaacagtcgtgttaaatatgagtcaccaatcaaaagtcccaaggatggatctgccacattgcaggctttggtttgctatccagctctttctcgtgtagcatactccagagttaacagcagcaggaatttactcacttagtgatggttaatgattctcctgggcaaggttggggagactagctaatatgtaatatatttttaaaaagctcaccaaaggtgattagaatccaaatagtttgggcacttaataagtgaagcttcacttaactgaaaactgcatccatccataacatctcatttcctgataatacgagatgaaagaggagttctttggcataaaatgtagtatacaggttattcaaagggacttacttgttgctgtttttataaaggggagttataggtcaagttatattatcaactaatgcaatgattaattgtccatattctaagatagaaattaatgagggcttactagtttgaaagcacttattttcctgtcttcacaaacattagactatgagggtttttttgtttgtttgctttgttttttagttcagggaatatctcttggtcatctttattttattgttacctagatacgctgtatgacatgtaatgagtggtctataaatcttgaatgaatgaatgaatggcgtttcatcttttcttacacaattttcataagaactagcttgcattatcaaaaaaaataagttattgggggagtttggtggctcatgcctgtaatcctagcactttggggggccgaggtaggaggatcacttgatgccaggagttcaagtccagcctgggcaacataacaagacccccatctcttcaaaaagattaaaaaattagccaggaatggtggcatgcagcttcagtcctagctactcaggaggctgaggcaggaggatgatgagcccaggagttaaagggtgcagtgagctatgattatgctactgtgctccagtctggatgacaaagagcaaaaccctgtttctaaaacagacaaaaagctatattcattttttaagaaataaggaaatttttgtatgcatttagaaaaattatcttaaatattttaaatggtaaatagagtgctatattttatttatctggaaaaatcttaaaagtttttaattccttgatggttatagatgagtgggatgttatcatcttttcagcataatggcttcttcacctaaggggtgtgtgtgttttcatgtgtgtgcttttttgaatgctattcactaataactactttgcatatagtcagcttagagttaaatgtttttgataaatatgattccattattttaaaaagctttgaagtcagacttgagctgcaattctgctcatgtgacctctccaagtttgttttctcactattaaaatgagaataattatgcttactgcatagatctattacaaggcttaaatgagataatctactgagtataatgcctcgcacattgaaagtgtttaataaatagtcaaaactattgttagaggattacaaaaagagagttttatatgaactgtggtagtttttaagggtctgctccttcacatttttatttttctagagaccttcaagtctgctattgaaaaacaggaaaagaaattatatatatacatatatatatatatatatacacatatatatatatatagatgattcataaattatcctctgttgcttttaccttactgtaaacaaaaactctccaggctttcaataggaatgaatcttaagtgaagtacgtccatatggcaattctgaaatgtaaaaatgaactgcttttttaatattgaataagcataaaaatcaaattatgttgcttaaaaaggaatcctcatacatcttttcccatcttgcataacacaaaaatagctaactgctttgcttaaatcatatttggagggtgactaagcatgagacagttcccaaacaaatctttgagaaacttatgcaggagtgaaagtgagatttcagctgtaatcagtctcttaatctaggttagctcaatgagggtaggctggtaaatttttaaattcatcaattaatcatacatcatttttcaagatattttggattttgctgaaatattaaaaattgatgtgatttcttttaaaccacacctggttttgtaggctatagctactatgtacttttgtctttacaggcacatgcatgtattttcataagaatgtttattaatttacataaaatgcattaaacagtgaaaccttatcttaaggctgacttaaaatgtaacatattatatattggtatactaaaatacctaaaaagattttttacctaaaaataatttgtgtaacaaaaacagcatttttattgaaaagtggggatattgatagtattataacagaatgttaattttattaaaaatttacggttcatgtgtcagaacacataatttagagggattatgcaatcacttttaaaggaagccaaaaaatctatctgctgtttcttaggttcaatagtagtttaatttcttaaaagacaatacatatatttttagagaaatctttaatttcctcttggagttgttaaatgccatttaaggcatgttaagatatttggtattgcagtttaccttaataagccttagattcacaaattataccaagccaagaaagttattctcagtagaatattgagatatgaatttgcccttgtttatatccaacttctgatttccatttgtgtaaactttgcaaatttgaagcttctgctttcactttgttttattctttgtttttcttgtcattttggttgtcaaatatagaaaatagtatgtttaaataaaaccatactaggccgggcacagtggctcacgcctgtaatcccagcactttgggaagccaaggcgggtggatcacctgaggtcaggatttcaagaccagcctgaccaacgtggtgaaaccccgtctctactaaatacaaaaaattagccaggcatggtggcatatacctgtaatcccagctacttgggaggctgaggccggagaatcgcttgaacccgggaggtggaggttgcagtgaactgagattgtgccattgcactccagcctgggcaacaagagcaaaactcggtctcaaaataataataaaataaaataaaataaataaaaccatactattttcaggaaataaaacaagttacatatactacttttaaaagtaatttaaattcaaaataatttaaattattttgaaaagttactgttcaaaactaacattatatcatgaaaatttatttgccaggataatgagggcagatattcatccagccaattgctgtgaatttcatagacattcctaaaagaaaatatttatccagaatattccagaatatgaaattttttttctgctgatggccgtgtattagccagtctttgaactaaatttgattttacttactgctaatcatgcccagctcttattttattttcatgatagatagatagatgattgatagatagatgacagatagatagatagatagatagatcgatcgatctaccgatagaaagtaatagagatacagatatacaaacacccatatatacatatatgttgaaattcttggcattaaaacaatgaaaatatttagtactggcttttcaatgtgttttttataaaatatcacatagctgggctttgctttttaacccaatctgaaattttcaatattaaagtggattatatttcctttgaacatggataataggcaaattctttgctttgtattctgatattcattatctaacatgtatttctccacagtcatctgaaaagtatgaactaaataagcaccctacaagtatgctttattctcttcttctagatgaaagcttaagaatgtttaattccctattccattcttccccccaaattagacctctaggatgcttttacatttctccaccgtcttctaactcctcagttttgctgacgtagttcaatacttttggttttagatttattagctttttcccttaccatatgtctcttctattttaagaattcttacttagctgttatgttatgaatacccagtcacaattcttatccatttagttttaacgtatatattgcaaggcttattgcactcttttctatttatcttcatgtgtcttgagatttctattctgattcatatgttgtttggttcaaatacttcttgagtagtttcctcggacagggtataggggtggttttatctctcatctttgaatatccacaattgtctttcttctaacctggaagatgaatgataacttacttggtggggcatagaatgctttgctgccagttcttttctctctgtcctcaacagtccagtatcttccagtttcaggtattgaagatgcaatgtaaaatgccagtctggattatttttctgctgtaacttgtttcttctggatatttgaaagattttctcttaatctttagaatataggaagtttaccaaaatatgtccggttgtatgacttgttttgattaacctacctggactttaatgagcccttctattcacaaacaaaattcttcaaaccagggaactttacttgtgttacttcttttttcctaatctctatttctttccccctgaagatttccctctctgcattttgctgcatattttcagctgtttcttcaatttgatgttaaaagccagttattgtgggctcaaagacaacatactttatttaactattttttaatttaaaaacatatttttacattctagaatatgttttaaagttgatcattcttttgtattgcttgtgttaaaagttttcttctatcttctccagcaactttattctaggagccccctaggttttagggctcgacttgttttttctgtctttgatttgtgtacccttgaatacattattatttccctttgcctaacaatggctctgtatagcctttgagtggtgaggggcccaggattttttgctctgtgagctttaaaaacaccattggtaagcttattcacaacttcttgaggcaaaaggattatttttggttaaagttatctttagggatatagagcaactctgaccatctttgtgtctgtttggaagtcttccacaaacaccagatagacctcctaggaccacatatgtgggcaggcacttaactttcagcaaaggcgaagacctctcggggccctgtaaattttggtcgtaccttctgaaccccaagccacagcacctccaatctccagcagccctagcagggaacaaaactggttatctgatgcttccttctggaattctggcatatcctatggccttgcacatgttataaactatctaatcatcagtctagtattcatagtggggggtggtgggtgtcagagttgggagattaaagcatcagggacacattctcaggtgaccacatttccaacaagttaaatggaaagaatttgtttaatttcaaagtacaactttttcagaaaactacagaatcacggtcttacgtgtactctaattgtgatatcttgttttacaaatgaggatcctaagacaggaactgtattctgtttctgtgtattcaaattgaatttataatctggggggtagggggaagaatggccatagacaagttgtacatagataagttaaaatagaaaagtgagaagttgaaattttggcgaaaagaagaaaaacttcaggaaatttgatattgggaaggtatacaaatgaacaaattaagcagattgtgttgtgacagtggtctctctctggatacatttgttgtagccatcaccaaagatttcgaatctctttccagaaaaatctttggtcatatagctgtttcttttaatttctcccttacttctgaaggcattaggtcaataaaggaggtaaacagttattaggtcaataaagttacttggctaacatgtgaagtttcatcagttgccagtcaagcagtagctaaattaggcagtagctggctttatgcagaaatcttacttagaaaatccttaataaaaaaatcttctccccagtttattaattttttttttttttgagacagagtttcactcttgttgcccaggctggagtgcagtggcacaatcttggctcactgcaacctccacctcctgggttcaagcaattctcctgcctcagcctcccaaggagctgggattacaggcatgtaccaccatgtctggctaattttgtatttttagtagagacgtgttttctccatgttggtcaggctggtctcaaacttccgaactcaggtgatcagactgcctcagcctcctaaagtgctgggattacaggcgtgagtcaccgtgcccagcccagttccttcttaattgagtctatttctacattattattagcaacttgcagctcttcttaatttcctttataccccttgcccaagttccctaaatctcctatttgtagccaacaggtctgttccccctgattttctcacttaacacacagtatttccatatcatacttgctaggcttagtcttcctgaaactttttcataatgttactcgctacaaatttttcaatgatgactggttcaaaatctgtcatcactgaccactatttctattttatcctgagctccatccaaactgggccactctgctgctgtctatactatcctttgcactgcaccacctctgttccttttctggtttcttcccttcttctggagcatcctcctcttccatctttgcctattaaaatcttacccatctggccaggcctcttggctcacacctgtaatccagcactttgggaggcttaagcaggaagatcgcttgaggccaggaattcaagaccagcctggataacatagagagacactgtctcagtgatcaatcaatcgaatcgagtcgtacctatccttcaaggtccattctaaactttacctcataggatgtgatggatgatactgtggtcatgtgccagataacaacatttatcgcaacaatggactgcaaataggactgtggtcccataagattaaaatgttgtaattttactgtactttttctatgtttagatattttagatatgcaaacacttaccattgtgttaaaattgcctacagtattcagcacagtaacatgcttcacgggtttgtagcctaggagcaatgggctgtgtcatatagcctacatgtgtagtaggctatatcatctggggtttttgtaaatacactctgtgatgtttgcatgatgacggaattgcctaacaatgcatttctcataatgtatccctgtcgttaagtgacacatgatggtatttatatatgtcagattacgaattgcaaattatgtcttagataaaaaagaaacaaatttcaggtaacaacaaggacaaaaataacaacaataaaatgtagagccactagcaatagctatctttactgatggcctactactgtgtgagagatacttgcaaaggcctcatacacagtgccacatgaactgtacaacttatatgtatttttacatatctttctccttaagatgatcatatgagatatttctattattctcatgttacagatgtaataaatgaggtatgtgaaaggtgaagaaatgtgcttacagtcagtgaaatccagacagcctagccatagatttcaggcttaaatttcaattagaatatggagaaaatgcatttatcaaggaattttgccgagattcatttggaataaatcttattcttcaaagagaatgcacacataactttttagaatgtagcaggtaccatgatgtgacttatacttgtatagaagaatgtcacctcgggaaagataatggagaaattgttatttataggaatcattatagaacacaaaatgaagtggggagattgggaagctattatactaacctaagcaagagatagtgtgattttaaactagtcaaggcagtgagaatgcaaagaagaatttgaatgcttgagataaagaaattgaacatatttgacctgacatttgaatggatatgggtagggaaagataatacttaggtaactcaaatccccaaattttctgtctgctgaactccacaagataaatccttttagaaagaaccgctaaaacattggggtttgaattttaaaaagtgtttaccttggaagaatgataaacaattgatttgagtttcagatcaaggcaacagttcaaatatatttcttctcaggagatgcaaatctcagagaatgcagtttctactgttgtgttttgtttctttttgaaagctaaattcattctttgtgacgttactaatgtatttgaaaattatttttatatattgttttagagaaatttttacatttttgagtttagcaaattttgaaactatttttatgccctattgattatctataatttatacagagactgggctcagaggatgtattggtccagaggaaatggtcagtttcctgagtatattgtcccaagatggtttttttaacctttttttttgaaacagagtttcgctcttactgcccaggctggagtgcagtgacgcaatctcggctcaccgcaacctccaccttccgggttcaggtgattttcctgcctcagcctcccgagtagctgggattacaggcatgcgccaccacgcccagctaattttgtatttttagtagagacggggtttctccatgttggtcaagctggtctcgaaatcctgacctcgggtgatctgcccgaggcctccgaggcctccgaaagcgctgggattacaggcgtgagccactgtgcccggccttctttaaacattttaaggcaatatgtagatatgaaagttgtgaagtctctgatgcaaaaacgaaaaaagcagtgtgaaatctaggccttggtatatgtaaagaaaatagtccatagatacgattttttcatgtccactctccccagacaacaaaaagtacagaacctatcattcttgtacctttcttcccaggatgacttctccacttttaaacaatagctacccccctgcacccattatctctcaatatgttcaccagatgtacacgtactggtgcatctctgagctttggttctggcttttccctggcttggtgggccccaacatatcctgttcacctctcagcctttaaggtcaagctgctgctcaatagtaatggcagaatgaatgattgtgacaaaacctaagcatgcaaattgtaaaactaaattcatcccccaaattaccaattagtaaatattgttgccgtgaaaatgattacattggggtaactgaactttcagtgatacagtggccttacttaaagattatctagtctaatgcttttattgaatagtggagaaacctgaggcccagagaaattaaaggatttctctatatttgaaatattggtaatgtcctagaacacagattcttttattcccatttcagtgctctttttaccacatcatattggaaccattatttaagtgtatataatgaaaagcatcttgtttttttcatgtatattgacaatggatttttgctttgaattttagacaaataatgcattttagtgtaactaaattgaaagcaccaaacactactactaattttagttttgtttaactattcaaattttgtaggttgttttagacaaaagcagataaaaaaattatgttgtacatttactttaaatattttaccactttttttggtaagtttatttgcattttgccatcccatgtaaaggtagttaactagtcacaattctcccatttagttaatctcttgaggaaattactcaaatactgtttcttattctataaaataaaataggtgatctggaatgatagcttaaaattctttctagctctatatttatctgaataagagctatctaaaacttgaattttaaaatgctgtcatacaaagtacttttttcctaatacatttttgagataagtaggatatataaaacattgctaatatattgtgaaaatctctggaaatgtcttaagtaatgtgaactttattgttggtaatgctgttcttttttttttttcccgaagatagggcctattgtattgcccaggctggagtgcaggcagtggtgtgatcttggcccactgcaacctctgcctcctgggctcaagcaatgctgtcacctcagcctcctaagaaactgggactataggtgtgtaccacctcgcccagctaatttttttattttttacagagattaggtttcaccatcatcatgttgcccaggctgttctcgaactcctgggctcaagcaatccacctgcctcagccaaccaaactgctgggattacaggtgtcaggcaccgcgcccagctggtaatgcattttaaattgacaaatttaaaagtgtaatcagaattagctgtaaaataattttcacaatgtcagactaggtgaatgtatttatgaagtatccttgagattgctgtgggttttggaaaacctactcaatgtaaagtttcagcctgtatagtaaaacagagcaaggaaatacctctttaccattgagacctcttgaaaattcaagcaagatcttcaggttcttgcaattggagacactcctacaaataggccatcttatctgattaacctgattaacccccaataaactccactagttgacaggtcctacccactcatttccttttggtacttcattcttaacacgaataaatgtccaacaattcattccaacagtagtctaataattgaaggaaagcatttaccatgaaacaaaatgaaacaaatagtataatggaatttggaggaaactgacaatgaaagttgtcagaaaattaaaatgcaataaggtgctatttaaatttttaaaattatatccacaggcagagctttgaaatacaaaatatgataacataagtaaaaaccaaaagccaggcatggtagttcatgcctattgtcccagctacccaagaggctaaggtaggaggatcacttgagctcaggagtttgaggctgcagtcagctgtaaacatgcactgaagtccagcctaggtgacagagcaagaccccgtctcaaaaaaaaaaaatgtttttaataaaaataaaaattcaaggctgggcacagtggcttacatccgtaatcccacattttgggaggctgaggcaggaggatctcttgagcctaggaattcaaggctgccatgacctatgattgtgccactgtaccccagcctgggcaacagaccaaggcactgtctcaataataataataataaataaaatactttggaaacttaaataggctggaagaaaacctatggagaactcctagaaaaataggacaaaaaaaccgaagcgataaaaaggcagacaaaaccatgagactcaagactgagaaggcctatcgtattgcaaatgggagtcccacaaaagaagaaccaaaacaatagagtgaatgagacatgatcaaagaaagaatatgttaaattttctcagaactgaaggatatgagtctgcacattgaaaaagcccactgaaatatccagcacgataaataataaatacccacactcaggaatataatcacaaaatttcatcataatggagataaagagaagattgtgaggtgcttcctaagggcaaggaatgtggatgggtcacattcagagtagtagaatggcattgaacttctcaaataatttaaattatggaagagtttcttcaaaattgtaagggaaacaaattttattacatagaattctatatccaaccaaatcaagtgtggtgatagaatagagagaatactaccctcacacccaaaaatactttccttggactgtttcttgggaaacaactggagaatgtgattcagtgagataaacaagtaaatcaagaaagagaaacacatagacaaatgaaagcagggtcctatccaggaaaggggcaaagaaaagtaccagcatggctgttattcagcaaactaagagcgaaaccaagtccagattgtaccctaacaacagagccttcaggaaggagctctccaggaaactaaggaaattgatatgtttgaacatataaaaaaaattgatacccagatagcagtggtgtcggaagagtatataaaaattgtactaagtacatataaaactaggtgattgaaaaaataatgcaattagtaaatccaggagaaataatagccatgttcctagttcacttttgggcctataatatttataagtcatgataatacagacattgaccattcatttaacccaaaattatgacattactttggcattagagatgggtagaaatggcaattatacggatgcaaaagagctaagtctttatatatgatgagaagtcaaccaatagggtttaaaaaattgttaagtgaagaagtagaagcacagtaagtccccacttaatatccttgataggttcttggaaagtgcaactttaaacaacgtacagcaggtcctcaaataatatcctttcagttggtttcattatacctggttttgcttaaagtcgcaatttccaagaatgtattgactatgttaagtgaaggtataagaatatcatttagaaataggctagtcccagagaaaaaagacagaaaagttgaggatgtttgcctctggagacagacagagtagagacaaacgtggcagaagaatgctggtttttactatgagcctattaatattattttacttcatacactatctacattgtattatcttgataaaaatgaaatcaattttttttaattatactttacgttctagagtacatgtgcacaatgtgcaggtttgttacatacatatgtatatgccatgttggtgtgctgcaccccttaactcgtcatttacattggctatatctcctaatacccacaacaggccctggtgtgtgatgttccccaccctgtgtccaagtgttctcattgttcaattccaacctatgaatgagaccataaggtgtttggttttctgtccttgcgacagtttgctcagaatgatggtttccagcttcatccaggtccctacaaaggacatgaactcatccttttttatggctgcatagtgttccatggtgtatatgtgctacattttcttaatccagtctatcattgatggacatttgggttggttccaagtctttgctattgtgaatagtgccgcaataaacatacgtgtgcatgtgtcttcatagcagcatgatttataatcctttgggtatatacccagtaatgggatggctgggtcaaatggtatttctagttctagatccttgaggaatcgctacactgtcttccacaatggttgaactagtttacaccaacagtgtaaaagtgttcctatttctccacatcctctctagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccacttgttgatggggttgtttgtttttttcttgtaaatttgtttgagttctttgtagattctggatattagccctttgtcagatgagtagattgcaaaaattttctcccattctgtaggttgcctgttcactctgatggtagtttgttttgctctgcagaagctctttagtttaattagatcccatttgtcaattttggctttggttgccattgcatttggtgttttagtcatgaagtccttgcccatgcctatgtcctgaatggtattgcctaggttttcttctagggtttttatggttttatgtctaacatttaaatctttaatccatcttgaattaatttttgtataaggtgtaaggaagggatccagtttcagctttctacatatggctagctacttttcccagcaccatttattaaataaggaatcctttccccatttcttgttttcgtcaggtttttcaaagattagatggttgtagatgtgtggtattatttctgagggctctattctgttccattgttctgtatctctgttttggtaccagtaccatgctgttttggttactgtacccttgtagtatagtttgaagccaggtagcatgatgcctccagcattgttcttttggcttaggattgacttggcaatgcgggctcttttttggttccatatgaactttaaagtagttttttccaattctgtgaagaaagtcattggtagcttgatggggatggcatcgaatctataaattaccttgggcagtatggccattttcacaatatttattattcctattcatgagcatggaatgttcttccatttgtttgtgtcctcttttatttcgttgagcagttgtttgtagttctccttgaagaggtccttcacatcccttgtaggttggattcctaggtgttttgttctctttgaagcaattgtgaatgggagttccctcatgttttggctctctgtttgtctgttattgctttataggaatgcttgtgatttttgcacattgattttgtatcctgagactttgctgaagttgcttatcagcttaaggagattttgggctgagacgatggagttttctaaatatacaattatgtcatctgctaacacggacaatgtgacttcctcttttcctaattgaataccctttatttccttctcctgcctgattgccctggccagaacttccaacactatgttgaataggagtggtgagagagggcatccctgccttgtgcctgttttcaaagggaatgcttccagtttttgcccattcagtacgatattggctgtgggtttgtcataaatagctcttattattttgagatacatcccatcaatacctagtttattgagagtttttagcatgaaggggtgttgaattttgtcaaaagccttttctgcatgtattgagataatcatatggtttttgtctttggtctgcttatgtgatggattacatttattgatttgcatatgtcgaaccagccttgcatcccagggatgaagcacacttgatcgtggtggataaggtttttgatgtgctgctggattcggtttgccagtattttattgaggatttttgcatcgatgttcatcagggatattggtctaaaattctctttttttggctgtgtctctgccaggctttggtatcaggatgatgttggcctcataaaatgagttagggcggattctctctttttctattgattggtaccattccttctaaaatcaattctaaaaatacagtatcccaccttttgtgaaaataagttaattgtatattgatatgacactgcagaacatttaacaacaacaacaaactctttagttaatgcccaatttattttggttatgtaatttattgacctacagttgtttatagtgagcttttaatcttattacagatatcttatatatgatgagtttgttttttcttgccacttagaaattatctctttgtcattgccatttgttttgtttttttgagacagggtcttgcccttttgcccaggctgaagtacatattatgatcatggctcactgcagcctcaacctccctggctcaagtgatcctctctataggtgtgcaccacacacctggctaatttttttattttttattttatagagattatatctccctgtgttgtccaaggtgatctctaactcctgggctcaagtgacccacctgcctcagcctcccaaagtgttaggattataggcatgatccaccccgcctggccttgtatttgccttttgacattttagtttgatgtgtttggttatgtatgtctttaatttatactatttgagtttgttgagcttcttgggtactcatattaaggttattttttcaattgtatttgggagctatttaaaaaaattattattactgcccctttctgttgcttcttctgggactcccttatgcattgttgggatgctggatggtgtcccacagatatctgaggctcttttaattttttaattgtatttgctttttgtttcttatataagatagtctcaattaacctgtcattagttcattgtcaccaagttcactgattctttcttctgtgttctgtgacctcaaatatgctgccagtcagacattctagtaaatattttgtttctgttattacctttttcaactccaggatttctattcatttcttctgaaagataatttctttctttttactgttattttctatttggcaagacattatttgtatactttaattcataggcatagtttcttttagttctttgaacatatgtattgtaggtggcttaacatctttgtctaataaatctaatatttgggtttccatgggaacagtttcagtcggctgctattttccctttgtataagccacactttcctttttgcatatatcataatttgttgtcaaaactgaacattttatttatttatttttattttatttattttattttttttctgagacggagtctcgcactgtcacccaggctggagtgcagtgggacgatcttggttcactgcaacctctgcctcctagattcaagcgattctgttgcctcagcccccgagaagctgggactacaagcatgcaccaccccaccctgctaatttttgtatttttagtagagacgaggtttcaccatgttggccaggctggtctcaaactcctgagctcaagtgatccccacctcagcccctcaaagtgctggtattacaggtgtgagtcaccatgcccagccccaaactgaacattttaagtaaatgttaactgtcaactctaaaaattagatgaccccctcccctcagtttgttgttatttggttttgttgttgttgctatgtgttttttgagttatttttccttaaaacctgtattctttgttgtgtgtggccactaaaatttctgctctgttacctttatggtcaactaatgattagtgggagattaagccagtacgtttccctgcctttgtgaagggcctgtgtgtgtgtgttgggtgatgacctcaatgctccagcagactgtttactactctgtcttagccttagccttcactttctgcttgcacagagcctcaaagtcagccagaggtgagagcttagagttttctcaggtcttttgtgatcatgcacaagtcaccatacatggctctatagattcccagaaatatgttagtcgtttttgtagacccctatgaacattttactctccaatttttttctttgatttttttgtaagcctcttgttagctccagctattaaagccatctccaacacctgcattgttaaacagttgccactgattatttttgacaaatattctgtaggtagcaatggttacataaaggcagttctgagtcagctgaagtgaagccatgtcctgaaaatggagcttagtgagctgccagataggtcaaatggtgactattctatgagaatggacatttgggaactcctaaaactgtagaatgtagaatttaaaaactgttctaacctcttagtgactgctcagctgctagtttacacagctaccataatagtgaagcttttggcttttggcctactatacaactggagaagaggatgggattagtgcaaattaaaatgccacaagattcgctcttcatatggaaattcagccacttttcttgaataaatattctttggattattttaagtttttaatttccagagttctgaaaaaggtgattttgacaatgtttgccagtgttattacctcaaagtttctaattcaataaatctgagttagggcctgggaattatttttcctttattaatattctccctagtcctttgtctattcctttttagatgtttttgttcttcttcctttgcctactccttaaatatatggtatttcccaatttctatgggttttataaattctcttgatcccttatacattgtctatagatatgacatgcttgatagaaccagctgaaacattttccttgtgcaccagtttaatgtctcagagacagcccctaatttagcatgtcttaaaatgaacttatcatcttctacatttatttttctctctatatgcccttgtgggcaacactgtacagttcttcactgaatcattaattaattaaataaatatttctttatttattttattttatttttaattatactttaagttttacggtacatgtgcacattgtgcaggttacttacatatgtatacatgtgccatgctggtgcactgcacccactaaatcgtcatctagcattaggtatatctcccaatgctatccctccccactccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctcaccagcacctgttgtttcctgactttttaatgatcgccattctaactggtgtgagatggtatctcattgtggttttgatttgcatttctctgatggccagtgatgatgagcattttttcatatgttatttggctgcataaatgtcttcttttgagaagtgtctgttcatgtccttcacccactttttgatggggttgtttgtttttttcttgtaaatttgtttgagttcattgtagatcctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggttttgatggttttaggtctaacatttaagtctttaatccatcttgaattgatttttgtataaggtgtaaggaagggatccagtttcagctttctacatatggctagccagttttcccagcaccatttattaaataggaaatcctttccccattgcttgtttttctcaggtttgtcaaagatcagatagttgtagatatgcggcgttatttctgagggctctgttctgttccattgatctatatctctgttttggtaccagtaccatgctgttttggttactatagccttgtagtatagtttgaagtcaggtagtgtgatgcctccagctttgttcttttggcttaggattgacttggcgatgcaggctcttttttggttccatatgaactttaaagtatttttttccaattctgtgaagaaagtcattggtagcttgatggggatggccttgaatctgtaaattaccttgggcagtatggccattttcacgatattgattcttctgacccatgagcatggaatgttcttccatttgtttgtatcctcttttatttcctggagcagtggtttgtagttctccttgaagaggtccttcacatcccttgtaagttggattcctaggtattttattctctttgaagcaattgtgaatgggagttccctcatgatttggctctctgtttgtctgttgttggtgcataagaatgcttgtgatttttctacattcattttgtatcctgagactttgctgaagttgcttatcagcttaaggagattttgggctgagacaatggggtgttctagatatacaatcatgtcatctgcaaacagggacaatttggcttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctactgagataatcatgtggtttttgtctttggctctgtttatgtgctggattacatttattgatttgcatatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctacccagctttggtatcagaatgatgctggcctcataaaatgagttagggaggattccctctttttctattgattggaatagtttccgaaggaatggtaccagctcctccttgtacctctggtaaaattcggcatgaatccatctggtcctagactctttttggttggtaaactattgattattgccacaatttcagatcctgttattggtctattcagagattcaacttcttcctggtttagtcttgggagagtgtatgtgttgaggaatttatccatttcttctagattttctagttgatttgtgtagaggtgtttgtagtattctctgatggtagtttgtatttctgtgggatcggtggtgatatcccctttatcattttttattgcgtctatttgattcttctctctttctttctttattcgtcttgctagcggtctatcaattttgttgatcctttcaaaaaaccagctcctggattcattaatttttgaagggttttttgtgtctctctttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaaaacatctttatttctgccttcatctcgttatgtacccagtagtcattcaggagcaggttgttcagcttccatgtagttgagtggttttgagtgagattcttaatcctgagttctagtttgattgcactgtggtctgagagatagtttgttataatctctgttcttttacatttgctgaggagagctttacttccaagtttgtggtcaatttggaataggtgtggtgcggtgctgaaaaaagtgtatattctgttgatttggggtggagagttctgtagatgtctattaggtccgcttgctgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctggatgctcctgtattcgttgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcatatgtgtgtctctgcacgtgagatgggtttactgaatacagcacactgatgggtcttgactctttatccaatttgccagtctctgtcttttaattggagcatttagtccatttacatttaaagttaatattgttatgtgtgaatttgatcctgtcattatgatgttagctggttattttgctggttagttgatgcagtttcttcctagtctcgatggtctttacattttggcatgattttgcagcggctggtaccgattattcctttccatgtttagcgcttccttcaggagctcttttagggcaggcctggtggtgacaaaatctctcagcatttgcttgtctgtaaagtattttatttctccttcacttatgaagcttagtttggctggctatgaaattctgggttgaaaattcttttctttaagaatgttgaatattggcccccactctcttctggcttgtagggtttctgctgagagatccactgttagtctgatgggcttccctttgagggaaaactgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccatcactgataccctttcttccagttgatcgcatcagctcctgaggcttctgcattcttcccgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttggtgtggatgtcctttctgtttgttagttttccttctaacagacaggaccctcagctgcaggtctgttggagtaccctgccgtgtgaggtgtcagtctgcccctgctggggggtgcctcccagttaggctgctcgggggtcagtgacccacttgaggaggcagtctgcccgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcatcctggctgctttgtttacctaagcaagcctgggcaatggtgggcgcccctcccccagcctggctgccgccttgcaatttgatctcaggctgctgtgctatcaatcagcgagactccctgggcttaggaccctctgagccaggtgcgggatataatctcatggtgtgcctttttttaagctggtcggaaaagcgcagtaatcgggtgggagtgacccgattttccaggtgtgtccgtcacccctttctttgactgggaaagggaactccctgaccccttgcgcttcccaagtgaggcaatgccttgccctgcttcggctcgcgcacggtgcacacacccactgacctgcgcccactgtctggcactccctagtgagatgaacccagtacctcagatggaaatgcagaaatcacccatcttctgcgtcgctcacgctgggagctgtagacaggagctattcctattcggccatcttggctcctccctaaataaatatttattgagttcttatgaggttctataggccctgaaggtgcaatagtgatataaagaaacaaacaaatatttacctctccagaaaggtatatttctagtgaaagagacaaagcaaataattaaaatatgttgtgtgtctgatattgacaaattctttggagaaaaatgagcgggaaagattgctaaggagagccaagatgaggataaaagttgcagttctaagtaggatgcttagggaagtcatcactgaaaagttaccatttaagcaaagatctgaggaggtgatagatcaagtcacgtgggtacctgggggaagactgttacaggatgaggaaacagcagctgctcagtgtgaggcaggagtgtacctggcattttgggaaaatgatgaggtagccattgtgcctggcttcagcgataggagagagctcagacaggtaatgggaaacatgattgtcttggtcctgaattcctgttttcttaaaaattgggaactgtccttcagagattaagtaatttatatcattcttctctttgtcctttgtcctccacatcttgtaagttatcacattttattgattccaactcctatgttactcttctgcctatgctcttcttcatccttgatacttttgccttcatttgggcttttatcatggtcacccagctggtctgctgccaggctcacatgccgtattcaacactcattcacaagagatttattgaataccttctgtgttctaggtcctgtgctagatattgtggatataatggttattaaacttgaaatgatcattgcccttagaaaactcatagtaactggtttatagagactgttaatgacatagagcagtgtaataagcactttgagggcaagcactcttagtagcacatgggaggctggtagctctgatttatgagtgcgaactctccagagtaagctatactcctgttactatctgaaagataagagggagttataccttcagagagaaaagaaacactgtccaaacgaagggaccacttgtacaaatgcccagaaaatggaaatgaaagcagtttactgttaccagatacagcataggggaaagtggctcaaaatcatcccggacaggtacaaaagagccagatcatacatgatatctttaggccctattaaagtatttggttgattaaatgatttggttgaccaaaacgataattttaaacaatcatacaataatttatctcccagaattaaaaccgaccaatgattccctgctgactttagattaaatttaaactgtataacatagcacctgaggtgctttaatctggcttttgcctcttcaacatcagctcccacaggccccacttgtctgtttgtacactaacaggaaagaactgcttataactactccccagaagaaacatctcaagtctccaggccacaacagattctaagagtgctctttcgtcccgccaacctcatgaattcatatttgtccttcaaaattaatctcagatatcatcttctgtaagaatcttttcctgaaaattcaaatagagttaatcatgtcctcttctgtgataccaacacttctgtatgatcttttcttgcagttatcataatctacaaaacctgtttacatgtttaacttctccactagtgtgagctctttgagagtctgtggatttttttagtttttattttttgtctgtgcatattttagcatagcgcctttcacttagccaaagttaataaatagtgaatttagttactctaatagaaggcttggttaattttgaccaaaaactaatgataattatttataggaaataacataaacttataggtcatttaaatcacaagactgtgatagtgctcagcacacttgttatttattgaatgatagccaaccttattataatataattttcatgagaacagaaagcttatctgcctattgactgctcctcttccatagctagcacagttcctggcacatagaaagatacttcataagtgcttgtccctatcacacttggtacattattatagtttatacgatttttaaaattctttactttcagtcacatagcaatatggtcaccattaaatatttaaataattttgtaagttattatttgaatcaaaacatctgttcatttttgttttacttttttatttctttttttattattattatactttaagttctgggatacatgtgcagaatgtgcaggtttgttacataggtatacatgtgccctggtggtttgctgcacccatccacctgtcatctacattaggtatttctcctaatgctctccctcccctagccccccacccccaaacaggccccagtgtgtgatgtttccctccctgtgtccatgtgttttactataataatgctttaaattttcaatttctggttattgtttttttaaaagcatggtattttatcatagacaataggttgtcttctccaaagtgagtacttaagtcctaaaagcatgaaactaccttctaggcacttcagagaccttgagcagtgtctctcatccagcccaagctcaggtattccttacatagcagcctgcaaagcatccgccataaaaactactacaaatgcctcatagataacatctcagaattatctcatcactgggggcagttctgaaaagaagaaacttagatagcaagtaaatatttttaaaaggtaaagccttgccagtaatcactgaaattgaagaactaggatatattaaacctttctcactatcaaagattttttatttttttgatactaataatacacatagaagtaagtgtgctatgaaatgggctctctcaggtgccactggtgaaagtgtaaattggattaacttttttattccagaggacagtttaacaatatatattgaaaacatttaaaatgttcatactcattaatatctcaaaaatattcatcacgatggaaatgttttagaactagatagaggtggtggttacacaatattgcgaatgtattaaatgtcattgaattgtgcactttaaaatggttaattttacattatatgaatttcatctcaaattattttttaataattatcctaacaaaataatatgctagcattaattagaatgttaatttcagcattatttacaataataaaaatttaaaaataaaataaatgtttaatagaatagtgattatatatgatccatcatatgctagaatactgtgcaaccattgaaaataatattttaagggatttttaatgatatggggaagtgctcaagagaaaatgtcatgaaaaatgttgaatataaaagtatgcaattagacagttatgcaaaacaagcatacacagcaaaagacctaaagaaaattataagtattacttgaacgcctttaagcacatgaagcccttgtctcagaggtttaaatggcaggtttttctttaagtctcttgcttctttaagacttttggccatttgggactctgattttgtcaatggtctactcattatacccagagcctaaaccttcgtggtacgaagagccaggacaagagaaaacgttactagtataccaacttgggaggttatacttggccgtttatactgtcatttaactataaatggattaagtatgatttggaggactagcttagagcatcaaagatattgaatatttaccatgtgtctgaccatatactagatatgttcacatccattatttcctgtaatttttgtttgtttgtttgttttatttatttatttttgagacggagtctcgctgtgtctgccaggctggagtgcagtggcgcaatctcagctcactgcaagctccgcctcccgggttcaagtcattctcctgcctcagcctccagagtacctggcgctacaggcgcccgccaccatgcctggctaattttttttggtatttttagtagagacggggtttcatcgtgttagccaggatggtctcgatctcctgaccttgtgatctgcccgccttggcctcccaaagtgctgggattacaggcgtgaaccaccgtgcccggccccattatttcctgtaatctttataaaaacacggtaaagtaaaaaactgcttttctacctactttacagatggagaaacaaaaagggccattgactttctctgggttacacaggtagttagttaatcaagactcaaacactcttattctgtttccaaatccgtgcttgttctcatgtaccacatagctgttattcctctatgccacactggacatgacagcacaaagcctcaaatacaaacagtcctcattttgcagataagttgtcttctaattatacttgttttgttgttgttgttgttgttgttattgttttgagacaaggtttcactctgtctcccaggctggagtgcagtggtacgattggctcactacaacctccacctcccaggctcaagggatcctccagcctcagcctcatgcccagctaatttttttgtaatttttgtagagatagggtttcaccatgtttcccagcctggtcttgagctcctgagctcaagcgatccacctgccttggactcccaaagtgctgggtttacaggcgtgagtcaccacaccctaccctaactatatttctcaattagaagtatatatatgtaatgctttttctcataggtatagcattatactcattaagactcaacccccaagagtgtttctcaggtctgaattggcaaataactcaaaactcataatgcctcttccgtgacaattcctaatatttagttaagctttccctttgcaggtactaaccctttcaatcccctcaacaactctagtaaatatgagcattatctctgttttcataaaagaaagctgaagtacaaagtcagacaggtaattggtaccaaaaccaagatttggatccaggcagtctgaacttgcactggctttagtacccttcttaacatggtgtttcaggcagcaatcaaaattggcactcaagaagaaatctatgtgctatgtaaaatttgtctgtgttctgaaagtgtgtgatgcacactggctctcaaccctggctgcacatcagaaacacctgtggggttttctagacatatagaacccaaacccagctatggaaatctgctccacagaggccgggtgcggtggctcacgcctgtaatcccagcactttgggaggccgaggcgggcagatcacaaggtcaggagtttgagaccagcctggccaacatgatgaaaccccgtctctactaaaaatataaaaattagccaggcatggtggcgggtgcctgtaattccagctacttgggaggcttaggcaggagaatcacttgaacccaggaggtggaggttgcagtgagtgagatagcaccactgcactccagcctgggtgtcagatcaatactccatctcaaaaaaaaaggtgcatcacagattattttggtgtggtatataaggtagttatgaaaatgtggaaatgtacctggatattacaataaacaatgagtagtgtggccattatgtgctataaagaacaatcatagcttttggaatcaggtgagaaagcttcctagaggtgatggcattttgagtggtcatgtgaaatatgagggaaactgttgagtaggatcatttcaagggataggatatactgtaggagatacctttgagaaggataagcagaagagatttatatgttttttcactgaaaattataattagggatgaacttgcatcttagccccttagtatttgatttttaaatcttagtccaccgaattttaatttgccttatatcagttctttaagaattacaaaggagttaataatccttccctccttttagcttgcatggcattttatttgtacctctacttttatagtgatttgtgtgtatttgatatcctcaactctgtgttcttaaaacacccaagagtacctaaacttgctttgcacgtagtaggagttcaaaatattattatattgaattatgggagaagactcattttcttgcacatactgccttctaccttttcttctgtgtactctctgcaaaaagtaaatcacaaccatgagtcagtttcacagctacaaatattggtcctggtaccgatatatagtttacatacacttaactttttcactgatacatttagctttcaagaaattactactctttaataaacccacatcagtgggcaatatgtgaccacaaacacccctatcttaggcttaaccatccagtctgttttagccatccattcagctgtgagctctaatccagagtgggacattgagcaaagtgaagatccagaaataacccattggacttagcatctcattgaccaaagaagctctggcattatggggatgctgggatctggatctgagccctcctggtcagcatctttatgctgaggactatgaatagggaccaagaaagactttaaagctaaggaaaaatttgaagcttaataagaaaaatcttacttagattgaggaagtgttgtccacacagagaaagtatttgtggatcctccaaatgactttaatccatactttttttttcttaatagtatcttccttcacgttgcagtaggagtgtagccgtttactaggggaacagacaggctgattatttgggacaatgtttcacatccttgactcttgttctggtggatgtttgttcttgctataatttggatcataccaggaactgtaaggattatttcttgaaagagtcagagcatagactgatattattattctttgaatttttctatgtcttctagtatcctgataccaggctcttattttgttagcattttgaattgagaacttacaaactacattactgtaacaatacttagctattgttagtgtattttcagctagtttgccaaaatttcgccaacatttagggctaaatttactttgtcagaactatcactgtggtaattatggatgtttaatggttttgctaatgtaataagtgatgtgagtggtctgctcatatggtttgaaatcccttgccattttgtgcacacctgccttccaaaggccagctcctccacctaagctgtaagactgcctttgagctagtagaagccactaggggaagaccttaagcagtgattggcaggtttcagcatataaatacactaacttctttggcccttacttagccaattctaaggcatgtgcctacactatttgtcaagagtttcctctacaggattaagcttcagttggcgcctgtgattgctatcttaatatattagctgccttcccttctgttatcatgttccccacccccctgtccatttactgagaccctcccaaataacttatcttcactcattcattgtctcagagtcagcttctggaggaactccaactaagacaactacctaattaacccaacgattagaattattcacatttaggctgatgttaatttattttacactgtcatgataaattgtttagaaaaaattgacaatttttctaaattgctgtaagggtgatctgtttgaatttatttgagatttaaaatatttaggatgacatctcttttctttttttgtgacacaaaattgttaaaattactggctatcaaatactagtaaaaattagcaatagtgtgtgagtaaaagggtgttacatggtcacttattagcattctaaacacaacttttagtaaaatcaatataagtaataaagtcttaggaaaaatacattctaacaaacaaaaaagaatataattctaacaaaaagtttatggagatctatagtctaaactaaaatgaaccttaatacctctaaaatgctcaaatattaatgtttaggggcacctaaaatgctaaagaattgaaaacaataaaaaatggcaaataaataagatcctaagacagtaaaaactaatattcagagaacttaatgtaccaaataaactaataaaatacttaacagccaccttgatactaaaagtaagttgtaataaaatgctcaaatgaaagtattaagacaatccactttatgtctccacccatcttatctgtctcagcctgcttttcctcaaaccaccagcatgttaagataattcagtatacttttcttgttcttttgcttaatttgaccagttttgtttatatcacaagttgagaaactgccacatattttttctaaatgttttggtttttaaaaaatgttcttttataattcaaataactccaaagacattatagtgtaatgaataggatcataggtcttggagcctaagcctggactttaggcccattcctgggtccaatcctggctctgccactttcttgctaagtgacccaaagcactttacttcttctcttagctttgatttccatcggttaatttgcggatgatcagagcatactatccataaagttgctttgagaattaaataactttttttttttcaagacggagtttcgctcttgttgcccaggctggagttcaatggcgtgatcttggctcactgcaacctcccaggttcaagcgacaatcctacctcagcctagcaagtagctgggattacaggcatgtgacaccacgcctggctaattttgtatttgtagtacagatggggtttctccatgttggtcaggctggtctggaactcccaagctcaggtgatctgtctgcctcagcctcccaaagtgctgggatttacaggcgtgagccaccatgcccagccgagaattaaataacttaaatgtacagtatttagaatagcgcttggtatgtatgaatgttcaataaatgttcatttttttcatgtagaaaacaatgtattatgggtaaaattagactttataaagttgagttgagataaaaactgagataaaaagtggttgacatatgtaaccacttttatataatgattagtatggggaaaatgcattctaattaccagactactgacttcaaaaatgagtgtttgaaacacaacttgtttgtaaaatactacatcttttactaattttttcatgtagtgtttactatttttctagtaaggcaaagtgaatgatatgcctactgtgtgctaatcagcactttcatgtcattgcatgtaatccacaaacagtcctactaggtagctagtaagaacttcatttaaaaggaggaagttggaactttagaagggtccagtgatttatgcagatagtagctgttgtaatgtagcctctataactccaagctcaaagcttctgctactatcttctgttattaacaggggagaggtttgatacatgtaacaactgttatgctacaggcaccaaccattctggcattatagtggatgccagaatactagaggatccctgttgcaccaggtgttaaccttagggtatatggaggtgtcttggtgggggtagggtccatagagaaggggacatttggagagcttggagcagtgcccattttccaaccagtatttaagtattatattatttagtattttagcaactagtacagccacactgttctttctgaccaaacattagccatataaaaattttgatataactagtgttataattaagtataagaaaaaatttaaagaccatattaatttttgttttcatgtttttttctacaagacgtttttaggaccaggcataattgagaatttcttccttgtaattcttgctaaactataagtacataaatatttggtcctgtttcacttacattgattgattaatcactgattgtttcagttcatttcctgttgccataacaagaatacctgagactgggtaaatgataagaaaagataattatttcttacagttctgaaggctaggaagtccaagactgagcagccaacatgtagtgagggccttcttgcctttattattttcagccattttttaaaaactttatgaacttgtggtaatttagaggaagaagcttacatgttaatgtattctgtccaaaatatttctcaatctattataaatatcatgaaggagtttattgtttacttgttttccaaatgtgaatttgttctcagttataactttcctcttgttacatattctttatcatcaaagaagaataaaacaacgatcatttttacctaacaatctacatattatgtgctcaaatttgctaaaagatccaatctctttatttcgtagtttggaagcaacacagatcactgattgtatttgttcctcttttatcttttttatgtggtagaaaaattatttgaattacagatgttagacagtgaatatatttttcttcatttagattgtaatattacatagaatgaaatgaattaaatatgttaactctaatgcttttagcctgaaccacatgaaattaccaatatttgacctttttaccaataaaaaggacaatttctccaatttaacccaatatagaagcatatattgccaaaaatattgagtactttgaggtaatctttttattattttctctgtttctgaagtgaatatttaatttttgtttcagttactaatggttagttgttctctgttgcaactagccaatgaacaggttttttatatattttatatttgatttttctggaaagtgaacccatcgtactaagattaatttacatgtattgatttgcagtcttctgtgccaatttaagtttttatgtaacatatttttatatagggcatattttattataaatatctatgtctatatctgcaacaatatctacagctctattctcagtgctataaaatcatgagaaaatcatagcattatgaagtccagcaacatagggaacatttaatatttgattagttttaagtagtatttgagactatgtgtgagaggcagtgttaagccttaaatcactcatatggagcaaattgtctgataatattttggtttaaacatttgaatagttatttttctgcatagtgatttcagttcattataaacagagaagattcagcaagtttctggaaatatttaacatacttcacattttattttatggcttttgtattgtcacctgtgaaatctaaaattatattccatttattttttgtacatcttaaaaaacttgacaggacaattctctaaatgtaagaaaaaaatctaataaacaagaatgactcagaagctctttatggttgcacttgctcattcaggttttattttttgatttgcgagttattgcaaagtcagtaatggccccatctttatttactcctgtacataatttatgtaatccagacatctttttttgcttatgagggttttattttcatgtcagtgtgttattttccctatctaaactcttcattatttgtcagattggcataatattgtgctgctctgggtaggatttgaaatattattctcatctggtaaaagatagctgtttctagacatgataaaaatcaggcattactgctggcttacagaattccttacataaaatggtttcttttactgttatgagtgcctgcaccaaaaatctgcagaaactcagagcctagtgtttctcccaagtgctggctgttttgatgctctagtcacattaactaacctccttttcctacatcactgaggatgataggatactgctgttcttctgtgtatttgcgttttctctgcctctcatttaattctttaagtattttcacatgagggtacttctccacctccttgcacagagttctaacacctctccctgctatgttttctgtgtgtgtgtgtgcctactggaaattgttggaattatttgtgcctattggaatttgttgtggttatgtcagaaattttcattttgttttgttttcttctgtatttctttcttttataacttcttaatatgttcctaatatgtaactactaattgcatttttttttgtcaattatgctggctgaagtgttttcccttgaggatttattaatgaggattctttaattgggggttttgtttctgtttttttgataatttttaaagtcacataggctgaagtatgcatcatctaaaagattatgctttacattgttaatgtcataaatactggacagagcttgtttatataaagtcttataacaaatttgatctttgcatataagcagtttatatgctaattttaatcctctatagctgcattttgaagctgctcctttaaaacatatctacaggaaaagaatttttagtctttatgccgattaaaatggtatttattaaaaatctttttctataaattaattcaaatatatcttccctctagttcccttcaaattagccttaattatcaaatactgattcattagtctaccatatcttgttgtttaaacttacatgatttccttctgtttttatacagagaatgtcttctaagaagactgtaagttctgattcagttttttctgctttagctcctacaacaacctagtgatttgttctgttgaacacagtggagtcactgttagacctattcatttctttgctactaccatgtaaataaaggattgtggtctgcattctagatttttttaaaaacattgaagtagatttatgatagcttaatgaaatttatctttataatagtgtttttcttggaatggtagtgtcttgtatgtccagtacccaaaaatgttatcattgctccattaaaatactggaaaatatgtgatgtcctttaggatctcctaatttttgttgataaagacaacagctcatccctctgtcctcttcccacttcagaatcagggacccattttctactttatcatcaacaggaacatcattttttttttgagccaaatcccacatcttttgctattttttatttggtgatttgtttgtttgcttggtttattttgtttgtaatggtggcccaccaccactttattatattttgtttgttttcactttggggctagttaaatatgttaagtaatagactgctgactggtaaaactaatgcctatattttaccatattgctttagaccttttaaaaaaatcatgataccctgttaagtacttattggtttcttttggctgaatccgaaagggggcagtacaactttggtgtttaatttgtgaaagtatttttttcttgtttgctcctacaagttctagttctattcatctaatttgatgaattatccattcatcaaaccatggagttggaagagaccttcaaggctaccatgattcagaaggaatttaaatataacctctggttaaattccttcttcaatagccctgtctcttatccagtaatttcatccatatttttaggatgaacctgaacagtgaaatcagcagtagttgtcactgttgcatttcttcccttcccttcttttttctccactatagaactttctagcactgaaaaataatttctggcattctggaaatgtaggcaattcccgttggtagtcataatgagaaaaagaggaatatgatatttgagaaaagtaaatgaagatgatgtcagtggtagtgattttttaagaaagtcatgaaaatgataaagtgggaaagtaaacctgggatttcaaactgcactccattggaaccagtgaggagggatatactactagagatgtgtaatagctggacatggtggtacacacctggagtccaagctacttgggaggcttagatggaagatcatttgagcccaagaggtcaaggctgtggtgagccatgattgcgctattacactccagcctgggtgccagagcgagaccctgtctcaaattaaaaaataaaaataaaaaagaagtgtgtcagagatatctctaaggactcagtgcagcaagaaacagaacctgagaagatataaagagaagatagcataaacatactagtcataaacttctaaaggtgccaatatttggatggaagcagacagtaaaattatattccaaatatatatataggatatatatacatatatatacacgtgtatatataggatatatatacgtataatatatatatatatattccaaaagtaaagtagcttcataagcatttctataacactgcgcagaggaagttcttgaaaggtactagcaagaatggaaaaataaatggaaattacccctaaagttaaaatatatgaattgtcattgatcatatctttagtttgctatccttctaaaaattttgttttagtgactgtaggcctattgacatagactttcatgttcacttgatcttaatcacctaattctgtttttcttcacaatatattaattttctcaaccttgaattcttgatccagagattttcaagaactctatttttgaagtcagggagaaactatatagaattaagagtaatggatgagctgccagctcattcactgagtcccagccttattagatcattaacgtcaacaagcccaatacattgataaggtacatgttcttggaactatatttgataaaatattatacttcttcctctcagaaaaatctctcaaggtgtttgcatacaagttacacaaaaatcactcactggtcttccccaagtaatggatataataaaggtgggctctcagaaccagattgcttatttattccagctggagagatacccttagcagatctgatagacatttttagaaaatgcttgtgaggaaaaaaagagtgcttcttttttaatctctaatgaaaatatttcacttactgttaatactctgaatagcctggttattacgaactttcacagagatctttagattctttgtactttttttcagtgagctcacatcctactgaagccatattgtctgggcaagttgcaagaggggtaaacacaaagcttaattcggtggacaggatttagaatttcctttggttctttgttcctgaaagtgacctggtcatacccaataagggattcttctttttttttttttttgagacggagtctcgctctgtagcccaggctggagtgcagtggcgcgatctcggctcactgcaagctccgcctcccgggttcacgccattctcccgcctcagcctcctgagtagctgggactacaggcgcccaccaacacacctggctaattttttgtatttttagtagagacggggtttcaccgttttagccaggatggtctcgatctcctgacctcgtgatctgcccgtctcggcttcccaaagtgctgggattacaggcgtgagccaccgcgcccggcccgggattcttcttttctttgcgacaaaaggataatagttgcattaaaatcattttaaaagtaatttaaggcccactaagagagtaatctggaataaacctactaatagtctgaattagtactaagtaatggctgaagtatgctcaggctaaaattattctctgtgataaaaacagttgataaaacaaatctgtggattgcatgattagagctatggttatactgaagaaatttggaatcttttaaacagcaaatataagctaaaaacatttttaattcattgactgtttgatttctgttgaaataaaggattctttgcggttttattttattttataacttcttgctatgattggtttctgttcaactatgtatgatatttgtgaattagaatttttttaaaagtcacctgtcagatcagaatgactgggatcttgaaggctacgagaaagttgcataatactaatactatgaaaacaatcactgttaaaagtttatgatttgatataatccaatagctcagggaagtagaaagcgtattttctttctctaagaattgccttattttaaaactagaatgaaattttattggaatgaaatgaaagagaagacattacaactgattctacagaaacagaatggatcataagagaccactatgaacaattctacaccaaccaattagattacctagaagtggataaatgcctagacatatgcagcctatgaagactgaatatgaagaaacagaaaatctaaaaataccaatgacaagtaaggagattgaattagtaatcaaaatctctcatcaaagaaaagcccaggacctgatggcttatggcaaaattctgtcaaacatttaaagcagaactaataccagtccttctcaaactcttccaaaaaatcaaagagcagataatactttcaaactctttttatgaggctagcattactctgataccaaagccagacaaggacatttaaaaaaagaaaattacaggccagtatccttatgtatatattatgcaaatatcctcaacaaaatactagcaaaccaaatgcaacaacgcattaaaaatatcatccaccatgatccagtgttatttatccctgggatgcaaggacagttcaaaatacagaaatcaataaatgtgatacattgccttaacagagtgaaggacgtatgatcatctgatacggatgaagaaaaaatacttgacaaaattcaacatcctttcatgttaaaaaactgtcaccaaattaggtatagaaggaactcaacacaataaagactatgtatgacattcagctaacatcatactgaatgggaaaagctgaaaactttccctctaaggaccagaaaaagacaaacatacccactgttacctctctttctcattatagtactggaagtcctagccagcacagttaggcaagagaaagaaagaaaaagcatccagataggaaaagaagtagtaaaactattgctgtttgttgataacatgatcttatgtataaaaaaccctacagattctaccaaaaaactattagaataaacaagtacagtaaagttgcaggatacaaaaaatcaacatacaaaaatcagaagcgtttctatacacttaagtgaactgtccaagaatcaagaaaataatcccatttacaatcgctacaaacaaatttaagaataaatttgcctgggcactgtgactcatacctataaactgagcactttgggaggctgaagtgggaggatcacttgacaccaggagttcatgaccagcctggacagcatagcaagaccccatctctacaaagaattttgaaagttagccaggtgcagtggcatgtgcctgtaagtcgcagctactcaggaggctgaggtgtgagtgatgtccacaatggcctgtctggaactgcccctgcaaagaatccagctgcagggggggaggtgcagccaaagctgggtgctctgaggagcctgcaggaaccaggaacagcacctgcagccacccagcagtggctgtagaccctggcatccctgcgctatcagaagcctgggaagcccaccctgcccctgcaggctccaagacacctgctcctgctgcctggcctctccttgctcccggtgcctgctcccatttcagagcaaggttgaaggcgagctgaggcactcttgtgaccagtcaagtgtgtgcatgctcggggctgtgcagacatgccagctcccactgccacctcagccccctctgaaactttgggagggaggcctggggttggggaaggcagagggtggctggggcaggcctgttggctattcccctccacaggaatagcctggctgccctggttgacatgattgatggcagcaggagacagacaggctcctgggtggaaaggggcaggtccctggtgaagccccaccttcagactaaggacagcctgaagcgtgggtgctaggctgttagttccaggtggagtctgccagtcagagtgaaaacttatgatgctttttccagacccgccatggctgcccatggaccagtcaccatgtacttcctcccttctgaagcccataaaaactctggactcagtcagactcatacagaccgttgggactaccaggtgcgggaaggagctacccatttcaggtctcctcagctcttaattaccagcctgcagaaatcagccacccaccatgggtctcctcgccactgagagctggacactcatcaggacgacctgcctgcggaaaagagctacccacttcagatctcctgagagctgctctgttgctcagtgaagctcctctctgcctgctcaccctccagttgttcgcgtacctcattcttgctggatggtgagacaagaacttgggacccgccgaatggcaccactgaaagagcagtaacaaacagggctaaaacacgccccccactcaccacaatgcgggcgactagaaagaaagacgagctgtaacccttctgggagcccaaaccagggggctccttgagccagtgctgtgacaccctctttgtggctctgtgtatcctggcatctccaagcttccacgagccactgtgttcccaggtgtctccggtggaaattgcttgcggtatgcctggtccagccatagccttgcacgtagctggtgcctttgccagcgcctggggcagcccaccccgctgcagtcagcacgcctggctctgcgcagtggtcggaccccacgcttgctcacacacccgttgccactccttgccaggctcacccttggcaagtgtggatctgggccagtatcatgagctgaactcagtctgcgtgctcaagtggacagaatgagcccagtggaccctagcaaaactcaggcaaaggcgccactagccacagaggtttctggctggcaaagtgacaccccaaggatcccataatgggagatttgcttgtgcccagcagtaaagaggctacagtgagctatgatcctgctcctgcactccagcttaggtgacaaagcaagactctgtctcataaataaataaataaatctaactacacaggttcactgaaaactaaaacattgatgaaagaaattgaagaagacacaaataaatggaaagatatcccatgtttatgcattgaagaaactaatattcttaaaatgctcatattacccaaaattatctacagattcaatacaatccatatcaaaattccaacatcatttttcatagaaatagattaagaaatcctaaaatttatatggaaccacaacaaaaacttgcatagccaaagcaatcatgagcaaaaaaatcaaagctggaggcatcacactacctgaattcaaattgtactacaaacctatagtaattaaaaatactgtagtgctagcaaaaaaaattaaaataaaaatgaacacatccccagtggactggaatagagagcttagaaatgagcccatgcatgtatggtcaattgatttatgacaaagatgtcaacaataaacaatggcaaaggatagtctctttaataaatgatgttggggaaagctggatatccacatatagaagaacaaaattggacccttatttcactccatatacaaaaatcaactcaaaatggattaaagacttaaatgttaagaccagaaactgtaaaactcctagaagaaaacttagggggaaaactgcaaaattggtctgggtattgattttttggatttgaccgcaaaagtgcaggcaacgaaaacaaaaatagataaaggggattatatcaaatgaaaaagcttctgtacagcaaaagaaacaatgtacagagacagcctacagattgggagaaaatattttcaagtcatacattgaataaggggttaatatccaaaatatataagaagccgaaacacctgaatagcaagaaaattttaaaaaaaaacattaaaaattggaaacggacctgaatatacatttctcaaaaaaaggcatccaaaagtccaactgatacaagaaaaacttctcaacattgctaatcattcaggaaatacaaattaaatctgtaatgatatataatttcacacctctcagaatgaccattaccaaaaaaaaaaaatacaaaagataacaaatgttgatgacgatgtaaagaaaaggaaaactttgtacactgttggtggaaatgtacacatgtggaaaactgtgtgaaggttcctcaataaactaaaaatagaattatctgatgatccagcaatcccatttctggatattcacccaaaacattttaaattagtttgttttaagagatgtctgcacttccatgttctctgcagagctgttcacaatagccaagttacagaatcaaactaagatgatgaatggataaaaagtagagtatggtaaaattcaagattgctaagagagtaaatttcaaatattctcaccacaaagaatattaagtatttgaggtggacatgtttactggcttcatttagttattttgcattgtattcataaatcataacttcacttcgtattttataaatatatatagctattgtgaaaatacaacaaaacattgaaattgcagtcatattttaagaaggtataattttttgtaagagaattgaaaatgttttaaaaccacaaatttatatctcagtattgaccatacttaatggatcttgatgtgattaggcacatagaatattacatttagaagcaagaccaaggttttaagaaaactctttgtatcatagagaccttattatattatttagattgcacaggaataatagaatgtatgtacagctaagtggggcttagtaatcatcttttttgtgaggaataagaaaagttggaagtggaacaccatggcattctgtttgcagatggaaaacctgaccaaagatatcttcatattaatttctgaggcttccagagttattggagattttaggttactggatggggccttcagaaaataccatagttaattgtagactgctggagtttgaaatccagttcttccagttattagctatggaaccttggataacttatgtaatctatgttcctcactttctttatctgtaaaatatagatgataatagcacttctttattttctactttttaagaacataagcacttcttaggattgttgtgagaattaactgtactacttataatttagaactcagtaaatgttagctattatttactatatttaaaagcaagaaataagttttagtaatttacatgacaaatgttagtgctacttaacaatgcctgttatctggaaacttgtatttttaatcattaaagattaatatgattgaattcttttgtgatgtagactatttgtgatttacagagctattggttcttattaaaaaagataaactgcaatgataaactgtggattgatttgaatttgtagaaaatctgagatctttagcattacatgcatgtaaaaagaatactttattaagagtacttcaaactaggtaaggaaaataagagctaaagtatagttttcttttctggtttagtagtttttaaggtctccatccttgttatgtataacaaagactcagataattacctctgtttattagagttttgttttttttttttttttttcagaaaaaaatcttaaatggtatatgtgtatgaatatatttttattgcaaagtatttggggacctgtttataagaattttcttgctttttttttttttttgagacagagtcttgctctgttgcccaggctagattgcagtggcataatctcagctcaccgcaacctctgtctcctggattcaagagatcaattctcctgtctcagcctcccgagtagctgggattgtaggcgcacaccaccacacccagccaatttttgtatttttagtagagacagggtttcaccatgttggccaggctggtctcgaactcctgacctcaggtgatccacctgcctcagcctcccaaagtgctgggattacaggcttgagccactacgcccagcaacaattttcgaaactaaaacattaatagcctatttcatgtcatttttagtagttatgagagagagagagacgattcaagacttcataaaatttttgactttgtatttaaacagaaaattaagctaggagtgcttctccccagcctgccacccccactaacttaaggacaaaaaaaaaaaaaaaattaattctgagccatcaagggcatgtttctagttatatgtgaggttttcagtaaaattttcattatggaatataacatttccctcttttttgccacagtattttattgattgtctacctacacagtttacctaagaggatagcaaagcttacaaaagatataatccataaacatgattttagtatgtctatattgatttattgctgaagtcctatttactatatgttcaaagttccttcctaagctggtgggtctcaggattatctttaaagattagaaatataatcttagaaaactcaagaagtatttacataaatgctaacaatgagagtctagtaatagtcagtgttcatatgtgtgctttagatcacaattctacacggactgtagatctacattataatcaagatgcctgtaaagaatagagaatctgcctcagcctagttctgaaccagaactgtgggcatgcacctggggttctagattttaaagtgctactttggtccttaagtgcattacagtttgagattcatgccagatactaattgcatcatgcttgcatccttgtatctaagatattacatggtcattgaggtatgtttgtgtgtatcatggaagctttcaaatcattttgacatttagtatttgtattagaaataactcagtgtttttcatagacatctgtaaatagtatttttggaagttaatgtcttattaatatgtagaaactaagctaaatatttgcagtgaaattgtttctcaactggagaaaaagatatccttccttcatgctttttaaaaatacctgagccctggccctacctcatactaattaaaccataatatgtaaagaatatgctgagtgtgaatatattttaaaagtgtttcaagtgtttgattgtacagctgcaactgaaaaaccgacatctgcactaatgaccaaaaggagcaatgataattgctaatccaaaaatcatttatgtttggcttgagaatctacagtactcaaaaccacttacttgggaggatgagaaaggaggatctcttgagctcaggagcccaagaccagcctgagcaacacagggagaccctgtctcaaaacaaaacaaaaacaaaaagtacatattaagtatggcactgtagaatccaaatcctgtttccctaactgcattgtcaaggaattcacaatcaagttctttaggcaaaaaacactctctctggataatcacatttgtctattagagggaattttatttaaagggctttttttttatgctaagtttagcaggttggtgtaaagtactgactggggagatttaagtaataagaggaatagaattttgaatttttcatgaggacagaatactgaactaattgatttctatgattttggcttttataagcaactcaagtgtaattaagaatatttttgtaataattttgagcagggaaactattttttagaatggggctctgttcatgcaggacaccacaatttatgtattttaaatcgtataaaaattttgcatagaaactaggtaggcagatcaaattagtattatagaaagtactcaactctgtgacatggatcataacttacgttccacaaaatattctgattcttctaaacggttaatcttaatgttattgctgtttgtttacataaaatatgtcctataatacatccctttgcccaggcttattatataaagtcatgaagaataatttcaatttttttatatttaaactaaatgaagcaatatctataatctcaaattcattatattttcttatgcttctcttttagatgtacattgaagatgtcagtttctacatgtgggaagtagacattgaaggctttatggtttacagacaagatctttagaagataagcactaaaggtaagtagtaactatagccccatatataatttcatgtaaatggttagggttgtcagattataattcgacttgttaaacttgtttactttttatcactgctcctgtctaagttacctcacaactgcattcattcatattcagacacaaatttttattccataatatcatcttgacagaaagtatcagatttcatttgtaataagcggttgattaaaaaataataaattgtaatacacaagtgcaaaccagttaagaataaagaataaaaaagtaacttctggccgggcgcggtggctcacgcctgtaatcccagcactttgggaggccgaggcgggcggatcacgaggtcaggagatccagaccatcctggagaacacggtgaaacccggtctctactgaaaatacaaaaaaattaggcgggcgtggtggcaggcgcgtgtagtcccagctactcgggaggctgaggcaggagaatggcgtgaacccgggaggcggagcttgcagtgagccgagatcgcaccactgcactccagcctgggtgacagagcgagactctgtctcaaaaaaaaaaaaaaaagtaacttctatcaaacctgtgaatacaactcagcagaatttaatttgaaaaaataattaaacagaaaaactattattcattgcactgttttcatgtatttattaatcagcccctttaacaagttaagaacttgttctttatccactccaaaacactctgtcatagtttcatatactcataacattataacccctgaatacaaacctcttttcattttatcatggctcccccaaaatttctctttacctagcatattctttcacgtagcacgttctgttcatgcctcccatgactgcttacatacttaacatgactaagtaaatttctgagcacattttgttaaaatttcaagtgagatacaaggggaataaacctccaaaaacaatattttaatgttccttgccaaatggggacaatggaagcctggagagtatgtgacctgtaaacgggatgctcctattcagttctaggatccttgctaaatggaaatgagatgctgtaaaatcaattctcagtagtttttttaaagaacagaaataaatttgaaaaatccttatttttaaatgtcagcataaaatttttcctttgaaaaaaagtttacttttgctactacttaagccaagtaaaacagtttacagcccctagtgcaggagtgttttttcttttttctatttttctttattctcttagagtgcaagtatttagagtctattttttctccttaatttgtggttaactgtttaatgatttttgccagttttctataatgaatattattgtcagaaatgacttctcttgaaaacataagtgatattacttatttctaattcatttacatagttatatatggtgacttggttacttggaagagctattcaattgttttctgaattataatgattagataactatttttatggttccttcttctccacagtctaaatcagatccttctagtaaaaaaaaattatacatatatatatatatatatgtatatatgtatcttttactttaagagatgtagtctctttaagttgctcagactagatttgagctcctgggctccagcaatcctcccacctcagcctctcaagcagctaggactgcaggtgtgcattaaccatgccgggcactttctggtttttgttgttgttgtcgtgtgtttgtttgtttgttttgaggcagggtcttattctgttgcccaggttggaatacagtggcataatcatgggtcactgcagcatcaacctcctaggctcaagccatcttcctgcctcggcctcccaaagtgatgggattacatgcatgtgccacctcgcccggcatcttttttttaaaagaccttttacacaaagagaaagcagagttaatcacactcttaggtccatggggcactgtcattactggttcatgcaaagcacttcttgttttatttatttataaattttccagtctcattctcctgcccttgacccataggaaatcattctaatattatgatattctaaaataatatctattgtactgttctattttgtttatattttcataatgagtattgttttgcatgcatacattttaaaatttttatatgagaaatttcaaataaatgaaaaggaaaagagagaatattatgaaccgccacatgtctatatgtcagcttcaacagttagcatcttatggtacaatttgttttacctctgacctctcctcaccctgacttatatacatgaaatttaaataagtgtaagtgatttcgtgctgtgtatctcattgtgatccttactattttatttcatataaccttaagttttaaactttatttatgttgccatgtttttactgctgcttactgctacatggtaatccacagtatatggcagccatattttcactacccattttcctcagtgtttgccatccaaattgctttcaatttccttttaccacatgttcatcatgtcctatcgtggaactttgcaaggatttctttagaatatatacccaggagcagaattgctgggtgacagaatatatgtttatgattaatttaaccaatccctatcagatgcgtccccacataaatactttggtctttacagactccagcaataaccttctcatcatccatgccagcccttaacgttttccagcttactcatgttttcagtctaatgtgtgtaattttatagatcattgttttgagttttttaaaatcactattgagtttgagtatctcatcatatacctgttggccttttgatttccctcttctgaacttgcttctcatattctttatatattttttcatttgggttcaattgttttataggaatttgttgtatgtgctcgatattaatttcctatcagtttagatattataaaatatctgcttccattctttcaacttttaaattttatgcatgatgttctttaagtagacattcagattttaaatatcccattaaaaatattttcttgatgtttattgctggagtacatgagtgctactgatatttttaaaagtttatctttgtcctaactatattgctaaaccctcttattcttaacagattgttcttttttttgaaatagattattataatcatttgaaattaatgataatattatttccttccttcccatctttatatttaaactcctttcttctttcctatatctttttttgttagttcctctggaactatgttaacgagtagtagtgatgttggccatctcatgtctcatcataaaggaggtgaacctaaagtttctcaattaatacttacaaaatgttttttaatatataacatttaccagattaagaaaggttcttctatttttagtttgctaagcagtcttataaatagctattgaaccttaacaatgctttttattatgtgtatgttaaaataattataaggtattcatcctgtggtatattaatgttatgtattatatgtatagaatttctaatattaaaccatccatgcattcatagtttgcattatgaagtattacctgatcatgatgtattattctttaatacactgttgtgtttggttagcaaatatctgactggagattttggaatctatatttttaagttaaatgcagtgtaattttcttattttcctcgtttggttttataattaagattacactagccttctaaaatgagatgtgcatgtttgctccttttaagaaaggaatttactgtttcttttaatgtgtgctaactcaaatgtaaaactatctggttctggggattttggtgaggacatatctttgacaattatatacatctttaatgctttttggtcaattcaggtttccttctcagcttcttccactccccttccaatggcttttgatggcagctggtattcttctcaccctcaggtatacctcagactgagtttcctttgagtcaggaaatactgagcccacattgacattcacattcacattcacaggaaatctcagtgcccacattcaactgagccatgtaatgggcaccccgcttttggactgactgggaattgattgtcctaactctgaccactggtctctgatctgcctggtcttgcttcagttaaactccctctgccacatacctaaattaatcctgcactacgacagtatcctgcttttgtataactagaaatttcagttaataatgccctgaattgacttcctcatagctcttaaaacttctggttatatgtgtcaagatgaatattttgataaaagaataagtaaagcatcatgttcaggaaagtaagtgttgcagaagaaatgagcaatgatatggtctgatgtcctctacatttgatatatactatatatcaatttgatatatagtatgtatctgattgtagttaactccaggagattttccccttatcttagagtttgaaccatatagtgaccatgtattatcgaagaaaaatgaagggtatttccccttacaaaaagaaaaaggagtaaagatcataagcaggaagttcatggacacactaacaaaaataaatgaaatagtaattataatcataattgtttatacattacaatgtgtttcaccattttcaatatttaagtttttcccacactttgaatgttttctgaatttattttgaatcttttattactaaaaaaaaaattggatgtatatatatctctcctacaaagaatcttgtccattctgacatccctttgtctcttcatcttctcctaccccatcatttgctactatctactttaaatcctaaaccattatgcccctatgttctccttttcttagttgttggctatttaaaaaaacagcacattttcccaagacattttgtcagcattacttcacacgtcttttaattatcttccatatttgtttctatttaaggattttatcaaaaactgtcttctgaggtcttgtatgcttggaaatatatgtcatcatagcctcatagttgaatgactgcattgtcatatgtaaaaatctaggttttaatatttttccttcaatactttgaaaatccatgatattccctaatcacattgtaaaaaaatttttttaattaatttaaaaaaataaaatccatgatgtttttggcctgttcaactccatcattccttcaaatacatccttcttaattttttttttttttttgagaccttctgactctgtcacctgggctggaatgcagtgacacaatctctgctcaacctcctcctgggcccaagcgattctcccacctcagcctcctgagtagctgggactgcagacacatgccaccacgcccagctaatttttgtattttttgatagagatggggtttcactgtgttagccaggctggtcttgaactcctgacctcaagtggtcctcccgccttggcttcccacagtgctgggattgtaggtgtgagccaccagacccagcctatttttctttctgagtctcctgttattcagatgttagcactgtcaatcccttagcctttcttttatattttctatatccttgttcttaggtttgaagatttcctcaaactgatctttggattcattaatttactcctcatttaaattctattatttatccagtctatatacttcaagtattatatttttgtacctaatatttctgcgtgcttctttgttctcttgttcttattatatgccgctaatatcttcccttatctcttttagtatgtttattaggcttattttaagttcttgggacatcagatctaataattctgcttctcttagaatctgtatgccaatattttatttttctttgaaaacagttgtgcttcttcaatgtcttgatatgttgacctgtaaggtaatttccctctggggatattggctactatgacatcacatgtgggaagagactagtatccagtctggcattttcagtgagctcaaaggatggaaggtaggtagaaaagccccaggctacttgagaaatcagtttatcaaatctacaaaatgacacctcagatctctgcttcaccatctctccgcttctccctgatcccaccagggagaacagcagccaaagctatttattgtaatttaccagctttacggtttagtaggaaagggcagagaaattactacctaaggttagttggtctccacctgttttcctcagctttttataattatggtttacttctgagggcatttggactgtagtctgagtccctgtagatatgggaactataagttttttactcaagtcatggaatagtcaaaagcagaactccaatagttcatttcctgttttatcctcccacatatttgaaggactgcctcctgccccagatccaaggcccaagccaccagccagcacacttaccagttcaaaattgtcctttttcaccccactttcttccctgggagttttcgggttttcttatttcttggctttttttctttatatttcctataggagttggtctttggagagggaaccagacagtgtactattccaacatcttggtattatctttctgaaagaaactcaaacaaaagctatatgtatgtgtgtaccctttgacccagagattacatttctagaaatttctccaaaatgtattatcaagaactatttaatcatgatattggaaaacagtttaaatatccaaaagtgggggttaattaaatagatacatagtcatggaataaactattctgagtaatacactactgatttctggttttttaaaagattgatgctcaggtgtggtggctcatgtctataatcccaacactttgggagactgaggtgagaggatcacttgagctaaggagttcaagaccagcctgggcaacataatgaggcctcctctctactaaaaaatgtaaaagtaaaatatcagccaggcatggtggtacgtgcctgtagttccagctattcaagaggattgcttgagcctaggagatcttgatctgtttctaatgactatcttttctcttggttttaggtcacattttcctaccttttaaaatgtcttgtaattattgaattgatgggtttgcgtaggatagtttttaaatgtggatatttagcatgatttgcgtatctctgttataaagtacttctcaaactgtaattatttctttacctctataacacacagaatgttaggactgagaaaaggatgactggagctggcagttgaatcactggtttagttgcagtatagtactagaatgaaagtaatacggtttggctgtgtcaccactcagatctcatcttgaattccaacgtgttgtgtgagggacccaatgagaggtaattgaatcatgggggcgggtctttcatgtgctgttctcgtgatagtgaataagtctcatgagatctggtggtttttaaaaacaggagtttcccagctcaagctctccctttgccctctggctgattgtgaggcctccccagccatgtagcactgtaagtccattaaaccactttttcttcccagtcttgggtatgtctttatcagcagcatgaaaacagacaaatacaatgagtaaaaggaaataaaaaagaagcagtcacaatcctttcatgtaatttgtcaacaagagggtagatgcagcatcatggaggaaacactttacaatgctttgaatattacccaaatcaaattgcccttaaaaaagtaaagagaaattaaaacagtcatgaagaaaagagcctcaaattaaaatagagacttttagagattttttaataacaggacattttgccgttgtgatttggagaaagtttttccttatagtttttaaccaacttgagaatagacacgaagagccagatgggaagacaactaaatctaaacattttacaaaaccttgatagtgatcagcatctagccaagaattataagacatgaaaaagtaggaaaattaaccccaaaccactagaatagacaatcagtagaaacagagcaagaaatgacagcaataatgtaaacagcaaagactttaaaacatctaattgtacacatatacaaggatataaagtaaaacattaaaacaatgaagagagtcttagaaaatatattttttagctctaggaattcccacatctgaatggaatatccactggatgggtttctcaatgcaataaacattgccaattaaaaagatcaatagacttgaagaaagtatgaaaaactgaaccgctgctgggtacagtggcacgtgcctatagtcctacctactcaggaggctgaagtggaagaatagcttaagtacaggagtttggggctgtagtgtgctatgatcacatgtgtggatagccactgcattccagcctggacatactagccagtccccaagtctaaaaacgagtaagtaaagtaaagtaaaaactgaattagagagtaagaaaactgaaccctcccccttcctccataccccccccaaaaaaaaaacccagcacctaagtgtcctgatactatgaggcataacaaatatggaattggagttgcagaaggggtgagggcagaaaaaatatttgaacaaatatggccaaaattgttccacattggatgaaaaatagaaacataaaaatccaagttcatttaacttcaaatagaaaagaaaaccataccaaaacatatcatttctgaaaccagtgataaagagaaaagtcataaaagtaaatgaagaaaaaggcacatcacaaaatgcaaaacaaaaatgaactgacttcacatcagaaaaaatgcaaaccagaagataatggaatgagatcggtatcaaaagatgaagacttataaaccttaaattctataaccaggaaaaaacatctaaaatgatgacattttcagaaaaaaaaaatccactgagagaattcattgctagcagacctgttacaagaaatgttaaataaagtcttaaggcagaagaaaaatgatgctagatggaaactcgatctcttcagaagaatgaagagccccagaaattgtaaatagattggtaaacataaaagactgttgtttatatatttaaaaagataactgactgcttaagtaaaaaacactgaaaaataaaaatgaatattttgttatcacatatgtagaagtaaaatatatggcaatagtgcaaagaatgggagggataaattgtagtacaggtggaatattcctaatcccagaatccagaatggtccaaaattcaaaacttattgagtgcctacccgatgctcaaaggaaatgatcattggagcatttcagattttggatttttggattagggattctcaatctgtttaacacaagtattccaaaatttgaaaaaattcaaaatttgaatgaattctagtcccagacatttcagatattgtgtcttaagctcattatattattaggaaattataggctattatttaaaattgggctgtgataagttaaagatgcatatttaaaccctagagcaatcaccaaagatttaaaacaaagaaatatagctgataaatcaatagaggagataaagtagaatactagagaactggctaggcatgatggccaatgcctgtaagtaaacactttgggaggccaagggaggaggatcacttgagtccaggagtttgagaccagcctgggcaacataatgagaccctgtatctacaaaaaattaaaaaattagccaggcatactggtgtaaacctgtagtctcagaggctgaggctgaaatgagaagataacttgagcccaggaggttgaggctgcagtgagccatgattgcgccactgcactgtagcctgggcaacagtgtgagaccctgtctcaaaaaaaaaaaaaaaaaaaaatcaatcatttcaaaagaagacaacattaaaaataaaagaacagggaggagccaagatggccgaataggaacagctccggtctacagctcccagcgtgagcgacgcagaagacgggtgatttctgtatttccatctgaggtaccgggttcatctcactagggagtgccagacagtgggcgcaggccagtgtgtgtgcgcaccgtgcgcgagccgaagcagggcgagacattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgctcaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgagacttaagtgtccctgtctgacagctttgaagagagcagtggttctcccagcacacagctggagatctgagaacgggcagactgcctcctcaagtgggtccctgacccgtgacccccgagcagcctaactgggaggcaccccccagcaggggcacactgacacctcacacagcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctaatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcagcagaaaccctacaagccagaagagagtgggggccaatattcaacattcttaaagaaaagaattttcaacccagaatttcatatccagccaagctaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaaccagcaaaataaccagctaacatcataatgacaggatcaaattcacacataacaatattaactttaaatataaatggactaaattctgcaattaaaggacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacacagatcaaaaaagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattgaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttctttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgctaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaagctattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcattctgaatgggcaaaaactggaaacattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggagtccaacttacaagggacatgaaggacctcttcaaggagaactacaaaccactgctcaaggaaataaaagaggacacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagcaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaagcaaacaaccccatcaaaaagtgggcgaaggacatgaacagacacttctcaaaagaagacatttatgcagccaaaaaacacatgaagaaatgctcatcatcactggccatcagagaaatgcaaaccaaaaccactatgagatgtcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcgcaagaacaaaaaaccaaacaccgcatattctcactcataggtgggaactgaacaatgagatcacttggacacaggaagcggaatatcacactctggggactgtggtggggtcgggggaggggggagggatagcattgggagttatacctaatgctagatgacacgttagtgggtgcagcgcaccagcatggcacatgtatacatatgtaactaacctgcacaatgtgcacatgtaccctaaaacttagagtataataagaaaaaaaaaaaaattaaaaaaaaaaaaaatgaaagaacagatggaataagtagaaaacaaatagcaaggtgctaaacttagaaccaactatatcatcactatattaagtataaattgttgaaacactcagattaaaaggcttttttgttttcatcagactgataaaaacccaataaacaactccaggggttggcaaactttttattaaaaggacacattataactattttaagattaaggtccatactgtttctgtcacaactactcaactctcttatcagagatcaaaatgtaaacaagtaggtatgtctatgttccaataaaactttatttgcaaaataagcaattggctttttgtagggggttagatatagggggtagactcctgctatactaaatagaaggagtgcattttaaatataaaaacacaggtaggttaaaagttaaaggatgtgttaaatataccatgcaaacactaataatcagaaagtcaaggtggctaaaataatatgagaaaaagtatatgtctggacaagtgttttaacagagataaagaggaaattttataataagatagttcaagaggatttattctcctaaatgtatatccacttaacaatagatcttaaaaatatatgaagcaaaaactggtaagagttgaaagaagaaatagacaattccacaattatagttagatatttcaaccttcctctcccataaatggttataacaagtaaacagaaaccaataagaaaatagaaaccttcaacaacactaaaaactaacctgaccgaattgacatttgtagaacatatgcctaataacaacagaatacacatttttttcactgtgtatagaacattaatcatgatagaacatatgctggcccatgaaaatcaataaatttttaaagattgaagtcatccagagtatgttctctgaacaaaacagaattaagttataatccaataccaaaaaagcaggaaaacctctcgatatttggaaattaaacagcacacttctaaacttatgcgtcaagaaaaaattcaccagagaaattagaaaatatcttgaactgaattgtgatgaaaccacaacataaaatgtaaaatgcaactaacacatggcttagaaagaaatttgtaattttaaaaataaaagcaaattaaactaaccaaagtaacaaggcaacaacaaggaaataacataaggaatggatgggaagtcattaaaatagcaggtgggagatcttgatgatgacagccctcaagctgagtaacaacttgttgcagtctggcctggctgttatctttgcacaggtatcattggtatcacttatcctcttacatgacgatttcctttctcctatgttgaaactcatgtttcttaatcttttgtttttttccttaatttgccgtctcattttttggagcaagtcctccaggaagttcttgagaaagaatgtataggaggtaattttttgtaatagttccatttctcattgttttaaatttccatggatgttagatctttccactacggtttcatttatattgccgtaatctgttatgactagtgtaggtaattagaagtagctattttaaaatatttttgtgccactactaaaaaaaaatggtttcctttatgtaatgcctataactatatgagggaagcattctgaaagagtccctttcataagaaagaaaattccagaagacattggtattaaaagaatcaatctcttaggtaagctttgttactcagaattgtgtttaccaaaataggtacatctccatttgtgtctatttcttctatgtaaaattaaaatttttgtcatcagcaataacagtatgacttagtatctttaaaacttggtgtcttttatgaaatgcaagaatgtagatcatatggtaacctagcttaccaaatgggaaatccgtgagccagagctagccatgattcctcttgttattttctatgaatttgaatgaaaattgcctaattcattcatgtttgggattattttattgtgtcagacaaagtaggctcttttataagcaaagggagtgggggtgccatttgcactggtgtgtgtgtgtgtgtgtataaacaaatctgtatgtaatatagattgtatagcatttggtgtacctccatccacatgtgccaaaattggaaaattaatatatctcacttgaacaaaagtatggcaacttatatttgccaaaaccagctacagaaatattccagatcccacatgctctttatattctttatactctcccatcaagaggtagattccatttcccctcctcctgaaatttggcttctttgaccaatagaatatggtggaagtgactctaggtagcttcaaaggcttaggcataaaaggcaatcccgttctgctaggatctctctcagaatactcacccttgaaatcccagtccccatattgtgaggaagactgagccacgtgagaggctgcaaccacaccaagcatgtgatggagcaagttttcagacgatttcagttcccagccttaaaggtgccccagctggtaccaagtggagcagagacaaactatccctgctgaactctgcctaaatttttaaacaaactaatgattgtttgttatgcagcagtaattaattaggacaaaaaaaggttctgtttccaggtaagtttggaaagtaccacattaaagaacagcaaaggaagtttccttcctgcaagaaagccttcagtgtgctaatgtgtgtaatggtctccaagatcatatagcatacactttgcaaagagcatgttagttctatattccatggaacttaacttgggaaacccttctccatattcattattttaatggttacgtattctattaataaagtatgatgcttcattcttctgtgcttgaacatttaggttacttataacattttgctgttatatgtgatttagtgttttctttcttttatttatttccttaggcactattctttggagtagaattactgtgtcatagcatctgaggtttttttttttgtttttttttttgttttttttttttgagacaaagttttgctctttttacccaggctggagtacaatggtatgatctcgcctaactgcaacctccacctcccgggttcaagcgattctcctgcctcagcctccagagtaaactgaaattacagggacccaccaccatgcccagctaattgttgtgtttttagtagaaatgaggtttcaccatgttggccaggctggtctcaaactcctgacctcaggtgatctccccgcctcagcctcccaaagtgaaattcttaatgactggctacactaacttatgaatgccataatcaatacagattttttctccagagtcttgatagctattaacattttcctctttttttcactaaaacataaaatggaaatataattgttttgatttgaatttaatgtctatcaagattgcatcttttttattgccttcgtatgtgtctgtagatccaacatgtttatcaccacaactacctgagttctaatggtcccaagacaactctaccaccaaatttctacctttgtttctcaatgtctctgtgcattggcttcctctgtaaatgggaatacaaaaattacctgtttcaggttgttacaaggagtaaaggaaataatgtacataaagcatttggtgaggttttatatattatgatatcataatatataaagaacaataaataagtctaggttttctcctatagatgagttacagtgatttttacatgttttcatagtaagttcatcatatatattagatataagcactttgttttattttttattgtcatttttcttatcttttgatttcattctatgaaagttataaatatttataatgaaatggcaaggaaaaaagcttataaatgttcatatgataacttctgcttcttaatggttaaaagtacattccatctacctatgaaattaaaatattcttctataaattattccatcaagaaagcatcgtgctatgagctatattaaacacagggatcataagaggacatgatgactttcctagagtagcttctaatctggtctaagaggaggattgtattgttcagggttctccagagaaacagtaggggggaatatatatatgtatgtatgtgtatatgtatgtatgtgtatatgtatatatctgtgtatattatatatatatgaatatatcatatatgtatttatgcatgtatatgtacatttatagaaatttatttcaagatattggcttaagcaactaagggactggcaagtattaaatttgtaaggaaggccacaggctgaaaactctcgggcaggagctgatcctgcagtcttgaagcaaaatttcttcttcaagtatatctcagctttgctcttaaggcctttcaactgagtagatgaggctcattcagattgtggaagataatctcctttacctaaagtcagctgattgtaggtattaaccccagtattgtttaactgaataaccgggtactctagcctatccaattggggcagaaaactaaccatcacaaaggcaaataatatggcagacttttaacagtaattttcatattaatacatttcagcacttcaatactaagtcattctttaaattgtggcctttaataaataaacaaataaaatgaataaactaatatgttgaaagggaaaagatggccaggcacggtggctcatgtctataatctaaccactttgggaggccgaggtggatggatcacttgaggccagagtttgagaccagcctgggcatgatggtgaaacctcatctctacaaaaaatagcttggcattgtggcttatacctgtggtcccaagttaccctagtggctgaggtgggaggatcacttaagcccaggaagttgaggctgcagtgagccaagattgcgccactgtactccagcctgggtgacagagtaagaccctgtctcaaaaaaaaaaagaaaagatttgttttcaatataaatgtcatggatttctttattatcccagctctctataacatatatcctatgagtgtctctctacaaaaagaaactatcatatgcggtatacaaagtatgactaagaaataaagtgatttgatttttaaactactacatcatgccatccaaatgaatgttaagtcttccaaaataatcatcttaggaagctgtacatttatcttatgatagaaaaattccttaatcgtttgcatatcctcttttaaaattacctcctcaatctgaagtgcattattttgactatattgatagtttcctcaccttctttaaacttttgctcaaatgttacttcctcagtaagaattactctgaccattctattttaaattgcagtcccccccttaccttgctttctttttcccccctaagatttaaattttctaatgcatatgtaatctacatatttattgtctgcccacactagaaactacgcaacaccgaggcagggtttttgcaatctaatagaggtactttctcaaagagtttgtagatatacaatccagtttttataaaaatgtagcacttaaaagcaagtctaattcagacttaagttgtttttgaacagaaatgtgatctggggctgggcgcggtggctcatgcctgtaatcccagcactttgggagccccaggcaggcagatcatgaggtcaggagattgagaccaccctggctaacacagtgaaactccatctctgctaaaactacaaaaaaaattagctgggcatggtggcgggcgcctgtggtcccagctactcgggaggctgagacgggagaatggcgtgagcctaggaggcagagcttgcagtgagccgatatcacgccacttcgctccagcctgggtgacagagcgagactctatctcaaaaaaaaaaaaaaaaagaaatgtaatctggtttcaacacagaaaaaaaaagacattatacgtatactgatgacttttaaaaatacttcgcacatcattaaggaacactttaaatgtaagaacttctaaagaagttcttctgatctaaatagttggcctttgtatactttattttaacctattaaggcacttttttaaaaagctgctttaaaactttttttaaaattcatcattggaaacatgatccatttatttatttgttaattcattcatttaaaaataaagcaaagttgtgtaccaaccatctgccagggattattctagagatgcagtatttttcttgattactttgccaaccggagacctctggccaatgatgcccctccccaggccttgctcaggcctgggcttgccacaggagatgccctgtttacttgacacaccaggccatgcctggcttgccccccagcatggatcccacggctcctgcaactgcgtgctcagtccctggcaggaggagatgtgtgtgccagtgaatgcagggtctggctggccattccaagcactggcacaagagtgggctccacatggggcttgttcctggaccaggtgtgttgcaagtgactcccacagtgggctctggtctccggacgagggaaacacagggacacccaagcaggggtacccacgaccctgaagccccagagggggatgttacagcatgctaatgacctcttttagtcccattgtctgcagcccgacagacagaggcgccttaacaactctgtcagcccggttgccctgctctagcctgcacctccagggctgccttggccttgctgctgcttcttgtcatatgggatggctgccctctgctggcagagggccacagtgttacagccttctgtgtacccgcgttcagtcggtccgaagttcttgtcctgcatccaagaagaatgaggttatgctgacaatcaaagggtgagaagggtggagaaaaattttattaagtgacgaaacagctctcagtggagaggggatgcaagagtggtcccccacctgaagttgggtggtttctctctcagtgtggctggatctgaggcttttatgggctcagactgggggagtgtgtgctgattggtttgtgagtatgcaaaaaaggctaaaacaaaggctcaaggggcacaacagtgtagaaaacaaattaggaaagggtaggtacatgtaaaataagtgaagggtagggatgaatcggaggaaagcatgccaaacaggaagagaagttctcagtccggtccttggatttacctgagatttgtagctaggctttaaactgtcattggcttgaaggttgggtttcactggccctgcctctatctgcctaggcatttgactgcctcctgccactatcactaggagctggcataaacagtgaaggagatggagtccttgcctgcatggagcttactaccttattagggaagacaaacaataaacaagtaaataattacataatataatttcaaaatatgatatgttctaaagagaaaaataaagcatggtaaatagatagaaggtaattgggtttggaattggaagtcctattttgataaagtggtcagggaggccttccctgaggtagtgatattcaagcagaaacttccaagttgatggaagtggtgagcaatgtctagaagagtgacctaggcagcagaatggaacagcaaatgtaaagactgttgattcagcaaaaacaattgtacttgaggctcaacaagaaatctagtctgctggtatggagaaagtgggagaaagagtggtttgaaatgaggttgaagggattacaaggccagaaatgtaaggggcttatagatcatattaaagaattaaaaatttaggtttaattttaatcacaaagagaaactattagtgagttttgcacttgggattgatgtgatttgagaaatttaaaacatctttggaacatatattggatttttttagaggtaacttcaatggtaaataacttttttgtttaaaaagcagttctttaggccaggtgtggtggttcatgccagtaatctcaccactttggtaggctgaggtgggaggatcacttgaggtcaggagttcgagaccaacctggccaacatagtgagaacccatctcttaaataaataaataataaaaagcaactctttaaaagctgtaaaatagactggccaacatagtgaaaccagtctctactagaaatacaaaaaaattagccagatgtggtggcaggcacctgtaataccaggtactcaggaggctgaagcaggagaatcgcttgaacttgggaggtggaggttgcactgagccaagatcgcgccattgcactctagcccaggcaacatcacgagactccatctcaaaaaaaaaaaaaaaaagctgtaaactaatgaatttttaattttttaccataacaatttttaatgattaggaaagttcacaaatgaaattaaaaggcactaatgaaattaaaaggaaacctgggaactaatatttggtacatgcaacaaagaagatgctgattttcttaacatgcaaagagttgtaacaattaaatgtgggaaagatggcctatttgcataaaagacctgaaaatgcagtttatcagagaagaaatgcaaatggctaataaacctgtaaaaataattttccacccattcccttgcactctgatgacatttttctagtgctcgcttgatgtctgtgtgttttgctattctttttattcttttcctgaattatctttgttattactactgttcttcttctgttgctcatgacagaatataatggttttacctagctacctattttcaagaggtgcgtgtgcattaggaaggagggtcaaggaaagggtgggttcacattattgttgcaattttgcaagtcttcacaagaaggtaatctccgctgcaacagaaacaaaatacttcctatgaggatggcttgtctgtggatcctttatgtagccctgtcttttatgcttctctaaagctgagtctagcaagattctgctgacaactcatctcacctttgttcccatacttgtgattataagcaatacctgtagcaacataaggtatgttatgtgtacgatcagagaatagattgtggacatcattttcttggatctacactgcagagccctttaccatggataaatttctccaagactgcttctgttcatgtattttcatgtggctccttctaattttgcatccccttttgcctattttagagtataagggtcaaacctgaactctaattttgctgaaaatataatgcttaactttcttcaggaagaaagaaaaggagagagggaaagaatgggagaaaagagaagagaaaaaatgaataaagcaatcacctttgttggaaaaacctacaatccagaaagcaaggactctggaaaagacatcatgaaacaatagtagaagatgaattatgagctggccaaacttaggaaaaaaggatttatttcaaatatgaaattggaaggagcacaagaaaggctagacatcatggaaagcaccttaaggaatattgtggattaaaatgtgaagaatgaataaaataaaccaaagaaaaaaaagattagaaataaaattttgtgaatgtatatagatagactgagacagagaaagacacaaaagaaaaccaaaagagtagaaaagaatgaattatttaaagataagactcaataataatttaaaatataattttgatctacatattgaaagagcataccatggaccagggaaagttgacctagaactgtcaatactgagacatgtcctcataaaatttctgtacattaaacatgaagaaagaatagtcaggtcaataatagaaggggaaaaagtcagacttgtgtctgtcttatccacatcaacatttagtaccagttgccagtggagtaacagctacaggatcttatagaaaggaaagtgtttaatattttaaatttagcccaaatgtcttcaagtttaaatactaaagacagttttgaactcaacaaatataaagacagttttgaactcaagaaatactttttgaaaacattcttagaaaatgagctactgccaatcagatataaataaacaggaaaattatcatagaaggtctgtcagcaagcattgaaaggatttaactgtaaaagaaagactaaaatgtgggaattagagctaaagaacaaaatgtagacactatatataaatataaatataaaatgtttactaaaattccctaaaaataaaatatattccctaaaaatataccacttctacctgttttctccactttttttccccagtctttacaattgtcttattatttttattttatttttttttgagacaagtctctctctgttgccctggctagagtgcagtggcgtaatctcggctcactgtaacctccacttcccaggttcaagcgattctcctgcctctgcctcccaagtagctggggattacaggcaccccccaccacacctggctaatttatttttatttttttgtatttttagtagagacggggttttaccatgttggccatgctggtctcaaactcctgacctcaggtgatccgcctaccttggcttcccaaattgctgggattacaggcgtggactaattttctcatctttaatacttggaagtcaaagaatatcaattaaagctgacaaaaaataaaagtatcagcataatttaacaatacaaggaaaaatagtgaaaaacattaactgaaatatgatgaatgaaagaaaaagggcagagtaatagaaagcatgcaaatattataattgcttataacagtgaactaatagattttgaatacagaaataaggacagatataaattacatgtttatttgtaaaaacaaagttgcataaaattataaacataaccactggaacaaagatacagagaaattacccatggagaaaaataggataaacagtaccaatgatatttttgtttaaaaatatgtagaaaataggcaggctgcaatggctcatgcctgtaatcccagcactgttggaggccaaggcagacgtatcccttgagcccaggagtttgagaacagtcagggcaacatggcaaaaccctgcctgtacaaaaatacaaaaatcagccagtgatcccagcgacttgggaggctgaggtgggaggatcacttgagcccgggagttcgagaccaccctgggcaacatggcgaaaccccagctctacaaaaaatacaaaaattagctggtggacccagtgacttgggatgctgaggttgggaggattgattgagcctgtgaagtggaggttgcagcaagccgagatcgcgtcactgcactccaacttgtgcaacaagagtgagaccctgtctcaaaaaaaaaaaaaatagagagacacacacacacttgtatatgtagacatatatattatatacacacgcatatatatgtatacagagagaaaacaaaataacagaatgaagaacaattctttctgttagatgcccactgtcacattatcatttaacattttactaaggggaatcagccaagagaaaaattaatgtaagtggattttaaaaacatgttttgttgaaacataattatacacatttatggggtacatatgatgttttgatacatgtatacagtgaataatgatcaaatcagggtaattgggatatccaccacctcaaatgtttaccatttctttgggttagaaacatttcaaaccttctcttctagctattttgaaatatacaacaaaatattcctattttgctattgaaccctagaacttattccttctatctaatggtatttttgtacccgttaaccagtctctctccatctcccctccccactgccttcccaacctctcactttttaaaaagtagatttctgaccaaatcatagagcactctattctctgatatgtttaaaagatacaataaagtatcttataaatgtcaaaacataaagatgaaaagccagataaaggtaagcaaggtatttatattagaccagagaaattcagtcaacaaaaatgttaagtgaggtgaacacagtctcattgtgaatacacatgaagatgaagcagttatgaatatctacaggttaaatagcatggcatcaataattggaaagacaatgcacgtaccattgaaaatagtcagaaacactgaatacaggttcagctgcttgctgtttgcaaaaccaaattacaaggacaaagttcagtggaagaaaagtgactttatttccaaagtagcattggggaaatggtctagacttcctgccttaaagaaaccatttcaaatttttggccagaatacaacaagttaaaagtgaaatttggtatgaaggatgtgcaggaggggcaaggaggtacaggaccacgtaacttgcttcagtgctttattatgtgctattgtccaatctggtaaatgggctagcattatcttgagcatatataggttgtaaattaactgtacactcacataatctcttgttgggagaaaattgcataggtacctggattgtctcaagattcaatcacagaaacttctaagcagacataattagataagtgagcagtgcaagggagtgcctgggggaaagaaggagagtaaaggtcattattttattattaacaagaaacaggcaccaaataagggagggaagtaaaaaagaaaaaaaaaggacaaaaaaaaaacccttaaaaataggttactcggttacaacaccactagacttggaaaagttactaattgtcccctcagtccataacagatcattcgagggtgggagatggtggaagaatgaggaaacactggaagcatttgtgcaaaagtcaggaacattgcaaagatacccactggcgtgactattatttaacattgtactaaagggagccagctgagagagatactagaagttaggaaaaaaaaaaaaaaagatgacgttaaacccctgggtgtagatgacacgattatatacctgcgttcatcacccaaaataaaatcaactaactatcacaaataaattccctaagatatatggcatgacattaatatatgttcatatagataacttttcatgtataccaaaataactttcagttaagccctagcaccctaaagcatgttgtttgtgtattagtgtcctgtggcttctgtaacaaattaccacaaacctggtgtcttaatgcaaaaaataattattttcttatagttctaggggccaggagtctgaaatcagtatcactggacccaaatccagtgggtccagtgtgttggcagagccattctccttctaaagaataagctgtttcttacctcttccagcttctgctggatgctgctggggaattattattaagattagttaatcaattgattttatgtagtttgtatattattcaatctagaaaacatggaataaggacactctaccttgtgtttgtttcccctatatacctacttttattttattttactttatttcattttattttttgaaaatagggtcttactctgttgcccaggctggagtgcagtggcatgatctcagctcactgcaacccctgcctcccaggttctagtgagattctggtgtctcagcctcccaagtagctgggactacaagcatgcgctccaatgccaggccaattttattttaatttttagtagagatggagtttcaccatgttggccaggctggtctcgaactcctgacctcaagtgatctgcctgcctcggcctccccaagtgctgagattacaggtgtgaaccaccacgccaggctatacctactttatatgactgctcatctcttttaggtgaaatgtgtggctggaaacaattttgtgatcttgctgcctttttcatttttggttatctgttctttttttttttttttccaaggttgcctgtaaacatcacttgactattacaattatttttatagattacttttacctgatggttactttaagggactcttcattccccagcttttctcttcaactacttatttttttagaaactttaaaattaacttttatagcaaagcaaatatttccatgaattataaaatgaatagaaatagtatcatcaaatacctctgttctataaattataatcaaaggaatttatttgaagcaaattgtattttaattgtctctagttatgttttcacatgggattgattaaacaccgttatatgtgatactacattttttcaaatccaaatgttatttttaactttcattattacttctgtcttttcattggcattggcataatatattgtaactttttcattttgattttaccatgaatagatagtttttaaattacattctaaaactgattatgttgacataggagcatacaactgaatttgctacatatgatcattttattatatatctcattgtgttatttgagatttgtagttttgtgtattacttagtactctagtcagaatgtttctgtctacccaaaattcatatgatgaaatctcattcccaatgcaataatgttacgaggtgggacttttaggggccaattagatcatgagggcagatccctcatgatgggattagtgccactataaaagtggcccaaggaaacttgttctgccatttgaggacacaaaaaaggcaccatctatgaagaacaggctcttgccagacacagaatctaccagttccttgatcttgggcctcccattccccagaactgtgagcaataaacttcttttttctttctttttttttttttaataaattacccagtgtaaggcactttgttatagaagctcagactaagacactgtgttaggttatttttgcattgctataacggaataatgagactggcatttataaaggaaaaagatttaattggctcacagttctgcaggctgtataagcatggcaccaacatctgcttggcttcttatcagggcctcaggaagcatacaaccatggtgaaaggcaaagcatgtcacatggtgaggggaggagcaaggggcggggggaggtgctacatacttttaaacaaccatatttcacatgaactcagagtgagaactcacttgtcaccaggggatggcactaagccattcatgagctagctatttgtccccatgatccaaacaccttccaccaggccccaccttcaacagtgaagattacatttcaacatgagattttgagaggacaaatatccaaacacatcaaacacatataaaatagaaactactacctcttggaggaaggcatttgtttttcattgctttttagttccaactaaaattctaatgtggactttaggaagcctaacaaatactttttgatcacagtatgttacataatagatcttaattttattttcatttcacaaagaaaagccataaaactacttatttagagctacaagcattagcctaattcctacattttaaataagacttacaggctgattttcatacaaaccagttgctactactaaattatcttcatttatgtataccctacccctttctacctccaatgttaaggatgtaccatttagaaaaaaactggttaattctttttttttgaatacctcaaacatacctcatttattatattgttcaagagataataggtcttataaaatgactggcaagctcatattttgctaaattacacagatccaattatattttatacttttttaatattgttaaactttttaaataatattaaacttgtattatcttaataggccaaaacaataacaatttttaaaaattgtgatttaccacatattagggtaaatattgggagctgcttaaatttagctcatgtcatatgttagaatctagtaatcatcttattatattataaatcaaagtttacccatttattttacttatattgcttaacctgaagaaaacacacaaattataaaaaataacttagatgactatataaacattggtaatgtaaacgttttatcttgttaatttattttctatgaatattaaagaaagtatgctgattttttgttacatatatacttttttcacttctactaaactttcagttgtatctagttttgattacttaagatcttaaaaaaatcctgtctttagatagttccctttttatatgtatgtataagagaagattatgtgattgtaaattcagtgtagactttcccaatctgctgaagtaaatttttctccttatccattgctaactagctgtaatctgccagtggaagggatcattcagcatattttcatacgtgaatcagcaaaccaatttataagttttattgagtaatattttatgcttaagcctaatacaacatcagtctaggacgcaaatgaattgagatagatttagggggactttgctgtccctttctttctttgtttctttttttctctgtgaattatcctttacatgttaaagctgaaggttgttcaaagttagtttccagtttcttcattctttcatttttctagttggatcttcaaatttacattttcttcagttttcagaagccatagttcacagtgatcctattgtagtagctttgaattcatttataaacattcctaacttcatttggtataaaaagaatgtaaactttggactcagagaaaactgcaagattaactctttaaaactactttcagcgtttgattgaaattttcgatttttgttatattttttggaataagcacactgtggcccagacttgttctttgattattttcctgtgtttatttattcatactaattatagatgttccatgattatatttattttaaaatatgaagtatctgaggaactcttttacaatttttttttccagtggatcttacaagatccatgtggctattcaaagtcacaaacaagtacatccctacaataactcatcttgatggcttattttaaatactttaaaatgtgcatgttcacgagataaaaaaatatgaatttcttttttgaatcaggatctcgctctgtcacccaggctggagggcagtggtgtaatcatggatcagtgcaacctcaacctcccaggcacaagcgatgctcccacctcagcctcccaagtggctgcactacaggtgtgtgccaccatgcccagctaatttttttctgtattttttgtagagacagggtcttactatgttgctcaggctggtctcaaatttctggactcaagcaatcttcctgccttggcctcctaaagtgctaggattacaagcatgagccaccatgccatgcccagcccactgttttttaaagaaaagaacagctttattgagatataattcatgtcataaagttgaaaattttaaattgtacaatccagtgcttcttagtatattcacagtgttgtatatcattcactactgttcaattctagaacatttcctcactccaaaaagaaaccctgtatccatttcctactctatttccctcaactcctagtcctggcaaacagtagtctactttctgtctctttggatttgcgtattctggatgtttcatttaagtggaatcatacaatacatggccttttgtttctttcactcatggtaatgttttcaaggctcatctgtgttgcagtatatatcagaattccattactttttatagccaaataatgttctattatatagatatacagtactgcattttatttattcatcaggtacttagagtccattctttttgaatcactatcaatcatcaatgataaaaagcctgaaattatagtttggtatagagcagtctttgacgtgtattttagacattaaaaaggtgtgtgtatgtatatatgtgtatgttttaatttttgtatgttttaatcttacctttcaaaactctaaaaaattcttagttctaaaacactgtgattttccaaaggttttggatgagggattttttataataacttgaaattaagaaggaagaggatttggtcatctctagaggaaaatttttagcatattcattttttctaggtaaacattcactagaccctttctttcttctctttatatctctaaatataaggcatctcattgacaacaattttaattctctatctttcttccctcatctaattggtcaggatgcccagtgtgttttaccttattaatagttcctatttgttcgttcttttctgttctcaccaccagaaactgagttcatctttattctacatgataacagtggcttactttacctgtgtcagagaacttatcaatctttgtactcgtctccttccagccaccagccagtaagctctttgaaagcaggaactgccgtttttctcttggctttcttccatagtggctggcaaagagttgtactcatctcttagctgaaaaaataatgatgaacaagtggtatgaataatattatcacttaattttttccctattctttagtatagtgttcctcaatgtttcttaggaggtaaaccttaagattttcaaaaaaggatgttattattttttagctacaaaaatttgagaaactatattgtcaagaattatatcattaaatttattttaaatataagctaatatgcataataaagacattaaaacattctcacttttagtaaatgatctgcttttattttactttaaattatgtatggggcagggagcagggaataggaggacttaacaacagtaactataaaagtcagatgatacttaaacagtatttgactttgaggccaaactagtatttaggtggatattgaaaagtaaatttaagttgccgcatcaaaagtacatgcaaaactgtgtttatgatgttacattttagagttttttatattttattctttctaaattaactgattttaatttctaaaccagaaaattttggatttgatcatcaccaaatttcttttaacacagacttttaacgtatttgagacttaccccttttaactacataaatacaactttttgatatggtgatggtcatcttgaggcaaatttatagacatcaaagaatgtttatgcttctcattaattatatgtcaccaactgttttttttttattctgtctttagccagcaatctgtgagtcagtaaattttaaaatgtcagactgagaattaaataatttaaacctgtatattaacaaaaaataccatgatgtctagaggtcatccaagtgatcaactgactgagtggctaagatgtgaacatgcttcttaggcctctaggatattcattcatttgcctcaggtgctttcaaatcattccattttaaagggaagaaatatttaaataactatgcatttactcatttttaaaattataagttaaacagatgttattactgcctttaacattaactctgtgaccttctaggtgagaggccaacaaattttttctgcaagaggccagacggtaatattttaggacttgagacccaggtctttgtggagctactcaactttgcttttgtagtgtgaaagcagccataggcagtacataaataagcatggctgtgtttcaactgtatttatagacactgaaatttgaattttatgtaactttttgctgtcaaatatctttcctcttttagcatgttttgaaccatttaaaaatgtaaaaacaattcacacaggcaatataaaaacaggtagcagattggacttactccatgggctgaagtttgccaacttctgcactaaatggttcaattcattggttggaaaaatctgcttttgtaattcattcttaaatttccccagtatcacatctatcataccaccccaaagttcttgctaatctgagcttatgcctgataaccaaaagtgttcaatttgttaccagtagctcctatatgacccctgttatgttgcttctctaccccatgtcacaagtagattatggaagtaaataaaaagaaatttcaacactgtctgctgtgaaacttgtcttcggttgtgattaggtaatgtggtataaaggaaataaaaccaggagatgtgaaaaccaggctatattcctggttctaccactaatcaaagtgatcaagtttggtgggcctctaaggctccattttctcacctgcccatcctgacagattattaagaagttataatagcacatatgaaattactggtaaggtaaccttagcattgctatttacctttattgtcattgtggtagttagtagttgtactttattattgctcttaaacttgactatggcagggctcccttcatatgttaatatatcacttaaaactagatataggttaaggattgcacattaatttcctctaagcattttgtgtttcttactctcacattttaagctactctaatctcctcgctgtggtacttgtaccaggttcattactaacagtagtgtgaaattttatattctacatattctttcttaccactactctgtgagggcaaagactgtctgttttgtccctgctacatcgccagcccccaaaatagtgtctggaatatatttgagcacttctgagtaaatcagtgacataaataatcccatatgttcacttgccttgaattatcaaaaggagtaaacaaagctcaatagaaataaaatgttttaatgcataaaatacataagattatgaaagatatctactttgttcagttttactgatatataatttatccacagactccttgtgggcccatggaccctgtttttgtttgtttgtttgtttttgtttttgtttttgagtgggcaggttgtgggcggggttttttttcgagacaaggtcttagtctgtcacccaggcaccatcatacctcactgcagcctggaactccaggcctcaggtgatccttccacctcagcctcccaaatagctaggaatgcaggtgtgcagcaccatgcccggctaattttttttttttttttttttggtagaaacaaagttttgctatatcgctgatctcaaactcctggcttcaagcgattttcctaccttagcctcccaaagtgccagaattacaggcataagccaccatgcccagccagaccttggtttttgaaaatatggaagaatttttaatgaatatcaggggacacattgtccacaactataaattgcaaaactactttgataggatataaaacaaatgcaagctttatttggtcttgtctttaagaaatcctccctctgcacttttaaattataacagaaaaaaacaatggatttttaaacttttggttaaatttcttaagattacaagaagaaaaacaaattttggcaagcttatacaaaaagggtattttctggggaaatactggagtttctaatgcaattggaaggtgggaagggagggaacaaagatagctctggacagtagctttctccagagtggagccaatgatagaaatgcccagtcatgggtgcaaatttgaaaatattagaagagaaacctggccgatcaagcttagatcacagatgcatgcctcaactggtcagccagagccagagagtagaaactgtagtagatctgttaacagtgagatccattatttggtatggggatgagctacgaaactaccccaagagctgtctataatgtagtcttattaatctgactccagaaagcagtgcatttattttatattattgatgtctcaagacaaaaaactttttttttctgtagattaggtttattagcaccaacttcatgacttctaaaatgtgactgctttcatgtccagatagcttgaatacaggtatctaccgtgatatggggtggataattaataatgcttggctacttatataaagacagtgttgcttatttttcaaaacatttttttaacaattatattcttcccttctccccaagaggtgggcagaaaagcattgttaatctccttttacagatgaggaaaaacaagatcagaggtgctaagtgctgtagcctagtgctaggtcttctgtccccaattctgggttctccccaagcccgtgtttctcctttctcacaatctttacttcttccgctgaccctcagcaccacccaaagtacttttagttctggaaaagaaacccagctgcacactggcacacttgaccttcatgcagccagaagctttggatggttccccatccaaaatattagagatgaaatgaaagcaaaataggcatctgacaaaagttgctttttcccttctgcattttaggacctaaagtaatgtttatccagaaactgctgtcataccatagattcattgtacattcaacaacataagcatacaatctggcaaattaaaaatctcttaacctacaccccggatccctgcccaaatttaagaaaagaactagggtggacacagtgttttttccatgtcacgtcttctgtgatggggctacggtatgtgggagcagagaatggggtgggtgggtgaagcgtatgccagatgaggatctatcagcaatgggagggatcctctgctttagcatctccacccctgctcctctcagaggatggcctttctttgcattcagctgtgatggtagcaagaacacaggcacaccaaagatgaggagagagggagccttgtgctctctctctgcatctgaggcaggacagcacagggtatggagcagtctgcagagaggccagctcatcagctcttcatggaagcacttgtcttccaccttgggctttgagcgctgggcaactggcccctggggatcaatggaataatcctaagcagacttactctatgtcacactatggaatgttccaagtaggtggccatgttttcataagatgtcttttcctccttttgttgttgccatttcatatgtttaggattggatgtgtgtttcttctctctgaatggcactcgaatgtttgctgagtcctattctgtatgactggggcgtacagctgtggactgatgcatgccatcccatcatctttcatgatcaaagcagtctcttcttttttgacagctgaagaaacatcaagtcacccttagtctgccactaatttatttccttcttgcttaaatgatgagagacatataatctccaccctcacggagttgtcattacccttcttttcaagggccagtttcccttgcctccataactgttgttggtactgatggccaggcttccaaacctcttaaaactcccccgataaaaaacattttactccaaattgcaagacagctttgtccattgatgtgtatatagacaatatagacaaaattaagaattttaatatgtgccagatcactcactagcgtattaatacataatttaatatcatacaatatagccagtatagtgtagtggcaatatggcatgggacttaagagtataagcccttgaccagacttgcatggcttaatgtcttagccctaccactggatgagaccactggataggtctcatccaggctgggctcagctggacttggttcttggtagggggtaagtctaggttcatatcacatatctctcatcttccttggatcaacggatacctgagacatttttttttctcagtatgaacagcaggattgcaagggaacagactaatctgcataagcatatttcaaagttctacttaggtaatgtctgctattattcaattagctaagagaagttacatagccgagcccaaagtcaaagcacagagaggtgcacactttctgtggagatgtggtagtgaaacagatggcaatctattctaccacaggggatgatacagtcatgcatcgcttaatgacatgagtactttctgtattgttaggcaatttcctcattgtgtgaacagcatagagtgtacctacagaaatctagatgttatagcctactgtacacttacgctatagggtatagcctattgctcctaggttacaaacctgtgcagcatattattgtactgaatactgtagagaattacaacataatggtatttgtatatctaaacaaaaaaggtacaataaaagtaagatatgaaagataaaaactggtacatctgtatagaagatttaccacgaatggagcttggaggactggaagttgctctgagtgagtcagtgagtgagtagtgagtgaatgcgaaggcctaggacattactgtatactaatgtagactttataaataatgtagacttaggctacactaaatttattttaaaagtttttttctacaataacaaattaaccttagtttactgtaacttttactttataaactttaaattgtttaacttcttgatgcttttataataacacttggcttaaaacacaaagcacaatcatgtacagctgtgcaaaaatattttctatttatccttatcctataagcttgtttctattaaatttttttctttttaaactttgttgttaaaaactaagacacaaacacacacattaggctaggcttatgcagggtcaggatcatcagtatcgctttcctccacctccatatcttgtctcactggaaggatctcaggggcagtaacccacacggagctgtcatctgctatgtaacagtgctttcttctggagtacctcctggaggacctgcctgaggctgttttacagttaacttttttttttaataagtagaaggagtacactctactataacaattaaaacatagagtatagtaaatactaggcaataggaattttttgacttcattataatcttatgggatcattgtcatatatgcaattgatagttgaccaaaacaatattatacagcacatgactaatagagagttgtaaggttagtgtatgtaaaaagcttaaaatagtttctggtgcatagaaaatgtccaataaacgtttgctattattaggcatacagaaacacacaaaaattcagtattgtgtaactgtaacataaaatacatatttggcaaaggtgtcactaagtgacactttttcctatcctaagcaaaaagaacaaaaaactggggaaatcacattacctaacttcacattatcctacaaagctatagtaacatttaaacaaataaacatgcttaagtttaattgaaaagctagtgtgagccaacctctaggatagtcaaatattatcacaattatttactgttagcagaatcagagaatggctaaagatcaccaggttttatccactcatttgacagataatgaatcgagccaaaatggcgagatatgtaagtcaaagaggaagaagtggatgaatggaggatggatagatgaataataaataggtaagtagttgatagaaaaaggaaaggaaggaaaccaacctagatctctagaactctagctgagaactcttcccactgtatcacacagaccaggtgttttttcctgtagtttatataaatactgtttatcatatttttctatccttctgcctttcaatgagccttaaaagaagagataattttaataataatatttttaaaagttcaactattgcttcaattgagagatgactgtaggacaagatttacttaaaatgtaaaaataacacaaagctaatccttacagaggccttcatttgtccacttagctaatatttattcagttattattatctgttaggcactggactacagagcaaaaacaaaacaaatctttgttcttgtgaacatgcattatgtggaagagacaagaaattaacaaattaataagtagtatgttccacagtcccttatctgcaattctaatatcaaaaagcttgggaaactggaaattttgacatttcaaatagtggtaaaagctgaatcagattcatttagtagtaaagctgatatgagactagtcatagtcttattttttattttaatttttgtgggtacctatgtgtatatatttgtacgatatatgaaatgttttgatacaggcatgcaacatgtaacaatcacatcatgtaaaatgggatattcatcacctcaagcatttatcttttctgttacaatcaaattatacttttagtttttttctaagacatcttgttataacaatttttacttattttaaatatacaattaaattactatcaactatagtcaccctgttgtgctatcaaatactaggacttaattcattctttctaggagtttttgtacccattaaccatccccacgtatccccaaccctccaactacccttcccaacatctggtaaccatccttctctcctctatctccatgagttcaatagttttgatttttagatctcacacataagtgaaaacatgctttgtctttctgtccctggcttaacttagcataatgacctctagttccattcatgttgttgcagatgacaacatcttattctttttgatgactgaatagtactttattgtgtgtcagtaccacactttcttatattcatctgttgatggacacttaggttgcttccaaattttggctattgtgaacagtgctgcaacaaacatgggattgcagataactcttcgatacgctgatttcttttgggtatatacccagcagtgagattactgaatcatgtggtagctctatttttagttttgaggaacctccagactgttctccatagtgcttttagtaatttacattcctaccaagactggggttccgttttttccacatccttgccagcatttgttattgcctttcttttgactaaaagccgttttaactgaggtgagatgatatctcattgtagtttggatttgcatttctctaattatcagtgatgttgagcactttctcatatgcatgtttgccatttccatggcttcttttgagaaatgtttactcaaatcttttgcccattttttaatcagattatcagattttttcccatagagttgagctccttgtatattctagttattaacccctagtctgatgggtagtttgcaaatattttctccaattctttgtggtgtctcttcactttgttgtttcctttgctgtgcagaaacttcttaagttgatatgatcccatttgtctatttttgttttgattgcctgtgctcgtagggtattactcaataaatttttattcagaccaatgtcttggagatttttccccaatgttttcttgtagtagtttcataatctgagggtcttaggtttaaatctttaatgtatttctatgtgatgtttctatatggcttgaaatagcagtctaactgcattcttgtgcatatggatattcattttccccagcaccatttattgaagagactgtcttttccacggtgtatgttcttggcacatttgttgaaaatgagtttactgtaggtgtgtgaatttgtttctgggttctctattctgttccgttggtctacatgtgtgtttttatgtcagtgccatgctgttttgattactatagctctgtagtataatttgaagtcaggtaatgtgattttctcagttttgttctttttgcttaggatagctttgactattttgaattttctgtggttccatataaattttacaaaatttatgtgtgtgtgtttgaagaatgtcattggtattttgatagggatagacctgattctgtaaattgcactgggcagtatggacattttaataatattgattcttccaatccatggacatggagtatctttctggtttctttcggtgtcctcttcaatttctttcatcagtattttataattttcaccatagagatctttcacttctttcattaagttaattcctaggtatttatttgtggctactgtaaataggattccatttttagtttctttttcagattgttcactgttgcattttgaaatgctactgttttttgtaggtggattttatatcctgcaactttactaaatttgtttatcagtttgaatagttgtgtgtatgtgtgtgtgtgtgtttggggtctttacatttttccaaatataatattatgtcatctgcaaacaaggataatttgacttctttccttccaatttagatgccctttatttctttctcttgtctggttttctagctaggacttccagtactatgtcgagtaacagtgagaaaagtggccatccttttcatcttccagatcttatacaaaaggcttttagcttttccatattcagtatgatgctagctgtgagtctgtcatctatggtttttctgatgctaatgtacattctatatccagttttttaatggtggattataaagggatgttgaattttatcaactgctttttcaccatcagttgaaatgatcatatggtttttgtctttcattctattgatatgatacatcacattgattaatttgtacatgttgaaccatccttgcatcccagggataaatcccacctggtcatgatgaataatctttctaatgtactgttgaatttggtttgctagtattttgttgaggatttttgcatcactattcatcagaaatactggcctgtggttttctttttttaatgtgtatttgtctatttttggtataagggtaatactgggctcatagaatgagtttggaagtattcccttttctgttttttggagtagtttgagtagtattggtattcattttttaaatatttggtagaattcagcagtgaagccatcagtttctgggcttttctttcctgggagactttattacagcttcaatctcattacttgttactggtttgttcaggttttggatttcttcatggtttaatcttggtatgttgtatttttctaggaatttgtccatttcttctagattttccaatttattggcatatggtttctcataggagtaattaatgatcatttgaatttctgtcgtatcatttgtaatgtctccatcttcatctctgattttatttatttggatcctctctctttttttcctagtgtggccaaaagtttgttaattttgcttaacttttcaaaaaactaacttgtttatttcaattttatttatttatgctctgctctttattttttcttttacttattttgggtttggtttgctcttgcttttctagttctttaagatgaatctttaggttgtctatttgaagtttttcttcttttttcatgtaggcacttatggccgtaaacttccttcttagtactacgtttgctatattccataggttttgcttgttgtgtttccattatcatttgtttcaatgaatgtttcaattttctttttaatttcctcattgacccactggtcattcaggagcatattgtttaatttccatgtatttgtacagtttacaaaattcctcttattatggattatgagttttattccactttggtcagagaacatgcttgatattatttcagttttttgaatgttttaagatttgttttgtgacctaatgtcttctcttgagaatcatccatgtgctgaggaaaaaaatgtgtattctgcagccattggatgaactgttctgtaaatgtctattaggtctatttggactgtagtgcagattgtccaatgttgctttgttgatttctccatctggacgatatgtctctgtctgatactgaaagtatggtgatgaagcctctagctttattttatttatttatttattttttgagatggagtctcgctccgtcaccaggctggagtgcagtggcaccatctcggctcactgcaacctctgcttcccaggttcaagcaattctcctgcctcagcctcttgagtagctgggactacgggtgcacgttgccacgcctggctaatttttttttttttttttttttttttttttttagtagagacgaggtttcaccatgttgcccaggctggtctcaaattcctgagctcagacaatctgctcaccttggcctcccaaagtgctaggattacaggcgtgagccaccacacctggctgcctctagctattagtgtattggggcctatctctatctttagctctaataatattcgctttataaatctgggtgtgtcagtgttgggtgcatatgtatttaaaattgttttgttttgtttttttgctgaattgacccctttatcataacatagtgactttttttgtctctcttatagtttttgactataaatctattttgtctgataaaagtatggccactcctgctcttttggtttccattggcatggaatatttttttttccatcccattactttcactctatgtttgtatttataggtgaagtgtatttctcataggcaacagatcacagggtcttgtcttttttttgtatccattcagcaactcaatgtcttttgattggagaggttagtccacttacattcagtttctttattggtaagtaaggacttactcctgccattttgttatttgttttctggttattttgtggtcttctttccttcctgtcttcccttcagtgaaggtgattttcttgggtcttgccttttatgttttgtgtattagttgtatgtttttttggtttgaggttaccaagaggtttgcaaatactatcttataacccattattttaagctgataacaacttaacactgtttacataaacaaacaaacaaaaaactaataaacactctatgccttaacttcatccccctgtttttttgactttctgttgtttccatttatattttattgtattgtttatgtcttgaaaacttgttatggttattttttatttattttattggttaattatttcatttttctatttaagataggagtagtctacacaccacagttacagtgttataatattctgtgttttcctgtgtatttgctattaccagtgagttttgtactttcagatgatttgttgcttattaatgtcctcttctttctgatcaaaatactccctttagcatttcctgcagaaagttctggtgttgataaaatccctaagcttttgtttgtctgggaaagcctttatttcctattcatgtttgaaggatattttcactgaatataccattctagagtaaaagttttttccttcaccactttaaatatgtcatgccattctctcttggcctgtgaagtatgaaatgaaaattctgctgtcagatatattggaactccattgtatgctatttcgtttttcttgctgcttaggatcctttctttatccttgacctttgggagttcaattattaaatgccttagggtagtcttctttgggttaattctgcatggtgttctataaccttcttgtactctcgatattgatatcttttataggtttgggaagttctctgttgctattcatttgagtaaactttctgcctctatctctttctctaccttctcttcaaggccaataactcgtagatttgccattttgaggctattttcttttttttttcattattatactttaagttttagggtacatttgcacaatgtgcaggtttgttatgtatgttcatatgtgccatgttggtgtgctgtacccattaacttgtcatttagcattaggtatatctcctaatgctatccctcccctctctccccacccacaacagtccccggtgtgtgatgttccccctcctgtgtccatgtgttctcattgttcaattcccacctatgagtgagaacatgtggtgtttggttttttgtccttgtgatagtttgctgagaatgatggtttccagcttcatccatgtccctacaaaggacataaactcatcattttttatggctgcatagtattccatggtgtatatgtgccacattttcttaatccagtctaccattgttggacatttgggttggttccaagtctttgctattgtaaatagtgccgcaataaacatacgtgtgcatgtgtctttatagcagcatgatttataatcttttgggtatatacccagtaatgggatggctgggtcaaatggtatttctagttctagatccctgaggaatcgccacaccgacttccacaatggttgaactagtttacagtcccaccagcagtgtaaaagtgttcctatttctctacatcctctccagcacctgttgtttcctgactttttaatgatcactattctaactggtgtgagatggtatctcattgtggttttgatttgcatttctctgatggccagtgatggtgagcattttttcatgtgtgttttggctgcataaatgtcttcttttgagaagtgtctgttcatacccttgacccactttttgatggggttgtttgtttttttcttgtaaatttgtttgagttaattgtagattctggatattagccctttgtcagatgagtaggttgcaaaaattttctcccattctgtaggttgcctgttcactctgatggtagtttcctttgctgtgcagaagctctttagtttaattagatcccatttgtcaattttggcttttgttgccattgcttttggtgttttagacaggaagtccttgcccatgcctatgtcctgaatggtattgcctaggttttcttctagggttttgatggttttgggtctaacatgtaagtctttaatccatcttgaattaatttttgtataaggtgtaaggaagggatccagtttcagctttctacatatggctagccagttttcccagcatcatttattaaatagggaatcctttccccattgcttgtttttctcaggtttgtcaaagatcaggtagttgtagatacgcggcattatttctgagggctctgttctgttccattggtctatatctctgttttggtaccagtaccatgctgttttagttactgtgggcttgtagtatagtttgaagtcaggtagcatgatgcctccagctttgttcttttggcttaggattgacttggcaatgtgggctctattttggttccatatgaactttaaagtagatttttccaattctgtgaagaaagtctttggtagcttgatggggatggcattgaatctataaattaccttgggcagtgtggccattttcaccatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattatgaatgggagttcactcatgatttggctctctgtctgttattggtgtataagaatgcttgtgatttttgcacattgactttgtatcctgagactttgctgaatttgcttatcagcttaaggagattttgggctgagacaatgtggttttctagatatacaatcatgtcctctgcaaacagggatgatttgacttcctcttttcctaattgaatgccctttatttccttctcctgcctgattgccctgaccagaacttccaacactatgttgaataggagtggtgagagagggcatccctgtcttgtgcctgttttcaaagggaatgcttccagtttttgtccattcagtatgatattggctgtgggtttgtcatagatggctcttattattttgagatacgtcccatcaatccctaatttattgagagtttttagcatgaagcattgttgaattttgtcaagggccttttctgcatctattgagataatcatgtggtttttgtctttggctctgtttatatgctggattacgtttattgattttcgtatgatgaaccggccatgcatcccagggatgaagcccacttgatcatggtggataagctttttgatgtgttgctggatttggtttgccagtattttattgaggatttttgcatcaatgttcatcaatgatattggtctaaaattctctttttgctgtgtctctgccaggctttggtatcaggatgatgctggcctcataaaatgagttagggaggattccctctttttctgttgattggaatagtttcagaagaaatggtaccagctcctccttgtacctctggtagaattcggctgtgaatccatctggtcctggactttttttaattggtaagctattaattattgcctcaatttcagagcctgttattgatctattcagagattcaacttcttcctggtttagtcttgggagagtgtatgtgtcaaggaatttatccatttcttctagattttctaatttatttgcatagaggtgtttatagtattctctgatggtagtttgtatttctgtgggatcgctggtgatatcccctttgtcattttttattgcgtctatttgattcttctctcttttcttctttattagtcttgctagtggtctatcaattttgttgatcttttcaaaaaaccagctcctggattcattgatttttttgaagggtttttttgtctctatttccttctgatcttagttatttcttgcattttgaggctattttgcagcctgctttgcttcattgttttttcttttctttcttttttttttgtcttttctgtgtattttcaaacagcctatcttcaagctcattaattctttattcagcttgatcacacctgctattaatggactttgatgcatttttcaatatggcagttgcatttttcagctccagaatttctgcttgattctttgtaattatttcaatctctttgttaagctaatcagataggattctgaattccttctctgtgttatcttgaatttctttgactttcctcagcacagccattttgaattctctgtctgaaaagtcacatatctctgtttctccagaattggtccctggtgccttatctatttcatttggtgaggtcatgttttccaggatggtgttgatgctagtagatgttctttgatgtctgggcatttaagggttaggtatttattatagtcttcactttctgtacttactcgtagctgtccttcttgggaaggctttccagatattcaaaaggacttgattgttgtgatctaagtgttgtgatctaagctgtatctgctttaggggcaccacaagcctggtaatgctatagttcttacagactcataaaggtactgccttgatggtcctggacaacatccagaaggattatctggattaccaggcattgactcttgttctctttcctcacgttctccaaatgaatggagtctgtctgtcccaccccacccccatctctgtctctgtctctgtctctctctctctgttctaggccatctggagctgggaatattgtgacataaccacctctgtggccgtcaccactagaactgtactaggccagacctgaagccagcacagcactgggtctcacctgaggcttgctgtaaccactcctgggcttcagcctgtgttcactcaaggctttagggctcaacaatcagcaggtgacaaagccagccaggcctgtatccttcacttcagagtggcgggttccccaagtccctgggcatgtccagaggtgccatgcaggagccagggactagagtaaaaaaatctcagaagtctacctggtgttctattgtactgtggctaagctggcactgaactcaaaagatgtagtcctccccactcttcccttccctttttaaaggcagaagagcctcaccctatggctaccgctaccacatctccacagggagtgctgtaccactgatgttcccttaaggcccaagggctcttcagtcagcttgtgttgcatgctgcctggcctaatactcacccttcagggcagcaggctgtcctctgacccagagcaggtccagaaattctattcaatagccaagtcctggaacctgggaccccaataacctgcttggtgctctgacccctgtggctcagctggtaactaaggtacaagacaaagttccctttgcttttccctttgattttctcaagaagaaggagtctcaccctgtacccaccacaactaggaatgtgcttagtctcacctgaagccagcaagtctcagagtctcacccaaggccctcaatgtagtacctgggtattactgctggttgttcagggcccaaggtctcttcagttagaaggtgatgaatgctgccaggactgggttcttccgttcaaggcagcaggttgccttgttgcccagggtgtgtctagaaatgtcattcactagcaagatctggaaaggggacttcataactctaactggtgccctaccctgctgtggctgagctggtatccaagatcccagagtcctctttattcttccttcttctctccttaaatggagtgagtgggtcttttttggagccaccagctgtatagcctgtggttaggaggaggtgatgccagcactcccttccccaccctggctggtgtctcagtaagtcacatacccccctcctccagtccactgtctctggcccaagttcaacactaggacttgccttggagttgcagtccttatggcctagcctgcctttccagtttattttgggccacagaacactttagcctgcactgatgaggcttgcaggaactcaagtttggaccactgggattggcgattcctttctggctaaacaggcctggttaaaatgctccttttttgggtggacatcagctgtgtttggtctacttttgttttctgttataatagggcagcactgagctcagtgcctcataaatgctacaatctccctgtctccagcacaccaaacactctccacaccatgcctctgctgctgcgggagaggtggcatcagctatttaagactgtttttcctacctgttcagtgcctcattagtgatatgaagttaaagccaggtactgtgagtgctcacctgatttttgagtcttatgaaggtgcttttttttgtgtagatagttattgaattgatgtccttgcttggagggacaatcagtggagatttctattctgccatcttgccctgcttcaagttatagtctttaaaaaatctcacttagaatgaatatatgttttactgcaaggctgttaacatgtttgacttcagggtgctttcccagacgtcttggatgggaggggagaagggtaggagatgttgcataattatagtatatgtactatattaccttaaaaataccaaaaatacttaattccaaatgacatctggcttcaccgggattgtggggctacataatatctaggaattataaatactgtgaatggaaatgaagcaggtatggatatagagaatgaaggccaatggtgaagagggtaaaagttggaggcggaggttttttagctagactggtgagagaatcctctctgggaagtgatatttgagaagatccagaaacaatccagaagctttcaaggaaaaagagtgttttagtcagtgggaacagacatgtcgttatctaaagagacattccaatctgagagaagacaaaggtcaaagacttaaatcaagagtgtgcttagcatgtttgaagaagaacatgaaggccactaaggctacagaatacgaaacaagaggaagagtgatcagataggctttcagaaaggtaaccaggatccaagtccttgccttagatgttatggaaagtctttgggggattttgaacaagggagtcttaaattcagttttctttttaaaaatgtcattctgttgctctatagataatttttaaaaatcattcttttgttacgtggatagtagagtagtagatggttgcagtggtgaggattggaaaagataagtgatcatgacaatggatgaaactcagaaatttaatgatgtgtgatcatatagatactttttttgtttttttcaagaaagcgtctcactgttacctaattggaatgcaatggcatgattgtagtgcattgcagcctcgaccacctgggctcaagtgatcctcctggtggaggctcccgagtagctagggctatagtatagcatgcaataccatatctgactttttttcttttttttttttttggtagagacatagtctcactatgttgccaacactgtatagatactttttaataaaataatgtcctatattatattttaacaaaataatatcttttaggtatctgttgcgtgaatggtatgctatgaattgataatctaaatattttggtttttgttctagatttttccctaagtgttagagctaagaaatcagcttggtcattatagtgctcttgccagtctccttctcttttctcaaagagggaaagagccccagctagaggaaagagcccccaaacttggagtaaaaagaactgttttctcatctccgatctgccactgactataacgttgtttatttaacctcttttgattttggttttctgtactgtaaagtggattgaattacctgattgatatagctctttttgaatcttcagtcttaaatttaacaagccctttctgttagagtctaaaattctatgattttaaatgagactgcataaaaatctcaaaacttccttaaatatgaatgtaaaagaatacagaataactggatgtgttcaaaattggtaaattcaccctggtatcgtttttaacaggaccaaggaaataaataccagaaatcaagaagagcacacactattttccttcatcaatccatagaaccctaatgcttctttagttccatcaaacacagaggaatgaccaccatggcagatggcaacagaggatgtcaacaattttttggaggcaagcaatgaaatatttctactatgagttttctgttattaatcatgtagacacaagtagaattatattgggttttaatttaaaatgaaaagtattatttcctgtaggaatttatgtatgcatgtctttttctttattttctttttttcctcttttaacactatagcatgtcaaaaattacattaagatgcatttgcccttacctctagagtaacagatagaataaggctatcttaaatcctgaaatacagaacaaggatttaaataaccaaaattaagtacctatatttgaaagcagggctttttcatatctctcttggacacatatataactgtaaatactaaataaaattggaaatcagaattattttctatttattttagagttagtcatactatttatgagttttatatagttaaaggtagcccagcatttttcctcccttttctttaacaactaatctacagtgctccaaaatcttggaaagctatccctttaaaactctcacagctttacattttgtgaaaattctgcatcaaaatatttcattgaacttttagttaattccatgacagctcctattgctcccaaagagcatctgggcaaggattgtggaccacaatgccaccttcaaatttcaaattgattacattacctttaaaagaaaagcttgcttggaaagaaattgaccatatatatttttaagtgtataaggaatctggctttttttctacattcatgaaaaatatagacttaagtagatgaaaataaaacaaaataaaaatatacacttttaaaattttaagtagaattcactgaaatgtaatctttcaagggatttcatacaaagaaactatatatatatgcttagaattttttatttagtgttaattcaactcatcagcctgaggtcatccatgaaaacgtgtctgctttttaagtttcacataagaggaatgctttctataaataaagacaatgataaatgtttaaaaagcccagtgtagagattctgagttttctttcagtaactagagtcaaaattaattcttgcttttctgttggggaaaatttcatctaattacattcaatttattctgcaactttttggacagcaaatcctgatcaccaaagaaaaagcagctgtgttgcctttgcctcacaattataacaatagtattattatgcagtcaacagagtttatggaaccatgaagtggttatatccactggctgttttctggcagagacacacctaaacctttctgaactgctgataatgtatgccttctatttctaaggatcttcaaagaaatagattccactgcttccttcagcaagccaatttagtataacagctctcagaagcagaaaattctttcttataaccctttatgcacttttattaactgtttctaaaacttattttcctggaattgcattttaaatattatttaaatattttcttagtttggtataatccacttaactatttttaaaaactactaaaaattgatcattgtttaattagtagaaatattctcataaaccatgcttcctcataagtagtctacgtttctcccttggtatctgcaagggattgactccagaaccccctatgaataccaaaatccaggaatgttcaagtcccttatatgaaatagtgcagtttttgcatataactcacacctatgctccttatactttaaatcatctctatattacttatactacctaatacaacctaaattctaggtaaatagctgttatattttttattctgattattttttattgttgtcatgttatttgtattgtcttttttctgaatgtatttgatccaagcttgcttgaatttttagatgcaaaacttgtgaatacagaagactgactatactatcaaatttctttttcttacatttcctttcctaactcatccacacatatattattttgagcttcagttattctttaaccatcagactgtatcaatggtatatagctttaacttattaagaatcaagccctttgttttttattaatttcattctatttgtgaccatgtaattaataagccacagatatttataattctaatccaaagtgctatttcatttattttccacatttttagggaaagttatactggcaaaaacttttagaggttagaaaggcagttgaacgtagcaggtatgatttataagaatgctacaggcatacctcagagatattgcaggtttggttccagactaccacaataaagcaagccatacatttttttcccagtgcatatacaaggtatctttgcactatactgtaatctattcagtgtgtaattgcatcatgtctttaaaaaacaatgcacatgccttaattttaaaatagttttctaaaaaagggggagtgttttggggggtggcggggacaggctcttactctctcttccaggctggagtccagtggtgcaatcatggctcactgctgccttgacttcctggactcaagtgattctcccacctcagcctcccgaatagctgggaatacaggcatgcgctatcacaccaggctaatttttatattttttgtagagacagggttttgccatgttgcccaggctggtcttgaactcctgggctcaagcgatctgcctgcctcagcctcccaaagtgctgggattacaggtataagccaccatactggcctccttttgatagtgaaaggtcttacctggatgttgatggttgctaacatccaggcaagaccctttattatggctgaagattgggatggctgtggcgatatattgaaataagacagcaaggaatattgccacatcaattgacttgacttgacaaagtaaattggttttcaatttactttgcccagattggtcagaggattcactatttgtatttgtaaggcagatactatttgtaaggcagatacagccttaaaaaatacatttcttaagtagacttgaaagtcgatggacttttcaagttagaagagttgatccatggactacagaaggaatgttatgttgacaagcatgagaacagcatgaatctccttgtatatcttcatcacagctcttggatgactaggtatactataagtgagtataatttttccaaaggagtattttttttctgggcagtaggtctcaacagcaaacgtaaaatagtcagcgaatcatgctgcaaacagatatgctgtcctctaggctttgttgtttcatttatagagcacaggcagagtagatttagcataattcttaagggccctgggattatttgaatggtaaatgagcattggcttgaacctaaagtcaccaactgcattagtctctaaaaagagaatcagtggttcctttgaagctttgaagtgggacattgacttttcttctagttacgaaaatcccaggtggcatcttcttccaattgaaggctgttgtatctacactgaaaatctggtgtttagcatagtcaccttcatcaatgattttagctagagcttctagatcacttgctgcagcttctccatcactacttcctgcttcactttgtacttctatgttgtgtagacaacttctttccttaaacctcatgaatcaacttgctctgctagtgtcaaacttttcttctgcagcttcctcacctctctcagccttcatagaactgaagagagttagggcctttctctggattcagctttggcttaaataaatgttgtagtcagtttgatcttctatccatgccactaaaagtttgtctgtatcagcaacaaggctgtttttctttcttatcattcatgtattcaccatagtagcacttttaatttgcttcaagagcttttcctttgcattcacaatttggctaactgttgggcgcaagatgcctggctttcagcttgtcttggcttttgacatgtcttccttacagtgcttcattatttctagcctttgatttgaactgagagacatgtgactcttcctttcatgtgaacacttagaggcaattataggttattacttagcctaattacaatattgtattttcggggattgggaggcccaaggagagggagagagacggggaaacagccaggcattggagtattcagaacacacatttatcagttaagtgtgctctcttatgttcaggcagttcgtggcaccccaaaacaattacaggagaaacatcaaagatcactgattacagatcaccataacagatattataatgaaaaagtttgaaatattgtgacagttatcaaaatgtgactcagagtcatgaagtgagcacatgctgtgtgtgaaaacggcaccgatggacttgctcagtgcagagttgtcacaaaacttcaatttgccaagtacaataaaacaaagcacaagaaaatgaggtatgcctacatttaagaactcaaattcacagaactgattaaggctgatttattaaccacaaccgtgcattctaccagctgtgtgaccatgggcaaattgttgatttttttcacccccaatttgtatatctttaaaatttgagtgctaataataatataactgtgaggattaaatggaatagataatataagtaataagcttaggttcttagcactgcctaacatgtaattcaataaacagatgacatagttatcccactctgcaaaataattgaaaacaggtttcttcatagcaagctcaattcttaaaaaagaacaatgaatttgctcattctatttatgccaaacttgttttacatcattgtttctgttttactgctgctaaattttgttcacattgaagtgtccaaacaagcagtttagagttcatgtttaaaaatatgaaaatgtgatttatccagaaaccacattagaaaacattataccaatggttattaatctgagtctcatagaaactatgtacattccaaattttgtttaaaaatgtagggtatgcatggactgttctaaaattttaactgaagtcaaccactattatttagagaaatattccatttataggacagagtgatttgaggaatcttcttgggattaaatctcttttatgtatatatcgatcagatgtttatttggtctgaaaaatggattcaatacttccactagaaaaataaaaagaaacagataattttgttctattaatattagttttctaggtctgctataacaaattaccataaattgtgtagcttaaaataacgaaagtttattctctcacagttctggaggctagaagtccaaaactaagttgttggcagagccttgctttttgaagcctggtggggagaatttgttccttttgcttggctgtggcgttgccagcaatttttggcattccatggcttgtagacatattacttcaatctttgcgttcatcatcacatggcattctccctgtgtgtctgtttctcttctgctcttcttataaggattggattagggcctaccctaattcagtacgacctcatcttaattacatctataaagactatatttccaaataagttcacattcataggtactagaggttaggacttgaacatatttttggagaaacataattcaacccataactctatcatatatatatatatatattatatacacacacacacgtgtgtgtgtatgagtgtgtatatatgtgtgtgtatatatgtgtgggtgtctgtatatatatataactgagaatagaattagaaaagaaaaatgaattttgaaaacaaatttcttctgttcagcctctgaaaagatgttatttcacttgtgataagacatgatctatgactagatctacatgttttgcctagtgatatctgacaccaccatttcttggacatcgacagttccttgatcattcattttcctatctactctctagctttatttgttaaaatttaaagcaatagctatcattttgcttgctttgtttacttgacatcagagttcaaacaataggtttacagattcaagatcacaggatacatactacatgcatcaacaaatgaaatgccctacgactttagagatggtatagcatttatatttataatcatacttatagttatattttgtaaatgaacttaggtaagatttccttttccatatttgtttaaaccagggccaccttttattattatgggtaagaaattaagaaaaattgttgacatttatgagtaacgtttattgataatgtttatgggttatattatgggtaagaaattaagaaaaattattgacatttcaaaatgaacaagtttattttatttacttacacacacacacacacacacacacacacacacatatattgagatagggtcttgcattgtagcccaggctggagtgcagtggcatgaacgtggctcagtgcagccttaacctcctgatcctcccacatcagcctcctgaataactaggaccacagctgcacaccaccatgcccagctaatttttcgattttttgtagaaacggggtcttgcccagccatcccattactgggtatatacccaaaggattataaatcatgctgctataaagacacatgcacacatatgtttattgcggcactattcacaatagcaaagacttggaaccaactcaaatgtccatcagtgatagactggattaagaaaatgtggcacatatacaccatggaatcctatgcagccattaaaaaaggatgagttcatgtcctttatagggacatagatgaagctggaaaccattattctgagcaaactatcgcgaggacagaaaaccaaacactgcatgttctcactcacaggtgggaattgaacaatgagaacgcttggacacagggtggggaacaccacacactggggcctgtcgtgaggcagggggagggggaagggatagcattaggagatatacctaatgtaaatgatgagttaatgggtgcagcacaccaacatggcacatgtatacatatgtaacaaacctccatgttgtgcacatgtaccctagaacttaaagtataattaaagaaaaaaaaaaaagaaatggggtcttgccatgttgcccaggctggtctcgaatgcctgggttcaagcaatcctcctgtttcagccacccaaagtgctgggattataggcatgagccactgcacccaacctcattatgaattgttaacattaattcaactgcttattctagtaaagctcattctagtgaagactctttctaatcattactacatttttagtatatatcttctttttggtcatgtcccatatagtattcaggcaattgtcacagatatttcatgtaataaaacttacatagaactaactattctttagaaatttctgtttcttcaggttcactggctggtttctctgccatatccaatgtgctgttaagcctatccagtgaatttttcattttgatactatactttttagtttcataatttgcatgtgatgcttttgaaaaatatttgttatggtaaaatatatataatataaaattttatccatttttaggtatacttggttcttttttattggttttatttctctgctgaaatgctatttgggcatttattatgatgatctttttctttatgttctcggtaatagctgccataaggtacatgtatgaatcatctcagagtctgttctattggctgctctttctgtggactttggtttatatttttctgtttctttacatttctaagaaattttttactgtatgttagatatagatgacacactgtagagactctagattctgttatcttcttctgaagagtattgaccttttttctaacagttaaatcagtagctgctcacatttatctagtgaaggcttggtttgatgttttgttagagagtggatctattttggttttgttcttaatccttaggtgacttccttagtatagggatataatatttactcctaaaacgtggtcctttatggatttctgtggaaagcctgaggtgttactaatctgcttttatttgatggggttcaaactcgaaactctttgtctcatgtaatgagcagtagaagaaatccttatttttgctttccagctgttactttccactgggttttttggagtcttccccatgcatgtacagtttaggtgccagcctaggtcggaatcaatatacaaatattgtaactcctgctttgtattttcttcctttctgggccccccctccctgaccctcgattttcagccattctctcaaccctgaattctggcctctgatacttcaagcaagtaagactgtggctttctgcttaagttctacttgctcatataccattgtacctcaggagagccatataaacgtagaattatatgttgcccagtgatgttatcttctttcaagggtcaaatcctcactctttctatttctgccttcatttggtcactctctaacatgtcttcaaataattgtgttttgcttattggctttagtattttttcaccatttacagttgttgtcagtgagagagtcagtgtgatttaagttattgattaattacttgaattggaattactgggtctttttactttcatatttacctgtttgctttattatttcatttcatcattagtgtagtcactttgacctaggttggattcctggttctgctgtttattactgtgttactccaaatttctgatcttcagtgttcctgtatgtaaagtggaaatgatcatatgtatctcagagttgctttagaatattaaatgtgaaaatatacgtaaagcatgtgacacataacctagaagttgacacttgtaaatactacttccctttattaccataattattctataaggttggaaggtcaaatattactatatgggatgaatcacttaagaccttactactagataccagaagtacagtttaattatattaaatatgtaaggtaagtttatgcctgccagaggttcatttctatattacacacacatatatatatatattcatttccatattatcacatcaagaagaattaactgcaattctgaggaaatatagaaaaataagtagggcattactgcatggccagtgttctgggctgtgtcctttttctcttctgggtacacttaaagccagcccactgttaggtcgccagaagatattactgcagtatttcttttctatcaaagaagaatgagtctaaggaagtttctgattttagagtcagatggaatttccagtgagaaaccaggcccagtgaaataaatatgtgtgtatgtgatcagtgaagaatgtattaaaaaactaccactatataatgagctattctattgtcagagtttccttatgactaaaaagtgagtgatttgtacccttgctaaacatgtaattttaaaaactgcttattgaatggtctctgcaatgagtagttaacgtgtctgtcctgcctattagaatcatattttgaatgtgtgtatgtatagattgttttgtgttatttttaagcagtgcataggattttatgtgtgggtttcaaaaacgttttgctatagtggaagtaatgttatgctgaagacaacaggggaaactggttgaggttgcattaactctctctgtaagcattattacagttgccattcacatttatgccttttcaaatagaagcccatcaatcacgtaaacttagggccagattctgatctctaatgcatagcatgaattgctacatatcttttttccaccaaaaaaaaaaaactgctcagtaacatctgagattaaaatctgtcctttcaaattgattttatttttatctagactaagaagcaaagtatagtgtcagtcctgtcaggacgtgatttctttttttatatagaattcttacagaatcaattgtttatgtatttctgtaatcataatagtagctctgagaaatatagaaaaattattgttatactttttaaaatggaatctttttatctctatgcaatcacatgtgctaatgtagattgtagggaaaagctgtattattaaaaataaattacctaaggttataatatatgaaaagcaaacaaacctgtttacgtagattattctgtttatcagaatatattttatattttccattaaaatttaacaatcatattaaaccttaccaataaagtaaaatatttaaaataataaagctatcttgttttggcatttgtgtgagggttttttttaaagttgtaagataattgacaaaaaattggaagataacatttttatttaaattttttcttacccaaggaaaattagttcagtttatgtatatttttatatttagcagtgtatattgaaaacttgttatgaccaacgctccaggctagacctttttcggggacccaagaagatgaatctgttatcacccggcctcaaagaagcatatagtttagtaggacaaacaaaagcacacatatcacacatagataagtatagagtggagaaactttcagactgtacttcttagcactatgattctatagaaaaatctggctatgtgtctttttttatgtgtatttctgaattacaagtgatctttaagggaacctagcatattgcctggaacatagtaggtgttcaaaaatgttgaaagaatgggcgaatattctctagtgcctgggataagacagcatgctagatgtaatgtgagcctatgtatgtatgttaactgtctctgctggaaaacaaagtactttagaattaaactgattttatctggctttcaccattttatagaacaaaataggcaaattatttctttgaactctggtttcttcatctgtaaagtatggtgacaatacctatcttataagtttgttgtgaagagtgaatgagataatgtatgtaaagcttatattgttatagtggctataagagtttagttgagaaattagtgttacagttactattactattatttttactaataaagggtgggtaaaagtaccacattatgagacagtagttaaaccataacattgactttgcatgtgtataagaagcagaatttttgttttgaataggtagcccttcattcaatctatattatgtgagtttttttaattaaggaaatatgtcatgagctataaaattaattcattattttactttgtacttgatcattttgtctttgtatgttgaaaactcaaataagtgcttaggaattagtatttactttttaaaaaagtattcattcaacaaatatttactgagtgctatttgccaagcattgtagtgggcactggtgacacagcaataaacaaggctgatgaagtctctgccctcaaaaagtttaccttttctgtttcatttttaatggacctggatttgcaggtctggcccttcaaagctggttcacagatggttaatggtgtcctaaacagtgtgcttgagatgtagggagtagttgtcacaggagtgagacatgcgaggttttttttcctatgacccatgaatcataaccaggccaaataccaactgtaaaaagttactacattcaagcctacattcctggaaattatatgtaattgttctcctttgccatcttaaacaaaagataaattttagagcatgctttacaaaattatgagggcctacgtacaaatgaataacagagttagttaaggaaggcacatgatcactattgaatctaacttgttagcaatattttacttagaagttaagcactgtggctcacgcctgtaatcccagcagtttggaagaccgaggcaggaggatggcttgagcttaggattcaaaaccagcctgggaaacatagtgagaccctgtctctacaaaaattttatttttattttttaagacagagtctcgcactgttgcccaggctggagtgcagtggcactatctcagctcactgcaacctccgcctcctgggttcaagcgattctcctgcctcagcctcccgagtagctgagattacaggcgcccaccaccattcctggctaatgttttgtatttttaatagagataggacaaaaatattttttttaattagctgagtgtggtggtgtgtgccggcttgtgcctgtggtcccagctactcaggaggctgcagtgggaagatgggttgagccctggatgctgaggctgcagtgagctctgattatgccactgcattccatcctgggagacagagtgagaccctgtttcaaaaaatatatatctatatattactttaagtataaagaattaagtttctttttatcttttgagtattagaaaaccttgggctttgggctggtacctaggttcacagttattttctgtttggaaattttcttctaactctcccaccattaatcaccttatagctaagtttatggtgaaaacattctactaagcagaatagactatcacttcttattttctatgctttcctgtttgtttacatgagacattaagtaaactaagaggatacagttttcttgctaatttaatttcttactaataggagaatttgggcaagtttacttaatctcttttgcttagctgtaaagtatagatgaaaatattaaactgattggtatgtgattcagatttcaaaatgaaaatgaagtcataggatacatgaggtttcatgtagttattattggcaagaagagagatgatcattaatgatagaaattgctgttaattgagcatttttaagtgccctatgctacatatagattatagttaggcctcaaaataaatctgcatgataggaatcattatttccagattctgtataaaggaatatactctaaaaaacattaactgacttgcccaaggactttcaagttagtcagttagtgagccagaattcaaattgggatttgtatatatcggaatccagcactcataacattacattgcctttcttgggtgctaaaacacagagtggagtgaaaatgcacatgcaaccttagattctctattatggccttactctcttctccttttaaaatttttattcatgtattatgtgtacatgttaaatagtactgagtgccccaacccttggaattcatctacagataactgcttttaattgtttgctactagctgggcacggtggctcatgcctgtaatcccagcactttgggagactgaggcaggtggatcatgaagtcaggagttcaagaccagcctagccaagatggtgaaaccccacgtctactaaaaatacaaaaattagcatgatggcaggcagctataatcccagctactcaggaggctgaggcaggagaattgcttgaacccagggagcacaggttgcagtgagccgaaattgcgccactgcactccagcctgggtgacagagtgagactccatctcaaaaaaaaaaaaaaaaaaaaaaaattgtttgctactgttcaggtacctgtttctaaatgtttttttaaaactgctatctctaggtttaccaatatgagacattatagaaagaagttatagatcatttgtctattatcacggatgatgacttagcatacttttaccacctaatacctctttgttatcccatccttgaaatatagttagttaaaccaaagacaaatgtttaccttattgatgttatataaatattattctctgcaacaccaaatagttataattacatttcctttcctgtaaagctttttttaaattgtctagagtttttctctcattctgtcatcagctttttagaatatagaaaaaaatgtcttccacctaattcttttcctgtctctatcactgtttcttgaaaccatggttggtataaatattactttttattcagtttgtttcttgaataaattttgcagcagattttcttgcagactgtatgacttatctgtgtcagaaattaattttagttcttaaagagcctctgtccttgtttccaaaagtttaccaaaaactacatttgagccattttgaataaaatacacaagctttaaaacaaacattggcaatctttttttcacatcaaataacctttatggtaggaggaatattttaatcaggccatcctttaaataagttaccatgggttttcagcacataaccagagaagatagtagcccaaagccagttcagatattgagttcctttaacaaacataacagctacctagggacattctaaatttaagcttgtacagcgtattgagtggtggtatacagtggtaagtccactgagcctaacaatttataaaattataaatattatataagagccaacaattaacagtcttttccttggggttatgtggagggtgggatgggggctacaactgttcacttttatacttccataccatttgaatttttttcaaaatgagtatttgtttatttttgaaaccagaaagaaaaaggattaaagatattctaaaagaaataatgtaaaggataaagctgaggggaaaaaaataaaatttaaactttatgtcttggtagtatggtgaagttaggtaccctgacatctcatgataaacaactaaaaacaatgtgaaatataaaaatagtgtttatatgcagctatgaactggaaagatggcaaatactaagaggctaaaacaaacaaacacaaaccctacataaaagtagtgttcagagaggtaagccttaaggatacttgctgaagctggtaaattctgggttacaattttgttttcatggcctcctattgaaagagtaacaagagactgtcaaaatcgtggactcatccaagatggagagtctatacttaaggtcccgtcagtacggacgtccaaatatctacatctttattggaagggtacctagtaaaatcagctatcacttcccatgacactgcaaggaaaattggttaatttaaaccttgacattgagcataggaatgaaatatctctttgatcatttgaatatcaagctggtattgtgggtttgctactgaagttcacactacataagtgataccaaaaaacaaaacagaacaaaaaacaaaaattaaagccaagaacttaaggtagtcccacgtagctggcagaagcaaacataaattctcattgaagaaatctaccttcaatataggaccccaaaaatttccacaggtaaaattcccccaaaatatgaatttactgtcaaaaattaaaaaccaaggcatcatgaatgagtgtcagaaactatattccaaagaagcagactcataaatattttatatattaaaaattatcagggagaatataaaatgtctgtttaataaagaaatatgagattaaagataatgatatgacattcctgaggaagaagaataaagtagggagacttataagatatgaaggttaatataacgctttagtgattagtagagtgtgatactggtaaaagatagacagactgaccagtggaacaaaatagattgcttagaaacatctatctataggtggtaagttggtatataaaagaggatataaaattaggtatataaaaaagaggtatataaaattaggataagggttgacttttcaataagtatactgggatcattgattatccgttaagaggaaaatgaaatttgaccccctactttatatcatatgtaaatatcaactctaagtggaatagagacttaaatatgaaaagcaaaactatacaaattttaggagaacatctttcgagtagagagaaaatgaaaaagcccattaaggaaaatattgttaaattttattgaattacaattgtgatattcttttcatcaagagtcaccttaataagaatgaaaagacaagttgcaaattagtgaagacattcacaatatatctaattgaaaaagaattattacaagttagtataaaaaagacaaaattggaaatttggcaaagactttttgtgtcttaatctgactttgctttccaataaccctttgtttctgatcatctcaacctgtttgaccacctgcctacccataaaaggggcaaaatccactgccatgagttcttcagttattgttttggaaaaaacaataagtaaaataattaaaaggaaaatttaaatcagcatactgaaaaagttactcctgagcttactcactttcatatctttttctctacccccacacaattttattattcccttctctcagcttctgacttttgacacagttcattacattgcattcactcttcttgtatagtatcatgtagatactgtactatatactggagaattaccactgatagttttcccctgacatgacttatataaatatatatcatttttgtgttgataagtcttttaaaattgtgcttctttttaattgtgaattttgtgggcagtattattacttacctcactctttttcctcctgccttctattactatctaaatcagtggttctcatccaggggaattttgcctcctaaaggaacatttgacaatatctggagacattctcaattgccattactggtggggtttgactgcaggccagggatgctgcttcacatccgacagtgcacaggataaccctccacagcaaagtattatataaaatgtaaatagcgccgcagttggaaactcagcttttaactttttttccgctactttcttattatgcttgtcttctgtttttggctctacctctcataactaccctcgtagacccactcatcttcctaatacaataaagaatatgttctcatttggctactacaattaatatatagccataagatacaactttttcaagcaagatcatgtcttttgttggaacatggatggagctggaggccattatccttagcaaactaatgcaggaacagaaaaccaaataccacatgttgtcacttataagtgggcactaaatgatgagaactcatggacacaaagagggaaacaacatacactggggcctacttgagggtggaggttggaaggagggagaggatcagaaaaaataactactgggtgacagcaataatctgtacaaccaatccctgtgacacaagtttacctgtgtaacaaacctgcacatggacccctgaaccttcttctttgctgggccccacagaatagtactgaaagtgggtaatggattggcagaaacaggtttaattgaagacaactagggcttttctgcttttgaagatcagggctttttctccatagagattatgaaatttagaccaattaacataacgtgatgaaaaacttcaccagatagtaatcttaccttgtttttcatttccggacttcatggaaaagtaacatttaatgagtggctagttttatgtgctagtcattatactatggtggtgcattcagagagctagcttgttaattctcagaacaactctaagagaaatgttattattcttatttcacagaaaagaaagctgggacttaaaagaaaagtagatgtaaatgccttgcccaatgtcactcggaggagcctgatcccaagttttctaactcaagtttagtgttctttctgctgccctattttgccacttcatcacttgcagcatgcatgcctgtttcatctagttctttttaaagcttttgctatctggaaaataaattatttttaaaatagtggggttttttaatgtggtttttgttttttgctttttttattttttaccctgacacaattcagagtgcctagtatagtgctataggtactaaaaaacgcttaataaatattcttttaaaataaaaaagggtgtcgggcaaaagggtgcaaaaggcaggagtgcctgacctcttcagaacagtgcaagaagtctgccagagcaattattttataacaaaaagggctagatttttcagtctaaataaggacttagttaacatttccattcgactcgagaaatactgtacttcagaagcccttgttacttgatgtatttgaatcgtttatttcactgatttttttccagttgcagtgaagttaaatgtcataataagaaagccaagaatttccatgcattatgggcttacctgtgactcatcattcttatcatcaaaatacaacatgattggtcttcattttcataattttgttttacaatgagaaaaaagcatttgaaagtatttaatacccatttatgatattaaaaataaagttctcagtaacttgtacctcataagccaaagtagaatggctaacataaatttattcatagtatacattttacgtaattcctattcaattgaaaatacctcttggtcataattcttgaagagttgttatttttcagagtcattccttcatattttaaggtgttccaaattctgcgtatttagttaaatgttagtatgtgtaaaaatgtttaaaagataacatttagcaaatgtacctatggtcaacaattaatgcaattgttgacttttctaacatttgactgctgtatgcccaaaaagacaggtcattttgagagggaaagaagtaatctttgcaatttccctgccttgctatcacgagtgagatatcagcgcaaaataataattgtattagataaatgagtacattttagaagttacatgaataatccaactcaaaatgattctcagccaagtgtggtaaattttgttttcccgcacctcactcctgccagagacagtttggaaatgtgtagaggcattgttggctgccacagtgattggagagagagagctatcaagagcgtccaggaatataacattttcagtggatcaggggatagttccatagaacaaaggcttttgctgtccagagtatctgaagtgtcctcattaagaaacactgtctggtcacggtgactcacgcctgtaatcccagcactttgggtgggtgaggtaggctgattgcttgagcccaggagttcaaggccagcctgaacatagctagacaccctctctacaaaatacaaaaaaaatagccaggcatggtggtgtgcacctgtagtcccagctactggggagactgaaatgcgaggatcacctgatcctggagaagttaaggttgcagcgaacccagatcatgccactgcactccagcctgggtaaaagagtgagatcctgtctcaaaaggaaaaaaagaaacactgaaagatacagactcatattctagttatgaataggtgtgaaataccagatatcatgtatctttatggaaaacctctgcaagttagtggatctttaagtggatctgtctcccaggctggagtgcaatggtgcaatcatggctcactgcagcctcgacctcccaggctcaggtaatcttcctacctctgcctcccacatagctgggactgcaggcatgcaccatgatgcccagctaatttttgtattttttgtagagacagggtctcaccatgttagccaggctagtctcagactcctgagctcaagcaatttgcctgcctcagcctcccaaagtgctgagattgcaacaatgagccactgcacccagcctggaaaatattttaaatttaacaaatatctagccatgagcatgtttattggaagaatctcatttacccacatcatcatggcattgtggtgtctgaagaatgtgtcttgaactattgttatggacgtttttctctagtgttcactttttaaaagaaggcccagaaatggaaatcgggacttaatctcctattatgaggagattattggggtttgggttctgaaactcagcagtaaaaattggcttagatctaagtaaaaaagattcacctaatggcctggtacttcatgcaaaaggtcaaaataaaaagcagagggaactctactaggagattgtaacaccatcatcttcactacagactgagaaaattgataaagaattgaaatatattgaccccctactctttcctaggcattgaaaaaagacctttatatgtagttattcatttatttgtacagtaaaatttcactgtaatgtacaataggaaaactgctggggaaatatatagctcttacaatccagggacatcaagtatgataatggagacagagaagcagtcagttgtaactatatatgacaaatgctataatatgtagtacatattggttgctgtgagggcatatacaggcatacctcagagatactgcaggttcggtttcagaccaccccagtgaagcaaatgttgcaataaagtgaaccataggatttgttttgttttcccaatgcatataaaagttatctttattctatactgtagtctattaagtatgcaatctcattatatctttaaaagctattgtcaggttctaactgaggtccgaggggagtcagtgggtgagtggcgggtagctggaaaaacactcaaggaattgtagacagtttcaacatggctttactctctctctgggcatgagcaagccatatgtagagcattagcagggtaattataccttttacagacaatagtggctccaagccaagcacgagctcatgtggttgatcacctaatgtgactcacgtgacatggttacataaatgtgcggggttgtgcacctgcactccaaacctgctgagtcatgctgcgctggaagtctaccccagcctactcctgactaaagcacagccatttcccttactttccacgctctaggccaggggcaccctctgggcaggaacacatacccatagggcagagtcctgaatccataactcacaacaacaatacagagaggaacagctcactactaggatcccagctatgccactcatgactattagggcccagcataggccagagcctagggatgcccaccctctctgcaggggttcatcagcaaggctcttgactgccttaatctcccatgacccactcgcagggctgctattatgttctgctgattgttagggataaaggtaaaacattgtgttcctaaaagggcacaggtgcctccttaggcagcagttactatgtttaaggccatttagttttgcaacaccacctttctgatctaatcaacctcatccgttaacaggaggagtgccactcaggtggaattcagaacctgagtggtgtgctgtgcaagaacagtaacttgtacttctacagttatgacacctgctccagggatagtcattgtcaaggggtagaaccaccagggggctcatcacaatcgcagaagctgagagcatagcacctcccatttatgcaggcatctgggcaacatgaggagaacagtggcaggtacataaggtcacccccaggtacaacgtctgctggtaggtaaggccaccctgtgtcctcacagacccataaactcctaagggggcacaaaatccatcagggaccaaccttggtgggactgcttgttccaccatatgttcagtgtgatgacatgtgttatgtttacacaggctgcgatgggtatccatcccacacagtggtgttaccacagtgttgctctatgcactgcggtgcttgggctgggggtactacatgttcccccacgagccagccccacccatcataaacactatgggccagccagggggcaggcgtgctgtgggtcttgcagtgtcctttgtccaaagcttgctgcatcatgttccaggcattgttatggaaccccaagtctccagccatgtccagttctctgcagatgctgaatgcatgtgccaaggcacagctgctgctggaagggtggtacagaaccaacagctggaaacattggtcatctcagcataggtgtgggcccagtccacaatgcagttggagcatgttaacctacggtcaaaacgacagagcaggcacaagtactaacaaaggtagatcatgtccctcaggcaacatagaagctaactttttgtcccgggataacaatgcagctgccaagggcttctgccctgggcagtcgtaccacaccttctcagctccccgtggttcctttgggtgctgtatctgtgccaaagtcagaggggagctcataataggccacacggacagtacatgtgtcccccagaggagggctctttccctggccattcccctatgagcagtcaaccatgggggccgtgtattgaacacccaaggagtaacatgcaagtcatactgtaggcctttcccccagggagctacaatgaccaaccactggcaatggggtgcttggagggtccatggccacaaccaggttttctattcccctgccttcaggtgcactaggtcaggtaacaacaggttaccattcatcgccatacctggttggaggaggtcatccttagtgtgtatctacaactgaatgggggtggcagcctgttgtaagaaagcctccaccagggccaggctgcctttccgtggccattcattcgaggtttagagcaccaggtccagcctggaactccagccccacaaagacaggagtgtgacatgcaagtataacccattcttcaagagcccattatattgcccaatcatacctgcagcttgcaggttgtatggcacacggaatctccactttatgtccatttgttatgccaagtgttgtaggtgtcatccagtgaaatgtgttctcctctcagtctcaacggccagagggtgaccatacaggggacataagtatttcagggcctggatggtgttctgttggtcagccaccctacaagtgtaggtgaacaacaggcctgtggccgtgtccacatctgttagcacatgcgtatacccttgtgactttggcagcggcccgatgtagtctatttgccacctggtcaagggcactcaccctgttgttacttgttgcgtaacattggacagctgcctcatttagggcatgcctgagcacatgccaggcatttctgaaaagcctcccaaatgtcttgcgtgggcagggacagaccccaatgcgtattgacctgttgtatcagtttaccccctgcatgtcccaatttccagtgtagccacaaggccacatctcatgtaggtgccgactctaaccattggaccttggccaaggcatctgcctcatcattgccgggggtggccaaaggcatatggcctgacacatgataaacggttacctgtttctgatgacccatttcccagaggtcttgccacgtggcttgaccccaaatgggttggtggccgactagcaacttctgtattttccaggtagttaaccacaaagttaagccttggtagaccacccagctattgatacagattaccatcagtgtcacctccttggtgatcaccatccacactgctctaagttcagcccattggctactttgtccacaccgggtttcaaaccatatggtgtcagtactaggttggactgcaacagcggtccaagcagttatagcacctcggctagacccatctgtgtaccatggcctatcgagaatggggggacaccctcccttaaatgctgaaggctcagggtctaggggtgcctcaggccccatggccttaggccccatgaccttatcttgcattaggactataggtcccaagaccttttgcagctctgctgctatggtacttgtactcagcttactccactgctccaagtaggcactccactttgccaaagtggatgtctgtgccatcccagttcagggggtcgttacccatgaatgcacccatcctgctataggctaagtcatccacacgatgactgcaccctgccctgtcacactctcacaagcctgaagggtggcatatatagctgctagctgtttctctatcaaggaataacagaactcagctcccttccatagttgggaccaaaagcctaccggtgttctcaagtgctctgtgcactgccacaggccccaaacaaaaccatctgtgttcatctgtggtcacatgcacatccagctcaaataggcgcccctggtccactacccatagggcttatgcctgctgaatagcccgcttggctgccaggaaggcagtctcagctgcatcattccaatcccaggtagctccctgctttgttaatcaatggaacggttttatcatttgagctaaatggggcataaatgcccaccaatatcccaggaggcccacaaaaatttgcagctgcttcgttgtggtgggctggagatatgcctgaatctcatcaacgatagcctctgggatggcctttgtcttacccgaccagataactcccaagaatttgacaaatgaagcaggcccttggaccttagatttgttgacggcccaactgcatgctgccaaatgtcgccacaagagggatgccaccacttctaaatctgcaagagaatcagaggttaacatatcatcaatataatggaataggtggacccattctggcattggccaggcagctaaatccgtggcaactagaccatgacatatggtgggactatgcatatagccctgcagcaacactgtaaaagttcattgttgcctgtcccatgtgaaggcgaactgttcctggctctctggagtgatatcgatggagaaaaatgcattgtctaagtccactacgtagtggtactgtcccacttccatcatcaaacagtccatcaaatccacgtttgatgatacagcttcatgcaaagagggtgttacttttttcagttcccaatagtccaccatcatccaccagtttctatcaggctttctaactggccacactggagaactgtaggggctatgggtgccacgcactatctgcacctcttccagctttttgtctcagttatctctgtatgtccatctggcaagcagtattgatgggtggaagtaaccagtcagggttgtggcagatcctgaggctggtgatgtgtatgtccgtgcagcaccagctacaccacatgcactcggagtctgaattccctggctgtagtttgtaatgccaagccatgtaaaatgtccacccccagaatgtattcaggtatgggagaaacacacacagtatataaacggggagtcaaacaacggatgccaaggtacagagatacaggtttcactttcactgactcgctttcataaccctcaatgtaagcaggtttgcccagaaacttattcaggttcccataaagaaggctgcaatctgcaccggtatccaccagtgccagcacctgcacccaccgtacattggtgggggaccagtggatcgctaattccacacgtggcctccaatcgtccagtgtccccccaaactgggcatcccggcaagttccctaatgaaacagaaacagctctacatgtcctcctggctacagcaagtagtctttgaggtaaagcacccgggtgggaccgggtggcgcagcagtgtatttctcccccttgggcattttctggaattgctgctccagagacaactgtctccacaaagctaagagtacttcattgggctgcttattgattttctcttggtcaaccccagccaaaatcaaatctatccatatccatgagcgtgtcacttgttgaggcccccttttctcccatgggggcccccctgtgggtggggcatcttccccttctttaaggcgcagaccccttggtcctgccagtggccttctgcttccctgagagccgccatagcagtggtcacttcatgtatgtgtcaccctacatacagggtggggacagcagctagggagtcaaaggcactcaggggtgcagaacccaacacgagactcctcatgtgggagtgaaatgttcatcatctggcctctgagtattcaggtcaaacatagcctgctgcatacccatctcccggatgacttgccccaaatcaccatatgactgtcatttactcacagtttcaggtatttcaccagtgtcgtcccacatagtccgtatggctgcccatagccactcaatcagggtgtggtcaccttgcccttgtgccaactgcccgctcacctgcaaccaacgtgctgcatccctcagagactggaagtgtagttcttctagtgcagtcaaaaatgcccatccaactctgcaagcaaagactcgttcattctcagtgctctgtgcttccagctgcttcagcatattctccatgcttgctggggacccatctacctctgcccatgtttccctcagagcccatccaagcagcacagctgccaccgtgtatcacaacccatgttgtggatacatggccgacccagaatcagtggggaccaaaggttcacttacctcaggatcctatttgatatgccaattctcaggttctaactgaggtccaaggggagttggtgggtgagtggcaggtagcaggaaaaacactcgaggaattgtagacagttttgacatggctttactctctctctgggtgcaagtgagccatatgtgcagcattaccggggtaattataccttttacagacaatagtggctttgagccaagcatgagctcacataggtcatcatctaatgctcctcacgtggtgtggttgcataatgtgcagagctgtgcacctgcaccacaaacccgctgagtcatgctgcaccagaaggccacctcagcctgctcctgactgaagcgcagccatttccctcacagctatgtaaataccttgatttaaaaatagtttattactaacaacaacaacaaaaaagctaatgatcacctgagccttcagcaaataataatcttcttattagcgaggggtttagcctcaatgtcgacatctgctgactggtcagggtaatgattgctgaatgttgggttgtctgtggcagttctttaaaataagacaatgaagtttgccacattggtcgactcttcccttcatgtaagatttctctagcataaaatgcagtttgatagaattttagccacagtagaactactttcaaaatttgaatcaattctctcaaaccctgctgctgctttatctactaagtttctgtaatactctaaatcttttgttgtcatttcaacaatgttcacagcatcttcaccaagagtagattcctcctccagaagccacttactttgttagccataagaagcaactgctcatccgttcaagttttatcatgacattgcagcaattcagtcacatctgcagtctccacttctaattagagatctcttgctcgttccacaacatctgtgatacttcctccactgaagttttgaactcattaaagtcatccatgagggttggaattcacttcttccaaattcttgttaatgttgatattttgacctcttcccatgaatcaagaatattcttccctcctgcccccatatttttcacacgtgaaccaggcatgggcacagactaaaagccaagctgggataaacaaggaattgctgtatctctggctgatatgagatgggcaccaccaaccagatgctgctctacccaggtcagagataatgaatattcctaatggcatctagaatggtaaatcctttccagaaggttttctatttactttgcccagatgcatcaaggaaacactgtgtatggcaggtatagccttacaaaatgtatttcttaattaaaaagactttaaaattgatgcattttcaagttgaaagacttgatccgtgggctacagaatagctatggttttggcaagcatgaaaacacattcgtctctttgtacatctccatcacagctcttggatggctaggtgcactgtcaatgagcagtaatattttgaaaggagtatttttttctgagcagtaggtctctcaacggtgagcttaaaatagtcagcaaatcatgctgcaaacagatgtgctatcctctaggctttgttattccatttatagagcacaggcagagtagatttagcataattcttaagggccctaggatttttggaatggttaatgaccattggcttcaacctaaaatcaccaactgcattagcctctaacaagagaatcagtgggtcctttgaagctttgaagttgaacattgacttctcctctaactgtgaaagtcctaaatggcatcttctaatagatagatagctgtttcaactacactgaaaatctgttgtttgttcatcaatgatcttagctagatcttctagataacttgctgcagcttctccatcagaacttactgcttcacttcgcacttttgtggagatggcttcttttcttaaacctcatgaaccaccttgcgttactagggtcatacttttcttctgcagcttcctcacctctctcagccttcagagaattgaagagagttagggccttgctctgaattagactttattttaaggaaatgtggctggtttgatcttctcccaagaccactaaaactgtttatcagcaaaaacgctatttcacagcaaaaaggctgttttgctttcttatcatttgtgtattaactgaagtagcacttttaatttgcttcaataacttttcctttacattcacaacttggctacctgttcagcagaagaagcctagctgtcagcctgacatgtcttccttactaagcttaattatttctagcttttgatttgaattgagacatgtgattctttctttcacctgaacacttaaaggccattgaagtaatcttggcctaatttgaatattgttgtgtcttaggggagagggagagagatgggggaacagccggattctgtggtagtcagaacacacacaacatttatcgattgaatttgcctttttatatggacatgtgttgtggcaccccaaaacagttacagtagaaacttacaaggtcactgatcacggatcactatattagatgcaataataatgaaaaaatttgaaatattgcaagaattaccaaaatgtgacacagagacatgaagtgagcacatgctgtgggaaaaaatggcacccatagacttgctgaatgcagggttgtcgcaaaccttccatttgtaaaaaacacaatatctgtgaagagcaaaaaaacaaggtgtgcctatacatttattcctgcactggggaaatgggagatcaaggaatgtttaccagaggatgacatataacatgaatctcttttatcatctaaagtaaaaaaaaaaaattatgtcatacgtattattcctatttgtagaagaggaagagactgaagtacagaaagtctatacattctatttaaggccatataatattagcatacatttatatggctctcactctacaagagctttatgttcattcatgtaaccctcacagccaccctataatacagatgcttttgtcatttcagttttataaaaaaactgagccctgtggaaataaataaatagaaagaagggaaaaaaattgagccctgtggggttaagtaatttgtccaaggtcatataccaaggtcgtatatgaaaaggcaatgctgggatttgaaccaaggcagatagactgtagtgtctatgtgcttaacaactatggcatacactgtctcttcctcccagttggtcattaagcctgattgaaaactcagcagtcagactggagaacccatacagttaagtaacagaatgccattggcattttagatagattgttttgactgtagtaaaagcaatagccttaggtgggactcatctggaggtgggaagaccaaatagaggaaagcatggatgttagtctgatctaggctaattgcaataaatatgcaagagatatttagcaaattgaacaatcaactttctgatacatgaacactgagtgtgattcaaaggagaaggtcaggaatcatgcgttgtttgattgactaggtgaaaagttgatatttggatggagaatacaagaaagagacaatttaggggaaaagatgatgagttttttattctccataaattttgtatttgaaatgaccatagggtgctcatatgaagatatacagaaggctgtggaatttgtgaactgagctcaggagaaatatctgggctgagaaatagagaaaaggactaatcagggaaatgtaggattgctaagcatgtttaaatacacagtggagtttttagatcaaaatatatcgtggcacaaatgtacacagttgtggtgtgtgcattgggaggcagagagagggagggagacgaagagaggagaaaactttttgtaagccatgggagaagacaacagattattaatacttaaaagtttataagtttttccctgtttcctgctgaaattaagggtcaacttttggtgctgttttatatattgggaagggaggaaacttgaaagaagccaataaagctagaatcacttagattaggaagttttagggagaatacaatcaatcttcaaagaccggaaaagtggatgtattgaaggaaaaagtcatattgggtggaggttagagtttgaggaagatttgggtgtgtgaaataagatcctgggacagctgccctgctgcacaattaagggagaagacaaaagaatctaattatcttttactatgcattagcaatgaaatcctacattagtgtgtcttcatgagagttcagtaatgatttaagttgtttttcatttttcaatgctttttacatataggctcctgttttatttgtttttaatatgaacatagttttatgagtctggccaaaagccatcttggctgtatatgggttacttctaatttctctagcagtactccagcaacctatgtatagtattagagaaagcagacatttgcattcatttataggagtttcataacctagtgagatagagagagttgatagtattgacaagtagtgttcaagataatggagatatatacatcatctcaaagtgcacatgtagatgtggaccatgaaataccagaagaaatttaagaatttgagataaatatgaaagatgcaaaatgttaacattgttggatcatcaaaaatagtttacaggctcagtaggatggctcatacctgtaatcccatcactttgggaggcctgtgtgctacaatcgcttaagtccaggagtttgagaccagcctgagcagcatcgtgagacctcgtcgaagaagaagaagaagaagaagaggaagaggaagaggaaataataataatttacagatgaagaaattaagactgagagaggttaggtctgttgtctaaggtcacacacaactagcaattatagtagctggtattcaaacctgatcagtctggcttcaaagtgcattctctttctagtatgcttttgaactgcctagaaaaataatggcaatttctgaaatgcaacagtatgattcacgatagttgctaggcattgtaccaatcagaattcttagttttaaacaatagaagccagctttgtctaaagcagaaaaggaatatttggtaatatcatagagcctgcagaatctataggggtgctggagaactagacttaagaaactggtagaaatgaagaaatgtaaagccttgccaatgtcataccataggaaaattctgctttgaagtctgctgctgatacagtttccactggacagcctttaacatgccactgggttctgctgcctttggacactcaatgaagtttgctgtttcagtgtgactgcagcttccatgagtaacctctgcctcactctcacaaaattcaaagtcctgggtgggagcattagtttggttaacaaaggtcacatgactgatgatcaataatcaaataactaggaaagggactatcccagactttttgagatttcccaaaataaggaatgtgttcagacactgggcagccatcaacagatgtcatttacacgtatgtgtgcatgtagacacacgcacacacacacacacacaaacacacatattcgatgattgcttcccaatgccagagatttctcattaaatttgtaacagcatggtgttcaaatacttttctttttaaatttatgttttactacctaaaacataatgtttcatggtctaaaggaagaaaaacacaagtaaaggaaaagaaataaaaaacttttaaaattccagtacctgattaaaataacagcaacatttttgtgtatattcttccaggctttgttcaatacatagaaatgaactctttagccaaagtaggatgatagtacatattatagtaagaccatctttttaaaattcacaatgtattctaaacatctttctatggcaattttagaaggacatactattctgttccatggatgtatcataatttgttcaaaaatcacagattattgaacagttagattatttacagttttctgtcataaacaatgctttgataaaaaactattttttcatacccttttcacattattgaattacttcagaaaaataaattgctagaaatgcacttgcctcatcaaaatataacacattttaaaggctttcagttgttaccctcaatttactctttcaaaacattatattaatatatgcataaatatgtacattttgcaatatggatattacaagtttttgtgttgcaaatttgatagatgaaaagtaggatttcatttcttttatttgttcaacgagtatttttgagactctgctatatgcttaacacagacctcatttctggagatagacaagctgcttacttttgtggagtttacattctagggagtatgtgaggtggcaggctggggacaaagaacaagttcaggaaagagaaaaaaatgcttaaataaatttgaaaagaatgggaggattaagaggataattcaaatggcgacttagattggggtggagagagagagaagtgtttcaagaaaagagggaaagcttttcttttgattttaatatctaaatcaggcaaagataatacaagaaagaaaaattataggacagtctcacatggaaacttcaatgcagaaaccctaaataaaatattgataaatcaaagtgagtatttgtgttggtatctcctgaccacgtaggctttatttgaggaattcaaaagtagttcaatgtttttctttttaaaaatctatcagtgtaatctgtaacattgaacaaattaaaggagaaaaaccatatggtcatcccaatagatacattaaaagcattcaataaaattgaacaataattataagaaaaactcttggcacattaggaataggaggacaatttcttaatatgataaaaagcatttacaaaaaataagaaaaaaattttaagaatagcaagcatgccactttaaagtatgaaagaaaaggttgcctgttgtcatgcaaacttgtcaacattatactagaagttctacccaatgcagtaataaaaagagaaagaagagaaataaaaagattgactagcaagacagaactgttattatttgcgcatgttactattacctatatagagttaatagaaaatgtctgcaaatatgctggactaaaaatcagtttataaaataataactcccctatcaataatcaattgataaaaagaaaaagcttaccagtaataataacaaaaactatagaataacaaggataaacataacaggcacttataaacaatttatctgaagaaaactataaaactttgctgagagacatttaaacaaatagactggtaagactaacacaataaaacgcaaatttcttccacattagtctgtaaatagaatcctaggttttcaggtgttttattttgttgattaaaagaaaagcagaagaacagatacttattaagtgattactgtatgtcacactctacggaggctgttgggatacagcaaagaatgaaacaagctttatcaggaatcattgaagatcttctaacatttaatatgaatgctataaagaacaaaaaacatgcaggaggtatgaggctaatgttgatttgggaggtgatgaggggtgtgagtagagggaggagatatgcaggctttgacatctatccgtttaaaaatgtattgtaaggggcattgagaccacagtagacagataaaaaaagaataaaacagacaaatagatctgggtatagagaaagttacagtttgttttaggtggcattttaaattaaaacagagaaaggatgaattgttaatagagttgtgaaaattgggatgaaatgagtacactaatctcacaatttagcatcagcccaaataaagatcagatgggttaaagatgtttacatttttctaattttacttttccttatgaaatattttgaacatattaaaaagtacagaaaataatgacattggtaacttttaatcgaatcacatcacattaattctgatttctctcccatttttttaaagaaataatatattactgacaaagctaaagcccatctccattccttccccttgcctccctctccagaggtaaccattattctgaaatcaatgtgttcatatgaatggatatttttatatttttactaaatatatgttattgttaaataatacatagtgttctttaactttttaaacttttatgtttgtttgcttttacgtgtagatctttaatccacctggttttgttttatgtatgacttggggtaggtatctaatttgattttttccatatgaattacctatcctgcagaagaatcaatcttattcccactgattctaataatacatcttctgttttatttattccaggtctatatatttttagttgctattgtgaacgattttttttcttttctctctcgctctcttttcttttttttctttttttttttttttgagacaggttctcactttttcacccaggctggagtgcactggtgtgatctcatctcactttgacctctgccttccaggctcaatcaattctcccaccttggcctcctgagtagctgagaccacaggcatgcaccaccaagcccagctagtttttgtatttttttgtaaagctgtagtttcaccatattgcccaggctggtcatgaactctgaggctcaagggatctgcccgccttggccttccaaagtgctggaatcagctgggatgagtgctcccttccttctttttccttttgtatagcctggtctccctaaactgcccccaggctggtcttgaattcctaatctcacgcaatccccccacccaggcctcccaaagtgctgggattacaggcttgaaccacagcatccccctctcttttctttctgttatactttatgttatctttctatttatatgaggctctccttgtttttatttttattgtatacttattttttaacagcccatcttttctgaactttattaatttagttggtaggcttagtttttttcatgtcgattattttgtcattagtagttaatggtaattctaaatctttgccattatttatatataatatcatgttcttatctggttgtgttggctaattcttacagaattatgttaaataaatgtaccatgtacagtttctaatttgctatgagtattttaaataaaagtggatattggacattataaaaaaacttgagtcatttatagtgatagtcatttggtttttcttttttaacctattattataatgatatattttattaaatttcccaacatagacatttcatattctccatttaaactctacttcatcatgtatttggtttgcttatttttaaaatctaatatccatagaggtgggtggggatttctatttttatttacttatttttatttatctttcatgcctagtacaatgcttggcatagaatagacactcagtaaatattaaatgaatgaatgaataagtgagattggttttcaggttttattttgtcttgtcattgtcatgttttatagtaaactatactagtttgataaatgaaattaaagactttctttctctaagatcattgaaagtattgaaatatcactagaatcatttgttgtatttgtctttaaaagggagcagcttttgttgtagttgttcaagtctacctttctggtttttgtttcatttatttgtatttatctttattcacctcttatttttctctgtttctttaggttcatattttctttcttttcagttttcttgaattcaatgcttggtttatatattttaattttttttaataagtaggtttaatgctccaagttctcttctcagatcaatcctaaaaagtctgtaatttattatagatttcttcttcaatagaagtattaaaggatacataggagataaacttttaagtccttgtatttctagaaaatttttattttacttttatatttgagaactgctttccctagacatgagtacaaaatcatttttctcacaacttttaagacattatttcatttcctacagtgatgttgatcacataattgatatgtgactttgtttctttctggaagcctttaagatctccttatctagtggtccaaaactttatacagatatatctaattgtgagtttttttagttttttttttttttttttagtgtagtatacttggcatacaaggactttcagtctgaagtcttataccagtttttatctttaaaaattatcttctattatatctactgttattttttcctctatatttccctacatattctcattctgggattccttttagttgaatgtcaaccctttagaatcaatcttctctcttaactttctcatattttacccacccagtgctaatattctacttactgaagattttttcttaacttagatttccaaatcacttattgtatttagcaatcatatatttaatttccaagacctctttcatatttcatgcttattctttctttaagatatcctcctcttgttcatggatgcagtgtattataagtttttcaaagttatttttatattctataaatattctcccttttctcagtgtctttctttttctcttcactgtggtagatgtgattcatgtgtctgatgcctgtttactttttaaataaagtaataggaaagctctgatttctctatgtgtgaacagactactgtattggctggcttgtcttgaataaggtatgcatgacattagccttatattttgcaagccctaaatatcaaaggtgatttttctgatagagagcattgcctctcattctagccatccttgttctcagcaaaattgtgttcaatattttagagaggaaacttccattacttcctttctattttttttttttttttagacagtctaaccctgtcacccagactggagtgcagtgtcaacatctcggctcactgcaacatcagcctccagggttcaagcgattctcctgcctcagcctcccgaataactgggattacaggcatgcaccaccacgcctggctaatttttgtatttttagtagagatggggtttcaccatgttggccaggctggtctcaaactcctgacctcaagcaatcctcctgccttggcctttcaaagtgctggcattacaggtgtcagccgccatgtttggcctcacaactttgtcttctgactttcaattttttttttgttttcagcctcataggtctctactaaagttcattgcattttgtgtttccaattgccctacctttcttggattcctacagcaggttggccccctcctcacctttcatctcttcctctactgctctttatcactcagcactccttctgatttccttctttctgaaattttttaattcccttttccacaaacagatagccctttattccttttccttattgtttgttttccctttaaaaatgtatttatttaccagtattttaaggagatctcaagagagaaaagataggaatatgagctcagcctcatatctcatatctcactctcataacaaagacccatcttaagagcttttgctgcctttatttttattgttaaaatatggagtctgtaattgatgtttcagtttcctctttggagaaagatttttaggctctaggtaattttatttatactctttatctttagtcagttgtttctagttttattaccctatgattagtggctggactataaaatttttaatttttggagttcagtgatgttttctttgtagtacggaatataatcaattttggtaaacattctgtggacatttgaagagaattatgttctctgttatatacaaggttaggtacatctgttatattggttaattctttaatttacttttgaatgtttgatttataaatgactttttgaaagaagttattttcccaagacaattattccatgttttcgtgctctccttgagtttcaaatagcttttatttcatatttcagcactgtgttatttctagtataaaagttcataaagtacatatcctcattgtggagctttactttttaatcagtttaaaataatttgttttgcctatataataaatttttctctaatttccgtcggtatgctattgatatttccactctgccttttattatttctacttttttaattgacaaaaattgtatatatttatggttttgaaatatgtatacattgtgaattggctaaatcaagctagttagcatatgcattacctccatttttaccattttttgtgatgagaacacttaatatctactcagcaattgtcattgtgtcataatacaaaatacatttgtattaaccacagttgccatattatacaataggtcccttgaacttatttctcctgtccagctgaaattctgtacccatcgaccagcgtctgccccatcccttcctcccctccagtctgtggtaaccacattctatgctccactactatgagtttgacttttttagattccacatgtaaataagatcatgcagtatttgtctttctgtgcctagcttatttcacttaacataattcctccaggttcatccatgttttcagaagtaacaggatttccttcattttaaggctgagtagtattgtcttatgtgttcatacaccatgttttctttacctattcatctgctgatggacactgaggttgattccatatcttggctattagttgtataatgctacagtgatcattggaatgcagatatatctttgaaagactatttcatttcctctggataatacccactagtgggatcatgtactagttctgtttttaagttttttgaggaacttccatactgttttccataatgactatactaattaacatttctacttacagtgtacaaacattctcatttctctacatccttgtcaatacttattttttttgtttgtttttcgtaatagctattctaacaagtgtgtagtgatacttcattgcggctttaattttcatttcctcgatgattagtgatgttgagcatttttccatatacctattcaccatttgtatgtcttcgtttgagaaatgtctattcaggtcctttgcgcactttttaatcaagttgtttgtttgcctcttgttgagttctttgtgttctgtatatattttagatattaactccttattaattgtatggttcacatatattttcttccattctatagattgtctcttcactctattgtttcttttgctgtacagaagtgctttttagtttgatataattccatttatctatttttactttttgttgtctgtgctttctgtttgcatttgcctgatatatctttatgtatctgtgtattttccttcacttttaacctttgcctagaaattgctaaggtgcaagtattataagcaacacaaaattacattttgtttcctagactgggctaaaagtcatgtatttctagacaaagtacagaatgatctcactgttactgggagaaaaatacacatttgttctcattttatgctgttttttacacttctttttagaaaacatttctctttgtttctttattgtctcatttcctattgaaatcacctttgcaaaaattatgacagtgagagaaatctgacagagctgactccatcatgcttccaacctcacaaaatgcctttgctcattcctgggcatcggtcaaactgtgcactaactatgggaggaatttagtttacagtttaactttaaaacaaagatgattaacagtctcttcctgaagctaacccccactttgcttggggattgaaactgcatttgtaagattaacaaattgtccacacagttaaaactatggttcacgagtcatgtagctggaggtcacaagatttgtaactccccacttgctccttatataacatcattatgctaaaacttaagactggtgtttggggtatttttcagaccttgcattctgatggacgagctggcaccaccctgaccagtaacccctaccaagaaactgactcagcacgttgtgacacccccaccctcaggaatagaaacagtgcaagaatacagcttcaaccccctgtgatttcatccccaacccaaccaatcagcattccacattctctagccttctacccaccaaactccttgaaaaactctagacaccaaattctccctggaggcagacttgacaattatctcctgtcttgccactggactgccttgtgataattaaactctgtctttgcttcagcacttctgctgttctcattatattggcatttttgggcagcagggaagaacctagttgggcagtaacaatacatgtactggaaagtgagagtgcttggattttcctgtgtcccttattgatatgggaagtccactttcatcatttgtacttttcaatgctagataattcttctttgctattttatttttctcttcctttattctgctatacccatcaagtttttcttaatctttttttattctagttctcatttggaagtttttcttaatctttttttattctagttctcatttggaagttttttatcatattcttattctactagtgcttcatttctctttcagtgtcaagagcaaaattgtctaatacttttccatgtgtacaatgagacatttaacataattttactttctactattcttatcctcacccccgacaccaccacacacacaaaccactttttttaaattatactctaagttctggggtacacatgcagaacgtgcagttttgttacataggtatagacgtgccatggtggtttgctgcacccatcaacccatcacctacattaggtatttctcctaatgttatccctccccagccccccaccccatgacaggccccggtcacacatcacttttttgttgaaataatctcgacctttaactttagattaatgttgcttatcattttacactatgtaaattttgttatttgaacttaggcataacccgatattttactgattttgttgctaatactccttcacagttaaaacattttgcatttcttaaagtcctaattttttaagaaggatggtaaaatttctgggtccttgcatgactgtgaaatacttagtgtctttggaaatgaatgataaagctaggctgggtttagaattctgttacaaaaaccttttacacttaaaaattaattgagtttttttgttttttttttttttgagacagagtttcgctcttgttgctgaggctggagtgcaatggcacgatctcagctcactgcaacctccgccttctgggtttaagcaattctcctgcctcagcctctcaagtagctgggattataggcgcatgccaccacacctgactaatttttgtatttttagtagagacggggtttcaccatgttagccagactggtctcgaactcctcaggtgttgacctcaagtgatccacccaccttggcctcccagagtgttgagattacaggcgtgagccactgtgcctggcgtcttttcttacatatggttgtgtgagagaaatctgatgttaatctgattattttttgttttagattatatgttttcttatgcaacctatataagattttgttttcctttattttttaaaatcgttaaattcataagcatcactaggttattctaggtctcttttttgactgcatttgaataagccctttgagtatgaaaatttatatttttctttatttcaggaaaattcccagtattatttctttgattattgcttcccctccatccattatcttcttaccttctcacatttttattattggactcctggatttgtctctctattaatcagtgttctccagagaaacaaaattagtgggatgtatgtagagagagggatttattttaaggaattatctcacgggagtgtggggtgggcaagtctaacctatagagcaggccagcaggctggaaatttctgcaggagggaatattaaagtcttgtatcccaaagcagtctagggagaatttcttcacaggagacctcactcttttctctaaataccttcaaatgattggatgaggctcatctactttatgagagtaatatgctttacttaaagtctactgatttagactttaatcacatctaaaaattaccttcacagcaacatttagactggtgtttgagcaaggaactgtgcaccatagcctagctgagttgacatataaagttaaccatcacagcctggaaatcactttttttttttggctcatttttctttattatcttaatatgagttctaggagaatttgtcaaaacagtcttctaaaatcacctgtttgctgcttacagcatttattgctgttataaatttgttaatttttatttaaaattaatattttctgattttatatttttcatagtttcaaagttttctcatattttattgaaaaatgttttaatttgaaatgtttcttggatatttatatttttgttttgactattttttaacgttggccaagcatggtagctcatgtctgtattcccagcactttgggagtccgagacaggaggatcacctgatgccaggagtttgagactagcctagacaccaaagcaagaccctgtctctaccaaaaaacaaacaaacaaaaagttagccaaatgtaatggtgcatgcccatagtcctagctacttggggggctgaggcaggagaatagcctgagcctgggagttgaaagctgcagtaagctatgatcatgccactgcactccaccctaagtgacagagtaagaccctatctaaaataaataaataaaaatagaactttatttagaaaaatgtcaaagctatagaatatttgtaaacatactataattaatattattgcacttttcacttaatcaattaccatttgccatatttggtttatctctcaccatacacatgcatcacttattttgctaaaccatttaagagtaaattgcagaccttatgaacttttacttaaatacttaagcatgtatctctgaacaaggccattcatttacattatttaaaatagttgtgaaattcagaaaatttaacattgatacaacattaatatagtctatgtttaaatttttccaattatttcagtaatgtcgttttatagcaattttttctccaatctgggttccacttgagagttatatattgcctttagttatcatgtaagagatttttttgaagtaattttctctttcttgacataaatctgtttcacaaagaaatatttgatatgactccttagaatgtgcctcttgtttttatatgtatgatgacttttctttattgcctttaaagagcagttctgcatgtttccagtatcaggatttcagaatttggggtaaaaattctattggttcttatttgaaaaaattaaacccaaaggagaagagaaagtttgtattttctctcattttggtatactcagttgtggtacttttggctctgtggcttcggagaacaattgtgtctccctttcttcaacatcactcttaaggggcaattttcagttgtccacagtatttatagagtgttatgttaagtccagttgagaatgcaaagtttgcaatctggttcaatgaataataattattaaggtaaggcaagtaaagagcatttgtgagacatggtaagaagttatggaaagttcaaagccttgagtctaaaaatatgaataatatttgggtaataggggaaacattcctgttaagagtttaggaaaaatatagatcattaaaatttggtcttagtgtaacactaggaagcatatcgtagaactaattcctttatttaaattttaccagagaaaacacaaacttaaatatgtagctaatatatattatgcatataatacaaacaaatataaatatatgtataaattgttcagttcatccaagctgtcaaatatttcctaaagttgtttttaatattctgtaacttattttttagagacagggtcttgctctgttgcccaagctagtctcttgaactctttgcctcaagcaatgtagttttttatctctactttacctataattactcaagcaatgtagttttttgtgtctactttatctgtattatgtactctttttcattgataatgcctctatttgtgctcgttttgttttcttcatcagtcctgctagagattggtctatattatcattattgtcctctttcttctttcttatatttactcttatttcttttctcacttatttgattgggacataattgattagcttttgatctttgtttttctaatttaataaatgaattgaagaaatgctttttattgttttaactaactgaactgtttttaatatcaggttaattaagatataatttgcataaagtcagatcaccttcttagtgtatagttctgagttttggcttgtgtacacattcattgaaccaccaccatagtcaagatacagaacctccatcacccacgaaaattttcttgggtccctttgtaataaacccctctcccaacctcagcccttggcaaccaatgatttgttttctgtcgctgtagttttgctttttccggaatgtcatataaacataattacaccatatgtagcctttgattctatcttctttcacttaatatcatgtatttgaagttcattcgtattgttattatgatattgtgatcagagggctggtttatatgactctgattgtttggcacttatttgggcttatttttgaggtttagtgtgtgatctgttttcatgaatgttctgtgtgtgtttgaaaggaatgctctattttttagtgcagggttgtatatatatagctgatagagaggcttgttgattgtgttgttcaaatctatttttactaatttttatccttattatccatcaggttttgatggggttgtgtatgtgtatgtgaaagtctctcactgtgtctgtggatttttccatttctttgggtaatttgtatgtttttaagtatattaaggccatcattttaaaaatcttcatactttttttaatgccacttttttctcatttaatgtttatttgccctaaattctattttttaaaatttatttgttttagtcagggttctccggagacagaaccagtaggatatatctagaggtatgtgaaaagggatttattaggggaattggctcacttgattatggaggcagagaaatcccatgatagactgcaagctagagaaccaggaaagccaaaatactcactcagtccaagtatgaaggcctcagaaccaaagaagctgatagtgtaattctcagtctaaggctgaaggcctgagagcccagtaggccactggtgtcagtcctggagttcaaaggttggagaacctggagttctgaagtcccaagtcaggagaagggtgtcatgactccaggagagaagtggtgaaaaattgcccttcctgcagttttttgttccatatggtcccccaagcgattggatggtgcccacccatgttgagggtgtatcttttccattcattccaccaactcacatgccagtctcctctgggaacaccatcacaaacacactggggcagcctagtcattctaatcaaaagcagagccatcaaggtgtggtagctcacacctgtaatcccaacactgggaggcagggtgggaggatcacttgaggccaggagttcaagaccaacctgggcaacatagtgagatcccatttcttaaaaaatgagaaaagttatctgggtgtggtggcatgagcctatagtcctagatactaggaaggtcaagtcggcaggatcgtttaagcacaggagttcgagggtgcagtgagctatgattgcacaactgcactacagcctgggcaacaagcaagaccttgtctctgtaaaaaataaaaattaagcaaaaccatctgagtttctctttcagcagaaaaaggtcaggcacagtgcctactgaaacattgagagtaattaatgctttaccagctgtctgagtatcccttcatccagtcaagatgacacccacaatccactatcacagtattgctttgctacttttcttttggcaagtttttgcttagaatatcatttccattcttctttattttcatttagctctagatgtatctcatctgaacatcataaagctggatttatttttctaattccattctgatagtacttttcctttaagaagttaatttaatttattatagttacacatttggactctttcttttttaagaagtgtatctctctgtgttggacaggtggagtgcagtggctattcacaggtgcagtcatagtacactgcagcctcaaactccatgggctcaagtgatcctcccgcctcaacctcccaagtagctgggactagaggcacataccaccacacctggctttgggctcattttaaccattttattgtggttttgtttagttaatttttcttcactttttttcctcctttcatgacatctgttgaactgatatttctcttggttgcttctgcttttttcttttttctcgtttcctggtttggaagctatagatttgtatttctattcttttaaaaactaactgcaaaaaaaaaaaaaaaaaaacaaaaagaaaaaacagaaaaaaaattaaccataaattttaatacatatgtggactatattatttttctcacagagtctaaaattgcttagtgtatcctttagttaaacaatccatgcacattttatctgctgcctttctttacaggtttttctagaatttaattcacctttgtattttgtcgattttattttaaaagggacagtagtttgatttccatcctcacagttacttcttatgtcccttgccttccctcaatgttcagttttctttttttctgctttttgtttcatttttcttgaggtgggtatctcactctgtcacccaggctgaagtgcagtggcacgatcacagctcactgcagccttgatcatgcaggctcaagtcatccttccacctcagcctcccaagtagctgggacctcaggtgtgcgctccctgcccagcttatttttgtatttttggtagagaggggttttgccatgttgcccaggcgggcctcaaactcctgcactcaagtgatccacccatctcagcctcccaaagtgctgggtttacaggcatgagccaccatgcctggcctaaagttgttttcttgctgtgaaaagtagttatttcagcaaacacatgtagcaggtaaactagtttttgtagttctgaaaatatctttattttggcctctctacttaatggtaatttagctaattttaagtgtttaggctacagttgtttttccctcagcaatttgaagatcagactctaatatctttcagtgtcttttgagagaaaagaaatctaccatttaactattgttactttacagatcatctttttctaacctctgatagcattaagacttcttattaaccttgattttgtccttgctctgtggtggattgaggtgtggatatatttttatggattttatcttctctggatttgatgataatgatgcttttaatccaaggtattctactgatctttagtactggggatatcttagacattatctgtgcaaacattcttatctgctatgccttctacattctatttctaaaatttgttctatgttaaggcctgtatcctacatgacttaacgctgtttcagttttcatctctctgtatctctgtatcacattctcagtgaattgctcaatcctgttttccagtttactaggtgccttttctactatatccttttctaatatatcctgtctactaggattttctttttcaaataataaatttcaatttccaagaatttttgtcatttttttgcatacaccaattcttatattttcttttaattttgttttcaaaatttcttattcttttttaagatatttcttcctttacttctgtatgaatcttcaactcttatttttatgttttctgattgctcgtaaatatatttcctcttgcatttttttaaaaattcatgatctttcaattgtgtttgttgactttcttagctttagttttcctcgagtgctttggaaatcattttgcaggttcatcctgacagtgacttttttttctctctatctctatctccttttgtttatcccaatcattgagtcagtgggtggattgacttaagttttaggaactaggatttgtctccctcctctgtcttcctggttttatataatggtttatccccaaaagcttttttcagcttcttttcacagtttggggaatcacatcttagtgccatttttatgcactgagacttgctcaagtcttttgccaggtggttctttttaatctccactaacatgcaatattaacccttggtgcatctaaccgctaccagacttggagcttaactattctataatgtcagccttgcgtactactttgtgttctgttacacagtgacttttatttttagtacagcagtatcttgatttttttctttactatatctcttatactttattctgttatactttttcaataatatatcttatactttatccgtaattgctgagtactgttttaaatagagaagtctctaaagtgtctattgccagtaccatcttgaccaggaatcctgtcaaaacagtttgcacatacatatttggaaattaggatatgaatctttgtcaaacccatcacctttggcatatatatgattcattctatttatttgtttaatgcatagatatgctacagcaaaacaagaataagaataccaattcatgttctcatagcatgacttccagactcaaattggatggattcaaatcctggcgttgatatttgcttcctgcatgactcatcttttcaaaacctttgtttcctcatctgtatttatgacatgtctgcttcatagacatcttgaaaggattaaatgaaatctcaaaaactcatgttgttcaaggttaaaaaaatatgtatatatataatgtgtgtgtgtgtatatatatatataattagcatagcattatgaaccctcaatgaatgttagccattactcgtacagtggagttgcatgatatacatgtttaatgtataaattcacttatagccattctcttttgtaaaatacatgtagcataataattttagatatatatattactatatatgatatattaatttgtactttaaagtgaaatattatcaaggttattaaacctcccccacactgtatttctgtactttctgggtcatttaaatgatcctcaaaagtaattttgactactggatattttttccatatagactgacttttaagacttaaccgcccccccccatcagatgcaattattagttgtctctatactagtcagtgtatttttatgtcagacattggcaattatataaagctgtatagtactgaaaaatcatttgggctcaaaatcagaagatctaggttcaagtagagcctattccattatccagtcacctcaccttactggatgtccatttcttcatttatataacagggatgataacactcccatatcagagtgtttgtaaagattaaatgcaataaggtattctcagaatgcaatgtataaactgtaaatcactagttatgtagctatgattgcatgtctttgttacagcagcttccttccatatttacatagtcatatggaaagtaggtaaccctgagcctggtaagttattggctctccaatccatcctgcactttttgcagtaaggaaaaactctcagtgagagttttatgaataatgattctttggggatgggagtgaagtagatctacattatctggtatttgtatttgacagctttaactgctaagaccaaagtattagaatcctttgctctttcagtcacagcatacaatatttagcttttagcaattcgaagcagaaataggcagcctaattttagtcctgaggtaagtagagcaggcatttcctttcctattcagataaaattattacatacctgtagtggaatatgccaaacaaatctaagaactaaaccatttatccttcaccgatggccctattttaagtcataagaaatgtgctctccactgaagtccccaatacagttttctcctcctccttcacatgcaaatatagtcaaaagtactctaaatggaccatgcctatgcttactagagcagtgcaaaggttagtaaaatttctgcctctgggagcccagaaaaaaagttagcacacaaacatagctacactcagctgctttataacccctttctttcttaactatcttcctaacttgccacatttgattcaaaaatcaaagcaatattagaaggtatacactgagtatcctgctttttaccctgttctgcccctgctgccacctacttctggtcactgttatcactagtttcttttgtactcttctgatgtttgtttatataaacacaaatataacaacatagatacagatgtattttccctcttcttacacaaatagtagcatactatatatactattttgcccttgctttttttactgaacaatttataatggagtttgggggattaaatctccacacatagagagcttcttcatttctctttagagttacatcttattacatcagaagtatatgccattgcttatttaaccagcccctaataaaggaacactttttttttcaatcttttgctgatgtaaaaccagcacagtaaataaccttaaatattgtcattttgtatatgcacaggatatctctaagatacatttccaaaggtatgattactaagtcaaagagtgaatgcattttttaagaattttctattgtttcaatcacctcaaaacaacagataatgagggcatcagggaagaaacctggtggccgtgttgtgcaggcagacttgcatttgatctgggtttcatccttgactcggtgcatggctttgggcaagttacccccctctcatggagccttggtatcaccctctatcaaaagtgggggctggtccctatctcaatggagtaattttaaaattagatgagataatggatgggtcttgtctgtactgccacctttaagatgctgggattattaaccaaaaaatggctacaaacctgatgccaggctcacttgctttttttctttcttttttgtttttaaattatcagattgtaaaatgactttttctttcttttgatatactgttctatcaattttaatatatacatagatttgtgtaactactcaaaatcagaatacaaaatagtaaatatatttttaatttggatagatactggctagttgctctccataaaggttgtctacccacactgcaatctccccaacaatatatgagtgactttttcctcacagccttggcaaatgatagagttggttatttgtttgctgtctgttattacagccttccccatgcagaaacacagcagcagactaggaccacagcagctgtctggtccttcttctcttgattaaagttgcttaagccacaaatctgaagcttaaaaagaaaaataaatactaaacagaggcctcatattttaatcatatttcaaagcagctactttccccatctgctcttcaaacaaatagacagcttagtttacagcactctgttattctgaataactacaggataactgaaagagagtagaaaaagtcatctcaataacagttatatacctttgacattgtaactgttcttgttcacaagttccagtgcacatacaacctcttttttctcatctgcctcctacctaatgtcaaaacatttagaaatgaaagctgattaagatcttatcatgttgaattttgtaaacatactaaaagaaagaatgatattaatagaattgacatgagaaaattggactaaactgtttgaagcatctactttctttattgtagatgtaaattagccacacttaagcaaaatactagatttacaaatctcttgcttatgggccagattcagccaacaggcttgtattgctggcctcacataatctttcaaaattaggaaatattacattgaaatccagattttactgaataatgagaatatctgagaataatatgcccatattaccacatcaccactgttagttggggcatatactctaattcaccgcatttttttttaaatagaggcaagctgtcaccatgttgcctaggctggtctggaactcctgagctcaagccatccacccaccttggcctcccaaagtgccgggattacaggtgtgagccactgtgcctggcctctaattcattacattttatatacattaaattttatacaatttatattttattaaagtgattttatatatcactttattcatttttttctacttattcttcagaatagtgtataatttagtaaaaattttaataagttttaatagcagcaaacacttctttttattattagtattttcaggtatccatatagtatttagcaataatatttcaattgaaagaatttacagttattgtgactaaagtgtttgttcttacagacatgaaatttgccgtttgacttagtagctggattatttgtcgtaaagctttttttccgttttaatacatgaacatattttcttaccattttgggaaactattactgatttttattactttctgaatgattcttgctttttatcatctgatatgtttattatttcatattcatgtgtcatttgacttttaatatataacttttaaaaactttagttgctgagaaatgttgtgccaagattcatcagagttatgatcatatttcttctgcatttcgatccccaagctgacaagcagacttacccacataacttctcattgattttaattttccagactttgcagacctctgtttatttaggtaagctgtaatcactttctcaccctactcccaacactctctgcattaaaatctatcattttataaacaaagattgcagatgatggacattgctttctttgttaacactgtaccagaactatgaatgctttgtttatgagcataattaattaaggtttgcctctgttttaaaaaaggtattcatttaatctggttgtactcatctttaagaagcaaaattatttttatgacttgtcctttattattattgttgttattatctaagaataattgcagccaggacaaggaatctaaatgaaataggaaccaaagacttatggtaaaggaaccgaagatttacggtaaatagtagtggtaagtttagtggtacttacttatgaaaaatatttaactgaaggctatttaaatgcaagttataattttaactgtgggaataatgaagagcaacaaaggataaatgacattttaattttcatttttgtaatttctaacaaagttgatgataatgcaatatgacatcttgcccttattgtttaactttctattatggtttttaaagaggttcttttttttgcaaaaatattcagagggttttttagttttcctaaaggtgtctccaatcattaatgtttatattattctcctttcaaacacccattgaatcatgatccttgcttattttctttatttcacttttaactgctcttactggctttatttgtgatgtgagtagtgttcaaatataattttcattaactccatgaaatcccacatctttcccaatattgactttgcataaatttgcatattttataggcatagatagcatcccaaaagaacagatatgtttacaccatccattgattagagaaagactgaccaacaaaatttttgtcatgaagagtaagaacaggctctttagtgttgagtagggaaggatatttgagaagggcccaattagtgagtgacggatgtatcagtcagttttttatgctgatagaacttttgattcggtaatgaatattcaggtaatgggacctctcctgttttgccttcagtcttctgaatatgggaattgtcttagtccattttgtgttgctacaacagaataccacagattgcataatttataaagaaaaacgtatttctcatgatcctgcagactgggaagtccaaggtcaaggggcctgcatctggtgaggacctacttgccacatcatcccaatggccaaaagcagaagagcaatagagcatgtgtataagataaagcaagagagtgtcaaactcacttttataacaaactcactctcacaataatgaaaccatcctatgataacaacattaattcatttatgagggcagacccctcataacctaatcccctcttgaaactccgagttctcaacgttgttgctttggggattacatttgcaacacatgaactttgggggacgcactcactctgtagcataaatggtgaatttctggatagcaagattctgaagcttttcaagtttattatagatgctttctcatctcaaataactcatcaactatggcatttttaagtaccatgaaagtgtgtgttatgttggtgtgtgtgtgtgtgtataaacttcagacctttaaaaaagtgatttctggccgggcgcggtggctcacgcctgtaatcccagcactttgggaggccgaggcaggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagctgagatcccgccactgcactccagcctgggcgacagagcgagactccgtctcaaaaaaaaaaaaaaagtgatttcttcacagtaataagatggaaattcattcatagcattgactaaagtgggctgtcagtgttgatagtgacatttatttagcatgaatcatattctactatccaagaaagatattttgctatgtcatagctatgaaccaaaataacctagcaccaattgattcaccattatattataatagatgctccaaaaacaaatacataccaagggaaaaaagccctgatgatcggactaggtgaaccataggcgcaattaactactcaatgcagggatgtgtgtagtgtaatctatcacaggatactttgttagaagtgagtcttgaagtagaaataataaaaaggaaaaaaaaacagtaatctaaaaatgaaatgattaaatgttataaacactaaacagaattttttaaaggctgatgcttatggttcaaagacttttgaataaagaccaagacttctctgtgttttctatatatttagtaagttctgtaattaataaatcttatcctaacctgcagtgatctctctcatctgaatttccagaggcttcatttttctgtattatatctttgacaaataattgtgtgcagcccctgaacaactcttctgctgttttctgaaactatttatttaaatctcatatggttattgaactacttttgtgcttacaacttcccaaactataagcttcattcattacagtgccttgctaatagtagaaatggccaaaatagtttttttatttgactcaagctgatacaaactcattcttttccagaataagaaaaattaactttactcctatttaatgtatagtacatttatctcataaaactatgaaaagcctttatagcaaatattaacaatttctccttttatgaaacttataatgagttcttctttcaatataggttatgagtggaattttagattcatgttctagagatttggtaagacaatagtgctcatgagggtaagatgacatgtttgtgaaaatgtccagaaacaggtattttcttacactgtgggtaggtataattagtacaactcttggaaaacaactaatcaatgtatgtatgccatacctacattggatacctaccaaggtatgccatacctacataaaggataaaaagatattattatcctttaactcagtttctaaaaatctattctaaggaagcatagaaaaacattatccacaggaaactttacaacattatttataataactaaatttggaaacaacctaaatggtaaacagtagtgaatggtaatgaacaaattacaatgcaataatgtgatgttattatacataatgttttcaaataatttgcttaaatgtggactttctctttaaaaatgtacgaaatttagtattgtcactgctttgcaaaaaatgaaagcagaaaaaaagtctgagaaagttatgcaaaaatatcaacagtttaatagttatttggttttaattaataggactgttttcattcttacacttatttgtattctctaataatcctataaaaatcatgtattacctttttttttttttttttttgagatggagtctcactgtgtcatccaggctggagtgcagtagcacgatcttagctcactgcaacctctacctcctgaactcaagcaattatcctgcctcagcctcccaagtagctgggattacaggtgcccaccaccacgcccagctaatttttttgtatttttagtagagacagtgtttcaccacgttggccaggctgatctcgaatgcctgacctcaggtgacctacctgcctcagcctcccaaagtcctgggattataggcgtgagtcaccgcacccagccaaaaatcatgtattactctttaaatgaatggaaaagtaagctgctttttttaaatctaagaaacaataaacacttaaatcattctcttgggaaagatatatttcttaagaatgagattcctgccttttaacaggctttaggaatttcagaataaaaaaggagaactagagcagtttaaagtactgagcaactgatcaaattcaccattgcactgccatgactctccttctagatgaaagaggcctcaatacaaattatcagtctcctcataccttaactgaccttctgttgacttatcaatactaagccatttagtgactgtatgttttcagtgtgacaaccccaggctcttccccgctcattattttctcttcatttccttttactcagtacagtatttttaatgttcatcaatattgtagcgtgtatcagtaattttttcatttctattaccaaataatatttcagttacgaatataccacatttcattttattcatcaattgatgaatatttgagtagtttctactttttagctatagtgaataataatactataaatatttgtgcacaagtttttatgtgaatatatattttcattgctctttgttatataactaggcatagaattactgacttatatgttaactttatgtttaacatttgagagactgtcaggctcttttccaaaacagctgcaccatttacagtcctaccaagagtgtatgagggtttcagtttctccacatctttgtcaatacatgctttatttatctgtcatgtctattccattgatctgtatgtgtctatctttttgtaggtaccacactattttaattactgtagctttgataagtttgaaataaggaagtaagagtcctccaattttgttcctgttttttaaaatggtgtgtttgggctattctacgttctatcaatttccatgtgaattttaagatcaacgtaccaattttagcaacaaagctagctgggagtttgatagagattacattgaatcagtagatcaatttggagaattttatcatcttaacaatagtagagctcagatccatgaacatgagatgtctttgtattcacttaagtctttaatttctttcactgatattttgtagtttttaaaatgtaacttcactcttcctttgttaaatctattcacaaatattttaattttttaatagaattttcgatggaattgttttattatttcatttcagattattcattgcccgtttagagaaaataaccaattttttttaacactgagtcaatggcaaaagaaaatgattgatttttgtatattgatcttgtatcctgcaattttgctgaacttgttaatttttgtagatttttagaacattcctttggctttcttatatataaaatcagtgtaatgcctatcaaaataccaatgacatccttcacagaaatagaaaaaacaatcctaaaatgtatatggaatcacaaaaaatccaaaataaccaaagctgctctaagcaaaagaacaaaactggaggaatcacattacctgacttcaaatatactacagagttgtactaactgaaaacagcatggtcctggcataaaaacagacacatagaccaatggaacagaatgagaacctagaaacaaatccatacacatacagtgaactcatttttgacaaaagtgccagaagcatacgctgagggaaaagagtcttttcaataattggtgctgggaaaactcaataatcgtatgcaaaagaatgaaactagacccctatctctcaccataaacaaaaaccaaatcaaaatacattaaagacttacatttaagacctcaaactatgaaattactacaagaaaacattggagtagctgtctaagatattgatctgggcaaatatttcttgagcaacaccccatgagcacaggcagccaaagcaaaaatggacaagtgggatcacattaagttaaaaagcctctgcacagcaaaggaaacagtcaagaaagtgaagagacaacaaacagaatgggagaaaatatttgcaaactacctatctgacaaaggattaataaccagaatatgtaaggagctcataaactttacaggaaaaataatctaacaatacaatttaaaaatgggcaaaagatttgattcaatagacatttctcaaaagaagacatacaaatagcaaacaggtatatgaaagggtgttcaatcattaatcatcagaaatgcaaatcgagactacaatgagatatcctctcaccccaattaaaatgacttatatccaaaagataggtaataacaaatgctagctaggatgtggaaaaaagggaaccctcctacaatgttggtgggagtgcaagttagtacagccactatggacaacagtctggaggttcctttaaaaactaaaaatagagctaccatatgatccagcagtctcactgctgagtatatacccaaaagaaaggaaatcagcatattgaagatatatctgtgcactcccaagtttgttgcagcactgtttacagtagctagagattcgggagcaagctaagtgttcatcagcagatgaatggataaagaaaatgtggtacctatacacaacagagtaccattcagccataaaaaaaaaaaagggatccaatcatttgcaacaacatggatggaactggagatcattatgctaagtgcaataagccaggcacagaaagacaaacaaatgcatgctcccactcatttgctgaattaaacaaaacaattggccaggtgaagtgtggcttatgcctctaatcccaacactttgagaagccaaggtcaggtggatcacttgagcccaggagttcgagaccagcctgagcaacgtagtgaaaccttgcctcaaaaaaaaaaaaaaaaaaaaaaaattagccaggcatggtggcatgtgtctgtagtcccaactccctgggaggctatggttgccagaggctgggaagggtagtaggggattgggggagaggtggggatggctaatgggtacaaaaactataaagaaggaataaaatctactattgtattgtgatagcataatagagtgactatagttaataataatttaattgtatattttaaacttaaagaatgtaatggtttatatctcaaaggataaatgccagaggggatggataccccagtctccatgatgtgtttatttcacattgcatgcctgtatcaaaacatctcatgtaccccgtaaatatatatacccactatgtacctacaataatttttttgaaaaagatcatatcatcttaaatcgagatagtcttacctctatcttagtctttcccaatctgtgtgccttttatttcattttcttgtctagtttccttggctagaacttccagtataatgttgaatagaagtggcaagactagatattttttgttcctgatctggggggaaaacatgcattcattcaccattaagtatgatatgaactgtggattttccataaatgtcctttaatggttgaggaagtgcccttctacttcttgtttgttgaatatttttaaaatgaagaggtgttagattttgtcacatgcttattctgtgctcctttatgttattcttgccagatatatttctatatgtgatagacccacagtactttctcctacaatattgttttatacaatttctttttcgatcaattaaggaaagaaggagacgaaatatgcattcattgtatcttttataattacttttacttgtgctgcccctttttgttttcttcatgtcagattatcaactggattcttgaagaagtttctttagtacttcttgtcatgtaggtagatgtgttatcaataaattttctcagtttcagtttccttggaacatacttatttcacgttcctttttgaaatagagtttggccagaatgaagttttttttttttttttttttttttttttttttttttttttttttttgagacagagtcttgctctgtcattcaggctggagtgcagtggcgtgatctcggctcactgcaagctctgcctcccgggttcacgccattctcctgcctcagcctcccgagtagctgggactacaggtgcccgccaccacgcccggctaattttttgtatttttagtagagacagggtttcactgtgttagccaggatggtcttgatctcctgacctcgtgatccgcctgcctcggcctcccaaagtgctgggattacagttttttttttttttttttttgagatagagctggctccatcgcccaggctggagtgcagccgtgcgatctcagctcactgcaacctccacctcccgggttcaagggattctcgtgcctcagcctcccgagtagctgatattacagccacacaccaccatgcccagatgattttttttgtatttttagtagagacaggctttcactatgttgcccaagctggtctcgaactgctggcctccagtgatctgcacacctctgcctcccaaagtgctgggattacaggcgtgagccaccacgtccagcccagaattaaaatttttaagtaacaagttttggggttttgttttcctgtcagcactttgtttatatcatccctctgccttctggtctccattgtttctgatgagaaatcagccactgatctttttgagcttcccttgtatgtgagaaattatttttctcttactgcgttcaagattttctctcccttgaacattttcactttgatgtgtctgagtatgattctctctgtcttcatcctacttggaatttgttgagcttcttcagtaggtcagttagtgaattttcatcaaattttggaagtttccagccattatttctttgaatattattttgtttctttctcacatctccttctggtacccctcttatgcatatgctgctgtgtttcatggtgtcccacatttctctgaggctctgttatttactacattcttttttctctgtgctttcattacataatctctatcaatctatcatcgtgttcactgattctttattctgccaactgaaatctatgattgagcccctctagtgaatttcttatttcattgtattatatatttatttccatccggaatttccacttttctctttttttaaaatccatagtctttgcttcattgtgtgcaaagagtattagtggcttttgagctccctgcatttctatttcttgaaaaattggtgtttgattctctccaaaataaccagagaagaaataaggcagaaagtatgtcctcctcacagtctccactcagttccgagactaatagaaaagaacgtaaccagactctgagttctttgcaatatctgaggtcaatacatagaattcttcagtaattcgtgcattcatttttttctacagtgtcatcaaaggacaagcagaaatcttgattcttaactattacaatataatggcctcacctgtgaccacttccgcagtaaatcataatagcaacaaggtcgtgtattctgtctggattggttgcatcccctgaagtgttacacagacaaagttctaaacgaaaaactacctagtaagaaagtttcgtacatcagtgaatttaatccatatatttaaatattttcagatgtagagctctaatcatgggtggtttttaaactttcattcatttatgtgcttcctatttgctacaacactcttcacagtaatgtctgtattcacttcatagagtttctgtgttgctaaaaacccttaaacagtgaataactgatatattttgttctatatcacaggaagttctttaaaatcttcatctttgctcttatagtttcacaagtaatacatctggtttcattagttaatgttttctgaaaaatttcatgaacctacattgggtctggtgtgctgttgttattttcattatcaatattaccatttggtaagtgaccattttgtttatcctgccttctctcttcttatagaatatcagcaattgtatttagtaggtaatttaagaacccatgggtatcttgttgcatgcagaaaaactcattttctttctgtaaccttgttttgaacttctcgggcgatattacttcaaccttttccttctgtgtggctacacagtggaagaaagttgctgagcacattaaaattttccttctacctaggttgtcttgtatgctagaactttttcctgaaatggatgacaaaaataaagcgcatgaagaactgaattcccaaaattgcacatatttcccaaattgactaacccaaaagtgcccattgcaggtattcccaaaattgactaacccaaaatagtgttcattgactggaaactgttctgggccaatctctttctctaatgctgaagcactggcactcgtggtccagatggaggcaggggaggagagaagctaggccacccacttgcattgcaaagcatgggccacaaacccacacaccaaacctgcccagccaccattgcccaattttttttttacaatttctgtctctttattaatattgtatatctgttaaaatgttgtaatcatactttccttttgttctttaagcatagtttgctttagttcttcaattttttttttttttttttttggagacagagtctcactctgtcgcccaggctgtactggagagtacagtggcacaattttggctcactgcaacctccgcatcccaggttcaagcagttctcgtgcctcagcctcccaaatagctgggattacaggcacctgccaccacgcccgactaattgtttttatttttggtacttgtagtagaaacggggtttcaccgtgttggccaggctggtctggaactcctgacttcaagtgatctgcccacctcagcctcccaacatgctgggatttacaggcatgagttaccgtgtctggcctctttgcatatcttataatattttattgaaaactggactttctagatagcatattgtagcaattctgaatattagtcctcaatatttgtcattgttgttggcctgtttattcatttaatgacttccctggactattttaacaaaatctattcaccacctatgtgaagcttctgatgttactcttcagagcacgcagcctttcccatgcatatagtcctcctgggatgacagtagctatgacagactccctttgactgtctctttccttgatctgttatgctgtttgcttctattggtatcatacctacctgttaagctctactaattgctggggtaatgctttattgtttccaataataccccagggaacaaactgctgtagtctgttccaattaaattctgtcccctatactgaactaattttgaggccattctttgaagtttattctgactccaggaagattgttcttaactgcctctttgattctctctggcaaataccttcaagttttggggagtgtttttctgttttgtttaataactgatatccagtcatttcctattgttcaccgagatgacctactacttagcttatttctctcatggagatactagcctccttttgcataccatcagaatcttcattgtttcaagagcactcttgggcttgaattctccctcactctattctcaataaagtcagttctcttggggagagcttcggagttctctgttcttatgatattctcctccccctgggcaaaatcttggaactactagcctgaagctaaggttaggaacagcagcccacttttcatgcagtggcaaacctgttttatgagcagagcagtgtgcagaggagtagcctctaatctcttggcttgcttctcccagcatggaacctgtgccctaagggtgagctggggcatggatgctttaagctccagtgttctcagtctacctcacctggagtagaagaacttttgctctacaggtaaggtcttggtgcagaaagggaacccctggcctctcaactgtacttgagtagaattttacatctgcaatacatagctggggtcatgagaaatgttgatagcttgccttctgtggaagatatcagagcccttggctgggaggtggggagaagggcagccctgtaatcttgaccacacctacctggagtggagcttctgtcctgctgagctggtgagtgggagtgaggaaggcagtgggttgtgactcaagtgccagtgactctctttgttcttcccaagagttagtaaattgtcttgcacaaatgtttcttcattggctgtgtgccctgaagacaattttcagagattttaaatgattttatttttataattttttaccagttatggttgtttcactggggagctcctcactcctcatccattccagaagtgagtctgggctattatcttttggacagtatcccataaacctctcttcttcttctcagaaggaactttattactgtatgatttataatttatcaatatattgcttatagctctagaaatcggcatcatgccataaaccactttgtacactgcatgtcagtaaattacagcatcctcatatatcaatattgtatgtatagacttagtgccaacatgtacgaataggcacaacctaacctaagtacacctgtttatatacatggcattctgtaggtgatatacaaggaaagagaataagcaattctgggttacagccaatctcagttgtagtcatgctactgcctccaaatccagtgtgacaaagcaaggatggggaaactttctcctttccccatccttgatggtcccccagttaacccaggatatgctaggccaagccaggccctttttcttctctagcagtttcttcctagaacctcccagcagaaggtaagctttgctccatcctctgtttaaagaactttcttttttttttttgaaacagagtctagctctgtcgcccaggctggagtgcagtgatatgttctggctctctgcaacctctgcctcccaggttcaagcgattcttctgcctcaggctcctgagtagctgggattccaggcatgcaccaccacacccggctaatttttgtatttttagtagagacaggtttcctccctgttggtcaggctggccttgaactcctggcctcatgtggtccacctgcctcagcctcccaaactgctgggattacaggaatgagccaccatgcctggcctaaagaacttttttaaagaactttgtctaaagttgtttgtaactttaggagttcttctttgctcctgcaaccctctattctctccaaatgttcattgactactaatgctctattctgtttcaccggagaaaaatgaaggaccgaccttctggatctattgcttaagccttcaggtgcctgcatataagatatataaaaggctcagttttattccatttcctggggtgttttgttttgttttaataactgatatccagtcatttcctattttgttcactgaagtgtcatgttttacccatatgcagagttaacaagtttctattatgtatgatctccattttcaaaaatgtctgaggacctgtagagtacactttaaatgcttcaggaagtcagtcataaccttttatatttgcccatagtttgctttcttgcctcatctctgatctccctgagctccatttatactgggccaaaaacttactgctttctcttaagcagaccatctattttatgtgtcagtgcttttgctttcacagatatttaaccaaatgattgtcacagaatatcctaatagtaatatgagatatcagggacccagtacatacctattgaataagtgactacatttggggatttttttttttgagatggagtttcactcttgttgcccaggctggagtgcagtggcacgatctcagctcactgtaacctccgcctcccaggttcgagcaattcccctgcctcagcctcccaagtagctgggattacaggtgcccaccaccacatccagctaattttttgtatttttagtagagacagggtttcatcatgttggccaggctggtctcgaactcctgacatatcatccacctgccttggccttccaaagtgctgggattacagacatgagccattgcgcccgggcatggggattgttttttagaaagctcttcatttgattctaaagctacttaagatccaatgctattctctcttcttttcctgcagtgtcttccctatcatcacttgttccctttgcttgacaaagtcttgcttaacaaaaagaagaaagaaaaaaaaaaactagacacaactaaaatattaccttccttgaaaagtttttctcaattttgtctgtattcctcagctagtggatatttgttattcttggataattagtattagaactctttttctgggtttagggagtaccctacactctgaatcagagacattttctatcttacaggcttaaaatgccaactacttactctcccagtctctgttacacattgggcatgagtccataaacaggactgccaatcaggcatactcaccacagactttgaaacaaaaattagagacatgaaaaaaatgtagactacagactccatttctggagtcttcatttctgaagtagcagtagcagctacttccagtttccaaatataacagaaaagttattatagtggcaacatctatcctgcagcttccagacagtagcattgcatgctgcacgctcctttcctggttgggtaacttccaaagctgtttctatagcatcctgaagaattctgtgaggtgtttcctatcctttgataaatgtattttcttctgaaattataagttggtttctattgctggtgactaagatggagggacacctctgtgcccctaaagcacttcattcataagccaatatagcaacaaaccaaactatcttatagttaattgccaatagaatatgagttaactgagtcaagaaggaaagaaaacacattctaggcagaaaagcatagcagtagcctgtgtagctggaaggaacatagaaggtaccagggactaaagggacagtgtgtctggaagataaagtgaagtaactggtgaagagtgtcaatggatgggaaattgttagaggaattaagtaactgaatcatactgttagcagtggtgaatccatatgggttttcaacaaccttaattcttacctcctcagaagaaataattcaacaaaggggcataagagcagagtgggagactgaggcaaattttagagcaggagtgaaagtttattaaaaagctttagagcaggaaggaagggaagtaaagtacacttggaagagggccaaacaggtgatttgacagatcaagtgcacggtttgacctttgacttgggattttatatcttggcatgtttctaggggaattacgtcccttttcccctgattcttcccttggggtgggctgtcctcatgagcagtggcctgccagcacttgggaggggctatatgcatagtatatttgctggagttgtacacgtgctcacttgaggcattcttttctttagcagtctagtgttcttagaaaaaggtcatataccagttaaactctgccattttgcttcttagtgtacatgcttgaccccacttgcctaactcctgaaatcttatcagaaagctgctgatcaccagtttcaggtgtttctatctattgggagactgcctttccctggcaccagctgtgaccaattattattttagagagacagaccatccacctgactctcacctgatggttgcctgacattcttggttgggaatggggggccctctcctgccttgctcgtgtctgactagctacctactgtaacaatactagctgtataagaccatgtgaagatatttttaagttcaaaaataacataaagctattgagtctttataaatggcagatattatgctcagattaatattttgaaaaaaatcctcttgctgtgggcatgaagaatagattggaggtgggaaaatactggtgattttagttggatttgtgatttgctcatagtgttaagttctgtattattgttccaagtgatcactgcctccagaccagatctttctattaatgcttactttttccttttggagcaatctggaatgaggactttccctccccatcaaaaagccttttattttaacctttaaagctacctaagacacagaacaggctagagcaatattttctccatgcttcttgctgttattaatagctcttgctaatagagatgtaattttttaaagtcaatgttctgctgaagagacttaaacttatatcaagtccatttaattacatatagatgtgggacttagattggattatttttctatgcagatattaaagcatttcggttttgggtttttgtttgttttttttctgggttttctggagacacggtcttactctgtcacccaaactagtgtgcagtggtgctgtcatggctcactgcagcctcaacctcctggtttcaagtgatccacctcagccttccgagtagctggcactacaatgtacaccaccctacctggctaattttttttttatttttttagagatgaggtgtcactatcttgcccaggcttctgttttattttgaaagcacggttgctttcatcttactcttttcaaactaaagtgaaaagtaaaatgatataccacactaaagcgtatatgtttcattatatcatatatacattatatgttatacattattatatatattatatatatttatttgaagagctattcaaaaataaaatttgaagatgttatttatatttttagttggtctcagaaagtgaaataatgattgcagattgccagattgctaatggccagcaaaataattggagctgctattggtttttaataagtggaaccttctgaattttagcaaatccagcaaatcattacaaaaggcattcagtagtaaatcagacaaacaatttggtgtttcgttaattagtatattcaagccatttaagcttctgaagaataaggttgccctgccagaaaatctttccaagcatacttaaaaaagcaatattctaaacaaaggcacagcatttggttgctaatatatgcaaagttggtagggaaaagtctgtgtggctacatgacaggccagccggcttaccacaacagcacagcagggagcaaggggaagtattggaggttaaaggcaaagacaaagaggagttttccagttccagagtgttatttcatataagaatgattttgtttgctgttgttgaccttatctgtccacatcatttcttagttattttaactgacaaaaaaagaaaagtgtagaatatgaataagaaaaaataaaagcatatattctttgtctaaagtaaaattcaggaaatattaggtttaacaatttgaaaagatctgtcgtttttgtgagtcaaaaatgattgattatggacaatttcatgtggttcaacctaatcaaacctaccagtagattgtaatacatcacaatatacagcatgttgcaaatatagtttgctcactctgaatagatttgtatatctttttctttttttgttatcaaaaattatttgtaagaaaatatttactggtatcaaataaatctaattttattaggtgtcagaaacacttgatgtggacatttttaatagagattaaagctcaaaagaaacctttaaagtaatgagggggcaatagagtacaaatgacctcaaagcctaacgctgatgaactgagccaacttataatgccctcatcaatctctcagctgatattccaggactcagagattttccacagccatatatccacactgcagatctccccgattcctaggagtctgaaatctcaggaaagatgagagtcaatgtaagtagtaataataataatagcagctaacacttaaacagtatttactgtacccaggcactgttttaagtgttttacatatattaattcatttaatcctcaaagcaatctaattaaataggtaatattaacatcaagaaataggtgaggaaatgcaggcacacaacagttaagcaatttgcacaaaagtgccacagtaagtaagtacctgagccaaaatttaatcccaggcgttctggcacaagagtcagtacttaaccagcagcaaactgcttctcaatataaaaaaaaaagtctagcatcactgaatcaattctagtacattgtgggttgcaaaattagttgaaataccaacatccttaataaagcttttcaagcttcttttcattctaatagctactattctggactacgttaaagaaaaatattatggatgacatttgataagacaatatgttcaagggactactgcattggggactgcagtgggagagagagattgggcccaactctaactccaataagggcagtgggtatctatacccaaggagcagagtgggtgtcagtggatggaaaattactgaaaggaaacatcagaggcaaggagaattctggctgaactgacttgacagggttattttaaaaggcacgccgggcgcggtggctcacgcctgtaatcccagcactttgggaggccgaggcgggcggatcactaggtcaggatatcgagaccatcccggctaaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaataaaataaaataaaaggcaggccatttgatcagatatcaaggatgggagatttttgctaaactgatccagcaggatacttgcttaaagtagactaaacagtcagagtcactagactaaggatggagcccaagattgaagccttgttaagaggaggactcagaggagcctaacgtttagtcaaaggagagagtttctgtcaatcctccctgttgttcaaaggaaagaagagtcaatcttcttttctttaaataataaaagtccattcctcatttggtagaggatgtctgccggatggtatgaacaatcaggcatttaatgagtggcatttctatgaaacagaaaaagaaaaaccaagattaatgtctacaaacccagtttctgtgtccagagggcagccagtcaagaagatttctggttattgggctcaaagcatctttaaatggtcgactgagggtgagagaagcaaccccacacatttcctggtttgcagtttgaatgtgtttagcgatgacatcgggtgaactttctgaggggcccaaacagcagcaggcatgatgtcgcctgcacacaatctgttatggtaatttgtttgaagttcatgtcaagttgtccagcctcagcttgcagagctttgggaaaatggcagttttagttcttagtgatgccaaagcagaaggatgggagaaaaaattagaatgttagtttggacagttgtagccagatatcaaaggaaactagaggaattctggatcccgtccagtttacaagtatataatgaaacctcaaagacagtgaacagagctagaatctaataacaggtccactatagttttccagtgaaacaaaattttttacaatctcccccctttttaattttttattacaaaataaatctagtgtcattagatttgacctgattatttaaataagcatggcaagaatggtaattgatcacataggcttttaaaatttgctttgtttgaacttttcataaggaatctcagattaaacttttaaaacccaggctaggatagcaagccaagaactcaccaccagattttgccacctattacgcctacagatttaagtgaattcctctcttctctaagtcaccaaggtatccagagtttcctgggcctcccaggaagagacttctgtattcaattgtaagaacgggaaccctgtaagccaggtaccaggctggtatcttaagagggctttgtaagcattggcttataaagttgactctagtttcttaaatctgtttagtcatatctgattctgtgtacttcattctaaaatatgccattccagtcaaagccttggtaatgtaatcaatgtttccagctctgtcctgctataataaaaacatattttattgaacttatacaaacaactatattgccataaaaataataatactcaataatagtatccatattttggagagattaggcagggagaaaaaaataaatgtttcgttttgtttacaaagacataatctgtaagattgctctaagttatagatagtttaagagaaaaaggtttctttaaatatggaaaacaaaacaacaaagaaccagcaatgtttcaaacaaaacctaataaaaattagttcattcagtctcatgtaattaatttttgttctgcttgatcttgaattaatagttttatgaacccatcaacttctaagggtctgataacaatttatttgaaaagagaatttggttgtttctgtgacacacaacaataataaccagaaaagaggattttggcaaagtcctatgaatgtcatacaatttctggaatatttatatcaatgacatatactcatagaaatagaaaataaataagcttaaacatcacattttatttgacagtgcttccttgtaatttaacatgtcaaatacaccaatgtagggtaacatccttctttttacaagattagagcatttaggatttgatttggggaactttgtcaaaaatgttaaaagttggaacacttgattaaatgggatcacaggtcactgtgaaacaatacttagttgtttatttaaccaaagtaattataaaaggttttgcaggcaaatacagaaatttacataattgtaaaaaagaaaccttaggtcttttaaaattgataagacttaggttttttaagtaattgaaaacaaacagactagaaaactttattcttttaacaaagagaaaacccaattgtagcttttcatcagaaaattatgagctctatttttttaaagaactttataagtaaatccatccaatcttagcaacttgattatacaaaatttctttttcacaaacttttacaaccattttacatccattcagtttttatcatactcttttcctctttcacatcctaaaacaacagtcatcttactgtagtagaaaactccctttttcctcagtgaaaacacatttttaaatcttttatactgtttcttactaaaaacacatcttacttttcttacacattttgcacacaaagttgtttccctttacctttattatttctagtagtttaaattacatatattgcttatactttttttattatactttaagttctgggatacttgtgcagaacgtacaggtttattatataggtatacacatgccatggtggtttgctgcacccatcaacccgtcatctacattaggtatttctcctaatgctatccctcccctagcccccgacccactgacagacccaggtgtgtgatgttcccctccctgtgaccatatgttctcattgttcagttcccacttgtaagtgagaacatgtggtgtttggttttctgttcctgtgttactttgctgagaatgatggtttccagcttcatccatgtccctgcaaaggacattaactcacttttttttacagctgcatagtattccatggtgtatatatgccacaatttctttatctagtctatcactgatgggcatttgggttggttccaagtctttgctattgtgaacagtgctgcagtaaacatatgtgtgcatgtgtccttataatagagtgatatataatcctttgggtatatacctagtaatgggattgctgggtcaaatggtatttctagttctagatccttgaggaatcaccacactgttttccacaatggttgaattaatttaccctcccaccacagtgtaaaagcgttcctatttctccacatcctctgcagcatccgttgtttcttgactttttaatgattgccattctaactggcatgagatggtatctcattgtggttttgatttacatttctctaatgaccagtgataatgagtttttttcatatgtttgttgacctcataaatgtcttcttttgagaagtgtctgttcatatacttctcccactttttgatggggttctttctttttttttttttttttttttttttttgatggggttaagttccctgtagattctggatattagccctttgtcaggtgaataggttgcaaacattttcttgcgttctgtaggtgggctgttcactctgatgagagtttcttttgctgtgcagaaactctttagtttaattagaccccgtttgtcaattttggcttttttggcattgcttttggtattttagtcttgaagtctttgcccatgcctatgccctgaatggtattgcataggttttcttctagggtttttatggttttaggtcttacatataagtctttaatccatcctaagttcatttttctataaagtgtaaggaaggggtccagtttcagttttctgcaaatggctagccagttttcctaacaacatttattaaatagggaatcctttccccattgcttgtttttgtcagctttgtcaaagatcagatagttgtagatgtgtggcatgatttctgaggcctctgttccgtttcattggtctatatatctgttttggtaccagtatcatgctgttttggttgctgtagccttgttgtatagtttgaagtcaagtagcatgatgcctacagctttgttctttttgctaaggattgacttggctatatgggctcttttttggttccacatgaaatttaaagtagttttttctaattctgcaaagaaagtcaatggtagattggtggagataccattgaatctataaattactttgggcagtatggccattttcacgatattgattcttcctatccatgaacgtggaatgcttttccatttgcttgtctcctcttttatttccttcagcagtggtttgtaattctccctgaagaggtccttcacgtcccttgtaagttgtattcctaggtattttattctctttgtagcaactgtgaatgagagttcactcatgattaggctgtctgtctgttactggtgtatagggtgatttttgcatgttgactttgtatcctgacactttgctgaagttgcttatcagcttaaggagattttgggctgagacaatggggttttctaaatataaagtcatggcatctgcaaacagagacaatttgacttcctctctttctatttgaatactctttatttctttctcttgcctgattgccccagccagaacttcaaatactatatcgaattcaaattcctgaataggaatggagagagagggcatggttctcttgtgccagttttcaaagggaatgtttccagcttttgcccattcagtatgatattggctgtaggtttgtcataaatagctcttattattttgagatacattccatcaatacctagtttattgagagtttttagcatgaagggttgttgaattttatcaaaggccttttctgcatctatgtggtttttgtcattgtttctgtttaagtgatggattatgtttattgatttacaatgttgaaccagccttgcatcccagggataaagccaacttgatcatggtggataagctctttgatgtgctgctggattcagtttgccagtattttattgaggatttttgcattgatgttcatcagggatattggcctgaaattttctttttctgttgtgtctctgccaggtttttgtatcagagtgatgctgccctcataaaatgagttatgaaggagtccctccttttctattgtttggaatagtttcagaaggaatggtaccagctcctttttgtacctttggtagaattcggctgtgaatccatctgttcctggggttttttggttggtaagctattaattactgcctcaatttcagaacttgttattgctctattcagggattcgacttcttcctaatttagtcttgggaaggtgtatgtgtccaggaatttatcaatttcttctacattttctagtttatttatttagaggtgtttatagtattctctgatggtagtttgtatttctgggggatcagtggtaatatccccattatcattttttattgtgtctatttgattcttctctcttttcttctttattagtctggctggtgatttatgtattttgttaatcttttcaaaaaaccagctcctggattcattgattttttttgaagtgtttttcgtgtctctctatccttcagttctgctctgatcttagttatttcttgtcttctgctagcttttgaatttgtttgctcttacttcttagttcttttaattgtgatgttagggtgtcaattttagatctttcctgctttcttctatgggcatttggtcctataaatttccccctaaacactgctttagttttgtcccagagattctggtacattgtgtttttattttcactggtttcaaagaacatctttatttctgccttgatttcattatttacccagtagtcattcaggagcaggttgttcagttttcatgtagttgtgtggttttgagtgagtttcttaatcctgagttctaatttgattgtactgtggtctgagagactgtttgttataatttctgttcttttgcatttgctgaggagtgttttacttctaattatgtggtcaattctagaataagtgctatgtgatgctgagaagaatgtgtattctgttgatttggggtagagagttctgtacatgtctattaggtcggcttggtccagagctgagttcaagtcctgaatatccttgttaattttctgtctagctgatctgtctaatattgacagtggggcattaaagtctcccactattattgtgtgggagtctaagtctctttgtaggtctctaagaacttgcattatgaatctctcagtgctcctgttattaggtgcatatatattaggttagttagctcttcttgttgcattgatccttttaccattatgtaaagcccttctttgtctttttttacctttgttggtttaaagtctgttttatcagagactaggattgcaacccctgctttttattgctttccatttgcttagtaaatattcctccatccctttattttgaacctatgtgtgtgtttgcatgtgagatgggtctcctgaatacagcacactgatgggtcctgactctttctccaatttgccagtctgtgtcctttaattagggcatttagcctgtttacatttgagggtaatattgttatgtctgaatttgatcctgtcattatgatgctggctggttattttgcctgttagttgatgcagtttcttcatagtgtcgatggactttacaatttgttatgtttttgcagtggctgataccggtttttcctttccgtatttagtgcttccttcaggagctcttgtaaggcaggcctggtggtgataaaatctctcagcatttgcttgtctgtaaagtattttgtttctccttcgctttggaagcttagtttggttgcatatgaaattttgggttgaaaattcttttctttaagaatgtcgaatattggaccccactctcctctggcttgcaggatttctgcagagacagctgctgataatctgatgggattccctttgtgggtaacttgacctttcactctggctgcccttaacattttttccttcatttcaaccttggtgaatctgaccattatgtgtcttgtggttgctcttctcaaggagtatctttgtggtgttctctgtaattcctgagtttgaatgttgacctcccttgctaggttggggacgttctcctggataatatcctgaggagtgttttccaacttggttgcgttcttcccatcactttcaggtacaccaatcaaacgcaggtttggtcttttcacatagtcccatatttcttggaggctttgttcgttccttttcattcttttttctccaatcttgttttcacactttatttcattaagttgatcttcaatctctgatatcctttcttccacttgatcgattcggctattgatacttgtgtatacttcatgaagttgttgtgctgtgtttttcagctccatcaggtcattagtgttcttctctaaactggttattctacttagcaattcctgtaaccttttttcaaggtccttagcttccttgcattgggttagaacatgctcctttagctcagaggtgtttgttattacccaccttctgaagcctacttccgtcaatttgtcagacttgttctctgtccagttttgttcccttgctggtgaggagttgtgatcctatggaggagaagcattctggtttttgggattttcagcctttttgagctggtttttccttgtcttcctggatttatctacctttggtctttgatgttggtgaccttcaaatggggtttctgtgtggttgtcctttttgttgatgtcgatgctattcctttcggtttgttagttttccttctaacagtcaggctcctctgctgcaggtctgctggagtttgctggaggtccactccagaccctgtttcgctgggtatcaccagcagaggctgcagaacagcaaagattgctgcctgttccttcctctggaaggttcgtcccagagtggcacccgctagatgccagctggagctctcctgtatggggtgtctgtcgacccttgctggtaggtatctcccagtcaggaggcacggggatcagggacccatttgaggaggcagtctatcccttagcagaactcgagcactgtgctgggagatctgctgctgtcttcagaggtggcaggcaggaacatttatatctgctgaagctgcgcccacagctgccccttcccccaggtgctctgtcccagggaggtgggagttctatgtataagcccctgactggggctgctgcctttctttcagagatgctgttctcagagaggaggaatcttgagaggcagtctggctacagcggctttgccaagctgtggtgggcttcgcccagttcaaacttccaggcagctttgtttacactgtgagggtaaaaccacctactcaagcagacgcacctccctgctccaagctcgagcctcccaggttgacttcagactgctctgctggccacgagaatttcaagccagtggatcttaacttactgggctctgtgggagtgggatccactgagctagaccacttggctccctgacttcagccccctttccaggggagtgaacggttctgtctcattggcattccaggcaccactggggtatgaacaaaatctcctgcagctagctcagtgtctacccaaatggctgccccatttttgcttgaaacccagggccctagtggtgtaggcacccaagggaatctcctggtctgcaggttgtgaagaccatgggaaaagcagagtatctgggctggaatgcactgttcctaatggcacagtccctcaatccttcccgtggctaagggagggagttctctgaccccttgtacttcctgggtgaggcaacgccccaccctgcttctgcttgccctccatgggctgcacccactgtctgaccaatctcaatgtggtaagttggatacctcagttggaaatgcagaaatcacccgccttctgcattgttctcgctgggagctgcagatcggagctattcctattcggtcatcttgccagccaccctgcttgtactttttagccatcagtagtcttttccttacagagaaaactaggaagtagaaaactgtaaactgtctgtcatagatcagcattttataaacatatcatctcacaattcctacagacatacgcttcctcatactatagtttttcatgtggcaaaaggaaattttttttttacagacctagatatcttaacttctttatattgtatgaaaacaagatgccaaaagtttataaacttatgttcagcaattaatgtttcagtgttatggtttttttttttttttttttgagacagagtctcactctgttgcccaggctggaatgcagtggcaccatctcggttcactgcaacctccacctcccaggtttaagggattctcctatctcagccccccaggtagctgggattaccggcagtgccaccactcccagctaattttctgtaattttagtagagatggggtttcaccattttggccaggctggtctctaactcctggcctcaggtgatccaccctcctcggcctcccaaagtgctgggattacagacgagatccagcgcattcagggtggtatggccatagacaagtgctgggattacagacgtctgccactgtacccagcctgtttcagtagttttttctttcttagaaattatttagatattcagtaactatctcttactcaacatagcataactctaaagtttcaagttaccaaaacagttggcaactgtttttaggcatatatatatatggttattttagggatggttattactgaaaagctcatttataagcttttatcgacttatatccattcaattcacttgtttgtaacaactatgtttgtattgttcatggatatttcatgagacattaaacaaagctacccattatctttttttccttcttttctttttctgaggagagggggactaagaacagagcccaagattggagcctagttaaaaagaggactcagaggagcttgattaaaatttggtcaaaggaactttttccatagttctttagctaggttacagattgttcatctccatattctagaccaacctgcatcctgctgctacattagtataagtaaatcatcattttaatcctgttactaccttgctgaaatccctcttacggtcccacatatccactgccagaaaaggatgtaaacaaaggtagcatagctgaaagcacctcaccacaagctcaatatttccttgaagtctcttgttttacattaaaaattcacacattttacatttcactccaaaatacatctgtttgttttaatataaaaataatgttttaaatcaggtatcacttaaatttcttcacttaattcttcaaatgttcaagtaaaattgaagagtcgggaagatgcttcatgtttatcctgggccttccagtggaccatgaggtatatatttctacttgaagagcccaagtatacagaatacattttaggtgactttgcttatttttaagaccctcaattatctggccccagtccaaccttcccatcttatatattgctgtttccctccattaatcctctgataaatccattcctctacccatctacaattatttacaacatgcccaccatgtaccaggcactgcattctgaagatgtcttataatgtataccacccatgtatctttacttttgtcctttctccctacttggagtatcttccctctttacttcgtgctaatcttcaagactaattttaacaccagtttcattagtccgttctcacataactgtaaagaactgcctaagactgggtacttcataaagaaaagtggtttgattgactcacagttccataggctgtacaggaagcatggctggggaagcctcaagaaacttaaaatcattgtagaaggtgaaggggaagcaggcatgtgttacatggtcagagtaggaggaagagagcaaagaggctggtgctacatacttttaaacaaccagatctcatgagaactcacttcttatcatgagaacagccaggggaaaatctacccccatgatccaatcacctcctaccagggcactcctccaacactggtgattgcaatttgacatgagatttggatggggacacaaatccaaatcacaacacctgcttttcctgactaccccaatcaggactctgaattcctataaaacttacttgatacttattatataatagtctatattcttgatatttgtatgagtaggtcttgtaaatgttttaaggaagagtttgtcatgctgagaagcatgtagattacattgggtatataagatgaaagtaaacatgtatttatagtttcttatttattatatgcaatctcatatcctcagcttgctaccaaatcagtgggcatttaggagttgttcccaccagtaatataacattataacccttgaaatagacccattcagtgactcaagatttaagttaaagtgtagtgatactttacatttcttaaataaaatcatcatatttcttaaaaaaattaaacccagaatctagcataatacttggttcatagttgatatccaataaatacttcttacaataataaatgaatggatgaacaaattaaaaaaatgaagttgatggttaataataaaaatatttttaaaaggaaaaaggaggaaaattgtacatacaagatagaagcttattttacatcagagtgtttggtaataagaaaagtcaagaatattcagaagtaagattaagttgattagtctttcagaccaggtcagttttttgtgttgagcttgtgctttgttatttattgttttgaggttttaaaagcatttagatgggactaaagttacacatcttcacttaatgggaaaagcatcagggtacttgaaagcatagacaattttcttcacaacttaaaccatgctaaaaaggagattaatattatcccaaaactccagtataaagcagtggctcacacctgtaatcccagcactttgggaggccaaggtgggtggatcacctgaggtcgggagttcaagaccagcctgaccaatatggagaaaccctgtctctactaaaaaatgaataaataaattaagaaatacaaaattagccaggcatggtggcgcatgcctgtaatcccagctactcaggaggctgaggcaggagaatcacttgaacccgagaggcagaggttgcagtgagccgagaacacaccattgcactcgagcctgggcaacaagagcgaaactccgcctcaaaaaaaaaaattgagttaaccacatctaaagaaccatgtttaaagcctctaaagtaatagatggggccaaagtaattatttttaaaaaattattttaattttagtatatttagtgggtacaagtgcagacttttacatgcatttattgtgtagtggtaaagtctgggcttttattgtatttgtcacccaaataaggaacaatgtacccaataagtaatttttcaaccctcatcccttcccaccctcccaccttttgttgtctctagtgtctattattccactctgtatgtccaagtgtttccgtcatttagtcctcgcttgtgtgaaaacatgcagcattttactttctctgtctgagttatttcacttagctgtaatgacctccagttccacccatgttgctgcaaaagacatgatttcattcttttttatggctgagtagtattccatggcatatatataccacattttctttatccagtcctctgatgatggacacttaagttgattccacatctttgctttgtgaatagtgctgcaatgaacacgagtgcaggtattttttgatataatgatttctttcccattgggtatatactcagtggtggaattgctaggttgaattgtagttctattcttagttcttgaagaactttccataccaatttccataaaggttgtactaatttacattcctaccaatggtgtatacatattttctattatccccatcctctgcaacatctgttgttttttcactttttagtaatagcccttctgactggtgtaagatggcatctcattgtggttttaatttttatttctctgatgattagtgatgttgagcattttttcgtgtgtttgttagccacttgtatatctgcttttgaataatgtctgctcatttactttgcctacttcttaatgtttttttttttaattatttttcttgtgagttgtttgagctccttgtagattctggatgttagccctttatttggatgcagagtttacaaaattttttcccattctatagattgtctgttttctctgttaattgtttcttttgatgtgcagaatctttttagtttaatttagtcctatttgtctatttttctttttctggcatttgtctttgagaacttactcataaattctttgtctaggtcaatgttcagaagagatttcctcggttttcttctaggattttatagttcccaatcttacatttagatatttaatccatcttgagttaatttttgtatatggtgatatacaaaaattcttacgcatatggctatccaattttcccagtaccccttgttgaataggatgtactttctccagtgtattttggtttcttcttgagacagaatctcactctttcccaggctgaagtgcagtggtgcaatttcggctcactgcaacctctgcctcctgcgttcaagtgttctcatgcctcagccaccctagtagctgggattacagacatgcgccatcatgcccggctaattcttttatttgtagtagagacagggtttcactgtgttggccagggtagtgtggaactcctggcctcaagtgatctgctagtctcggcctcccaaagtgctgggattacaggcatgagccactgcacccagcctctcagtgtatatttttgttgactttgttggagatcagttggttatatgtgtatggctttatttctgggttctctattctgatccattaatctttgtatctatttttataccagtaccatgctattttggttactatagccttgtagtgtaaaccggagtcaggtcatgtgacatctccagcttcattctttttgcttacaattgatttggctatttggggtcttattttttagacccatattaattttaggattgttttttctaattctgtgaaaaatggtgctgctaatttgatagggattgtaatgaatctgtagattgctttgggcagtctggtcattttaacaatactgattcttccaatccatgagcgtaggatgtttttccatttgtttgtgtcatcaaagattttttcatcagtgttttgtagttctgtttatagagatatctcaccttggttaaatatatttctaggtttttgagtggttttttgtagctattgtaaatgggattgccttcttcatttggtcctttactatatcattattggcacatagaaatgctactgatatctgtatggtaattttgtatcctgaaactttactggattcattgatcaaatctaagaggtttttggtggagtctttagaatttgctagatataagatcatatcatcagtgaacagggataatttgaatttctgttttccaattcagataccttttatttttctatgtttcctgattgctgtggcaaggacttccggtactgtgtggaataagaatggtgaatgtgggcatccttatcttgtttcacttcttagaggcaattctttcaaattttccccaccaagtatgatgttggctctgggactgtcatatatggcctttgttatttggaagtgtgtttcttctatgcctagtttgttgaggatttttatcatgaagggatgctgaattttattgaatgccttttctgcatctattaagatgatcatatgattcttgttcttagttcgttttgtgatgtatcacatttattgatttgtgtatgttgaatcatctttgcataaatcctacctaatcatggtatgttatgtttttgatgtgttgttggcattctatttgctagttttttgtagaagatttttgcatgtatcttcatcaggaatattggtctgtagttttgttgttgttgtgtccttgtctggtttcagtgccatacagacctcatagaatgagttagatagaattacctcctcctcgattttcatctgctcctgcacttttgttttattgggagtttgggtttgttgttgttgttgttgtttttgctttttgttgtggtttggttgtttgacagaatctcactctgacactcaggctggagtgacagcctgagttatggttcactgcagcctcgacctctcaggctcaggtgatcctcccatttcaccctcccaagtagctgggactacaggtgcatgtgccaccatgcccagctaatttttgtattttttgtagagatagagtttcactatattgcccagggtggtctcaaactcctgggcttaagcattccacctgccttggcctcccaaagtgctgggactataggcatgagccaccacacccagccctgttgggacatttttttatttactgacttaatcttgctgttcattattaatctgttcaagggctctatttcttcctggttcaacctcaggaggttgtatgtttctatccctctaggttttctagtttttgagcatatagttgttcataatagtttgataatcttttgtatttctgtggtatcagttgtaatgtctcccttttcatttctgattgtgtttatttggatcttctctcctcttttttagtctagctattggtttatcaattttgtttgtcttttcagaggagcaacttttcatttcatttttcctttttattttttgtctctatttgataccttacattttaaatgaagggaaactaaaaaaatttttcaaacctatatgccaaagggaatttcataacaaaggaattctgtggtcaaattaatttggtaaaatatactggattgaactgcattatgcaagcatgtattgcatttctgtagatgtatattgttcaatgaaatataacttagtaaacagttacattattccaaattattatagaccaagggtgtccaatctctttggcttccctggatcacattggaagaagaattgtcgtgggccacacataaaatacactaacactaatgatagctgatgaactaaaaaaaaaaattgccaaaaaatcatataaagttttaaaagtttacaaatttgtgttgggctgcattcaaagccatcctgggtctcatgcagcctgcaggccatgcattgaacaagcttgttatagacatttgaattgtgtcctgtcatgcagataggttcccaagggccatttttgtggtatctgtttttgtcccctaggtgtgcaggtgtgggaaagcagacccactcagatccctactaacttgcctatgaaaaacatctagactaaccttcaagataccactaatacatctatcaatcaatcacaaaagcctggaattctgaaaatactggattataaatatttttaaagcatccccagtacttttttacctttgtgcttttgcaaacctttcccattccatttgcttactctctctttcctctatttctatatattaaaatcccaactctttttttaagagatgaagtctcactatgttacccaggctggtcttgaactcctgacctaaagcaaccctcctgcctcggcctcctagagtgctgggattacagatatgagctgccacccccagccttaatttttttaaaatgccatactctctttgaacctttctccaagctctccaatgggaattaaactattccttgtttggttttctcattctcactttgcatttatttcactgatagcacatctaacaatctgctttattgatccacacaattgttgtgcatgtactctacgctagactccataatatgacctctagttcttcctcgctctggagaagctcataggctagccgagaaggcagatacataagcaaatttctacagtgtaaagtgatatgtattcataaaggtatacaacactgatggtaatcggattgacctgagaaaatatggactaaagtatttgaatgtaaattggcttatacaactaagcttttagcttcatttataacgttcaagtctaaagtagaatgttgtcattcttgttgtacataacttactattcaacagcttgtaagtgccttgaggacctgacctgtgtatttttcatttttctatttcctattgtacctagtactactttagttacctagaatacattcaataaatgtttgttaaatttcgttagtttctaagagttgctcatttttatgaaatttgatcttaatctgcagtttaatctatcttcatattcagactcctattttttcctactttaaaatgtaattgtagggaaggagacaacacacaagacttacataccttgattattatttgactttctcagtggcagtttggaaactgtagacttactccatgtgcattgcctttgcacaaaatatttacggaattgcttttgttccacactattttgaacacacatgttagtttcatcagaattcttagtccaactaaatgtcatctaaaactaagtttagtgagtcaaaagttatatatataacttttatacataaaaacctgatgaagtagatgcaaaagttatatatatctttatttatttatttattattattatactttaagttttagggtacatgtgcacaatgtgcaggttagttacctatgtatacatgtgccatgctggtgcgctgcacccactaactcgtcatctagcattaggtatatctcccaatgctatccctccccactcccccaaccccacaacagtccccagactgtgatgttccccttcctgtgtccatgtgttctcattgtacaattcccacctaggaatgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagactatgattgttggacatttgggttggttccaagtctttgctattctgaataatgctgcaataaacatatgtgtgcatgtgtctttatagcagcatgatttatagtcctttgggtatatacccagtaatgggatggctgggtcaaatggtatttctagttctagatccctgaggaatcgccacactgacttccacaacggttgaactagtttacagtcccaccaacagtgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgagttcattgtagattgtggatattagccctttgtcagatgagtaggttgcaaaaattttctcccattttgtaggttgcctgttcactctgatggtagtttattttgctgtgcagaagctctttagtttaattagatcccatttgtcaattttggcttttgttgccattgcttttggtgttttagacaggaagtccttgcccatgcctatgtcttgaatggtaatgcctaggttttcttttagggtttttatggttttaggtctaacgtttaagtctttaatccatcttgaattgatttttgtataaggtgtaaggaagggatccagttacagctttttacatatggctagccagttttcccagcaccatttattaaatagggaatcctttaccctttgcttttttttctcaggtttgtcaaagatcaggtagttgtagatatgtggcgttatttctgagggctctgttctgttccattgatctatatctctgttttggtaccagtaccatgctgttttggttactgtagccttgtagtatagtttgaagtcaggtagtgtgatgcctctagctttgttcttttggctcaggattgacttgccggctcttttgtggttccatatgaactttaaagtagttttttccaattctgtgaagaaaggcattggtagcttgatggggatggcattgaatctctaaattaccttgggcagtatggccattttcacaatatttattcttcctacccatgagcatggaatgttcttccatttgtttgtatcctcttttatttccttgagcagtgctttgtagttcttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaagggggttgtctagatatacaatcatgtcatctgcaaacagggacaatttgacttcctcttttcctaattgaataccctttatttccttctcctgcctaattgccctggccagaacttccaacactatgttgaataggagtggtgagagagggaatccctgtcttgtgcctgttttcaaagggaatgcttccagtttttgcccattcagtatgatattggctgtgggtttgtcatagatagctctttttattttgaaatacatcccatcaatatctaatttgttgagagtttttagcatgaagggttgttgaattttgtcacaggccttttctgcatctattgagataatcatgtggtttttgtctttggttctgtttatatgctggattatatttattgatttgcatatattgaaccagccttgcatcccagggatgaagcccacctgatcatggtggataagctttttgatgtgctgttggattcggtttgccagtattttattgaggatttttgcatcaatgttcatcaaagatattggtctaaaattctcttttttggttgtgtctctgccaggctttggtatcaggatgatgctggcctcataaaatgagttagggaggattccctctttttctattgattggaatagtttcagaaggaatggtacaagttcctccttatacctctggtagaattcggctgtgaatccgtctggtcctggactctttttcgttggtaagctattgattattgccacaatatcagctcctgttattggtctattcagagattcaacttcttcctggtttagtcttgggagagtgtatgtgtcgaggaatttatccatttcttctagattttctagtatatttgcgtagaggtgtttgtagtattctctgatagtagtttgtatttctgtgggatcggtggtgatatcccctttatcattttttattgcgtctacttgattcttctctctttttttctttattagtcttgctagtggtctatcaattttgttgatcctttaaaaaaaccagctcctggattcgttaattttttgaacggttttttgtgtccctatttccttcagttctgctctgatcttagttacttcttgccttcagctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttctcattggtttcaaagaacatctttatttctgccttcatttcgttatgtacccagtagtcattcaggagcaggttgttcagtttccttgtaggtgagtggttttgagtgagattcttaatcctgagttctagtttgattgcactacggtctgagatatagtttgttataatttctgttcttttacatttgctgaggagagctttacttccaagtatgtggtaaattttggaataggtgtggtgtggtgctgaaaaaaatgtatattctgttgatttggggtggagagttccgtagatgtctattaggtccgcttggtgcagagctgtgttcaattcctgggtatccttgttgactttctgtctcgttgatctgtctaatgttgacagtggggtgttaaaatctcccattattaatgtgtgggagtctaagtctctttgtaggtcactcaggacttgctttatgaatctgggtgctcctgtattgggtgcacatatatttaggatagttagcttttcttggtgaattgatccctttaccattgagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcctgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcccagtctcgatggtctttacattttggcatgattttgcagcggctggtaccggttgttcctttccatgtttagtgcttccttcaggagctcttttagggaaggcctggtggtgacaaaatctctcagcatttgcttgtctgtaaagtattttatttctccatcacttatgaagcttagtttggctggatatgaaattctgggttgaaaattcttttctttaagaatgttgaatattggcctgaactctcttctggcttgtagagtttctgccgagagatctgctgttagtcttatgggcttccctttgagggtagcctgacctttctctcttgctgcccttaacattttttccttcatttcaactttgatgaatctgacaattatgtgtcttggagttgctcttctcgaggagtatctttgtggcgttctctgtatttcctgaatctgaatgttggcctgccttgctagattggggaagttctcctggataatatcctttagagtgtttcctgcagagggggggttccattctccccatcactttcaggtacaccagtcagacgtagatttggtcttttcacatagtcccatatttcttggaggctttgctcgtttctttttattcttttttctctaaacttcccttctcgcttcatttcattcatttcatcttccatcgctgataccctttcttccagttgatcgcattggctcctgaggcttctgcattcttcacatagttatcgagccttggttttcagctccatcagctcctttaagcacttctccgtattggttattctagttatacattcttttaaatttttttcaaagttttcaactcctttgcctttggtttgaatgtccttccatagctcggagtaatttgatcgtctgaagccttcttctctcagctcgtcaaagtcatctccgtccagctttgttctgttgctggtgaggaactgcgttcctttggaggaggagaggcgctctgctttttagagtttccagtttttctgctctgttttttccccatctttgtggttttatctacttttgctctttgatgatggtgatgtacagatgggtttttggtgtggatgtcctttctgtttgttagtttcccttctaacagacaggaccctcagctgcaggtctgttggagtacccggccgtgtgaggtgtcagtctgcccctgctggggggtgcctcctagttaggctgctcgggggtcaggggtcagggacccacttgaggaggcagtctgcccattctcagatctccagctgcgtactgggaggaccactgctctcttcaaagctgtcagacagggacatttaagtctgcagaggttactgctgtctttttgtttgtctgtgccgtgcccccagaggtggagcctacagaggcaggcaggcctccttgagctgtggtgggctccacccagttggagcttcccagctgctttgtttacctaagcaagcctgggcaatggtgggcgcccctcccctagcctcgctgctgccttgcagtttgatctcagactgctgtgctagcaatcagccagactctgtgggcgtaggaccctccgacccaggtgcaggatataatctcctggtgcaccgctttttaagcccatcggaaaagcgcagtattcgggtgggagtgacccaattttccaggtgccctctgtcaccactttctttgactaggaaagggaactccctgaccccttgcgcttcccgagtgaggcaatgcctcaccctgctttggctcgcacatggtgcgtgcacccactgacctgcgcccactgtctggcactccctagtgagatgaacccagtacctcagatggaaatgcagaaatcacccgtcttctgcgttgctcactctgggagctgtagaccggagctgttcctattcggccatccatatatatctttttagatcagaaacaacagggcatctttaattaaagttatctttaattcaagaatatcattcttatttcattgttttctgtcttttgaaaaagtcattatagctcaattttaaaattcttaattgaatatttttaattgagaaaatgtatacatacatgctcatgatcatttttgcattattacattcactgtcattaggtaatgataatagagggtgagacaaaaatcagcctcattagctgattatctgaccctttacctaaaggatcctaacctggagataaaaccaaggatatatcagatggagcaaatactgtaaaacaacatttatttcaactgcacttactcagtttctgagaaatgaaacagtagttgagctgaagtttacttctcctttagccagaaagaaaagaagtgccagtcaaattaatcctatagacataaatagatagataattttaagaaaacaaatgcttttttaaaggctgtgagcttatttggaatatccatttactttcaatttttattctgacttcaaagtattttataagtttatgaaatcatctttttaaaaatatggagtaggtaccttttttcaatttccccttaatgttttatttataaataataaaacaattgtacttctccagactgtactaattaagcccagtaaaattcacttataagtaattagtagagaatacatattttcataagggttcaaataggtttatggagcataaatatcacagggcaaaaatagagatttgagggatactagcttaaccttttatgtttgatgtataagaaaggcaaatgagctactgtcagaggcataacctggaatgatttgagcaacaattgcacattcttatattttatacaaaatatgtattcacaaataatatccaatgtgtcaagacttttaacagggtactttggtttttataaaaattatttgtaactgttacaaggcataacttgctttgtgtagacattaggcttgttttataaaaaattatgttagtaataacagttaccatttgcatgctgctttgagtttaccaaatatttttatatctatcatatcagttcatcccagaaacattgaagataataccgataaggtaggcaagagttaagacttccttggttgtaggtaagaacccccccccgccccccccacacacacacacacactgcctaaagccctcctgccatacacacacacacacacacacacacacacactctaccttaggccaaaaaagggtatggtgggtcataggatgaaatgttcagataggttgatatgagactcccagcttctctctctctggattagcggcatttttaactccagtcttggtagccctgacagttttgagcatcattggccctgatttggctaaatgccaatctctggacccatcactgtagacagagagagagaaggatatgctgattgactttggcagctagacacatctctagaggtggggtaagatttccaaaggaaaatccatatacagctaccagaagtagcaggaaagaatggtgagaagtcaaacaacaaacatccactccagcagatgcaatcatctccattttacagatgagaaaatggatactcaggctatatgacctactcaaatgtaagtcttctcattacaaatcctgctatagatttcttaaaggaaaaaggatggaaaagaaaagagacgtggtttcaggtatgacatctatttctagtctatgttttgtagttaatcaggcatgattgtctttacggtgataagtgagtttgatctgtgtggggtagttgaacaagacatttgtgtgaaataaaatgtcccaagatcagtgtggaggagtaggaagaggtgcagtggacatgatccttatgatccaaagttaggaattttggaatactaaatcaaaatagctaacaagtattagctacttactatgtctcaggcattttggtaattactgttcatgtatcatttaaaaatcaccacattcctatgaaatgaagattttacagataagggagcttaagcaaaaagaggtttaatatcttatccaagattatataactagaaagaaatagagccaggatttgaatctaatctagaacctatgctcctacccacaacagtgtctgtttttgtcatggttaccaaataaagtagtgatgtttacatatctgctatatgctagcttccatggcagatacttgtctggtacaatacctgttttctagaaatttctcctataaagttgtatgagacagcaattcatatgcagcacacttaagaatttataaatgcctacttagtttccacagattattaaagttaattttatgcttttttaaatttatcaaagttacacatcaaattatttaaaaaattaagtagtcgttcaagacttacaacagcagtcccctgctctaagcttcctaccatcagtttccaatccccagatgcaatcattttccatttttttttttttggtaatttaagatttacttttgtaaagccatgtggacaaagattaaatattatgcttgcattttgaacattataaatacaaaacacaaaacatccagtgttaaatgctgatttctcatgcctgatgtgtatttagatattgagtatttcccattttatagaaaggaactttcaaagttttgtcaatacttaaagtgtatactattattcctcaccaaaatcttcatgaaatttaaaaggctgatattaaaagtagttttttttcttaaatatgctaaaacatgtgagtttggattaaccttcagattttcaaggcatgaaagatatacaaatagagtacccaataatatgttttaacacagttaggataagtttgtttacagttgtgacaggaatgcctttgactttcagacattgaaaaaaaataccctaagcaaacatacagggtgttttgggtcaagttacttcttagtaaaaataatacatggtagcaatcaatttttaagccaaattcttaaaatcactcaaaaaacacttgcattttataattatcaaacaatgagtttatgtaacagaagataaaacaaaatctagaaataaaaaatctcacactatattccaagtaccaaaataagaaagaagaaatttgcaaattcttttttaactgtgtcttttggtaattataaaacagaatatctctaaatcacatgattatatttctacttcttgattttttttcaatttcacaggtaatctactaaatccttactatgcaagctatagacttagatctctttattatctcctaccctactgccacaagcacaccatcatttctatatagttatataatgattttgttaagtttaatattcaattgtgcatgttattataatgatacaaactcagttcatagctgaaccatatcctgtatctaactctgcttttcctaaaattaataactgtcttgtcatttgcttggttctctatgtacttatttctgatttggctgaaaactgtgtcccacatagtacagatcccttttcactatcaacttgaggcttctttctgcccctgttttgagttggatctcccagttttcatgtcttttccttcttgagttggtcttgcctgtctgaagatgtctttattgtttactgacatttgattgatattgtggctgagtataggattctggtttgtaattcattttctttctgaatttttatgtcttccctccattgtcttttagcctccagtgttgaaaagttgaaagatagtctgatttctgttttatctatttttcgtttctagaagctattaagattttctatttctatcagagatctgaaattttattaggatatgcccttttggaggcctattttcattcattcagccaggtactcagtgagcccttttaatctgaaaattcatcttctttagtgcaggaaaattttataaatgattttttgaattttttttctttttattttcttggttctctccttctgttatttggatgttgaacctcccagactaattttctaatattcatgtcctttgtctcctatgtttgttttttcttagtgtctttacttgcagggagatctgacctttctattgagttcttcatttctatcattattttgtctctcagcagtactttcttgttccctgaatattcttttgtttttgtttagaccatctgttcttctttcatggatgtagttcttctcttatatgttagaaacattttttcaaattttatgtccctaaagagtcttattttctgtttgttttaccctccatctttcctgttaagggctttcctcagaagtctagtggtccttggctgtcaccttatagttaaggaagtaaaaatgtggatacctcgataacatgtaattggggcttaatgactatgaatttcctagatctgactgctgttttatccaggaacctaatattgttttattgaatatctttcttttgggcctgttagattcaccaaagaagaatcttcttccactttcctacctagagactataagatgggctgctagcattgtgtgaaccaagtaaaagaggacttagagtctcaatattcagcaaataaaatttcattcagttttcctcttttcagtagagtacccttcaaaattccccagttcaaggctgggcacggtggctcacacctataatcccagcactttgggaggccgaggcaggtggatcacttgaggtcaagagttcaagatcagcccagccaacatggtgaaaccctgtctctgctgaaaaaaaaaaaataaataaatacaaaaattagccaggtaaggtggcatgtgtctttggtcccagctacttgggaggctgaggtgggaggatcacttgagcccaggaggtggaggttgcagtgagctgagatcacaccactgcactccagcctggacaacagagcaagaccccatctcaaaaacaaaaaaattccccagttcaagaacctcctattttattcacaccaaagaatgaacttttagtcttctgctagaatgagagagggaaaagtacttggccagttgtgaatggtggcagttaattagaaagtatataattctttttagtttcttcttttttttgtttatttatttatttacttttgccacctattcttttattcctctaaagaaagtatctaattcttaaataaatttctaaccaagtttgttcatagtctcatctttatctcacttccgtaagcactggctgtcaccaattcctaagtcttttggaaattgtagtacaaaattgctgcctagcttatcattaccaactgctggtttagaaaccagcttgcttgggtctgctaagtcagttagcaatagtcctgctttctagcttccaaactgtggttactgtcactcatctctcattctcctttttcttatttgttttgttttttttttaagagacaaggtctcattctgtcactgggctgtagtgcagtggtgctaacatagctcattacaacctggaactcttgggctcaagtgatcctcctgccttagtcccccaagcagttgagactacatgtgtgcgccactaagcctgactcctttttttaatattttatagaggcaaggtcttgctatgttgcccaggctgacctcaagctcctggtctcaagtgatccccttgccttgatttgccaaagcactaggattacagacattaccattgtgcccagccttgtttttgctttttaataaaatacttaagataaaattatattttagtttggttttggaaagggatagagttaagtgcatatgttcaatctaccatctttatgaataatagatactgttgatttttcttatctgttgtgaagtttcttctttttaacatttgttggatttgaggcaaatatcttttgaaatgccaatatctatgtggagaaagtgggaaattgtatatccaacccttgtactcagtctcagggtaagacttgaggagatttctgtttatgtatcctatattttatatttaaatgcttatatatttaaatgcttgcttcactgcatgtaagggtgtttattactcagtaaacccaggaacaataactagtagtcatatattatttaatatatgtagagcttaatctcttttagttaggacatatgataagatgatcaaatattccaagtcaaaagctaggcaactgaccgggtgcagtagctcatgcctgtaatcctagcactttgataggccaaggcaggcagatcacttgagctcaggagttcaagacaagcctgggcaacaaagtgagacccccatctctacaaaaattatccaggtgtggtggcacatgcctgtagtcccagctactcaggaggcttaggtgagagggtggcttgagcctgggaggcagagattgcagtgagccgagatcccaccgccacactccagcctaggcaacagagcaagaccctgtctcagaacattaattaattaattttaaaagctaggcaacatagtttaaactttaaggaaaggctgagcatggggctcacacctgtaatcctagcactttaggaggcggaggcaggaggatggcttgaacccaggagtatgagaccagcttgggcaacatagcgagccctcttctctaccaaaaataaacacaattagctgagtgtggtggctctcacctgtggtcatggctactcaggagcctgaagtgggaggatcacttgagcccagaggtcaaagttgcagtgagccatgatcgcaccactgctctccaggctaggtgacagagtgagaccctgtcttaaagaataataataataataaaataataataaataaataaactttagagaaagaagataggtccacccaccatgagccagacaatttgctttgtatattttattgtcttacataatacatgtatgaaatgatttttgacttctatattttatggatgaagactcaaagattcaaataagttatttccccaaattcatacagctagtgcatgacaaaagtcgaattcaaattcaagattcatttatttcaaagttaatgctctttggaactgagtctgtgtaagataagatggcatgtgtggtttccacatatgggactgcaataaaggtcccaaaacttggagaaaagtcaaagaaaggtcactatcagaaattgcaatcagaaaatccaccattctattttctcacacctatgtcattgaatccttctaacacccctaagagctggctatgtaagtttaagttttgtagttattgatcttaaatctgtaaaacattgtttgcctatatcaaaaaattgattgatctcagtgtcttttcctggtacccccaccaataacatttccacagataaatttgaagttacttggtcatttctgaattaaaattaatttcagttttaaactaagattctacccctatctcctatttgtatcccttctactcttcttttctttcttttcttttgagacaggatatggctctgttgcccacacaggagtacaaaggctcaattctggctcgctgcaacctccacctcctgggctcaaaccatccttccatgtcagcctcccttgtagctgggactaccagcatgcaccaccacacgcggcaaatttttgtatttttggtagagatggggttttgccatgtcacctaggcttgtgtggaactcctggactcaagcagttctcccacctcagccttccaaagtgctgggattacagacatgagccaccatacctggcctcttcttccctttcactcttcctcaagttcctgagggagactgacatatcctgaggcatcgtcaacacttatgggtttgcatattcttttctgttcttgctggcctctgttgagtaactgcttggcccttggccttttggtaccatgtgccagcatctacttatgtcagttccgcttgcttggcctctggacttcatatactggatccactgccatggtccttgctgtaatttccaattgtgagaaccatgtattccttacccttcaaaccccagtctcctttatgtcttccagcttagtcttagccacttttgcacccctcgcatgatggaagcttcaataacttttcacatgctctgccacaatacaatggaatgtttaggattcaaaaatgtcttcagacaaatcttcccaactacctttcttagcctttgtctttggtacccagtgctcagttaccttaatcacagcccctccaaactctttcctgcctagtagcccgtaccttatttatttgcatgagaaaacatctattatattctcttgcattcttgtgtactctatgtttttagtggtactctaggtttttagtggtatgtttttacataaagaatatggccatattctttatataaaagaaaatggttatatcctcttgcattcttgtctactttatggtttttatcatgtaagctttatacaatgatgctcttaaaataataaggcagctttatatgtcctgatatgatcagttgacaaaacatcttacacgaagaaagcaaggtatagaacagtatgcataacctgcttcatttgtggaaatttatgtgtagcatggcaatgcattgaacatctctggaaggatgtatgaaagtggtaatgggggttgcctctggggaatgaagagacagatggctgagggacaagactgagagagattttttactccctttttatatctttaaaattctatgtcatgtgaataacctattaaaaaaaatagataccagataattataaagcatttgtaatttggcttcttcactcttgctaatgtccagatctcctattctcagacacagataaaaagtagctttattggcaaaggtatctttttttccttcactgcttcctgaccttccactctttcttgtaggactttactgaaggctgcataaagcagccaacctgctccaacagtctgaatttttcccttcaattagaagggaaatacttcagtaggcagatggtctgagtcctgaaatgtagcagatgatagtttagttattttgctaacttgccagactgagatagaggggtcctcactacccttcacctgaccctcttggccaagccaagtctacattttacttacaagaatttttcaggttctgttacttacaagaatttttacctgcagggttattacactgaatagatatttaatattattataaatgtatgagtgaataatttttctaaaggaataaattacctgagatagttttaaatgtgtttttgatagagattctttaaatcaatatttaaaatttcccagttgtccattaattatagctatctttttcctcctgatctgaggtccagtcaaggttcatacattgtatttagtggttatatttgcttaatctcctttaatctaaaaaaaaaaattcccagccttatgtgtctgtcatgttgttgacattttttaactcattcaaaaacatttattggccacctatgaaatggcaggcatggtgtcaggttctaggtatttgtacataataatcagtaaaatgttataaatactacaataaagaccgtataaagtgcagaaggagcacaaaagaggaagatacctgtcctctctcaaagattcaggaaagacatgtcagtggggaaatgacatttcagctaacttgaaagataagcagacaaaaaagggaaagcagagatcatcatatgagcaaaatatgtgtattactttttatgtttttgcaaagcacacagtttagagatctgagtcacctctgaggatattaccatgagacatgagtcaggagaaacacacaggaacaggcctttgtatgctgggccaatgaatctggacttcatcctgtgtttgagaattcaaaagctttaagggacaggcagaaaacaaacacaaacatatgatgtgaaatgatagacctgtggcaaactgaattgtatgagttctgcctaaagacattcaaatttgggctgaccaaaccttgccaatgggctggattccgtagacaggacccagtgaggacttttgagcaggcactcgtgacaacgtggagagaagctaaagttggggatgatggggacaggagacagatcacaggttggatatagacaccacagtgtgaaggaggacagatgcctcgtgcctatcaggtctctgtgatgactgtgttaaaatctcaagctcattcttggcaccggacatacatagcattctgaaggcagaggtgcttccatccccttttctgccatgtcttcctctggatgaaacacattcctcactaccatctcaatacatgatctaaaaaaatcttgtttttttcacaaaaaggatatggtaggctgttcttcccctttcccagctttctttcacccacatgggccaaagtgagtggccctcaagtctccaaagtgagtggcctccctttgccctcaagtccttcaagtttctcacccaggaattttcatcatctctgactatgttttccacatttcttctcaaagtatcatttatttctgtataaataagcaagaaaatggagcagagtttgatgaatctcaatgaactcatctctcattttcacatgagcttcagaacacatcatgcctccagattaacaacagtacaacacacagtcaacactggcccctgagcagaaggccatccaagcactgtactttctccctcacccctaagagcagggacaaatatcctagtacctgccaacacctaaaagtctttctttcgttcctacaaatgacgatcaccattttggtcacatactctatacaaaaaataaataaataaataaatttattgtctatcctcaataaaaatatattttaaaggtactagtgttaatctatataaacattactaaagcttttttatttttatagaaaacaggtaagtactgatatttcctccccacatcagcagattgtcttgtgcataactatacctgctgtgtaattcccagaggctgtataatttccagggttcagatttttttctccttcccttttttctctgtatcagttcttctactcaccaacatctcaacactgatttgggtccctctctcccttcagaatcctttatttcctggctgtttattctcagcaactccttccattctgcctaaaaactctttaaaatccttcacaaactaacaaactttagtccttaggacaagccagggttctcaagtgaaatttcaaatctctatgaggcttcccaataccttcatgccagaaggtaaacaaattacttgtctattcccatcaaattctagcctttggactctaatctcattgacatttttgattgccctgggccagttgtttgcaagatatcactttagtttgaatatttctgaaattttttattgttaaatttaggctaaatattctttgcaaaaacattacattggtgatggtatgccttctcaaggtatgatatcatgtaaaaggaaatttttaacacagtagactactatggcttgatgggaggtctaatttgagtttttaattctccatgttttaattttacagtaatgaagtaatttcttagcggtttggtactcaagatagacttgatatcgatatgtagtgttttatccaattcattggctatcattttggaacaacaaaaaaatttcccttttaagttgataagtttctaatgattgagggagttgataaaatcaagtttctgccttttgaagctaaaagccaggtggcaataatatatacctcataggattgaagtgaggattatttgagatgttaacagacaaaatataactgtgagtaatatgctccatgaaggggctctattaatataattaaccccactcagatatttattttaaaccacacatacacacacacacacacacacacacacacacacacacacatagcatttattattgaaactgatactttaagtgctttgtgaatgttaatccttataacacctctattagttagatactgttattgttgtcatttacagataggaagctgtggcccagagaagataagtaactttcctaaggtctaagcaagtgagtggtaatatttcctgctatttttctgtgagaccccacttgaaagtaagtggcctgtatagctacaatctgtgtttgaggatgattttcattcagcttctcctcctagatagttgctttcccctgtcatcctcctcccaccccaatactgttttgccagataatgatgggtgtttattgaatggcagtaccacaatccatataggtgtgtgatactgtgtgtgttttgtatgtgtgtgcatacatcaggctgcttaaatgagttgtttttcttacttctttgttgctttctccattttaatgtaagtttttttttttcttgttctctttttgagatttttaagcattagaattaggccgacccagatttaagctgaatgtttctaagacagtgttctcatctacaaaatggtaatactaacacctatatcatgagattaagtgaggattaaattaggtgatattgccaattataaaggctatatagagatattttgtatatattttatactacatttagttgagttgttggggattttttggtattttttggtattttccattttaacttaaaaggtttggagtttatttttgtttttagtggtgacggtgataagactggcaaacttcttttaattgggctataatagaaagagtaggtttgaagttagactatttaatattaaatcccaaagcctcaattaccacattttaaagtgggaatgttaatgactgtcttgtatcattatagtgatcaccattatatctccagtgcttcccgcagtacctggcacagagcaataaatattgttgaataaatatcaaataaaaagatgttgagagaattaaatgagatataaaggatctagcattgtgtctgggtagatagtagatatacaaaattatactactatttttatcaataatttttaatttattaaatatgtttcttctgattatattattaaacatatgaaaataaagtatagaacatttgctttaattatttctggtagttaatcatagtatttctgaaggatgaagatactaataccttgattctctctagttctttggcaaagacttattgatgtttggaagtgaaaaaatgccaacaatactgttaatgattttgaaaacaagcctttaaataaatgtgcggactcatgttatttctgttccagagagaagaggtactcccttatagggactcgtaaagacatagagcatctggaaattaactgcctccattacactgctgagtcacacacaacgcttgttatgttttcatcacttctctccagaaggtaggcatcatggtttctcttcatagattcttcatacaattatagtttttgtctgcagacttagtttttattaaatatgggaagtgtctgacatctatagattgaaatgctgtatttctccaaagttaggatgcttaaacacgttgcctctaaaaattatttctattggaaaatgaatacatgtttactattttttaaaaaaaagaatgtaatacagaaaaatatagttatcctaccaccttcaggtaactattcttcatattttgttatatcttcctgaatttatttttatatatgtgtattatgtataatatgtggatttatatagttacaataattatgactagacaccatagggcttaaatggtgtttccctgctctgcttcttttacttagtggtttatttcagcctttttaaaaaaaatttatttttttctcctcaacttttattttagattcagggggtacatgtgcagatttgttaactgggtatactgcatgatgctgaagtttgtggtataaatgatctcctcatgcaggtactgagcatagtgcctagcagtcagtttttcaactcttgctcccccttccaccctttcccctctagtagtccctgttgtctattgttgctatctttatggccatgagtacctgatgtttagctcccacttatgtgtgagaacatgcgatatttggttttctgttcctgtgttaattatcttaggataatggcctccagctacatcatgttgctgcagagaacatgagttcattccttttttatggctgcatgatattccatggtgtatatgtaccacattttctttatccagtccaccactgatgggcacctacgtagattatggaatctttactatgaagaatagtgcttaatattgtgaatgcatgtgtctttttgggagaacaatttgtttgcttttggatatgtaccaagtaatgtgattactgggttgaatggtaattctgttttaagttctttaagaaatctccaaactgctttccacagtggctgaactaatttacattcccgccaacagtatgtaagcgttcccttttctccacagcctcaccaacatctgttgttttttgactttttaataatagccattctgactggtatgagaaggtatctaattatggttttgatttgcatttctctgatgattagtgataataagcactttttcttatgtttgttggcctcttgtatatcttcttttgaaaagtgtctgttcatgtcttttgcccaatttttaatggggctgttggttttttgcttgttcaattgtttaagttccttatagattctggatataagacaattgttggttgcatagtttgcaaatattttcacccattctgtggattgtctatttactctgttgataatttctgtggattgtctgtttactttgttgataatttctttcgctgtgcagaagctatttagtttaattaggtcccaattgccaatttttgtttttgttgcaattgcttttgagaacttagtcataaattctttcctaaggcccatgtccagaacggtgtttactgggttttcttctaccattcttatagtttgagttcttacattgaaatctttaatccatttttagttaatttttgtatatagtgaaaggtagtggtccaatttcattcttctgcactgcatgtggctaccaagctattccatcaccatgtattgaatagggagtcctttccccattgcttaattttgtcaactttgtcaaagattagatggctgtaggtgtgtgactttatttctgggttctttattctgttccattgatctatgcatctgtttttataccagtaccatgctcttttagttacagaagcattatagtatagtttgaagttgggtaatgtaatgctttcagatttgttctttttgctttggatttgcgttgtctcttcaggctcttttttggttccatatgaattttagaacagtttttttccaattctgtgaaaaatgacattggtagtttgatagcaatagcgtttaatctgtagattgctttgggcagtatggcccttttaaaaatatcgattcttccaatccatgagcatgtaatgttttttcatttgtttgtgtcgtctgtgattcctagcagtgttttgtagttctccttgtagacagacatctttcacctccttagttagatgtattcccaggtttgtgaatgtgtgtgtgactattgtaaatgggattatgttcttcatttggctttcagcttgaacattattggtgtacagaaatgctactgctttttgtatactgaaactttgctgaagtcatttatcacttccaggagccttttggtggagtctttagtgttttcaaggtatagaatcatatcatcctattgcagcaatttttatgccagtaaatatcatccaccttaaattccaattaaaggttataacatgaatcatgtaaccaccttccttttattaaatatatggaaacatgacttaagtgatatgtattcatatctgatgattttttaagagaatctctaaaagtaagtgttatagaactttagcacctaaacattttctctgatggaagggttccatgacatataacctaaggaaagacttattcaccatcttagagatatatgtcctagtgtatagtattaccgtataccaaggttgtagaaatcaaacttatttaaccatggaatgcattcttaagataacgtatgtcttcaagatgttgataatgggggaggcagtttggagttgtattagtgagggttcttttagagggacagaactaataggatatatatatgtgtgtgtgtgtgtatatacgtatatatgtatatatacacacacacatatatatacccacacatacacatgcgcatatatatttgtttctattgtctatgattcctagcagtgttttgggtatatatacacacacatatatatatatatgtatatacacatatacatatacacatatacacatatacatatacacatatacacatatacatatacatatatacacatatacatatacatatatacacatatacatatgtatatacacatacacatatacatatgtatatacacatacatatacatatgtatatacacatacatatacatatgtatatacacatacatatgtatatacacatatacacatacatatgtatatacacgtatacacatacatatgtatatacacgtatacacatacatatgtatatacacgtatacacatacatatgtatatacacgtatacatatacatatgtatatacatatataaatgtatgtgtgtgtatatatgtattatatatattatatatatatggaagtttattaagcattaacttacaggatcacaaggtcccacagtaggctgtctgcaagctgaggagcaaggagagccagtatgagtctcaaaactgaagaacttggagtccaatgttcgagggcaggaagcatccagcacaggagaaagatgtaggctggaggctaggcctgtctctccttttcacatttatctgcctgctttacatttgctggaagctgattagattttgcccattcagattaagggtggacgtgccttccccagcccactgactcaaatgttaatctcttttggcagcacccacacagacacacccaggattaataatttgtatccttcaatccagtcaagttgatactcagtattaaccatcacaggaagcaaggggtatatgggagtctctgtactttccactccattttgctatgaaactaaaactgctctgaaaaataaactctatttgaaaagaagaagaagaagaagaagaggaagaggaagaggaagaagaaatggaaaaactttaaaagggaaattttttaaatgacattttataaatttacatttaaaattaagtttagacttacacaaacacaaataacatctgtcaatatcccactacacactttgaaaatgctagattatgatatattcttaaaaatggaatcggtagatcaaatagtaaataaattgaaagattataccagtttacatttctaccaacagtgtttgaaagaatgagaatgtcactttctctatagttttgtcaacatttgacattaactttattttttacaaaacctgatacaataaaagtatatggcattttaattttcatttgtgtgattactactgagcatgagtatctttttatatttttatttgaattttaagttcttttatgaatgtcccattcatgagccatgccaaatttttcttgtggaggggtctttgaattttatgtagactgataagaatcataatcatattaagaatattaaatctataaatcatatatatcacaattatgtcttcttttttatttttaatgttttgtgtgctttatttttgttatataatgctatcatttttatgagcttaaatctatcatctttttcatggcttttgggttttgatgtttctttgtaccttggctttattttaaaaaaaaactattatagaaagtcagaaacagaggagttgacaggataataaaatgaaccccaatgtacctcaaatctggcttcattaattgagaattcatggccaatcttgtttcatttataccccctgtattattctgaagcaaatcccaggcattatatgattttctctgttactatttcagtgtatatactaactttagatggaattttgcctaacccatgttttacatctgccatagtttggctgaaatcactgacttccactacaatatacttatgttatatcaaacatcagcattaagcctgggcaacatagaccctgtctctgaaaagaaaaattaactgggcatggtgatgtgtgcctataattctagctattcagaggctgaagcgggcgaatggcttgagccaaggagttttgaggctatagtgagccatgactgcaccattgcactccagtctgggcaacagagtgagatcttgtctttaaaaaagaaaatcagcattagctaagattattgttatttaatttactattttaaaatggcctctataagaatttaattattttaatatggcatgcctcaccagcctcccttatgccatcctctcctacactccctgctctagccttttaattccctgagcaagtaagcccctagaaacttctctatatgctattctctctatccaaaatgttcttgccccaaacttccccacctccagtgccgacttatccaaaaggcacagtaagcgcagtgcctagggttcacaaaattttaaggggtccacaaaaatgtttaaatttattttaaaataagaaaacaaaggacttctaggtaaaagaaaacatttcagtatacagtattaactaacatattcatctttttaccatgtaagttgcaaaatatgatttttagttttattttttatgctgaaaggggcccatgatggcagaagtacctagggcccataaaaatgataatgcagctcttgcctaccctaccccccaatgccacttttactagtagaatcctactcatccctcaggtttcaatgaaaatgccccttcttcagggaagctttgtctgattcttccagattatgtgaaatcccctgaaatatgcaagcccatcaccttgtacgatggaaataaaataagtaattgtataatgctgtgtttaaagaaatcaggaactgagcctaccttgtttaacactatatccccagcacaaagcacaatgccttgtatgcagtgatattagaccctgaaggactgatcatctttcactgtgactctcttatgcccttgtatccagtggttgttcctccccatacctttttgcacacaactttagcccgtacctgttcctctccttccctcttgataaaatctagattgcccaaacagtgggtacaaatcagcaaggacaattcctccctcttgcaagaactatccctggttaactcttcctcaaactagtcagactttggctgatcctcctatacatttcaactcactttaaattagaatacacctttgaagccttctcatattcagtattttcaaataaaggtttatatgccctggctaattttgttccacagtggccattcaatgaagtcacaccgaataaattgctgctacataaattataggcttggtgtcttggaataattaagaaattttttgagagtagtcttgcaaatctaaacatactaagtaatagctaacatgacagtgagaaataatcctaataagaatttcagtgtaagtagattcaattgtttttatttgtgttaacagaaggggttgctggtgtagacattccaacattgtgagaaatatccacatggctctgttgtgggttttttgttcttgcattcgaacttggattttacgttttggggagactttagaagtcaccagaaagttgtccagttttcctatcttgctcacagttcagaactggtttgctttcaatgtacataacagcccctggaataatgtttgacaaatagtagggcttcaataattatttgctgaattaacagaactaataccatttcgaactagtcaggctcaactagaaacaggaggaaggaagggtagcttaaaaaacatccaagccctatatttttgctttgatttattttattatatttaatttattctaaaaatgaaatagaaatcatgagattttatgttttatcaaggaaaatagaagaatagatttcaaagggtaaaaaaaaggtctcagtagttaaaaagcgctacgctaaattctaggtttctgtaagtggggtacattttagtccaattttctgatcctagatttaccaatgctatttaatctcattgagtctcttattgactcagtttcccatttgtaaaatggggataatggctaatgatggagttatgaattaatatatgagtcagaatagtgttggtatacagtaagccctatttaaagcctattctccttcatatcatcagattgttactactgcacttatatttttattattatcatcatcattactctgtaaattgagtgagataagtaaatgttttggtttgttaaattcccccctttactatttattatgtaaatatgtttttaaaaagtgggtgtcattcacacaacttaagtcacaacgtgttaatgacggagaagaaaacagcattaatatgacagcaggaaactgaggttctggtaaataaaaatacataattagccatgaattcaagacttcagagctttcaaaatagccacactaaccagttcataattttgcatgtttagatctggctaaaagaatatttttggcaatatacaataagtcacaattctctgaaatacaaatttgccatgaaaatctaataaaaatgagagagaaaatttgttctcttaaatcttatattacttccattgaatacacacctaacatagtagaacacaatttcagtagtgattttggggttacaattttcacatgtaattccttctgcaggtaaataaaaatataaacccagaacagtaaaaataacataaggtaacagtaaaagcctaccaaggcttttgtttaggtaaacatttatcttaacactggagcttcggaatcctgagaagacccttgggataaagtgacagacacaggtttgattcttcctggtatttcaaacaatgcccccataacctaaggacaattttttgaggataaatgactggctaggagcaccaatgtcctcaggccttgcttggggcctgtaatctcacctaatcattattcactatcccccagaaaagcctcaagctaaaattgtgattgctatttagaactaaacttgcaaattcatttttgaacatccgttcttctgccctcatgacttcattttttgtttaattcatgtgcaccattacatagcagctgcactaagcattaaaacctacagcaacagtcaatgtgttctgagtgctggccttctttattcatttataaaaagatattctgataacaaaaatgcctaaggattacattgcataattcatgcaactggatatctagtcattaaaggggataggaaatgcagtgatagtgggcaatagttcagtaaactcagaattttgcaatacagtttttataagccagcttttactggaaaaatcaaaataatttttataagtgcaaaaataagtttagaatgcaatggtctctgaaaaccaggggataagctagagtaaaatcaggctacaaatttccttaatgagacctttcagtttttcttgcatgggatgtaaaatatattatttcttagcatctatcctgctaaaacttcccatttttgctttgtttctaggattgagcattgcagtcctttccctgttcttccagtaactgtctgcttcagttgatagtgagacacaatttcttactgattatcatatttaagtctcttttatctctttttatatgcaatgctattctttttctagttgaggctgactttgttctttcctcattgaataagaaccacaactgacaatattgtgaactcttactgccattagttattatgcaatattttccaatttcctatgatgagctattacattcactagcaaaccttaacagaagacctcaaggtattgctttcttttagtttttaataccttaaaaactaatcagatattcatcacatataataacacatgaaattttatattctatttaatccaaggactttttttcatttcaaatatacaatttaatattttttacaatttggggttgtgcacccatcgtcacagttaatttcagagcattttcatcactccaaaaagaaatcctataaacactggtattcactttttccacaaatcccccagtcccaggcaggcaaccactaatctactgcctctgtggatttgcctgctctagacatttcagataaatgtgatcataaaatatgtggccttttgtgaccggcttgatttacttaatataataattttaaggttcatccatactgtacaggaatcagtacatcatctctttttattgctaaataatattccattgtatgtacataccatattttatttatccattcatcagctgatggacatttgggttgtttccactttttggctactataagtaatgctgctgcacacacttgtgtacaatattagtgtatttatatatttttatttctctatgagtagaactgatgagtcatcaatctggtaagttcttaaggaataacgttgtaagaatagacaaaagataaatattcctgatgtctgaaaccctttcaagtaaaagcacctggaccctaatcccacacttgctgccaatatgtgttttccttctcagtgaagagtgcctcccaaggttctgctatgtaagaattggggtgtttattgctgcttctctctacccttcatgtccttcatgtcagataacagatgatcctggcattgaagtctaaaagtataatctctgactcttggttctgcaacctatgtgtttagtgtagagatcctctctgccctttgtaccctgtctggcttccttttgaggttgtcgttggatactggcaggtttggtatccacagaaatgagaggagcttgggtaacttttggagtcaaaccctaatgagtgggaccttaaaaagatttgtgtatctttgcttgactagttctcagttttcttgctcttccaaagcagaggaaggctctggacaaagtagctttgttataaaagtagcttgataaagccatctccctctccatgtatctctcctcctttgcttgaaggcctgaattaccatcaccccacctccttgccaccaatggagaacaattcatatttttataatacgtaccagctttttttccaaattaaactttttattttgaaataattatatattcacatgcagttgcagaaaataatacagacatatggtgtactctttacccaatttcccccaatggtagtatctgtcaaattatagtacaatataacaaacaagttagtgacattgatacagccaagataaagaacatttccatcaccacaagggtccctcatgttgctcttttataccacacccatttcccttccctcaccacctgtttcttaactcctcacaactcattaatctattctccattcctataatgtcatttgaaaaaatattttatgagtagaatcacatggtatataaactttggggattgactattttcactcagcataattttctggagattcatgcaggttactgagtgtatcagtagtttgttcctttttattgcttagtagtgcaggctaagtatacctcttatggaatgcttggaaccaaaagtgtttcagatttcagatttttggaagttttggaatatttgcattatcaaaccctgcagaagaccctaataaggtattgccttcttttgaagtgataacataaaaactaatcagatattgatcacatataatagcatgtaaaattttatattctatctacccaaggattttttgagaaatcaaaactgtcatgtttctggagaaagcatatgtaaaattttactcaaaagacttgggaaattccatgatactattcacaatttagtacaatatctcctgaggatagagaaataaaatttatatactgatggagagaagagctatagtttccaataaaatattactttagtaaaaaagggcactgagggtttttgtgtacattaaaggttctgcttttaacatgagagataaaaaaacacttttgtgtcacaagtatttagtataattaaatttttatagaggttgtatttgggattctgacctttatcctaagagtgatggaaaacctctgaagggtgtatatgtgagcagatgtgtgtgtttaaatcagattaaaacatgcgcatggttaaaataaatggtcctttggcccaaattttcccatgtaagcctcgcttctctttccacttttcctttgatacgtatctctattttttcaggtaaaagtaatttgcttccacttgaaaatttttgttaatcattttttagacatcatatattaacaacacgcacacaaacacataaaggaagcattatatactcactcacccaaccctacctccacctttcctgtctctatcattcagcatttagtttgttgttgttgttttgagacatggtctcactctatcacccaggttggagtatagtagcataattgtggctcattgcaacttccgcctcccaagctcaagtgatcctcccacctcagcctcccaagtaccttagactacaggtgtgtgccagcaggtacagctaatttttgtattttttgtagagccagggtttcaccatgttgcccaggctgatctcaaactcctaacctcaagtgatctgcccacctcagcctcccagaattctgggattacagctgttagccaccatgcccatcctttatttagttttatctctatttttagtttctctgttgtaactataatacctttctttttttgtcccattcgctatagatacttctttgtgattgccctcatcagatgaggatattagtacacccaccttctccttcaactcttcttcttcctgatttcattatcaggtctttcatttttgcatttctaaaattaatgccagttacatcttttaaaaaaatttttttattttactttaagttctggaatacatgtgcagaacatgcagatatgctacataggtatacatgtgccatggtggtttgctgcacctatcaacccatcatctaggttttaagccctgcatgcattagataattgtcctaatgctctccctccccttgccctccaccccccaccaacaggccccagtgtgtgatgttcccctccctgtgtccatgtgttctcattgttcaactcacacttatgagtgagaacatgtggtgtttggtcttctgttcttgtgttagtttgctgagaatgatggcttccagcttcatccatgtccctgcaaaggacatgaactcatcattttttatggctgcatagtattccagggtgtatatttgccacattttctttatccagtctatcactgatggacatttgggttggttccaggtctttgctattgcgaatagtgctgcaataaacatacatgtacatgtgtctttatagtagaatgatttataatcctttgggtgtatacccagtaatgggattgctgggtcaaatggcatttccaattctagctccttgaggaatcaccacactgtcttccacagtggttgaactaatttacactcccaccaacatgtaaaagcattcctatttctccacagcctcaccagcatctgttgtttcccgagtttttaataattgccattctaactggtgtgagatggtatctcattgtgattttgatttgcatttctctgtaagctttttttcatacgtttgttggctgcataaatgtcttcttttgagaagtgtctgttcatatcctttgctcactttttgatggactttttcataattgccattctaactggtgtgagatggtatatcattgtggttttgatttgcatttctctaatgaccaatgatgatgcgcattttttcatatgtttgttggccatataaatgtcttcttttgagaagtgtctgttcatatcctttgcccactttttgatggggttgtttgttttttttcttgtaaatttttttaagttccttgtagatgctggatattagacctttgtcagatgggtagattgcaaaaattttctcccattctgtaggtggtctgttcattctgatgatagtttcttttgctatgcagaagctctttagtttaattagatcccatttgtcgattttggcttttttttttttttgccattgcttttggtgttttagtcatgaagtctttgtccctgcctatatcctgaatggtattgcccgggttttcttctagggtttttatagttttaggttttacatttaagtctttaattcatcttgagttcatttttgtataaggtgtaaggaagggatccagtttctgttttctgcatatggctagccagttttcccaacagcattattaaataggggatcctttccccattgcttgtttttgccagttttgtcaaagatctgatggttgtagatgtgtgatattatttctgaggtctctgttctgttccattggtctatatatctgttttggtaccagtaccatgctgttttcattactgtagccttgtaatatagtttgaagtccagtagtgtgatgcctccagctttgttgtttttgctaaggattgtcttggctatacaggctctttttacatttcatatgaaatttaaagtagttttttctaattctgtgaagaaagtcaatggtagcttggtgggaatagcatttgaatagtattgaatctataaagtactttgcaatagcattgaatctataaagtactttgggcagtatggccattttcacaatattggtttttcctatctatgagtatggaatgtttttccatttgtttgtgtcctctctcactctcttgagcagtggtttgtagttctacttgaagaggtccttaacatcccttgtaagttgtattcctaagtattttattctctttgtagcaattgtgaattagagtttgctcatgatttggctctttgcttgtctgttattattattttgcaaccataattaaccatgtacattattgtgtgaaaagggcttttgcatttggtgttccctctacctgcaacataaattcactgagatgacaatttaatccctctttttcttaaattcttgacgataatggcagctgatcagtagggcctcccttgccatacttattttaaatagcaacttcccatgcctggaatttttgctctggtttccttattttttttcttcatagctcacgttgttaatacacattatatattttaattttcttaatttttaaaactactgtcactctcccccactggactgtaagcttcaagaagggagagaatctgttctaactaatttaatccattttttaattcattactttccccatcattactgtattcctagtagctaaaacaatgctatataaccagctgacactaaataagtattaatttaattagtgattaattacagtgccaagtattcttctttggttatattttcttaagcaatttttccgttttcttagaatttctaattcccttttgtttttcttgtatcatttttctttatgatattcccagttctttccaactctccattatataaaacattctggtgtatctctttccttttcttcccccttttccttgggaactgctcttccagagtcttgacatcctctggctgcacaactgtcatcctgagactcccctttcctgatcttctggatggtgctatttcaacccacattttttctcttttcttttctttttttttaattctgctgtgatgaagcgtatcccttagcaactcctaagaacaagtatatggataatcaattttttaaatttttatgtttgaattttttcttattttatactcacaagttatccaggttctaacattagaagatgcaagcctaggggcagagccttacaggtctgggggaaaggagagaagtagtgagtgtatgcatccacattagaaaaggagaaaacacatttaaaaggtgctatttttggccacctactctacatgagacactgtttaaaattgacattttgtaccactttcctaactgttttttataatagtcttcacaattcatcatgttgaaagttatagaaaaggcacacctttaaagactgtggtgaggagaagcaattactatccattttaattgcttgccatcttaattctagtttatctgggactctagattacaaatcttccctctgaatttggaaggtgatgctccactctcttcagacattcatttttgtcctttgtaggtcatctgcttttttcttctggcttttaggatttactcttttttttttttcttggtattttgcaattcctgatatgtctaggtgtaggccttttaaaattcatgttgtacttgaattttaagtgggtactctcttctgaggagttgtgtccttcatatctagaaaattatcttgcattattttcttataattctcccctaacccaccttttttttcttgttctttccttctacaacttttattattctatgatggtccacatgggctggccatttgaagtctgttcttttgcatgatactttgtttcatttttaatctacctactgggaaagctctcaactcttaaaacaaaaattcatgggagggttgaaatataaaattatgtttttattttctaaaagtctttcgtattctctgtggtctctgtgtgtcattgttcattatacaaatattcagtaaatctccccattttcagccctatttctccctgctgtcctcttaccaggcatctcagagcccctgaacctccctgtgtatctacagatcaatgggtcttgtctactctaggctgaggtttcctgtgcccacttcagcagttctaatctgttttcctgctcacattaatatattgaaatctcacatctgttaatggcccatcctccacctattgtggtgttacttattttttatttctgtattgtcattttactgggtcttaaaagaagtaaaaacatgcgtggtctacctggtatctttaactagaagtcattgaaagtttgtaggcaaaaaaaatggccagaggaaatgccattttacaaagatcactcctgataaagcttgagttatagcagcataaactagcagatgaggttactctgcatgtaattatgtgatgcttataacacagcccaagatataggtaatagggctacttattaaaataatacaggagggatataattagtatattcttacatataaagaaataagtggattaatatttaaaggaatgcaaccacctaggaacaagttaaatacaatactttctcctattataaagcaaaataggctgggtgcagtggctcacgcctgtaagtgctcacacagcactttgggaggccaaggcaagtggatcacttgagctgtgaaattccagaccagcctgggcaacaggtgaaacccccactaaaaatacaaaaaaaaaaaaaaaaaaagctgggtgtggtggtacacgcatgtggtctcagctactcaggaggctgaggagcggatcgcttgaggtgggggttggggatgggtggatgaaggctgcagtgagcggcatgccactgcactccagccggggtgacaagagtgagaacctgtcttaaaaaaattaaaagacaaaatataatttattctccagggcaaaattgaagtgactcttttcagaaataatctaatctctacctactctaccagtgctttctatcacttgatttcaatgttattttgcatagagtagcagtaagttagctttataccagccttggacttctagaaatttatagtcttttgacggggtgtggtggctcaagcctgtaatcccagcactttgggaggccgaggcacatggatcacctgaggtcaggagttcaagaccagcctgggcgacatggtgaaaccccatctctactaaaaatacaaaaattagccaggcttggtggcaccctgcacgcctgtagtcccagctatttgggaggcagaggcatgagaatcacttgaacttgggaggaggaggttgcagtgaggcattatcacaccactgcacttcagccttgatgacagagtaaggctctgtctcaaaaaaaaaaaaaaaaaattgtagtgttttattttcagttaacagcaataaggatcaaaatgctatttcatagggtggtaatgatgaataaaatgagataaaacatatcatgttcatttttgctctttctttgtgctatatacccatttttaaaccgcttctagaatatctccataactatagtaaattctctaatatcaaaatcctcctactatatgaaaattttggtcctttaaaagggcactattgccaaataatggagtgtgatatgtaaaaagcatttttcttgccttcttaagtcttaagaaaggctttgcagtcttaagcagctcctttgtgtactcgattgaaagatccttgtaagctttagtgccattaaaaaaatacattgtttatagccagttctatagatctttttgataataggaataaactctttatcaaagcatgatctctatgaatcctagtcatttaaatgtggtttttcaatgttacccattttaattgttgtgctggcatatgtgactgctctttatgtattgcttttcaaatagattaagaaaaattcactgaaaaagttgttttcatttctgtctccctttaaaagaagtatacatatataaaagttatatgtggtagcagttttattatagattattagggactctcattttgctgagacacatatttacttcctgtccttcacataaaaacttggaaaaagggcaagaagaaattttaaatccataactgaataaattcactagatttcaaggaaaataataaaattatagcaaagatcatttcaggtttcaaatatctgtaactgtatattattatggctgaaagaaattgcaaatgcagtgtgcatttttcataatcaaaatgtattataaaccctccatgtctcttttatataaataaaaaggattataatttcaaatatcattattatcatatctgtttgcctttattataagtggaagctgtagtttctgattacctctaactactgctggatttttccctaaagtgcatatattttttggattaacaacacatttatttttagtatatgttctttttacctgcttctgaccattcagtgtgcacatacacacacacatctcagagaataggaaaaacaaaagacattttattaagtaaataatactctgcaaaggttttatttggtttacataatagatgagaagttcctttttgggatactgtcttctattttatgtaggaattatttttaaaaccatgatatcctaggattttttaaaatgtattttgcatgttatgattttctggtggctatacagaaatcttcctgctttttttcccctattcacagtattcaaagtagtccatgtgacctagatattgaaaatctaggtagagtgtgctgcattgctgatatttactgtgaaaccttagaaacattctggtaccacatgctggaattacagggtgcacactgtttaatattgctggtatttttgtgacagtctatatgatcatttttctaagctggcattaaaattgttgaaaaatattcaaaaacaaataaaaaataatgtttttatatttcagttaaaatgcacatataatcaatgttcattttaaaattttagctcagactaggtaagttttattatgagttttcccaccattatttaccttgtatttagaattatcataatctgctaactataaaaatcttccctccgctcccctcctctccttccatgtttttattgagaagaaaaataagaaaaaaagtgctgggttggggccaggcgtggtggctcatgcctataatgccaacacgttgggaggccgaggcagccggatcacaaggtcaggggttcaaaaccagccagcctggccaacattgtgaaacccaatctctactaaaaatacaaaaattagccaggtgaggtggcacatgcctgtaatcctagctactggggaggctgagggaggagaatctcttgaacccaggaggtgaaagttgcagtgagccaagattgcacaactgcattgcagcctgggtgacagagtgagactctgtctcaaaaacacaaacaaaacaaaaaaaaaaacgtgttggatttacagatttcttttcagtacatattcttctgaacatcagttgggacactgactcccctgttttattagtatttccaaacagaaatctgttgcagagccatttttaaaaggtagggtatatgttgaatgactggcttaacaatttgtccaatattaactaatgtagccttttgcaacattgcccaggatctaggctatgaaacaagaagggctcacattatctatatagtcagagaaataggaacttaacaatagttatttttaaagacacgttgccaatcccatagtttggacaacaatcactagatgttaataagagcatcaaaatggtggtggctgccaagatggccaaataggaacagctccggtctgcagctcccagcgagatcaacgcagaaggcgggtaatttctgtatttctaactgaggtacccagctcatctcattggaactagttagacagtgagtgcagccctcccgactggggaagcacaaggggttggggaactccctcccctagccaagggaagacaggagagactgtgccatgcggaacagtgcactcgggcccagatactacgcttttcccatggtctttgcaactgcagatcaggagattccctcgggtgcctacaccaccagggccctgggtttcaagcacaaaactgggtggccatttgggcaaacaccgagctagctgccggagtttttttcataccccagtggcccctggaatgccagcaagacagaaccattcactctcctggaaagggggctgaagccagggagccaagtggtctagctcagcggatcccagccccacagagcgcagcaagctaagatccactggcttgaaattctcaggtcagcacagcagcctgaagtgaacctgagatggtggagcttggtggggggaggggcatccaccattactgaggcttcagtaggcgattttcccctcacagtgtaaacaaggccatcaggaagttcgaactgggcggagatcactgcagctcagcaaagccactgtagccagactgcctctctagatccctcctctgttggcagggcatctctaaaagaaaggcagcatccccagtcagggacatatacataaaactcccatctccctgggacagagcaccaggggaaaggaacagctgtgtgcacagcttcagccaacttaaaggttccttcctactggctctgaagagagcagtgcatctcccggcacaatgctcgagctccgctaactgacagactacctcttcaagtgggtccctgacccccgtgcctcctgactgggagacacttcccagcaggggtcgacagacacctcacacaggagaactccagctggcatctagtgggtgctactctgggacaaagattccagaggaaggaataggcagcagtctttgctgttcttcagcctttgctggtgatacccaggcaaacagggtctggagtggacctccagcaaactccagcagacctgcagcaaaggggcctgactgttacaaggataactagcaaacagaaaggaatagcatcaacatcaacaaaaaggaaatccattcagagaccccatctgaaggtcaccaacacaaagaccaaaggtagataaatcaatgaagatgaggaaaaaacagtgcaaaacggctgaaaattccaaaacccagaatgcctcttctcctccaagtgatcacaactccttgccagcaaaggaacaaaactggacagagaatgagtttaacgaattgacagaagtaggcttcagaaagtgggtaataacacactcctccgagctaaaggagcatattctaacccaatgaaaggaagctaagaaccttttcttttttttgagacagagtctcactctgtcacccaggctggagtgcagtggcgcaatcttggctcactgccagctccacctcctgggttcacaccattctcctgcctcagcctcccgagtagctgtgactacaggcgcccgccaccacgcccggctaatttttttgtattttttgtagagacggggtttcgctgtgttagccaggatggtctcaatctcctgacctcgtgatccacctacctcggcctcccaaagtgctgggattacaggcatgagccaccacacgcagcctctgagaaccttgagaaaaggttagacaaattgctaactaaaataaccagttaagaaaagacctgttctgcagcctctgctggtgatacccaggcaaacagggtctggagtggacctctatacctgatggagctgaaaaatacagcatgagaacttcatgaagcatacacaagtatcaatagctgaatcaatcaagcggaaaaaaggatatcagagattgaagatcaacttaatgaaataaagtgtgaagactagattagagaaaaaagaatgaaaaggaacaaacaaaccctccaagaaatatgggactatgtgaaaagaccaaacctgtgtttgattggtgtacctgaaagtgacggggagaatggaaccaagttggaaaacactcttcaggatattattcaggagaacttccccaacctagcaagacgggccaacattcaaattcaggaaatacagagaacgccacaaagatactcctcaagaagagcaacccaagacacataatcgacagattcgccaaggttgaaatgaaggaaaaaatattaagggcagaagagagaaaggtcaggttatccacaaagggaatcccatcaggctaacagcagatatctcagtagaaaccctacaagccagaaaagagtgggggccaatattcaacattcttaaagaaaagaattttcaacccagaatttcatatccagccaaacaaagcttcataagcgaaggataaataaaatcctttacagacaagcaaatgctgagagattttgtcaccaccaggcctaccttacaagagctcctgaaggaagccctaaatatggaaaaggaaaactggtaccagccactgcaaaaacataccaaattgtaaagaccattgacattatgaataaactgcatcaactaacgggcaaaataactaactagcatcataatgacaggatcaaattcacacataacagtattaacctttaatgtaaatgggttaaatgccccaattagacacaggctggcaaatcggacaaagtgtcaagacccattagtgtgctgtattcaggagacccatctcacacgcaaagacacacataggctcagaataaagggatggaggaatatttaccaagcaaatggaaagcaataaaaagcaggggttgcaatcctagtctctggtaaaagagggtttaaaccaataaagatcaaaaaagacaaagaagggctttacataatggtaaagggatcaatgcaacaagaagagctaactatcctaaatatatatgcacccaataggggagcacccagattcataaagcaagttcttagagacccacaaagagacttaaactgccacacaataatagtgagagactttcacacccaaatgtcaatattaggtcaacaggacagaaaattaacaaggatattcaggacgtgaactcagctctggaccaagcagacctaatagacatttacagaactctccaccccaaatcaacagaatatacattcttctcagcaccacatcacacttattctaaaattgaccacataattgaaagtaaagcactcctcagcaaatgcaaaagaacagaaatcttaacaaacaagtctctcagaccacagtgcaatcaaattagaactcaggattacaaaactcactcaaaaccacacaaatacatggaaactaaacaacctgctcctgaataactactgggttaataacaaaattaacacagaaataaataagttctttgaaaccaatgagaacaaagacacaacataccagaatctctgagacacagccaaagcagtcttagagggacatttatagcaccaaatgcccacaggagaaagcaggaaagatctaaaaccgacaccctaacatcacaattaaaaggagtagagaagcaagagcaaacacattcaaaagctagcagaagacaagaaataaacaagatcagagcagaactgaaggagatgaacccttcaaaaattcaaggaattgaggagctgattttttgaaaagattaacaaaatacatagaccactagccagaccaataaaaaagaaaaaggagaagaatcaaatagacacaataaaaaatgataaaggggctatcaccactgatcccaccaaaatacaaactgctatcagataatactataaacccctctatgcaaataaactagaaaatatagaggaaatggataaattcctagacacatgcaccctcccatgactaagctaggaagaagtcgaatcactgaatagaccaataaaaagttctgaagttgagacagtaattaacactctaccaaaaaaaaaaccccagaccagatggatgcccaggtgaattctaccagaagtacaaagaggagctggtaccattccttctgaaactattccaaacaaaagaaaaagagggactcctccctaactcattttatgaggccagcatcatcctgataccaaaagctagcagagacacaacagaaatactaaatctcaggccaatatccttgatgaatatcgatgtaaaaatcctcaataaaatgctggcagacagaatccagcagtacatcagaaagctcatccaccatgatcgagtcgacttcatacctgggatgcaagcctggttcaacacatgcagatcaataaatgcaatccatgacataaatagaacaaatgacaaaaaccacatgattatctcaatagatgcaaaaaaggccttcgataaaatccaacaccccttcatgctaaaaactatcaataaactaggtattgatggaacgtatctcaaaataatgaaagctatttatgacaaacccacagccaatatcatactgaatgaccaaaagccggaagcattccctctgaaaaccagcacaagacaaggatgccctctgtcaccattcctattcaacatagtgttggaagttctggccagggcagtcaggcaagagaaagaaataaagggtattcagataagaaaagacaaagtcaacttgtccctgtttgcagatgccatgattgtatatttagaaaaccccattgtctcagcccaaaatctccttaggctgatgagcaacttcagcaaagtctcaggatacaaaatcaatgtgcaaaaatcacaagcattcctatacaccaataataaacaagcggagagccaaatcatgagtgaactcccatttacaattgctacaaagagaataaaatacctaggaatacaacttacaagggatgtgaagggcctcttcaaggagaactacagaccactgctgaagaaaataagagaggacacaaacaaatggaaaacattccatgctcatggataggaagaatcagtattgtgaaaatgggccatagtatgcaaagtaatttatagattcaatgttatccccattaagctaccattgactttcctcacagaattagaaaaaactactttaaatttaatatggaaccaaagaagagcccatatagccaagacaattctaagcaaaaagaacaaagctggaggcttcacactacctgacttcaaattatactacaaggctacagtaatgaaaacagcatggtactggtatcaaaacagatatatagaccaatggaacagaacagaggcctcagaaataacaccacacatctacaaccatctgatctttgacaaacctgacaaaaacaagcaatggggaaagattccctatttaataaatggcgttgggaaaaccagctagccatatgcagaaaacagaaactggaccccttccttacaccttatacaaaaatgaactcaagatggattaaagacttaaacgtaagacccaaaaccataaaaaccctagaagaaaacctaggcaataccattcaggacatagacatgggcaaagccttcatgaccaaaacaccaaaagcaatggcaacaaaagccaaaattgacaaacaggatctaattaaactaaagagcttctgcacagcaaaagaaactgtcatcagagtgaacaggcaacctacagaatgggagaaaatttttgcaatctatctatctgacaaagggctaatatccagaatgtacaaggaacttaagtaaatttacaagaaaaaaacaaacaaccccatcaaaaaatgggagaagtatatgaacagatatttctcaaaagaagacatttatgcagccaacaaacatatgaacaaaagctctttatcactggtcattagagaaatgcaaattaaaaccacaatgagatagcatttcacaccagttagaatggcaattattaaaaagtcaggaaacaacagattctgaaggggatggggagaaatagtacacttttacaccattggtgggagtgtaaattaattcaattattgtggaagacagtgtggcgattcctcaaggatctaaaccagaaataccacttgacccagcaatcccattactggttatatacccaaaggattataaatcattctactataaagacacatgctcatgtacgtttattgcagcattattcacaatggcaaagacttggaaccactccaaatgctcgtcagtgatagactggattaagaaaatgtggcacatatacaccatgggatactatgcagccattaaaaagtatgagttcatgtcctctgcagggtcatggatgaagctggaagccatcattctcagcaaactaacacagaaacagaaaaccaaacaccgcatgttctcactcataagtgggaaccgtacaatgagaacatatgggcacagggaggggaacatcacacactggggcctgtcaggggttagggggtatggaagggatagcattaggagaaatacctaatgtagatgatgggttgatgggtgcagcaaaccaccatggcatgtgtatacctatgtaacaatcctgcacattctgcacatgtatcccaacttaaagtattaaaaaaaataaaaacttttttaaaataaataaaaacaaaaaatatttaaaaagagcatcaaaatgtgtttcacaatagttaccttctgctcttactaattcttggtaaagggactccaactgaagcagtactaaggcggtcttgtgttaacgtagtcccagcagccaaatgtggggcaatttgagcattaagataaataatgataataatgaattataacacactatataaaatgagaatcttatcaatccagaccaatataaatgaatacataaatgaaggagaacagaaaattctttcttacatcagaatgccaactaatagaagggataatagagttagaaaatgattttataactctattatcccttctattagatgctaaaattagcgagtaaaattttatattagtttcaaaatattcaaaatttaattataaaggaaacctactaatttgacagtggagaaaccaatggatatcacattaacaaagtgatcatagttaccaccaccaatattgtaataaactttcatttcctgtgtctcctgatatgatgcatggagaaggacacagcatcgcctctgtaatattcccactaaaatgcgtgacctcaattgaattatgaggaaacatcagacaaattcaacatgtggtaaaaatttttaacaaaatgaccggcctacattcttcaaaagtgccaaagtcatgaaaaagaaagactaagtagtggttccatttttcaaaaaacttaaaaaaaaaaaaagtaggaaactgaagacacttaacaactaaatgtcatgtgataattgattggttcttggcctagggttttttttcaatctataaaatcccacaaagggcattgttgggacaattacaaaaattgaatagcgtatgtagattagatacattacttttttaatttgataagttgtattgtaattatgcaagagaatatccctgttctaaggaaatgaagtatttaggggtaaattggaacattgctccagtttactctcaaagattccagaagtacaaattaagcagatagatgctaagatgacaaattaaatagagaaaaatgaaaatcattgaggaatctggataaagagttacaagagtccctcagcctattcttgcagcttttctgtgtgtttgaatatatactgaaataaaaagttgtaatactttttctttttgttgtaatactttttgttgtgattgtttttatttcaatagcttttggtatactcctgtgttcaaatcaataaaattatgaagcaaaattacagtgactaatctgcctccctcaagaaaagatagtttatgttatatttgtgagccatgttaaattctttatgttaaatgtaccatttgaattcaggatattaatattttaagtgaatgcacttaggggatgtataatagatagctatttcaaaacacataaaactactacatccagtctcttccaatccccaccccacctaccatacatttactcattctttattccccactttacctggctaattgaagtgtaacaaaagcttcatccaggaacatttttcttcctctatattttatactaaattattatcatcactttataaaggtgatagattacatattaaattgagaaacatgttttgttaaaaaagactttgtgcaagaaattgtctagttgttgatacttgctttgtatcataaattaccataatgtttgtatttttaaaatgggacaattatcaaaatatcctcaattttaaatattttgcctgcatcatggtttttaaaaacttggcacaatatatttacattatattttcttactttaatataaattctgccttcattgtactgatgagctatctggtctgtattcccagaaatgtagtattacacctttctgttcagaagttaaatattactgtttggtgattttttgacaatgagagttagtaaattcaaagtaaaatacagatgacaaaaattgcacgatagcctatttatttatttatttatttattatttacttattttgagatggagtctcactcaggctggagtgcagtgatgtgatcttggctcactgcaacctctgcccactgggctcaagtgatcctgctgcctcagcctcccaagtagctgggaccatggatgtgcaccactacacttggctaatgtatgtatttttagtagagacagggtttcactgtgttgcccaggctggtctcgaactcctgagcccaagagatcagcctgcctcagcctcccagattactgggattacaggcatgagtctccatgctggctgatagcctaatttttttaaagatatttaccatttaataggaaattaggagaaaaagactgttacagattcagatagtacctgctttaatttttttaatctaagagtccaaaccaaagcaagaatatagatgagggataactaggaaccaagtatttgcaaatatatgagtatatttgaagcaggattttaatatagtttggtgtttctgtttaagaaggaatattgttattctcaacattataagcgttaagaaagaaaggattgtcttctcatggaacatttagtagctttctaaggaaagatatatgtataagcatttcaaaaaattatttctattttctgctgttccttagttttttaaaattccatcaagaattttaaagtctacatttaaaatgtactgaataaaacatgttaatactcttgcccttttaatgaccatataatttctatgagaaaatggtcatgtgtcatcatgtaaatgattttatagaattaaatcttggagctcttatttacaacagaaagaatcccacatcaatgttgacctacttttttccccctcaattagatattttttagcaagagaataactgtctcacaccaggatatgaagccagaattcttattgtaacatattaaaaaaagagaaactctttcttgctgtgtttctgtaatctgaatataaagttacactgtatcaacaaccaacagatggagaaaaagaacactctaggaaactaggctataaatattacgttaattccagaacttccaagattttctagattttgctaaagcatccctaaagtgtgtgatcttttagtaagaaattaataacttagagtggaaaagaagggcacagaatttcaagtcaaggcctgtttattacatcaggcagttttcatcattttcttatacttaacgtgagagccatttttggttctgaattcctaacttgtaggatttcaaagtagtagctccatcaggaattaaaaaatgactttttccctccatcagtgttgtgattctcttattatacatgtagtgaacttcctataaaaacatcaacatattaaagtcacccttgatattggtgattgaatacactattgaaaaacctgctttggcttatattcatttagcttatatcatatacatatgtaccaaatactgtggttgagctaaagctgtagacatagaagatacagtccccattctcaacttgtttaaaacaagcaaactggaccatgataagctaatataataaatatgacaaaagtaagtaaaacactctatggaactatgtagtaagagctgctagcccatatggggtagttatgaaagtcagtgattttgattacccaagttacaaacagaaaaatataaatgaattttggatccaaatcacgttatctaaagataaacagcagttttaataacattaccaatacactgaatgactaggatatgctaagtgttaacaacaaatacaatcttatcatctacattagagatctaaaataataataatgaagattttttcctaagaaaatatttgtcttatttcttctgattgttgggctctttattgttaattggtatacaacaattcaagccacacaatcgaccttttcagagtgacacagcgaaaagaatatgtgtttattaatgaaaatccatgctttactactagaaacacaagtcaaattcgtggcctactaatgatagatcatgaggttcatccttatgtaaaggacagtaacctcatggttacactgtgagccctcactggtgggaaaagcattatgatatgttgtttgagaaagatagtagtggtgaatttggagaaatggccttggacaaagagggagattgccaaatataagaaaaagtgtgaatacagaattgagatgaaagacaagagcttgagaaaggttagcaaagagaatgcgagtgtaagtgaagtaagtggaagagagtatagtgggctcaagaaactcgaagtgtttgatagctaaatatcatgaaaaaaagacttagtggaaagtaacttctacttgaacctggaatgttgggcagtcattgttactctctataatttttcctctgattttccaccgactctgctagcaaggcaactgagtaatagtaatttagcctttgagcaattattctaattagctctctgtagtataataaagacctacatcttttcttttggttacatgctataataaacacatagtttagctgtggatagtctttaccattttttaaagaattacgttttgatatggctacaatattgaattttaacttcggtgaataaacagattttaatgaaaaattgaaagtcagttctcttttaccacaggaaagcaagaaggcctgtttttgaataggtttcaatattcaaagctttcagagaacagagggaagggatatctttgataagattttatttatttaaattttatttccactcatgattttggtagatttccatcaattctggatgtaatactcttgttcattggtagcattgcattacagtgagaagtgcatattgaataaccagataatgacctaacacagtaatgaaccttgctgatttggattaattatagggaaaaatacaaacatgttcttctatattcgttattggaaggacaagttttacaaataccattttagctttcacttatcatatattatatgcattatccatctgatgatagataaaccataaggctttctagagcatgctattctagagcctttaagattttcaaaatttcaaattaatagtacatatgtggcataaatattgatgaatttaatataaatttaaaaataacaacctctctatatgcaaagtaccttttttagagactcttgagatgagtaacatttattagaagattgttaatgaaagcacaaaccaaataagctactctcagtgatcaggtgactacaattcttttaaaaatgtttgttgattagaattattcataatactttaattgactttgtggctttcctctgtcctctgtccttatttagtgtgtttctttcagtgatgaatacaggcttaccttatatcagtagtaacataatacaggctgggcatccataacccaaaaaatccaaaatgccccaaaatcagaaacttagcccaatataaggctcaaaggaaatgctcatgggagcattttggatttcagattttcagattagggctgctgaactgataagtataatgcaaatattccaaaattcttctggttccaagcatttcggataaggggtactcaacctatataccaaaatgtttgattgggttgtagtgacttactagatgccaatttgccaaacccagaatgttgcttagctttgtactttgcacacaaagcccatttccttattccaaactaaatatgtttatgcatacacacacacacacacacacacacacacacacacacgaacatgcatatgcccatgtattttcttactacaaagtcagatggtggaacaattctgaatgtatatgtagatagttaactgtcctcaattaccatattgtgtcttacattgtaaaagacccttgagcaacattaaacaatatgcgacttccttttatttttcttgttacaagtcttactgagatatccagttgttgttttttattacttccataaattatagttagttagcaagtgcttattgaatgctttctaagtgtaatgtagaatttaaagtgatattaaagaaaattaaggcctagcgcctgttgaccttccgtttgaagtttttctccacagtaggtgggcctgaaggtgacccatatgctccttcaccctgaggttaaggtgcaaaagacaaagtacctcctctcaggattctgggatattacagaagatgatcgctcaggcagacgtgcaaattggtacaatagatacagaataatcatagtacaaattatactatcctcttgaattgtcatgcctagcttcctttctcccacacatgcgtatgactattctcccacacatgcgtatgactatacttatattttaaattattttttactcctatgtatgcttttttcttaatattagaaaacaatactatttaaaatacttgattgcttatccaacttagtgatattattttgaattcatttaagttcttagctagcattgcttaatacctggtgtgtataaatattatgctaaatatcgatcctgaatgctacagtctcagacttctcatattttagcatcttctccaaagtataatacaagtcatcaatgaaaatacagtaagcaccagattcaaaactttatggtttcatagcatatcttaggcctcctaactgctgaatcttcagtaactttataaaaaataatttaggaaagaaatttttttacattttacacttttctaccagtcagtattctttattgcaaaccacataatcctcactgaccagtataacagcaaaaggaacatgttaaagttatctctgactttgctaacagacatcagcaagacaagagctggctttggagttgtctaatcagtaatgttgtgcgagcacattccaggagcttgatccactgcatgcagcacttactatgcacgaatctgaacaccactctcatccccaaggaacctgattagtcttccaacaaatcaaatccctcaggaagatttgcatccccagttcgtttgcttccaatttcaaatcatattctgtggattacattgctgggatatggggtacttgccttgctgttagcagtctggaaatgctagttttctgatttctgccttaagaagattgaagccatttcatagaaaattatcaaaatataaggaaagtgttcaaaatttgggggctgtcacaggtcatagatgtccaccaataccaatgaactagattaattttcatcttaaatcttcattgcattattttaaatttctaaggatcagatatttctttgggaaatttacccctatttttgccttcagtaatcatccaaattattttctcagtaaatcactcccaccaaatgttagctgctctgactatcatcgttcatacttgagtgaaagggagaagcacatctggggttgtagtatagaattttttatccttagcactattgacattttaaagtgaataattctttgttattggggctttcctgtgcattgtaggatgtttagcagcatccctggcctctgcctactagatgccaatagcatacatacacatactcagaatgataatcaagattgtcttcccttgaggggtcctaagggaagtttccaaggtactagttctctatcctgtttgacctgatgctgattatatgggtgtgttcactttgtaaaaatttgttaagctctacatgtatgatttgtaccctttaaaaatattcttattatatttcttttttttcttttcttttctttttttttttttgagacggagtctcactctgtcgcccaggctggagtgcagcggcgcagtctcggctcactgcaagttccgcctcctgggttcacgtcattctcctgcctcagcctcccgagtagctgggactacaggcgcccgccacaacgcccggctaattttttgtatttttagcagagacggggtttcactgtgtcagccaggatggtctcaatctcctgaccttgtgatccacccacctctgcctcccaaagtgctgggattacaggcgtgagccaccgcgcccggccaaaaatattcatgttatatttcaataaaatgtacttagtgtttatgaagaaaaaaattgtcttcatacattgacagatactagattagggtactgtattggtcagggttctctagaggggcagaactgataggatatatatatcctattatatatctaatatataattatattatatattataattatatatatttatataattatactattataatttatatatataattttatatataatattataatttatataatatatataacatatatataattatatattataatcatatatataattatatattatatataattatattatataccatatatggtatattgagtatataaatagagagttagcaagtacttattgaatgctttctaagtgtaatgtagaatttaaaggatacatttagagagagaggatatatatatatatgggatatgtatacagatatatatatatcctatttatcctattagttctctccctatatatataaaggggagtttattaagtagtattaactcacgcaatcacaagatcccacaatagaccatctgcaagctgaggagcaaggaagccagtccaagtcccaaagctgaagaacctggagtcggatgttcaaaggcattcagcacgggaaaaggatgtaggctgggaggctaagccagtctagccttttcacatttttctacctgctttatatcctggccatgctggcagctgattagatggtgtctacccaggttaagggtgggtctgcctttcccagcccactgactcaaatgttaatctcctttggcaacaccctcatagacacacccagaatgaatactttgcatccttcaatccaatcaagttgacactcagtattaaccatcacaggtagtaaattattgctggttgagaaccagtaagggactcctatgtctttgcttcatgggcaactaagcaaacaaatagatgccttgtataactattacactttctctgcgtttcttacagtttgaccactgatgtgattatgtctctctcactgcttcctctaaattattttcatcaaaacgtaataaattatataaatctaaagaggaggctgaaaattctctttgctatggaggccttcaataattcactctgcttcctccaatacttcttgtttgtcctctgccccttatggacagacagtctaagtattctgcatccccttccttctttgagggtatcctcgacaatagaaacctacaagaaggtaaagaagagaaggatagtagttcatactttgaatttgaactttgtacttcagaaatttggttagttgggtgagtacatatttcttaaggttatcatgggagcaaatgaaataaaagtatccattttgtctttgcattaattttacatgaaaaagtgttccccctttatagaaattagctattatgtagctaagatttgggattgaggctgtaaaccagtaaccttcctgtatttccttttgtaattcagagtatatgcagggaactgtagataagccatatgaattgcctttttcttttaatgcattctacagtattcattaatttatacatattttcactccttaaaaatgatactgtatgtgagtaaaatggttttatatattaatccttaactattccaagcaaagataaaatagtacaaaaaatcagtttaatgacatttggtttcctgataaatttcaaagttggcctgagtcatattgctgctttttcacattaacctccaaaattgctaacctgctttaagagtttaggagcctgcctttccaaaattgaaaagtaatatttcatttccttattttaagcatttcttttactgcctaataagttatagctctgcaagtatgagggcatgattaaattttttcctctcgcttttaagtagaataaataattcctttttttgtcagagtagttttagtttttatactatatcataaatagctcatcagctgtgtttgagagaacttttttctcactagaaatactgtttttctattattaaaaaagatacaaaatgtttgtcttcttatgtcttaaatcaattgtaatcaattttttaaaaatattcatttggctagctttgtcttaatgtgtttatttagtacccatattctaattaaaattcactcagaatttggtatagcttcaatataatttaataatatatgtaggaaaaatgcatatttacaaatatgtgattaggtaattacaaatgtatagttattggctttccattgaccagtttggaaagtaacaaatgtcttgtggcttgaatctttctatttgtatatttagatacaggtgaagagacaattagtggattgagagagattttttaaatgacacagaacatagcatagaaagaaaactacatgaaatatatgaaaggtagagatttgtagactaaaatgtgaaattctgagactagtaaaagactcacaaagacaagatagagcaaatgaaagaaagataatatttaaagagctcatggctaatgattttccaaaaacagtaaagaacagcagtctacagatagtgaaaacaatatgtaacaaatgagaaataaaaagaaatccataccttgagatattatggtaaaacacaggtcatcaaatacaaaaaaaagatgctcaaagcagcttaagggggaaaaaacacagataacctgaaaagaaacaatgaaatttaccacagacttctcaacagcaataatggaagctagaaatcagtggaataacattttcaaagtgctgagagaaaatacttgtcaacctaagattgaatgcccaccaaaactttacttcaagccaaggatgaaaaaaagataatcaaaaacagtgtactatcaaaagacataaactaaagaaacctctgaaagataatgattagaaaaaattcagtaaaatgacaggaaaaggaaaaataatttcaaaaggagaatctgagatgccagaaggagcactgagtgaaaaaattggcaaatgtgagtaaatccaataaaatctatataaaacaccattactgctgctattaatactactaataggtattattatcttatctagtttcagagattgataaaaaggacaaaaataaaatgttagacaaaaattgcatgaaagccaggggagggggtataacaggaaccatcagtatacctagtaagatttccaaggtaacccactaagagattataatccaataaaggattacaatccaatagagggaggaaatgaaataaacacagtttcaaacaaataaatataaattttgtaagtctatttttaagacaataagagggattttaagtatagaagaagtggcacaaacagaaagcaaaaagtaagatactgggagcaagtctaagaacattagcaattgctgaggtactctgcaacataaaaatgtgaaaagattgaaaatgaatcgatagcaaaaagttatgccaggcaaacaccaaccaaaacaaaactgggcatcaattttaatgcaacaaatatgactagagatagggaaggtcactgcataataatgaaaggtactactcactagaaaaatataattataagcctttttgtccacttaatatcatagcctctgaatatataaaattcaattaaattaaaggaagaaaatgacaaattcagcagtataataaatcttaatatacatttgtctgtattgaactgtgtacccaacaattagagaatatacattcttttcaactgattaatcatttacaaaaagtgccataattttaccacaaagtctcagcaaatttcaaagaattgttgtctcatagaccacattctctgataaataaaagaccataccaaaaagataaatttaaaaattattacacatttagaaatgttttaaatctttgaatagctcattaaccaaagaagaaatacttttaactagacaaaaactaaacatgtaaaatttatatatatatagtcttaatcacttgcattagaaaaaggacagctttgaagagagtagtggttctcccagcacgcagcttgagatctgagaatgggcagactgcctcctcaagtgggtccctgacccccgagtagcctaactgggaggcacccccagtaggggcggactgacacctcacacagccgggtactcctctgagacaaaacttccagaggaacgatcaggcggcagcatttgcagttcaccaatatccactgttctgcagccaccgctgctgatacccaggcaaacagggtctggagtggacctccagtaaactgcaacagacctgcagctgagggtcctgactgttagaaggaaaactaccaaacagaaagggcatccacaccaaaaacccatctgtacgtcaccatcatcaaagaccaaaggtagataaaaccacaaagatggggaaaaaacagagcagaaaaaccagaaactcaaaatcagagtgcctctcctcctccaaaggaacacagctcctcaccagcaacggaacaaagctggacagagaatgactttgacaaattgagagaggaaggcttcagaagatcaaactactctgagctaaaggaggaagttcgaaccaatggcaaagaagttaaaaactttgaaaaaaaattagacgaatggataactagaataaccgatgcagagaagtccttaaaggaactaatggagctgaaaacccaggcacgagaactacgtgatgaatgcacaagcctcagtaaccaatgtgatcaactggaagaaagggtatcagcaatggaagatgaaatgaatgaaatgagaagtttagagaaaaaagaataaaaagaaatgaacaaagcctccatgaaatatgggacaatgtgaaaagaccaaatctacgtctaattggtgtacctgaaagtgacggggagattggaaccaagttggaaaacactctgcaggatattatccaggagaacttccccaatctagcaaggcaggccaacattcaaattcaggaaatacagagaatgccacaaagatactccttgagaagagcaactccaagacacataattatcagatttaccaaagttgaaatgaaggaaaaaatgttaagggcagccagagagaaaggtcgggttacccacaaagggaagcccatcacactaacagctgatctctcagcagaaactctacaagccagaagagagtgggggccaatattcaacattctgaaggaaaagaattttcaacccagaatttcatatctagccaaactaagcttcataagtgaaggagaaataaaatcctttacagacaagcaaatgctgagagattttgtcaccaccaggcctgccctaaaagagctcctgaaggaagcactaaacatagaaaggaacaaccggtactagccactgcaaaaacatgccaaagtgtaaagaccatcaaggctacgaagaaactgcatcaaataacgagcgaaataaccagctaacatcataatgacaggatcaaattcgcacataacaatactaacctcaaatgtaaatgggctaaatgctccaattaaaagacacagactggcaaattggatagtcaagacccatcagtgtgctgtattcaggaaacccatctcacgtgcagagacacacataggctcaaaataaagggatggaggaagatctaccaagcaaatggaaatcaaaaaaaggcaggggttgcaatcctagtctcggataaaacagactttaaaacaacaaagatcaaaagagacaaagaagaccattacataatggtaaagggatcaattcaacaagaagaactaactatgctaaatatatatgcacccaatacaggagcacccggattcataaagcaagtccttagtgacctacaaagtgacttagactcccacacaataataatgggagactttaacaccccactgtcaacattagacagatcaacgagacagaaaattaacaaggatatccaagaattgaactcagctctgcaccaagtggacctaatagacatctacagaactctccaccccaaatcaacagaatatacattcttttcagtacaacaccacacctattccaaaactgaccacatagttggaagtaaagcactcctcagcaaatgtaaaagaacagagattataacaaactgtctctcaaaccacagtgcaatcaaactagaacttgggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaatatcagagcagaactgaaggaaatagagacacaaaaaacccttcaaaaaattagtgaatccaggagctgtttttttgaaaagatcaccaaaattgatagaccgctagcaagactaataaagaagaagagagagaagaatcaaatagatgaaataaaaaatgacaaaggggatatcaccactgatcccacagaaatacaaactaccatcagagaatactataaacacttctacgcaaataaactagaaaatctagaagaaatggataaattccttgacacatacactctcccaagactaaaccaggaagaagctgaatctccaaatagaccaataacaggctctgagattgaggcaataattaataccttaccaaccaaaagaagtccaggaccagatggattcacagtcgaattctaccagagatacaaggaggagctggtaccattccttctgaaactattccaataaatagaaaaaaagggaatcctccctaactcattttatgaggccagcatcatcctgataccaaagcctggcagagacaaaacaaaaaaaaaaagagaattttagaccaatatccttgatgaacattgatgcaaaaatcttcaataaaatactggcaaactgaatccagcaacacatcaaaaagcttatccaccatgatgaagtgggcttcatccctgggatgcaaggctggttcaacatatgaaagtcaataaacataatccagcatataaacagaaccaaagacaaaaaccagatgattatctcaataaatgtagaaaaggcctttgacaaaattcaacaccccttcatgctaaaaactctcaatacattaggtatggatgggatgtatctcaaaataatgagagttatctatgacaaacccacagccaatatcatactgaatggacaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagatgacatgattgtatatctagaaaaccccatcgtctcagcccaaaatctccttaagctgataagcaaattcagcaaagtctcaggatacaaaatccatgtgctaaaatcacaagcattcttatacaccaataacagacaaacagagagccaaatcatgagggaactcccattcacaattgcttcaaagagaataaaatacctaggaatccaacttacaagggatgtgaaggacctcttcaaggagaactacaaaccactgctcaatgaaataaaagaggatacaaacacatggaagaacattccatgctcatggataggaagaataaatatcgtgaaaatggacatactgcctaaggtaacttatagattcaatgccatccccatcaagctaccaatgactttcttcatggaattggaaaaaactacttgaaagttcatatggaaccacaaaagagtccacattgccaagtcaatcctaagccaaaagaacaaagctggaggcatcactctacctgacttcaaactatattacaaggctacagtaaccaaaacagcatggtactggtaccaaaacagagatatagaccaatggaacagaacagagccctcagaagtaatgccacatatctacaaccatctgatctttgacaaacctgagaaaaacaagcaatggggaaaggattccctatttaataaatggtgctgggaaaactggctagccatatgtagaaagctgaaactgaatcccttccttacaccttatacaaaaattaattcaagatggattaaaggcttacatgttagacctaaaaccatcaaaaaccctagaagaaaacctaggcaataccattcaggacatagacatgggcaaggacttcctgtctaaaacaccaaaagcaatggcaacaaaagccaaaattgacaaatgggatctaatcaaactaaagagcttgtgcacagcaaaagaaactaccatcagagtgaacaggcaacctacagaatgggagaaaattttggcaacgtactcatctgacaaagggctactatccagaatctacaatgaactcaaacaaatttacaagaaaaaaacaaccccatcaaaaagtgggcaaaggatatgaacagacatttctcaaaagaagacattcatgcagccaaaagacacatgaaaaaatactcatcatcactggccatcagagaaatgcaaatcaaaaccacaatgagataccatctcacaccagttagaatggcgatcattaaaaagtcaggaaacaacatgtgctggagaggatgtggagaaataggaacacttttacactgttggtggaactgtaaactggttcaaccattgtggaagttggtgtggcaattcctcagggatctagaactagaaataccatttgacccagccatcccattactgggtatatacccagaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtccttagtagggacatggatgaagctggaaaccatcattctcagcaatctatcgcaaggacaaaaaaccaaacaccacatgttctcactcataggtgggaattgaacaatgagaacacatggacacggtaaggggaacatcaaacactggggactgttgtggggtggggggaggggggagggatagcattaggagatatacctaatgctaaatgaggagttaatgggtgcagcacaccaacatggcacatgtatacatatgtaacaaacctgcacgttgtgcacatgtcccctaaaacttaaagtataataataataaaaaaaaagaaaaagaaaggctacaaattaaatgacctagattttcaatttattaagttataaaatgaacaaaagcttttaaaaaagtaagaataagataataaagagcagaaattaatgaaatgaaaacatacattcagccaatgggatccacaaaacctgaaattacttaatttgaaagaccataaaattgacaaacctgtggaagtttaattagttaaaaattaagaagaaaaacagagataagtgatatgattaaaaaagggaagcacacatctctgtgagtagacatttaaaagataagaagatactttatgccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagatactttatgccaataaagatatggcatatgtttttgtatgccaatgaactgtgaaatctaagatgaactgtacccattcctaagaattataccttaccagaagtgactcaagaaaatattgaaagctaaaatggtcctgtaaatattaaagaatcaaatatttaattaaaaacttgtaactaaaaaataaaaagcttcaggcctacatggctgtaactgacccctggcctttcaaatgaaggtcatttcaaacttatgcattcctccagagaatgggaaaagatggaatatctctaaactcagcaatgtacatctatatcaaacccttaatagccaaaccagccaaagacagcaagagaaagtaaaagtacaatgcattctcactcatgaactttaatacaaaatcctaaacataacattagccgactgagtataataatgtatatataaaaaagaaaatacatcgtgaccacggaaggcatccaaagaatacaagtatggtttgacattagggaggaaaattatttagcatattaacagattaatagagaaaaaaacatgatcatctcaatagaattttttaattcagctgaatcattcatgagaggaatgaaagaaaaaaaacctctttgcaaaatagaaaggaagtccttaacataatgaagataatctgtgaagaacatacagcaagtatcattcttcccaatgaagtactagaagcatttactttaaaatcagagcaatacgattgaacattttagtggaggtcagagttcccacagcaagaacagaaaagaaatacaaagtataagcattaaaaagaaagaaataaaactgccttcatttgtctgaaggacatgacaaatgaaaattaaattattagatgtaataaataattagaaataatagaattagtaaaaataggagaatttagctactatttatttcactataaaatcagtttacaaaaataagttgcatttctaatacaaaaaagttagaaaagataatatttactatagcaacaaagatataaagtacacagaaatgaaaataacaaaaatgtgtgtgatctctatgaaaaaactatagactttattgaacaatattaaacatctaaatagtttatacgaatatattagatccaatataatcaagatgtcagttctctccaaattgattcataaattaatttgattccagtgaaaaatcctaacagggtttttggggaatctaaacttcatatgaaaaagcaaagagcatggaatagccaagagacgagggaaataagatggaattggctctgtcagaaaatgagatttgttgtaaagctgtaagatttaagaaagtgtgttattggtggagaagaagacagcttgaccaaaggaacaaaatacattgttttgtgattacctaaatatgtggtaaaagtttttttccacacaaaggaatggcgaatataaaatttaggagaatgcaattgaaaaatatgttcgaagttggattttgtaaattagttaggggagaattgttggttcctaagcacagataatttagagaagtcttcggtgacttatatatgaaatcactgtggatataaacgattacaaatgttacttttgaaccattttatttaaaagaatacaatgttttcctggaaaaataattaggataataattacttctgaggcagggagtttgagattacagttagtatgggtttgtaagcatgtgttattttgcttcatagctcccatatatgtgtatacatattttatacatcatataattatattcattttctagggctgcctaagaaaataccacagactgtgttgcttaaacaacaaatattttatattctcacagatttggaggttggaagtccagaatcaaggtgctggcaggtttagtttctgctgaggcctcgctccttggcttgcagacagctgcattcttgctgtcttctcacatgaccttttctctgtgcatgcacatctctgttgtcatctcccttttttataaggacaccagtcctactggattggaaccacaccattatgacctcatttttcaaaattattataattattcaaaattattataatttcaggggatacatgtacagatttgttccatgagtatgtaatgctggggtttggccttctagtgactccattacccaaatagtgaacatagtacccaataggtagtttttcaactctcacctccctctccttacccctcttttggagtccctaatgtctgttatttccatctttatgtcccattgttgagctcccacatttaagtgtgaacatgcaatatttaattttctgtttctgagttacttcacataggataatggcctcctgctccatccatgttgctgcaaaggacataatttcattctttttatggctccatagtattccgtggtgtgtgtgtgtgtgtgtgtgtgtgtgtgtgtgtgtgtaatgtgatataaataggaaaaaaaaacatatatatatatatatatatatatatatatatatatatatatatatatatataacattttctttatccaacccaacccagcattgatggcacttagcttgattccatgacttttgctattgtgaatagtattgcaatgaacataacagtgcaggtgttttttgatgaaatgatttattttactttggatatacacccagtagtgagattgctggatggaatggtagttctatttttgttctttgagaaatctccacatcattttctataggaattgaagtaatttgcattaccaccaacagtgtataagcattccctttcctccacatcctcaccaacgtctgttatttgttgactttttagtaatagccattctgactggtgtgagatgggatctcattgtggttttgatttgtatctccctgatgattagtgatgttgagtattttttcacatgtttgttggatgtttgtatgtcttcttttgagaagtgtctgttcatgtccttgggccactttttaatggagttattcacttttttcttgttgatttgtttaacttccttatagattctggatattagacctttgtgggatgcacagtttgcaaatattttctcccattctgtaggttgtctctttgttgattttttcttttactatgccgagctctttagtttaagtcctatttgtctgtttttgtttctgtcgcatttgcctttggtcttagttaaaaattatttgtctaagccgatgtccagaaaagtttttcctaggttttcttctagaatttctagtttcaggtcttacatttaagtctttaatacatcttgagttaattttttaatatggtgagtggtagaagtccagtttcattcttcagcatatggctagccagttttctcagcaccatttattgaatagggggtcccttccctgttgcatatttttgttgtctttgtctaatatcagttggatgtaggtgtgtggctttactcttggtttctctattctgttgcattgatctgtgtgtctatttttgtaccagtaccatgctgttttgattattacattataacctatttaatcttaattacctccttaaaggccgtatttctatatgcagtcactttaggggttagggcatcaacatttgaattttcagtctataataattatatatatatgtgtgtatatatgtaagtatatatatgtgtgtgtatatatataagtatatatatgtgtatatatgtgtgtgtatgtatatatgtgtgtgtgtgtgtatatgtgtgtatatatatacgtgtatgtgtgtatatatatatatatatatacatactttttgagatggggtctcactctgtcgcccaggctggagtataatggcatgatctcagctcacggtaaccgtgacctcctgggctcaagtgatcctcccacctcatcctcccaagtagctggcattacaggcatgcaccacacccagctaaatttttgtagagatggagtttcaccatgttgccctggtctcgaactcctgggctcaggcgaacctcccaccttggtctcccaaagtgctgggaaatcaggcgtgagccactgtgcccagcctatagtaataattgttaattacaaattttaaataaaatatacatcctatgcacgtcctttttggtgttcagaagttcttaataatattaatcccttttggaatttctttccatatttctctaaggaattcaatttaaaaggtctatataggataggaatgattacagcctttaacaggcatattcacaaatcactctgcaaagtctgaagtctacatttcaagccaataaattgaaactcccaagactctttaataaacctagtaatagatgagacaagagaagaaaatgtcctgaggtttctgaatattttatttaatcaagtcgtatttcagggttatttgtttcttccattaagggcttacaaaaatgctgattatttttagatgttttagaaaacagtgttaaagaacagtatttactgggaaaatatacagctaaatatagttttatcatatgagtatatattttagcacaaacaaaaaaatttacaggtttaatttgcagctatatttttgacattttattgcttcactcggactaaatgactcaatgacttaatatttctctgcactgcctactagggattttagcaaataccaggatgatttgatgtaatttatattacttaaatctttttcctgcctgaatgtaatgtttgactttataatgtttttcttttgacatcatatatttcacaagtaatatactttgggatcacctaaaacaaggaatgggtttcttatcagcagacaacattcctctctaatatggtcatcttcctgattttagaaagcatataaataaaaattaatggaagcttccagatgtttttacaataggcacatttatttcaattattctgtattttgtcaaagcctaattccctgaaagctaataggtatattgatgaagttatcagataaaagcaaatatttacaaatcatcattctgaaaacagataagttaatattggcttaggttttgcatctgttcatcaaggaacaaagatatacaacatgtatctctacaaaaggatatttcccttgacccttatatgtgtgcacaattttttcctgttctttcttcttgtattgcattattggaaaacttaataattttttgttgtagcctgcctccaagtctagtatagcacatatgtaaatttttgtttttcttttttctcacaaagtagaaattagctcattggttttttttctgaatataacagtgatactatttattacagatgtctgtttttctaataatacagacaaagttcatattagactatggtttttggaagacatggtatcacatttcattattgctatagttattctataataaacaatgtagacagcgacatagcatgaatccaaatttcaaatctttgttatggtttttgattggcttttattagcaaaaataaactggggaactgccaaatactctatttctttatgatattatagatcagtgtttttcaatttgttgtgtctagactttcacttctgtaaaaattacctggagttgcttgttaaaaatacagatgccaaaatgctaccctagtcttctcaatctgatatcttcagtttggcctggagttctgaattttcacgcacaatgctgatgattcttaggctactgtttgagagccacttatgtacaccatagcctgagtaaggtacaagctttgttccctggcttttttggtgtgtttaattttccaaattacttcttgagaatattttatctgtctgacagttattttatgcctttatttaaatcaaacagcaacttaaaccaatgagagccagcctcagctctggctctgtgctaaaaggccttccctactccagtttatctaaggaacttctcttcatcctttacagcctgttactggcctgtgcttgccttcatcaggcctggggtatagagagcattcataaaatcggacccattcttaatacagtgagcttaggaattattttctctttatttatttaaataaatatttagttcattgttaacaggggataatggttacaatgaaagatttattttcatttctttatttaatgtcattgcaaattggaaacatttttaaaaactcactgcccttcagcctcttaaatatagcctgtaatcctctgctagaggttacagtatatttcttttctgcatttccaggatttagttagtcctggaaatattataggccataggacttttgatattgtttgttatagagagaccaagggagctaaagataaaggccttgtaaaattattcagttctcactcctgtgagagtatctaaataaaggaaaacaagaaattaccagcatgttttagagaattgagaagtttggcaatcctatgggaaggtatttccatgtaatcttttaaatttatgcccacccaatctgttttccataggtttcagaatctcctcttcaactacctacaatgaagaaataaatcacctccaacagtcaaaagtctgaaattaaggaaagtaaacagtatattacccagactagttaaaataacaagacagtaaagtgacacagtctatgattgacgtctccttttccaaggacatctctcacagatgtaatcttcacaggttagcagggagttgatgttgaaaccatactaagaaacagattgtgcacccccaaaataaaaaagaacaaaaaaaattgatccctatgcaccaacactataaaccagtgcttctaaattaactaaattatcctaactcaagttaaccagatataccaaatttgagggtcagcagcaaacatctccttgtccttgtccattaccctggtctcttctcactttatcctggttttgaatttgagtttctagtttaccaactttgatagacacagaaagcacagcctcctttcagatgaacttcagatagaacagatattcttggtgttcacattcaactctaattcacctgaaagattagtagcagtgacacaatacagtggaatgggaggggaagctggcatgttgggggcaataggagttattgagagtcactgaggatatattgaaattttgaattgaaaagaaaaggttatgcttataactagggtagacatttaggcaatgttaccttattgctgtctagtgttacttgtactttttactgctttatgttacaaatgttctgatttaagatatacaaatagcaaatgcatttttgcacccataagtatgtggggtcctgttgttttctgacatcctaaattcactgcgtggctatattgttttttctttagtggtattattttcaccttatgttggaatcaagattataatagcctcataaataataacttgagtagcttttgctctttctatgtttcctggaacaacttaaaataagaattcactataccttgaaaatttggtagaatctactagttattttactctggggtttcctgagatgggtggtctttggctatcactttaatttctttatttcttattcaagtctatgttataacaattttgatatcctatatttttctgggaattcatatatttcatttctatcttcaaatattttagtatataattgttcataataaccattcttatgtttcttaatctctgtggtgtctacagttaattcccttttttcattctgtactttggtttttttttttttttcatttttttgttcattccataccttatttgaacattctgtcttttgtctttttttagtctcaacaaaagtatgcttatgttattaatattttcaagtaatcagcttttgatttgctattttttcttgttattattttgttagtgctgttctcaatttcattctgtctttatatttattatttccttccttgtttctttgtgcttgctctgtgcctctcttttaacttctttagttagatgcttaactcatttaattttaacccattttgtttcatgatgaatatattattgatatgaactttcttctaactcctatatcaacaccttttcttactttcttcctaagatcaatgaagtttaggtttttcattcctgtttgaggccaaccatttccaagtttacttttcctttcctatctcctccatggctttgtttttagtctttgtctcagtgttggagctcaggatgtggaacagaaaacccattcatgctaagagaaaaggtgagttagtataaggataccagtggaccatacctggaaagctatgagataccaatgcagtttgctgtctccccttaagggatatagtttcccatggagcctctgcttctctctattcatgtttggcctattctgttttctctaaaagctagtttcctcatgttctacttcacagatatttcctttagccacttatggtttttgtttcatctaacttcagctttaacatggctcattactgctgcaccatcctttgtttttacaccactaccctttcatctgagtttctacgctattcagtcaattatttccatatttcttagtttatactcctaatgaagagaatccattggcccaactcatcttttttttttttttttttcacagagtctcactctgttgcccaggctggagtgcggtggcgcaatcttggctcactgcaacctctgcctcccaggctcaagcaattctcctgcttcagcctcccgagtagctgggatcacaggcatgcaccaccacacccggctaatttttgtagttttagtagagacagggttttaccatgttggccaggctggtctcgaactcctgacctcaggtgatccaccctcctcggcctctcaaagtgcagggattagaggcgtgagccaccgtgcctggccccaactcatcttttcataataggtaacaggtcattaaccaacgtgtatgcctaatgttagtcagtcagctatactgaggggtgaggaatcacaccatataagccacactctcatgggcaagagctgtgggcagggtatttccacctcatgatgtgaacaggctccggcaatctctaatagccctccagttcttatacattcagttttactccactggttttttccaccttacaccttaatgttatttgtcttgtcactctaaaaaatactctcttttgatgttgtttttttctagctgtgttcaactcattcttcttttcccctcatccattgttctcaaaagtataatatttgctgtgttcacattctcatctctcattaactttttatcccattaaaactgagcttcctcttctattacattcctggaactgctctcgctaagggaaccagtgatcttccagttgtcatatccagtggatacagaggcagtcaactgtgttggagccatggtatggagacctccttacttgcccctcctccttcagctagagcttagtgagctagagccagagctggtgttagagagcaatggcagcatggtgaccatgcacagcggcggctacaagcaaaattccactgccctgttttcaatatctaacattcatggcagctttcttccacaaatgttccactcccttgatttccatgaatctacactttcacagtgctgctcataacctctggatattctttctttttttccttttgtagattccatgcttacctactactttttttattctgtgtactctccacttttgtagatccgagtatcacagataagctgctgattccaaaattcacatttccaacctagacttattctccaccttgctctttgtgcagtcacctttatgactatgtcaaagagctttcttgccttctggcttccagttgggtttggcccaatgaaaggcatttggaaaagatcagaaggtgggaagtgagtgagactggggtattcttacagggttgccacaggttagctacatccatttactgaagggcacaactcctgtcaacacccaggaagtgcccttttctgacttagatatgataatgggtctccaatattgcctgtgtcagttcccttaaaccttgcccatgtccttatagataaatttttctgcaaattacacttttgagcgtactgtctttttttctaccaggaccctgactcatataacatatgagttataacttatttaccatgcctttcctaaactccttacattgtcctgaggccccacacagccatataattactaagacttgctgatttcagatcccaaatattactcaagtatataccttttctctcttttcactcttaaaatcctagaggcccttaatacatctctatgaattttttttaagtgtgagatagaaaaggactgattaaggtaaactgtgtagtaaaaattgtcaaccaccagcaaactgatcatatggtcaacgtgattatatttggctttattattctctagctaatacatgaatgtgcatcttgtggcccaaatgtttctgtcttctgatccttttttttttttttttttttttgagacggagtctcgctgtctcgcccaggctagagagcagtggcacgatctcggctcactgcaagctccgcctcccaggttcacaccattctcctgcctcagcctcccgagtagctgggactacagatgcccgccaccacgcccggctaatttttttattttttactagagacagggtttcaccatgttagccagtatggtctcgatctactgacctcgtgatccacccgcctcggcctcccaaagtgctgagattacaggcgtgagccaccgcgcccagcctgatccttatattttatttattttattttattttttattatactttaactttcagggtacatgtgcacaacgtgcaggtttgttacatatatatacatgtgccatgttggtgtgctgcacccgttaactcctcatttagcattaggtatatctcctaatcctatccctcccctctccccctaccccacaacaggccccagtgtgtgatgttccccttcctgtgtccatgtgttctcattgttcagttcccacctatgagtgagaacatgcagtgtttggttttttgtcttttgcgatagtttgcagagaatgatggtttccagcttcatccatatccctacaaaggacatgaactcatcattttttatggatacatagtattccatggtgtatatgtgccacattttcttaatccagtctatcattgttggacatttggattggttccaagtctttgctattgtgaatagtgctgcaataaacatacgtgtgcatgtgtctttatagcagcatgttttatactcctttgggtatatacccagtaatgggatggctgggtcaaatggtatttctagttctagatccctgaggaatcgccacactgacttccacaatggttgaactagtttacagccccaccaacagtgtaaaagtgttcctatttttccacatcttctccagcacctgttgtttcctgactttttaatgatcgccattctaactggtgagatggtatctcattgtggttttgatttgcatttctctgatggccagtgatgatgagcattttttcatgtgtcttttggctgcataaatgtcttcttttgagaagtgtctgttcatatccttagcccactttttgatggggttgtttgtttttttcttgtaaatttgtttgagttcatggtagattctgggtattagccctttgtcagatgagtagattgcaaaaagtttctcccattctgtaggttgcctgttcactctgatggtagtttcttttgctgtgcacaagctctttagtttaattagatcccatttgtcaattttggcttttgttgccattgcttttggtgttttagacaggaagtccttgcccatgtctatgtcctgaatggtattgcctaggttttcttctagggattttatggttttaggtctaacatgtaagtctttaatctatcttgaattaatttttgtataaggtgtaaggaagggattcagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattggtctatatctctgttttggtaccagcaccatgctgttttggttactgtagccttgtaatatagtttgaagtcaggtagagtgatgcctccagctttgttcttttggcttaggattgacttggcaatgtggactcttttgtggttccatatgaactttcaagtagttttttccaattccatgaagaaagtcattggtagcttgatggggatggcgttgaatctataaattaccttgggcagtatgtccattttcacgatatttattcttcctatccatgagcatggaatgttcttccatgtgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctcttattggtgtataagaatgcttgtgattttagcacatggattttgtatcctgagactttgctgaagatgcctatcagcttaaggagattttgggctgagacgatggggttttctagatatacaatcatgtcatctgcaaacagggacaatttgacttcctctttacctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagataactcttattattttgagatacatcccatccatacctaatgtattgagagtttttagcatgaaggggtgttgaattttgtcgaaggccttttctgcatctattgagataatcatgtggtttttttcgttggtcctgtttatatgctggattacgtttattgattttcgtatgttgaaccagccttgcatcccagggttgaagcccacttgatcatggtggataagctttttgatgtgctgctggatttggtttgccagtattttattgaggatttttgcgtcgatgttcatcagggatattggtgatccttatattttaaaagatcattgaattctttcaattttgttttatttataaacatagaatgtttttatctagtggaatgttgatagaatccttttttaactttttcttttttactttttttaaatttttttttcagtaatatggtattccccagaaagaatcctaatatacaaaataaattaaagtgaagctggttctggttaaagcagggttagcacctaagacagagcaggaatgttaattctctattaccagtgcttattaagtatttgttttctcccagttattttctccaactctaactctattgccatcctggccctgggctgaaacccttattcactgacataatcagaaactggttataatgagatcctagctcccattccacctgggcaggatgatttttcaagaaagattcttgtttcaaaggtatttggaatctccatccaacatgaaggttggtttattctttttttatgtaggaattaaagaaacttgatgaaagaaatatggaaaagctttcagtaaatcagaagagttccccattgtaacataagctctgaatatcactttctgagaggtatgatcctattagccctattattaactatatttttgagtagacttatcaaacttgcagttagccaaatgtcttttttatgtcatatactataaattatatctcttccatttaatcttatatttaaggtgattttttacccttttatggatatttggattctacttctgcattcattcttgctgatattgtcttcatcctagttaatggaaaataatgtttatttgaatagcactgcagagaaagccttttgatctaccaatagagaactatctaaaaggaaattgagtcataaatctgtggatggttgtttagtcaataataaatatatctgacttttgagatatcatctagctcttgttttgtcatctggtccataaggagattttgaatgactttgcgaaataccttcttaaaatcaaattaactatgtctagagcatttttcatatctgccaaccaagtaatactttcagaaaatgattaagattagtctgacatgtcttgttcttgatgaagccaagcttgctttcactgccttcctttctaaacatgtgtaaaactatctgctcattaattccttcaagaaatcttgcggagttcagcagcacggtttaaagcctggctggtttataatttgaggtctccacattcttttccttttcaaaaaaaaaacatagaaacagttttattctctagtcttccagcatgacttctatctttatagttcttcaaagattaccatcatcaatccaatcatttcatctccagtttcttgtattcaattctttcaagaaatcatgtgggtcaaaatgattgccctaatttaaagcaggtgaaagatctgctactatttcttcatctgtctgagcttatgatttattctggtttttaaaaaaattattttgaaattattttagagttcaggaagagttgcaaaattgtgcagaacattcctatataccctttaaaccctctaatgttaacatcctgcctaaccataatctaattatcaaaactaagacattaacattggtacagtattgttagctaaaggctttcttttcatttcaccagttattccattaatgcactttatctttttcaggatccaatccaggatcccacgttacatttagttttcatgtctccatcatctcctccaatctgttagaattcttcagtctctccttactttcatgaccttgacactttcagtactattcaggcattttgtagattgcccctcaatttgggttcttctaatattttctccttagtagattaagattatgcattttgaagacaaatacttggaagtgatatcccgttctcggtgctttatagtagggtcacatgatgttgattacatcttattattgatgagactaaccttattgcttggtttagaggtttacatcaggcttctgcactgtaaagttgctattttccccctttgtcattaataactatgtggaaagagatactttgagactatacagatatcctctttattcctaaactttcacttactattttttagcattcattaatggatcatgcctgctataattattactagagtggtcattataacagagtttttttatttccttcattcctcctacttttattacgtgaaattcttcaataaagaagagctgtttcttcttttatttttaacagcctcttgagatataattgacaataaaacagcacatatttaaagagtgcatttttatgttttcacacacgtaaaacactgcaatcaagataatgaaaatacaaccaccaaaagttttcttgtatttccttctaattcctccctcctacttctccccatcttccatgctgttcccaaagactgtactgctttctgtcactatagattagtttacattttctggaattgtatataaatgaaataatgcagtatatactcttttgtcaattggcatctttcactcaggataattattttgagatttattcttgccgttacataaataaatagttctttttttctgagttatgttccactatatggatatactacaactagtttatctattgacttgttgatggatatttgggtgttttttgttttgattatcacaaatggctattctggctttcttttgattagtgttaacagaagttatcagatagttgttttttttttctcttaagtctgggtgctggaatagaatcaggtagtagagttatcaggccactgataattctattcattttattttcagtttcatttctcgctctgtttcattttggatagtttctattgttatatcttcaagttcactaatcttttcttctgcaatgtctaatctgctattaatctcatctagtgtatttttatctcagacacagtttttatctctagaagttcaatttggctctttttaaaaatagcttttatatctctctatctttttaaacatatggaatacaattataataactatattaatgttcttcttttttttttttgagacagggtctcactctgtcacccaggctggagtgcagtggcacaatctcagctcactgcaacctccaccccccaggttcaagcgattcttgtgcctcagccacccaaatagctgagattacaggcacgcaccaccacactcagctaatttttgtacttttagtagagatggggtttcaccatgttggccaggctggtctcaagttcctgacctcatgtgatccaccctccttgatctcccaaagttctgggattataggagtgaaccatcaagctcagccataatagctgtattaatgttcttgttgctaattctaaaaatctgtgtcagttctgatgtttccattgatttctaactaaaaatttaattgatttaattgtagatttgcttgcaattttaagaaataatatagagaaatcctatgtgccttctgtcaaatttccttcaatggcaacatctggtaaaattgtagtaaaaaatcacaaccagaatatatcgatacaatgcaccaatcttgttcagattttcccaaatctacctgcactcatatctgtatgtgtgtgtatttcgttcaatacaattctgtcccatgtgcagattcatgtgtctaccttcacaggcaaggtacagatttgtgccatggccaaaaggatcacttatgttacccacctctttcttgtccccaccctcacccccattcctaacccctgcaacaactaatttgttccccatttctaaaagtttgccatttcaaaaatgttatataaatgaaattatagagtatataaactttgggtattggctttttcattcaacataattgcctggaggttcatccaagattgattaatttttctcttcattatgtgttatattttcctgcttctgtgcatgcctgatcatttttattggctgctagcattatgggttttttttttttcttgttgcatcctgggtatttgtttatgcctttaaatattcttcagctatgttctgggatgcagttaaattacttagaaaaaaacatttgatctttttaggttttgcctttaagactcattaagtgttactagaacagtatcagtctaagtcctcttattctccactgctgagcagaacacttctgaatattctaccctatacctacgagtttgaattattttagttctgagctctgtgtgactttctttcaagcaattattttctcagcctcagttatcccctcacatgctgaatactcaaaaggaaacttctatagatccctgcatttctctcccagtgtgtttctctcttctctagcattctattctgtaaactcacactgcattggtctcccttgactcttcagatacgtttcctctacttaggatttctgctgagctccagctaggtttaagctctttgcgtgcagcctggaaactctctcaagacaataagctagggacgttctagggatcacttcatttgtttactatttctgagggactgcgccttcattgcctgctgtccattgtcttaaaaaccattgtttcatatattttccctgttttatttttggttgtttcaggcaggagggcaaatctgacccttatttttccaggttgacttgaagccagagtcattacttattattttacagtctattacttattttttatctaatttattttatcactttgatataagtttgaaatttgaaatataattttatttttattttattattgcattgttcatccaagtaaaagtcttttccatactattcttgttgttctgaacataactttaaagatttctatttatatctttaggcttttaatttgttctggacttgataaacattttgacatttttgtcacatagcttttcatttcctctcccttttctttctacctttattccttctttctattcaataaatatgtttttgagtgtgtataatattctagatgctgtgctaagcactggaaataatttcatgaaaaggatagaaaaaatatttgatctcttgcttaaattctagtgatgggagaaaggaaataaacacataaataaaattattttagtacagaatatgtgctatgtagaaaataacatgcttttcaaggtgatatttgagctaaaacagtaacgagtactacacgagtgctgagaataagtctgcttacttcccacaactaagtaagatacttctgagtattccaccctatgccccatgaattatgaagtgatgagcaacagcagttatcggaagagctggaagagcatgccaggaaaacggaacagcaactgcagaagccaaaagtcaagaataagttcgacatgttcaaggaacagaaagaacaggatgactggagggtcatccaggaagaaaggagtgctgcaaagttaggtcaggaaagtattcagaagtcaaagcacataagcgctaaaggactgaatcttagattatgtaccttgccttttactcttgaaatatggcttcattatacctgaggcacttagaaaattccttgtacaaccatttgagcctgtacagctatctctttaggcttgtatgttcagagagtcctttttaaaaaaaagtaaattaataacttcaagaccttctttgtcttccacataacagttgctggtagctgggcatagtggctcctgcctgtagtctcagcactttggggcactgagggaggtggattgcttgagcccaggagttcgagaccagcctgggcagcatggtgaaaccaaatctctatagaaaatatagccaggggtagttttgtttagtgtgctggttatatactaagttgatttaaataaataaataattaattaattaataaaaattagccaggagtggtggtacattcctgtaatcccagctactccagaggctgaggtgggacaatcacttgagccatgaggcagaggttgcagtaaaccaagattgtgccactgcactccagcctgggcaacagagtgaaaccctgtctcagtaagaacaacaatgaacataatttctggccatgtacttttttctggctttgaatactttgaaatatagttttccaatgtctaaaataactgtaacactcccattgtacatttcttaggctgttataatctccaagaaaacatgacccattattccaattattcctgttattattggtcagagttaactacagagaagcagcttgaagggacagctatgaagaaggcatccaaaatttcatcagattgtcagcttttatcacaaagacttccagcagattgcttcttccagtcaattctcaacacagcaataagagataccttcctaaagtgcaaataaggttttgtcactcctcttgcttatactcttacaatggcatctcattgcaattaaaataaaaagcaaaacattatgatgtctaataaatccatacatgattccctcctcacctatttttccaaccccatctcatgccagtcccactttcctcattacactcaagttacacttcattacagtgaattcttccttcagcttctaaaacatacctacccagcttttgtccagctccgtagtttttcgcatcctgtttctgttgcctggaatactcttcccctgattctcttcctacggtcagcttctttctcatcctttaggtcttgttgaaatgccaccctctcagaagagacttcccatttatctaaaggtggtctttcctgcccatatgctctcttgaacccttatttctttcataacatgacctgcaattattttacatatgaagttggttattggtttttgatctgtatgcaccattacaatgtaaactccaggagagcagggtccagatacagaatccccagtgcctagcattatgtctgatacataaagtccagtaagggaaaaaggacatttaggtgttgaaaatcctcatcatccaaatactactgattcagtatgaaccaataactcttatgaatctattttcgaataagatgaaaaagatgaacataaatgttattgtctcataacatgcatttttactaaacataattttatttttagttgtttatgacaaatttccacttgtattttgtaagactaatgaagacttgataatgtggaatttcccagtggctttctgagtgtgtgtgtgtgtgtgtgtgtgtgtgtgtttgtgtgtgtgtgtgtctgtgtgtctgtatgtatttatgtatccttgaagtagattgatgctgccagaaatttattcaaaaaacataatttatatagtagtaagatgtttggcaatgcctgatgtaaaaccgtgattgaaaatatgaattagcatgggattttatcactttgtcattcagcatcagtcacttagtactcttaaattatagcactcatattataatatcctggatttctttttcaaaaataatattatgttgttgaggtgttcatacctgaaacactagagttatcattgcaaacacatctatagatttaattgttcattatgagtgagaaatgaacggacgatctaaatttaaagtttatttgagggtttcagggctattttcttatacatttgttaaattcctttcatttgtccctcttgtttttagtgtaaaaattcatagttacttttcaaggttgcccactgtgtttaatagatgccttatatgtcaacatccgttttctgattccattttgtatatttttctgacaaaaacaaccaatcaatagctggtaatactgcttagccatgagctagaattaatatatgctcccacacattacataacctatttcagagactgactgtgtagatcattagaggctagtttattagctgattggttagtcagactcatcagtattcatcttgagaattataaaaataaaaattttaaaacatcccaattgatgttaaaaaagaaaaagctgcaataaagaagaaaatcttcaaatggtaccttcaattcgaaataaagaaatctttatattttactctgcacctttgcttctgtatcaggttgccatggaaattttttcattaacattagattgatttgcccagagataaaattgcttgcatcatttcatcttttaacgttcctgaagcctcctaagccaacttcagtgttttaacctccaagtcgttccagattcccaagagtttctgccttgctgagtatttttgaaactcaaacacagcacattgatttcttcaatgttagcatcaaggttgctgtcatgttttcattctgtatgggtgcaaaaataattttaagcattttgtgtcatcaaataaaaatcttggattataatctatagaattccaaggacatttacataataaatataaagaaacaaagacaaatgcttgtataaaggcttctatttaatgttctagtcttttttgctgtaaaacattaacatccatgttaatgaaaataaaaaatagtatgtaatttgggtaattgggcttcatacacccctatttatgtattaaaatttgtgattgaaaggaaatctaattggctctctgtatctgaggattctacatccatggatttaactaaccatggatcaaaaatatttggaaaagaaaattacatatgtactgaacatgtatgtacaggctttttttttcttgtccttattctgtaaacaatgcagtatagcaaccagtcacatagcatttacatcgtattagatattataaataatctagagatgatttaaaggatatgggagcatggacataggttataggcaaatactatgtaattttatgtcagggacttgagcagccatggattttgttattcatgggaggttctgaaaccagtcccctatagatactaagggatgattgtattcaacttgtgtatattgtctaaaataaacataattttgactgggtgtggtgactcatggctataatcctagcactttgggaggttgagtgagtggatcacttgagcccagatatttgacaccaatctggacaacatagtgagaccctgtctctacaaaaaaataaacaaaaattagccagacgttatggcacgtgcctgtagccctagctactcgggaggctgaggtgggaggatcacttgagcccaggaggtagaggatgtggtaagacatgatcatgccactgcactctagcctgatgacagagcaaggccctgtctcaaaaaaaaaagaaagaaagaaagaaagaaagggagagagagagagaaaggaaaagggaaggagggagggaagaagggagggagggaggaaggattgatttttttctaagtactgtgattgcttcatgctacttaagtgtagctctgaagtgttttctaaaagttattccacagtttttaagggaacataccatgtattatttcttttgaacacctagacatatatataagtagacgctcactacatgttttatgcactaacatttaattttagtgtctaaaaatgaagatacaaagaatagttttactaaggccaaccagggaagaaaatctcaaggtattttgtgttaaaggaacccaatttcaccatctatagatactcaaatactatatgtgtgatatttaaatgtcaatagttttacactcaacatgttctttgactcacttttcttcacttgacagtatgtatggggagtctttccatatcactatagaactagcttttttaagtgttgtattctctctgtagtatgaatgttttatagattattcattccccaactaataggaatttagagttttttgtattttttactctaatgttcaatgctaccaagaatatcattttatgtaacttgtgcacatgtttgattatttcttcagacctggtgaagaagaacaattgttcttccaaaggatatgcacatttaaaattcttgtagataatgatacattaccttcccagaagaatataacagtttgtccttttaccagtggtttataacactacttttccatgtctttgataaaacttgatattagcaatcacttttaaatgtttacaaattttatgagtaaaaagcaatacttctttattagtgtattttgcattttatgattacttctaagattaagcatcatttattatgcttactggtcttttgcattttctcttctcagtctgtccatatgtactgtccgttttactttggggctctctatctttttcttattggtttgtaggtgttctttatacattctggatattatttttttgagagaaatagagggtctcactctttcacccaggctggagtgcagtggcgtgatgtcagctcgccacagccttgaccactctggctcaagcaatcctcctgcctcagtcccactgagtggctaggactacaggcgtgcaccaccacacctagctaactttggtattttttgtagtgacagactttttccactttgcccaggctggtcttgaactcctgaactccaagtgattcacctgcctcgtcctccgacagtgctggtattacaggcagtgctggggttacaggcatgagccactgcacctggccaggatattaatattttgactcttgaatatgttgcaaatattttccccaggctatcagtcgaattttaaggtttttttatgattcttttgcagaagagaagttttaatttttttaacttttattttagattcaggggtacatgtgcaggtttgttatataggtaaattgcatgttacagggagttggtgtacagattatttcatcagccaggtaataaccatagtaaccaataggtagttttttgaccttcaccttcctcccaccctccacgctcaagtgggtcctggtgtctgttgttcctttctttgtgtccctgtgtactcaatggttagctctcacttataagtaaaaacatgcaatatttgattttctgttcctgcattagtttgcttaagataatggccttgagctctacccatgttgctgcaatgacatgctcttgttctttcttatggtgtaatagtattccattgtgtatgtataccacattttcttaatccagtctactattgatgggtatttaggttgattccatgcccataattctgcaatgggcatatgcgtccgtgtgtctttatgatagaatgatttatattcctttggatatgtacccaaaaatgggatcactgggtcgagtgacaattctgttttatgttctttgagaagtcaccatactgctttccacaatggctgaaccagtttgcactgccaccagcagtgtataagcattcacttttctccgggaacttaccagcatctgttcttttttttttttttttttttttgtagtaattgccattctgactgatattagatggtatctccttgtggttttgatttgcatttctctgatgattagtgatgttaagcattttttaatgcttggttccttggaagtcttcttttgcaaaatgtctcttaatgtcctttgcccactttttaatggggtgtttgtttcttgttcatttaagttccttatagattctggatattagaactttttcagatgaatagtttgcaaatattttcttgcattctgtaggttgtctgtttactcttgatagtttcttttactatgcagaagctctttattttaatattgagtcacatttctcacttttttgcttttgttacaattacttttggcatcttcatcatgaaatatttcccagggcctatgtctagaacgatatttccaaggttattggttatcttccagggtttttatagtttaaagttttacatttaagtctttcatctatcttaagtttgtttttctatatggtataaagaaggggctcaatatcaatcttctgcatatggctagccagttatcccatcaacatttattgaatggggaatcctctccccgttgcttgtttgtcttgactttgttgaagatcaaatggttgtaggtgtgcagctttacttctgggctctctattctattccattggtgtatgtctctgtcttggtaccagtaccatactgttttggttactgtagccttgtagtatactttttgtgtgtgtgtgtgtgtgtgtgtgtgtgtgtagagagagagaatatatatatgtatatatatagagagagagacagagacagagacagagagagagagtgagagagagttggataatgtgatgtttccacctttgttccttttacttaggattgctttggctgtttgggtgcttctttggtttcacatgaattttaaaatagtcttttctaattccatgaagactgtcattggtagttttgtaggaatagcattgaatctgtaaactgtttctggtagtatggccatcttaatgatattgattcttcctctccatgggcatggaagtttcttccatttgttgtgtcatctctgatctctttgagcagtgttttgtagttctccttgtagagatctttcacctccctagttagctgtattcccaggtattttattctttttgtggcaaatgtgaatgggattgtgttcctgatttggccttagctcggatgttggtttataggaatgctactgatttttgtacattgattttgtgtcctgaaactttgctaaagttttttttcttaatgagatctaggaggtcttgggcagagactgtggagttttctagatataaaatcatatcgtctgcaaacagatggtttggcttcctgtctttctatttcaatgacttttatttctttctcttgcctgattgctctggccaggacttccagtactgtgatcaataggagtggtgagaatagacatccatgtcttattctggttttcaaggataaggtttccagattttgctcattaagtgtgatgttagctgtgcctttgtcatagatggttcttattattttgaggtatggtatgtcccttcaatgcctagttcattgagggttttttaacataaaagatgttaaattttatcagaagcctattctgcgtctattaagatgatcatgtgaattttatttttagttctgttcgtatgataaatcacatttataaatctgcatatgttgaagtaatcttacatcctagggataaaacttaatttatcatggtggattagctttttgttgtgcttcttaattcagtttgctaggattttgttgaggatttttgcattgaagttcatcaaggagattggcctgaagttttctttttttgttgtgtctgccagcttttggtatcaggataatgccggcttcatagagtgaattagggaagagtccctcctcccccaccttttttttttttttggagtaatttcagtagaaatggtaccagatcttctttatacacctggtagaattcagctgttaatccatctggtcctgggtttttttctggttggtagatttttattaatgattcaatttcagaactcattattggtctgttcagggattcagtttcttcctcattcaatgttaggaggttctttgtttcaagaaatttatcaatttcttctaggttttctagttatgtgcatagagatattcatagtagtatctgagagtttttgaatttctgtggagttggtggtaatgtcctctgtgtcatttctgattgtgtttatttgaatcttttttcttttttctttattagtctagctagcagtatatcaatcttacttattttctaaaaaaaaaaaaaaagccacctttggatttgttgatctttggtatggttttttgcctcttaatttatttcatttgattttggttatttgtcttctgctggcattggagttggtttggtgttgtttttctagttcttctaagtgtgatattatgttgttaatttgagatcttcctcactttttgatgtaggcatttagtgctataaacgtttctctttacactgctttagctgtgccccagagattctggtatgttgtatgtttgttctcattaatttcaaagagtttctggattttggccttaatttcattatttacccaaaagtcatccagaagccggttaatttccatgaaattttgtgattgtgagtgattttcttagtattgatttcgatttttattgcactgtggtccaagagtatgttgatatgatttcagtttttttgaagtcactgagaattctcttacagccaaatgtgcagtcagttttagagtttgtgccatgtgcatatgagaagaatgtatattctgttgttttcagtggagagttctgtagatttccattaagtccattttgtcaagtgtccagttcaggtcccagatatcttttttagtttcctccttggtgatctgcctagtactgttagtgggatgttgaagtctcccactattatagcgtgggactctacatctctctgtaggtctccaagaacttgttttatgaatctgggtgctcctttattgggtgcatatatttttaggataatttggtcttcttgtttaatggaaccgcttaccactatgtaatgctcttctttgtcttttttgatcattgttggtttaaagtctgtttagtatgatactagagtagcaacctctgcttttttctgttttctaatatcttggtagatttttttccatccctttactttgagcctatgggtatcattgcttgtgagatgggtctcttgaagacagcatacttctgggtcttgatgctttattcaacttgctgctctgtgccttttaattgggggatttaacccatttgttttcaaggtcagtattgatgtgtgagaattggatcctgttatattgttatattgttagctggttattatgcagatttgattgtgtagttgctttatagtgtcaatggtctatgtacttgagtgtgtttttgtgatagccagtaacagccttacctttccatatttagcactcctttaaggacctcttgtaaggcagatgaggtggtagtgaattcccttagcattcacttgtctgaaaagggtctttttactcctgtatttatcaagcttagtttagctggatatgaaattctttcttggaatttcttttttttaaggatcctgaatataagcccccagtctcttctggcttttagggtttctgctgaaaggtccactgttagcctgttggggttccctttgtaggtgacctgcctcttctctcttgctgcctttaacatttcttccttcatttaaaccctggagaatctgaggctgtgtgttgaggatgttcatcttgtatagtgtcttgcaggggttcttggcattccctgaatttgaatgttggcctctctagcgaggtttgggaaattttcatggctgatattatcaaacatgttttccaggttgcttgctttctctccctctcattcagggatgctaatgagtcatagatttggtctctttacacaattccatatttcttggaggttttgttcattcttttttattattttttatttttgtctgactgagttatttcgcagaaccagtctgcaagctctgagattctttcatcagcttgttctattctgatgttaatacttgtgctggtattataaaattcttgtagtgtgtttttcaactctatcagatcagtttggttttttcataaaatgatcattacatctttcagctcttctatcattttatttaattccttagattccttggattgcatttcaacttctcctgaatctcaatgagctttgttctgagtcatattctgagctctatttctgtcatttcagccattcaagcctgattaaaaaccagttttaaggaactggtgccatcgtttggaggtaagaagatgctctgggtttttttgagttaccagagttcttgcactggctcatcagtgtggcttggtgttccttcagtccttgaagttactgtcctctggatagggtttctttgcttttatcttctttaatgcttttgcatttgattgtggtctaaggtgggttcagttgattggctttgtttctggaagattttaggggaccaaggctcagctcagcactcatgggctgcatgctgtaactttaaggggctggtactgggcccccagctttgttctctggctctttaaggttaggaacctgctgcaccagaagggccaaggtgtactcaatccactggccatggtgctccaatggatggtgctagccaaagcagttcattagggcagtggctgcagaatccatgctcactcacacatgccagcaaccatggcagtgcagcaggttgcacacacatcagctggggccaggcactggtgggggtggggttgccagtatctgtgcatgtgtttgcacaggtagtgtaaatatttatgtagtcaaattaactagtcttttgtattaggacatttgcttttcggttttttatatatttaatttttttttatatcaatagctctaggggcacaagttgtttttgttacatggatgaattgtatggtggtgaagtctgggattttagtgtacccataacccaagtagtacacattgtactccaatagctagtttttcatccctcacactcccccaccctccctcatctgagtatccaatgttctttataccacactgtatgcctttgcataccaatagcttagctcccacttaaaagtgagaatgtgtggtatttggtttttgatttctgagttacatcacttagaataatcacctccagttccatccaagtttctccaaaagacattagttcattcttttttatggctgagtagtattccatggtgtgtttatatatataaatcagtatacaccatattttctttatccactcatcggttgatgaacatttaatttgactctatttctttgcaattgtaaattcttcttctgtaaacatacatgtgcaggtatcttcttgacataatgaatttttgttttttagacaggatctcactctgtcacccaggctggagtgcagtggtgtgatcttggctcactgcaacctttgcctcccaggctcaagcaatcctttcacctcagcttcctgagtatctgggtctacagacatgtgccaccatgcacagctcttttttttttttttttttttttgtacttttagtagagatggggttttgctatgttacccaggctggccttgaactcctgagctcaagtgatctcccatccttggcctcccatagtgctgggaatacaggcatgagccactgtgcccagctggtataatgatttattttactttgggtagatacccagtagtgggattgctgcatcaaatggtagatctatgtttagttctttgagaaatctccatgctgttttccacagagtttgtactaatttgcattcccactatcagtgtgtaagcattcccttttcaccaaatctacaccaacatctattgtgttttaactttttaatactggccattctggctgaggtaagatgttatctcattgtgactgtaatttgcatttccctgattattaattatgtcgagtatttttttcatatgttttttcgccatttgtatatcttcttttgagaaatgtttaatcaagccatttgcccactttttaatgggttgggtttttttttgtgcgggggggtgttttttgtttgtttgtttgtttgttttgagacagagcctcacactgttacccattctggaatacagtggagtgatcttggctcactgtgacctccgcctcctgggctcaagcgatcctcccacctcagcctcacgagtagctgagactacaggcacccaccaccacgtgcaactaatttctttattttctgtgaagacggggtttcaccatgttgcccaagctggtcttgaactcctgagctcaagcaatacccccatttcagcctcccaaagtgctgggattacaggtgtgagccaccacgcccagccttatttattatttttcttgctgctttgagtttcttgtagattctgaatattagtcctttttcagatgcatagtttgcaaatattttctcctattctgtgggttgtctgtttactctgatgattatttcttttgctgtgcagaagtgttttagtttaactaggccccacttatttattttttgttttgttgcatttgcttttggggttttcatcataaattttttgccagagaaatcaagaaagaaaaataaataaagggtattcaaattgaaaaagaggaagttaaactaactctgtttgccaatgatgtgatctgatctgatacctagaaaacactaaagagtcctccaaaagactcctagatttaaaaaatgtatttagcaaagtctcagtttacaaaatcaatatatacaaatcagtagcattggtataaaccaaaaacaaccaagctgaggatcaaattgagaattcagtcccttttacaatagctacaaaaaataaaataaaatatttaggcatatacttatccaagaaggtgaaagatgtctacaaggagaactataaaacactgttgaaagaaattatagatgacacaaatggaaatatatcccatgttcatgaattggaaaaaacaatatcatgaaaatgaccatagtgccccaaacaatctacagattcaatgcaactcttatcaaaaataccaatgttattctttatagaattagaaaaaaaaattctgaaattcaaatgggactaaaaaagagccagaatagccaaagcaattctaaccaaaaagaacaaatctggaggcatcacattacctgacttcaaattatgccattatacaaggctatagtaaccaaaacagcatggtactggtataaaagtagatatacagaccaatggaacagaatagagaacccagaattaaaaccaagtacttacaaccaattgattttctagaaagagtacagtaatatgacttggggaagggacacccaattcaataaatggtgctgggaaaattggatagcaacatgtagaagaatgatactggatccctatctctttccatatgcaaaaatgaactgaagatgaattaaagacttaaacctaagacctgataaccatacaaatttgggaacaaaccctaggaaaaactctgttggacaacctaggcatttgctttttatatcttttagaaggccatcgtaaatatgacacaaatacacaaattcttctatattttttaaaaagcacatatattttactttggtttagtttttaagtcctgagtcatctggaatgcatttctgtgaattttatgagctatgaaaataacttacttttttcagatgggtattcaattgctccaatatcatttattgaattagccagccttttttcagcagtttaaaatgccaccagtgtcataactaaatctgtatattatgtgggtttgtggccactctcttgttacactatttacctattcctgcaccaatactatagcttttaaagtatattttactatttggtaaggtaatttaccttgctttttatatgttagtattatatccagccaccctctacctacctttctcattggttctcataatttttcagtttgggtttcctaggtaactgatcctgtagacttcaactactgacagttttatctctttatttctattaatcataccccatataagagttatttattttcccaaacatttaagatcagtctaattccagataaacatctctggaggaactcatttctatcagcttccccagaagtttttcttcctttctatccattcctcacccaaatttagtccttctctattcatccaaggtggatttctaagccatatgtaagcctgggggaggtaaggaagagattcaaaagtgaaatatcccattatgacattaaccttttctgacctgatacaaaattgttttgaattgtttttcccctttatatgagcatttaatgactttttttattatacttttcatgagactgtgcttgtctccccagcattttgtctctttcctgccagacttttcatcttgcttgtcatatgtccaaaattactttccttcctcccttatactcatactgcaacttctttaacttcatgtaaatctttattatggcttagagtctatgttccatattttcagtaacacagttagcatatcccaaactttattacccctctgtcttttgtcccccaacttcaaaacccatctcctatttcatttttgtatttttcttatattttaaaaactttatttttgaaataatttaacaatgacagagaagttgcaataattcagagttcaacactaattcagcagttattaacattttcccacattctctttattattcttctctgcctcacctctgtgtatttgtgtatatgtttttagaacagtttgatactatattgcaaacatcacatgatctgttttgttttcactttttctatcactatactcaagccaggtccagctctacccatattgccctcttgtctgataagtcatgttttgttttgttttgttttgttttgttttgttttgttttgttttgtgacaaggtctcactctgttgctcaggctgggagtacggtggtgctatctctgctcactgcaacctcctgcctcccagactcaagtgatcccccacctcagcctcccaagtagctgtgaccacaggcacacaccaccacacccagctaacgtttttgtatttttggtagtgacagggttttgccattttgccgaggctggtcttgaattcctgggctcaagtgatccacctgtcttggcctcccaaaatgctgggattacaggcatgagccactacacccatgaaaagtggtgctctgctagattaagtcacactttgaattctgtcacaaatttgtgatcactatcctcaaattgccgtttaatactgcctgtgagaggtctaatctcaagatggctgaacaggaacagctccggtctgcagctcccagcaagattgacgcataaggcacgtgatttctgcatttccaactgagctacctggttcatctcactgggactagttggacagtgggtgcagcccatggagggaaagccaaagcagggtggggcatcgcctcacctgggaagcacaagcggtcagggtatttccctcccctagccaagggaagccatgaggggctgtgccatgaggaacagtgacttctggcccagatattgcgcttttcccatggtctttgcaacccgcagaccaggagattctctcagtgcctacgccaacagggttctgggtttcaagcacaaaattgggtggctgtttgggcagacacgaagctagctgcagaagtttttttttttttcatacccagtggcacctggaaatgccagtgagacagaacacattcactcccttggaaagggggttgaagccagggagccaagtggtctggctcggcggatcccacccccagggagcccagcaagctaagatccactggcttgaaattcttgctaccagcacagcagtctgaggtccacctgggacactcgagcttggtggagagaggggcatccaccattgctgaggcttgagtaggcagttttaccctcacagtgtaaacaaagctgccaggaagttcgaactgggcagagcccaccacagctcagcaaggctgctgcggccagactgcctctctagattcctcctctctgggcagggcatctctgaaagaaaggcagtagccccagtcaggagcttacagataaaaatcccatcaccctgggacacagcacctgggggaaggggcagttgtgggtgcagcttcagcagacttaaatgtccctgcctgacagctctgaagacagcagtgtatctcccagcacagcattcgagctctgataagggtcagactgcctcctcaagtgggtccctgacccccatgtatcctgactgggagacacctttcagtaggggctgacagacacctcatacagaagagctctggcaggcatctgacaggtgcccctctgggaagaagcttccagaggaaggaacaggcagcaatctttgctgttctgaagcctctgctggtgatacccaggcaaacagtgtctggagtggacctccagcaaactctagcagacctgcagcaaaagggcctgactgttacaaggaaaactaacaaacagaaaggaatagcatcaacatcaacaaaaaggaaatccattcagagaccccatctgaaggtcaccaacacaaagaccaaaggtagataaatccacgaagatagggagaaaccagcgcaaaaaggctgaaaattccaaaaaccagaatgcctcttctcctccaaaggatcacaactcctcaccagcaagggaacagaactggacagagaatgagtttgacgaattgacagagttggcttcagaaggtgtgtaataacaaacccctctgagctaaaggagtgtgttctaacccaattcaaggaagctaagaacattgaaaaaaggttagacaaatggctaactagaataaccactttagagaagaacataaatgacctcatggagctgaaaaacacagcacgagaacttcgtgaagcatacacaagtatcaatagccaaaatgatcaagtggaagaaaggatatcagagaatgaagatcaatttaatgaaataaagtgagaggacaagattagataaaaaagaatgaaaagaaacaaagcctccaagaaacatgggactatgtgcaaagaccaaatctctgcttgattagcatacctgaaagtgacggggagaatggaaccaagttggaaaacactctttaggatattatccaggagaacttccccaacctagcaagacaggccaacattcaaattcaggaaatacagagaacaccacaaagatactcctcgagaagagcaaccccaagacacataattgtcagattcaccaaggttgaaatgatggaaaaaatattaagggcagcgagagagaagggtcgggttacccaccaaagggaagcccatcagactaacagcagatctctcagcagaaaccctacaatccagaagagagtggaggccaatataaagcattcttaaagaaaagaattttcttttttttttaaaggctaaaatatttaattatgtttttaaagcacatgaattctttacatttcaataaaatatttccaaactatattatcccagaaaacaaaacatgattgcattttcaacccagaatttcatatccagccgaactaagcttcataagtgaaggagaaataaaatactttacagacaagcaaatgctaagagatttcatcaccaccaggcctaccttacaagagctcctgaaggaagcactaaacatagaaatgaagaaccgataccagccactgcaaaaacataccaaattgtaaagaccatcgacactatgaagaaactgaatcaactaatgggcaaaataaccagctagcatcataatgacaggatcagattcagacataacaatattacccttaaatgtaaacagactaagtgccccaattaaaagacacagactggcaaattggatgaagagtcaagacccatgggtatgctgtattcaggaggcccagctcatgttcaaggacacacataggttcaaaataaagggataaagtaatatttaccaagcaaatggaaagcaataaaaagcaggggttgtggccaggcatggtggctcacgcctgtaatcccagcactttgggaggctgaggcaggcagatcacgaggtcaggagatcgagaccatcctggctaacacagtgaaaccccatctctactaaaaatacaaaaaattacccatgcatggtggcaggtgcctgtagccccagctactcaggaggctgaggcaggagaatggcatgaacccaggaggcggagcttgcggtgagctgagattgcgccactgcactccagcctgggcaacagagcaagactctgtctcaaaaaaaaaaaaaaaaaaaaaaaaaaaaaaaaaaaaaaacagcagaggtcgtaatcctagtctctgataaaacagactttaaaccaacaaagatcaaaagagacaaagaagggcattacataatgataaagggatcaatgcaacaagaagagctaattatcctaaatatatatgcacccaatacgggagcacccagactcataaagcaagttcttaaggacctacaaagagacttagactcccacacaataatagtgggagactttaacaccccactgtcagcactagacagaccaacgagacagaaaattaacaaggatattcaggacttgaactcagctctggaccaaggcaactttatagacatctacagaactcttcaccccaaatcaacaaaatatacattcttctcaccaccacatcacacttattctaaaattaaccacataattggaagtaaaacactcctcagcaaatgtaaaagaacagaaatcataacaaacagtctctcagaccacagtgcaatcaaattggaactcaggattaagaaactcactgaaaaccacacaactacatgaacactgaacaacctgctcctgaatgaatactggataaataacgaaattaaggcagaaataaagatgttccttgaaaccaatgggaacaaagacacaatgtaacagaatctctgggacacatttcaagcagtgtttagagggaaatttagagcactaaattcccacaagagaaagcgggaaagatctaaaatcaacaccctaacatcgcatttttaaaaaactagagaagcaagagcaaacaatttcaaagctagcagaagacaagaaataactaacatcagagcagaactgaaagacatagagacgcgaaaaacccttcaaaaatcaatgaatccaggagctggttttttgaaaagatcaacaaaatagatagaccactagccagactaataaagaaggacagagagaagaatcaactagacacaataaaaaaaatgataaagggaatatcaccactgatccctcagaaatacaaactaccatcagagaatgctataaacacctctaagcaaataaactagaaaatctagaagaaatgaataaattcctggacacatacactctcccaagtctaaaccaggaagaagtcgaatccctgaatagaccaataacaacttctgaaattgaggcagtaattaatagcctaccaaccaaaaaaagtccaggactagacaggttcacagccaaattctaccagaggtacaaagaggaggtgacaccattctttctgaaactattccaaacaatagaaaaagagggaatcctccctaactcattttatgaggccagcatcatcctgataccaaaacctggcagagacacaacaaaaaaagaaaatttcaggccaatatccctgatgaacatcggtgcaaaaattctcagtaaaatactggcaaaccaaatccagcagcacatcaaaaagcttatccaccacgatcaggtcagcttcatcgcagggatgcaaggctggttcaacatgtgcaaatcaataaatgtaatccatcacataaacagaataaatgacaaaatccatgtgattatctcaatagatgcagaaaagacctttgataaaattcaacatcgcttcatgctaaaaactgtcaataaactaagtattgatggaatgtatttcaaaataataagagctatgtatgtcagcccaaaatctccttaagctgataagcaacttcagcaaagtctcaggatacaaaatcaatgtgcaaaaatcacaagcattcttatacaccaataacagacaaacagagagccaaatcatgagggaactcccattcacaattgcttcaaagagaataaaatacctaggaatccaacttacaagggatgtgaaggacctcttcaaggagaactacaaaccactgctcaatgaaatagaagaggatacaaacaagtggaagaacattccgtgctcatgggtaggaagaatcaatattgtgaaaatggccatactgcccaaggtaatttatagattcaatgccatccccattaagctaccaatgactttcttcacagaattggaaaaaactacttgaaagttcatatggaaccaaaaaagagcccgcatcgcaaagtcaatcctaagccaaaagaacaaagctggaggcatcacactacctgacttcaaactatactacaaggctacagtaaccaaaacagcatggtactggtaccaaaacagagatatagaccaatggagcagaacagagccctcagaaataatgccacatatctacaactatctgatctttgacaaacctgacaaaaataagaaatggggaaaggattccctatttaataaatggtgctgggaaaactggctagccatatgtagaaagctgaaactggatcccttccttacaccttatacaaaaattaattcaagatggattaaagacttacatgttagacctaaaaccatcaaaaccctagaagaaaactcggcaataccattcaggacatagacatgggcaaggacttcctgtctaaaacaccaaaagcaatggcaacaaaagccagaattgacaaatgggatctaattaaactaaagaacttctacccagcaaaagaaaccaccatcagagtgaacaggcaacctacagaatgggagaaaatttttgcaatctactcatctgacaaagggctaatatccagaatctaccatgaactcaaacaaatttacaagaaaaaaacaaacaaccccatcaaaaagtgggctaaggatatgaacaggcacttctcaaaagaagacatttatgcagccaaaaaacacatgaaaaaatactcatcatcactggccatcagagaaatgcaaatcaaaaccacaatgagataccatctcacaccagttacaatggcaatcattaaaaagtcaggaaacaacaggtgctggagaggatgtggagaaataggaacacttttacactgttggtgggactgtaaactagttccaccattgtggaagttggcgtggcgattcctcagggatctagaactagaaacaccattcgacccagccatcccattactgggtatatacccaaaggattataaatcaagctgctataaagacacatgcacacgtatgtttactgcggcactattcacaatagcaaagacttggaaccaacccaaatgtccaacaatgatagactggattccatatacaccatggaatactatgcagccataaaaaatgatgagttcatgtcctttgtagggacatggatgaagctggaaaccatcattctcagcaaactatcacaaggacaaaaaaccaaacactgcaagttctcactcataggtgggaattgaacaatgaaaacacatggacacaggaaggggaacatcacacaccggggcctgttgtgggatgggggcaggggggagggatagcattaggagatatacctaatgttaaatgaagagttaatgggtgcagcacaccaacatggcacatgtatacatatgtaacaaacctgcacgttgtgcagatgtaccctaaaacttaaagtataataaaaataaaaaagaataaaaaaatgaaaaaagaaggaaatacccaaaaatgtccacaaaaaaaaaagagctatgtatgacaaactcacagccaatatcatactgaatgtgcaaaaactggaagcattccctttgaaaaccggcacaagacaaggatgccctctctcaccattcctattcaacatagtattggaagtgttggccaaggcaattagacaagagaaagaaataaagggtatttgaataggaagagaggaagtcatattgtctgtgtttgcagatgacatgattgtgtatttagaaaagcccatcatctctgcccaaaatctccttaagcagataaggaacttcagcaaagtctccggatacaaaatcaatgtgcaaaaatcacaagcattcttatacactaataacagacaaacagagagccaaatcatgagtgaactcccattcacaattgcttcaaagagaataaaatacctaggaatacaacttacaagggatgtgaaggacctcttcaaggagaactacaaaccactgctcaaggaaataagagaggacacaaataaatggaaaaacgttccatgctcatagataggaagaatcagtatcgtgaaaatggccatactgcccaaagtaatttatagattcaatgttatccccatcaagctaccattgagtttcttcaaagaactagaaaaactaccttaaatttcatatggaaccaaaaaagagcccttatagccaagacaatcctaaggaaaaagaacaaagctggaggcatcacactacctgacttcaaactatactacaaggctacagtaaccaaaacagcatggtactggtaccaaaatagatatatagaccaatggaacagaacagaggcctcagaaatcacaccacacatctacaaccatctgatctttgacaaacctgacaaaaacaagcaatggtgaaaggattccttatttaataaatggtgttgggaaaactagctagccataggcagaaaacagaaactggaccccttccttataccttatgcaaaaatgaactcaagatggattaaagacttaaatgtaaaacctaaaaccataaaaacgctagaagaaaacctgggcactaccattcaagacataggcatgggcaaagccttcatgaccaaaacaccaaaagcaatggcaacaaaagcaaaaattgacaaatgggatccaattaaactaaaaagcttctgcacagcaaaagaaactctcatcagagtgaacaggccacctacagcatgggagaaaatttttgcaatctattgatctcacaaagggctaatatccagcatctacaaagaagttaaacaaatttacaagaaaaaaagagacaatcccatcaaaaagtgggagaaaaatatgaagagacacttctcaaaagaagacatttatgcagccaacaaacatatgaaaaaaaagctcatcatcactggtcattagagaaatgcagatcaaaaccacaatgagataccatctcacaccagttagaatggtgttcattaacaagtcaggaaacaacagatgctggggaggatgtggagaaataggaacacttttatactgttggtggagtgtaaattagttcaatcattgtggaagagagtgtggcaattcctcaaggatccagaactagaaataccatttcacccagcaatcccattactggatatatacctaaaggattataaatcattctcctataaagacacatgcacacatatgtttattgtgataccggtcacaatagcaaagacttggaaccaacccaaatgctcatcaatgatagactgaataaggaaaatttggcacatatacaccatggaatgctatgcagccatgaaaaaagatgagttcatgtcctttgcagggacatagatgaagctggaaaccatcattctcagcaaactaacacaagaacagaaaaccaaacaccatatgttctcactcataagtgggagttaaacaatgaaaacacatggtcagagggaagggaacatcacacactggggcctgtcatggggtggggggctggcggaggatagcattaagagaaatacctaatggagatgatgggttgatgggtgcagcaaaccaccatggcacatgtatacctatgcaacaaatctgcacattctgcacatgtaccccagaacttaaaaaatactgcctgtatattgatgactatttttaaaatttgcaaacatattggtttttggcaataacattttcttatggcattttatttttatgagaatttgaccagagcatacattctgtgtgaattcagttgtttggaatcactgagatttcccttgcggccaactatttatttacaattaatgaatttagtgcttactatttagtgcttacttagtgccaggcactaagccctttgcaaatcttcatttattgcattttctgaacaatctattatcttcatttggcagataagggaactaagggaaggggaagtaactgtcactaagtctcacagcaagtagcagactaagatgtaatcctagcagtctggatccagaaattatgctcttaaccaacatactgtgctaattttttcaatttcatatgttgtttttttaaaaaatgtgtatctataattcctataaatttatgtcattccctgtgtgtttccaatagattgagcacactggtttattatagtttagatcttgtatatcttcattaatttcttgcctattttatttatccatttttgagaaatgtttgcagactgtctattaatcaacttctcattgtaattctatcatttacaaatgtcaattatttttaggctattgttaggtatatttattttcagagattttatatctaatagatatttccacttaatattacataccatgttctttatcaatatgttttttaaaacaataagagaataaaatgaaaaatcaaccttaaactctaaacaacttcatcatttcaacatgaaattcatattctcactcacaaacaattaagtattacttttgtaacagcaagaaaagtcctcttacccaacacaatctgaaccaatagttggttaattgaaaagatttgtttaaacagagaattatctaaaattacttataattaaacattttgttttacctagaataaatttatactggctttttatgagtttactgattggagtacagtctgtctttacacataatgtaacataaaacactttcctttcttccccctactttggagaggaacaagaactcaaagccacttgcaaggtgatctgagtacagaattattccagatttttaggattcctttccctaaaattctcctctctctcatttcattcaaccttattttttaaaaggctggtgttaaaacttttctttcaacttatttttcatagaaacattcactttttatacttgtatttcatcagtttacaaaatattttattaaatttccaaattagaccaataaatattactgtctcataccactttggaaacaacacaactcatattggaaatcatacaaccagcaagagcagaggtaagcattctgtctggcctttaacatttgttttaggtttggtgtacacgtgcaggtttgttatacaggtaaactgcatgtcacaggggtttggtgtacagacagtttcatcacccaggtaataagcatactacctgataggtattttttctgatcctctctctccccccacctccactctcaagtaggccccagtgtctgttgttcttctgttatccacgtgttctcattgtttagcttgcacttataagtgagaacatgtagcatttggtttactctttctgtatttgtttaggataatggcctgcagctccatccatgtttcttcaaaggacatgatcttattcttttctatggcttcatagtattctatggtgtatatgtgccacattttctttatccagtgcaccattgatggacatttaggttgattccatgtctgtcctgttttgaatagcgctgcagtggacatacacgtgcatgtgtctttatgatagaatgatttatatttctttggttgtataccccaaaatggaattgctgggtggaatggtaattcttttttaagctctttgagaaatcaccaaactgctttccacaatggctgaaccaatttatactcccgttagcactcacttttctccagaacctcaccagcatctgttctttttttactttttaatagtagccattctgattggtgtcagatggtatcttcctgtggttttgatttgcatttctctgatgattagtgatgttaagcattttttcatgtgcttgttggctgcatatatgtcttcttctgcaaaatgtctcttaatgtcctttgcccactttttaatggggttgtttcttgttcatctgtttaaatttcttatagattctggatattagacccttgtcagatgcatagtttgcaaatactttctcccattctgtagattgtctctttgctctgtaggtagttacttttgctgtgcagaagctcgttagtttaattagatcccatttgtcaattttggttttttgttgcagtggcttctgctgtgttcatcatgaaatctttgccaagtcctatatccagaatagtatttcctaggttatctttcagggattttatagttttaggttttacattaagtctttcatccatcttgagttgatttttgtgtgtggtataaggtaggggtccagtttcaatcttctgcatatggctagacaattatcccgtcaacatttattgaatggggaattctttccccatttctcgttgttgtcaactttgttggagatcagatggttgtaggcgtgcagctttatttctgggccctctattctattccattggtctatgtgtctgtcttggtaccagtacaatgctcttttggttactgtagcctcgtagtatagtttgaagttggataatgtgatgctttcacctttgttctttttccttaggagtgctttggctatttgggtgctgttttggtttcatatgaattttaaaatagtttttctaattctgtgaagaatgtcattggtagtttcataggaatagcattaaatctgtaaattgttttcagtagtatggccattttaatgatactgagtcttcctgtccatgaatatggaattttttaaatttgtctgtattgtctctgatttttttgagcagagttttgtaattcttgttgtagagatctttcacatccctggttagctatattcttaggtattttattctttttgtggcaattgtgaatgggattgtgttcctgatttgacctcagctttgatgttgttggtgtatgggaatgctactgatttttgttcttcgattttgtattctgaaactttgcttaattttttatcagattaaaggaagagactatggggttttctagatataaaatcatgtcatctgcaaacaggggtagtttgacttcctctctatttggatgccttttatctctttctctttactgattgccctggccaggacttccagtactatgttgaataggagtggtgagagagggcatccttgtcttgtgctggttttcaaggggattctctcagcatttgccaattcagtatgatattggctgtgggtttgtcatggatggctcttattactttgaagtatgttccttcaatgcctagtttattggcagtttttaatatggagagaagttgaattttattaaaagccttttctgcatctattgagatgatcatgtaatttttgtatttagttctgtttatgtgatgactcacatttattgacttgcatatgtggaaccaaccttgcatcccagggatggagctttcttgatcgtggtggattagctttttgttgtgcttctggattcagtttgctagtattttgttgagggtttttgcattgatgttcatcaaggagattggcctgaagttttctttttttgttgtgtgtctgccagcttttgttgtcaggggatgctggcttcataggatgagttagggaggagtccctcctccccgtttttgttgttgttgttgtttgtttgttttcatttttctttttttttttaatagtttcagtagaaatggtaccaggtcttctttatacacctggtagaattcagctgtgaatccatctggtcctgggttttttctggttggtaggctttttattactgattcaatttcagaactcattattggtctgttcagggattcagtttcaccctggttcagtcttgggaggttgtatatttccagagtttatacatttattctagattttccagtttgtggtcacagtggtggctgatggttcttttgtatttctgtggtgtcggtagtaacataccctttgtcatttctaattgtgttcatttggatcttcttttttctttttttgtctagcaactgttctacctatcctattaattttttcaaagaaacaaattctggattcgttcgtattttgtatgggttttcctggctcaatttccttcagttcagctctgatttttgttatttcttgtcttttgctagctttggggttacttttgtgttgcttttctagtacttttagttgtaatgtcaggttgttaatttgagagttttcccactttttgattatttcgttatttacctgaaagtctttcaggagcaggttgtttaatttccatgtacttgtatggttttgagtgattatcttactgttgatttctgtttttattgtgctgtggtccaggagtggggttggttgattttggttctttgcatttgcgaaggattgttttatgtccaaatgtgtgatccattttagagtatgtgtcatgtggcgatgagaaaaatgtatattcggtgttttggggtagagagttctgtagatgtctgttatgtccgtttggtcaagagtccagttcaagttctgaatatcatttttagttttttgccttgatgatctgtctaatactgtcagtgagttgttgtgtgggaatctacacctcttcataggtctctaagaacttgttttatgaatctgggtgcttgttttatgaatgttgggtgcatatatatttagagagttaggtcttcttgtggaattgaaccctttgtcatttacataatggtaagcataacatgtggtcttcattgtctttcttgatcattattggtttaaaatctgttttgtctgaaattggagtagcaacctctgcttttttctgttttctatttattttcttggtagatttttctccatccctttactttgagcccatgggtatcactgcatgtgagatggatcacttgaagacagcatacatttgagtcttgcttctttatctagcttgccattctgtgccttttaattggggcatttcgtccacttacattcatagttaggatcaaatctgtacatatcaataatgtcattgtgttgttagctggttatgcagatttgtttgtgtggttgctttatagtgtcactcatctgtgtactgtttttggaatggctggtaacagtctttccttaccatattgagggacctcttataaggcaggtctggtagtaatgaattctcttagcatttgcttgtctaaaaaggatcttatttctccttcacttgtgaagcttagtttgcctggatatgaaatgcttagatggacatttttttctttaagaatgctgaatatagggccccaatgtcttctggtttgtagggtttctgctgaaaggtctgctattagcctgaagagatttcccttgtaggtgacctgccccttacctctagctgcctttaacatttttttctctcatttcaaccttgaaaaatctgatgattatgtcttaggaatggtcttcttgtgtaatatcttgcagggggtctctgcatttattgaatttgaatgttggcctctctagtgagattgggaaagttttcatagacaatatcctcaaatatgttttcaaggttgcttgctttcttcctgtctctttccattctgtctgtgtccaaaaggaaatgcaattttgattaattcagtgatttgtttaaacagaagtcagttaagagagtgtcctctgtagttcaaatcagaatatgttcttcaagtaaacgaaggcaaattcagtgaaaagttattctacatctgacagatgttatcagaaaatagctacataggaatgaaattgcatttgtaagttaagatacctatagaccagcaatgtttctgtttatagggtgtcatggatttatgataccaagctgtttttagcttatctgtgtaggaattctgcctgttctaggaagattgacatgttttcttaaatgtaatatttcttgatactccctaatacaagttctccactcctgtctgatcaggctctttcttctcccatgagtgtctaatctcagtaaaagtgtacaagatttatttgaagaaataaaaaacatctttataaattctttcttggtttttttgttgctgttgttttgttttgttttgtttggttttgttttttgacatagtcttgctctgttgcccaggctggaatgcagcgatgtgatcttggttcactgcaacctccgcctcctgggttcaagtgattttcttgcctcagcctcgcaagtagctgggactacaggcatgcaccaccacgccaggctaattttgtatttttagtagagacggggtttctccatgttggttaggctggtctcgaactcccgacctcaggtgatctgcctgcctcagcctcccaaagtgctgagattacaggcgtgagccaccacgcttggcccttgcttttctagattatgtagaaatgatggaattgaaaggaccagaaagagtatccagttcacaggaggttcttcaaggttttccaaatgttggctacaacatttaaatattttaaatatattaaatattttaagactgtaataaaaacaacatgcacactcagatgtgttgtaccaaagtgtaacacattagggatcacaaaataaaatgaaactatgccactagtttatatttttatggactactgattaaagcttccctactaatttttatgttggtatttgaacttcctatgaatatatgtttttatttattttttatttttattttttatattttcactctgtcacccagtttggagtgcagtggcacgatctcggctcactgcaacctccacctccctggctcaagcgattctcctgcctcagcctcccaagtagctgggactacaggcacgtgcaccgcgcctggctaattttttgtatttttagtagagatggggtttcaccatattagccaggatggtctcgatctcctgacctcattatccacccgcctcagcctcccaaagtgctgggattacaggcatgagccaccacgcccagcccatatgtttttatttttaagtttatagctggcctttttaaatcttgggtgcaatattacatacccaaatcaaattatacaagcaagaccactgctgcagcatatgtatgccttggatttgggtcataatcccaaaagccacaatcctgaagccataatcccaaatactgaaattctgaaacatcaaattccctaatgtctaaaatcttgaaagttactatctcaaaagatcaaaatctcaaaaatattattctggaaaaaataattttaaaaattctttaaagacttttatttacactttgaaaagaggatctatttgataaacaaaaaatatgtcacaacacttcacaggccactttacacaatgaaataggaaataataacatacatatctttgcaagcagaaacaggcatactaaagacagtcacataggtgaaacagttatgagcagatgaaccatattcatgaagaaataggccaaaaagtgaaatatataaacacatattactatggttggtaattgtttgcacccagctttatgactgcaatcatctgaaataccatgacagacaacctaagtcttttgatgagattaatcaaaagccttaataggtcaccaccacatatgcccaaagaatcaagatcatgagaattttggtttttatcttttagaaatgcagatatacaaaaaggacctgtctttatttactgaggaagtttcaacattttatgtacacccacaatgttttcacacaaagtcaacttgtgataatgtactttcgtggagtcaaatttgcaataaatgcataaaatgaattagaactctctaaaagtcttacatattttgtacatccagtattggaaatgatgcaaagacgaaatacatagtgtatcatattgatgctatatgtgaagctacggaagtcatacacaactgagaatttggcaggggagattttttgtatttttcatctgccttttcacttctgtgatcttcaaaatactcactgcacttgtatttggagagtcgtagtggtctacacattttgtaagtaaatgctgtcacttgaaactctggttactgctcagacatttcaattaagcaattttctgctttcacacaccaataataattagctttatactttgtatctgtcattattaagtagccttgtacacttacctgatcatagcccttttgcaacagaacaatttcacagatctcttccacagtgttgtgaggaatacagtaagaaggaaggatatttggcttcttgataccaaatctatattagacagagttttccagagagagagaaccaagagaatatgtatatagatatatgagaggagatttattaggggacttggctaatgctattatgatgggtgaaaagtctcattgcaggccatctgcaagctggagatcctgggatgccactggtgtaagtcctggagtccaaagcccaccaacatgtagttctgatgtccaaagcagcaaaagaaatgtgtgtccaagttctcgaagagacctgtttgccttttgtattacttctctctaggtccccagcagattggatggtgcctgccaacgctgagagaagatctttcccacctagttcactcagactcacactcctggaaacaccatcacagatacactaaaaataatgttttactaggtattacttaacctagtcaagttaacacctaaacttaagcccaccagtccacctcttatcaacctggcacccaaacacatccccttaaaccacacttaatttccaaataaagacaagaacaaagtaatagttccacctaacatgatccaactatctgacgtacaagtgaaaatcactaatcccttcctcagaagttgactttcaggatttcagcatttgaaattttaagtttttgggattctgattttcaagattttagactttaaggattttgattttctgggatttcagcattcaggattagggtgttgaggattgtatcttttggggttatgattgggactagtatgccacattaagtataaacagatgtagggacatctttctgccatgtgtactttagcactttaaagtagtttgcaatgataagttaatatgataatactatattaaagaaagttttcttgcttaatttaagttttgggtggttctggtccattttttatattcgtgaccagaaatatgaataatgattatagtccctcagttttgaaaacaagatattctatactcctcattcaagctgctggaccattttaattgcagaaatcttaatattgccaaattatttttttaaaaactgttaccatttgtaatagtgtatttgtggtaaccagaattgtatcaatattgtaaagccaaacaaaatacagaaatgacattgttgatgaggataatttaaaattgcaattgtcacctatgttcattctctctctttttttttttttttttttagagatgcagtttagccctgtcgcccaactgaagtgcagtggtatgatcatagtttattgcaacctcaaactcctgagctcaagcattccttctgcctcagtctcccaggtagctgggactacaggcatgcaccaccatgcccaattaatttgtaaaaattttttgtagaaacaggttctgctatgttgccaggctggtctcaagctcctagcctcaagcagtcctcccaccttggcctcccaaagtgctaagattacaggagtgagccaccgcacctggcgcctattcttaataatgaatttaaataagtagtatcataatttgatcttacgaatttttactaatgaatcttttctgttttatttaatggcagttccatttacatttcattcaacaatggagactactgataaaataatttgaaaactagtctaatctattatttttacaaattaagaaattaaagatcagtttaaatgtgtcttgctcaaagttataaaactagaaaattgcagataccaaactttctaatccttagttcactgtttttctgatttgttacttcatctctgtgttcctgtaatacatctggttcaacaagtcattttctgtgtgccaggcacttttctaggcactggtgatatcccctgaatgtggaattgtgctgaaaataaaataagaaaagtagattctattcggcctccactcagttttgattgaatacatgcctgcagttagcatctgtgtgtgtatttaccactgggtgattttaatatattattaagaagaacttttctatctatggttatattttaggagagtaaaaaaagcaagttttttagtattttgaaaggagagaaaaatgagtaattaaacttaaagcacattgtttgcatactatgtacctgacaatttgtttggaaaccaggaacacaaagataaataagataagggatgtgtgtatattaaaacggagtttggcaagtgccgtaacatacatgtaacacatgtaggatgaaagaggaataaacaggtaactctaggcaggataacaaaaggttactttaaagaaaatggggagaagttttttttctatgcccagagagcaacatatgcgaaggcttagagttgtaaacacattgttaaggcatttccaagaaagtttagtgcaacagaatacaatggtatcttggaaggagctgtgagtaggcatttttagacattgttagatgattgagaatggaattaatgacatgtgaggacttcttcttttatgcccttggtattggtcatgcctctttctatttcctgcttcatccctagctctattcctaagtgttattttaatttttttttatttattatactttaagttctagggtacatgtgcacaatgtgcaggtttgttacatatgtatacatgtgccatgttggtgtgctgcacccattaactcgtcatttaacattaggtatatctcctaatgctgtccctccccctacccccgacaccaccacaggccccagtgtgtgatgttccccttactgtgtccatgcgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggtttgttccaagtctttgctattgtgaatagtgccacagtaaacatacatgtgcatgtgtctttatagcagcatgacttataatcctttgggtatatacccagtaatgggattgctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgttggccagtgatgatgagtattttttcatgtgtcttttggctgcataaatgtcttcttttgagaagtgtctgttcatatcctttgcccacttgttaatagtgttgtttgtttttttcttgtaaatttgtttgagttcattgtagattgtggatattagccctttgtcagatgagtagattgcaaaaattttctcctattctgtaggttgcctgttcactctgatggtagtttctttgctgtgcagaagctctttagtttacttagatcccatttgtcaattttggcttttgttgccattgcttttggtgttttagacctgaagtcctaagtgttattttaaatcagagactgtattttgtacttccttatcttatggcgactagctcagtgctgagggcttggtatatgcctactgattaatagtgttcatcattcactcatcaaatatttttggttccagtatgtgcaaggcctgtactttgtgctatgggggaaaaagtgacacaaagccaaccttcaaggagctagtgagcccaaaacaaaaattagcagggatttttgtgtgttatgatgactgctatatcccatgtgctcacagagcttacattcttgtcagaggagacagacaataataagataaattgtaaaaaatagactatgttagatagtaataaatactaaggagaaataaaagtagaaaaaggatatattaattaccagagaaagaaagataaggtaaatttacataatttctcatcccagtttccacaactctagaacagaaaaaataaaagtatatgccttatatgattgtgataaggattaaatgagcttggatatccatatataaaagatggaaactagacccctatctcttgcaatatacaaaaatcaaatcaaaatggatcaaagactcagatatctaagacctcaaactatgaaactactacaagaaaacattggcaaaactctgcaggacattggagtgggcaaaaatttcttgagtaacacaagcacaggaaacaaaagcaaaaatggacaaataggaccacatcaagttgaaaagcttctgtacaaccaagaaaacaatcaacaaagtgaagagacaacccatggaatgggagaaaatatttacaaactacctatctgacagggatcaataaccagaatatacaaggagctcaaacagctctataggaaaaaaatctaatagtctgatttaataatggacaaaagatctgaacagacatttctcagaagaagtcatataagtggcaaacaggcatatgaaaaggtgctcaacatcactgatcatcagagaaatgcaaacaaaactacagtgagatactgtctcaccccagttagaatggcttttatccaaaagtcaggcaatgaatgctggtgatgatatggagaaaagggaacctttgtacactgttgtacactggaaatgtaaattgggaatgtaaagagagaacagtttggaggttcctcacaaaactaaaaatggagctaccatatgatccagcaatctcactcctaggtagatacccaaaagaatggaaatctgtatcagatatctgcactctcatgtttattgcagcaccattcacaatagccaagatttggaagcaacctatgtgtccatcaacagatgaatggataaagaaaatgtagtatatatacacaatggagtactattcagccaaaagaagaatgagatcctatcatttgcaacagcatgattggaattggaggtcattatgtgaaatgaaataagccaggtgcacaaagacaaacttcacatgttctcacttatttgtgggagctaaaaactaaaataattgaactcatagaaatagaaagtagaaggatggttatgttaccagaggctgggaagggtagtgggggtttttggggagaggtggggatggctaatgagtacaaaaaatagaaagaatgaataagacggagtatttgctagcacaacaaggtggctattgtcaaaaataatttaattgtacattttaaaataactgaaagtataattggattgttcgtaacacaaaggataaatgcttgacatgatggataccccatttatcctaatgtgattattatgcattgcatgcctatatgaaaatatctcatgtaactcatacatatatatacctactgtgtacccacaaaaattaaaaattaaaaaatttaaaggattaaatgagctaatttgtgtatacataaagtgttcagtgcagttcctggaagttgataagtggaaatattatttattcatttggctaaaataactttagcatcatagccatcttcttctcataagttagagacttcttttgttaaaggacatacttttcagtggttttaaactgctttatctaaggctaatactttctcgcccgtgtgttgctccttttggcttctgcttccactgcactcacatctattcctttcttattaaagcaaatcatcactctttgataatactttgtcaagaaaacagcatttgcttatctagatgtctggtcatcattttctacttcagccatcaggcaggtatccacatcttctttggaaaatatttattacttcatcacttatcacatctcaaggttaaaaagtctgacaaaatgagacccctatgtttgtttaccacctaaaaatgagtacgatattagaaatgttattaacagacagaaatataaaatcttcaatattaatctttcagaaatgagatcatttgcaaagattaggcgaagtttcaggtctcccactaaccttttctttgcccatctaagctccatgcagccctagatgtctcctgcccaccacacctaccaattcttgaaaactagattaactctctcttcaagcttaattagcacgccatacttagccctatcataacaagtatcattcagtgttatgcccacctccccacccctctgctccccagacagtaagctccttaaggtgaggactacgttctcttcatgtttggattcccagtatccatcacagtgcctcacatagagttgatgtccaatacttgcaccattaataataatacctggagtacatttattatatcaggattatataatataaatgccacttgaccttgtttccacatcccttgcttgctcctttgtctctcttggctgctttctgagaaatagcaccacccaagcatgttgccacaccttgtcctacacattcccctgtcctgctctggttcaaaatcattccctagtttttcttttttcttttcttttattttttattatactttaagttctaggatacatgtgcacaacgtgcaggtttgttacatatgtatacatgtgccatgttggtgtgctgcacccattaactcgtcatttacattaggtgtatctcctaatgctatccctccccgctccccccaccccatgacaggccccagtgtgtgatgttccccttgctgtgtccaaatgttctcattgttcagttctcacctatgagtgagaacatgcggtgtttggttttttgtccttgcgatagtttgctgagaatgatggtttccagcttcatccatgtccctacaaaggacatgaactcatcaatttttatggctgcatagtattccatggtgtatatgtgccacattttcttaatccagtctatcattgttggacatttgggtttgttccaagtctttgctattgtgaatagtgcctcaataaacatatgtgtaaatgtatctttatagcagcatgatttatactcctttgggtatatacccagtaatgggattgctgggtcaaatggtatttctagttctagatccttgaggaatcgccacaccgacttccacaatggttgaactagtttacagtcccaccaacagtgtaaaagtgttcctatttctccacatcctctccagcacctgttgttttctgactttaatggtcgccattctaactggtgtgagatggtatctcactgtggttttgatttgcatttctctaatggccggtgatgatgagcattttttcatgtgtctgttggctgcataaatgtgttcttttgagaagcgtctgttcatatccttcgcccacgatggggttgtttgtttttttttcttgtaaatttgtttgagttcattgtagattctggatattagccctttgtcagatgagtaggttgcaaaaattttctcccattctgtaggttgcctgttcactctgatggtagtttcttttgctgtgcacaagctctttagtttaattagatcccatttgtctattttggcttttgttgccattgctttcggtgttttagacatgaagcccttgcccacgcctatgtcctgaatggtattgcctaggttttcttctagggtttttatggttttaggtctaacatgtaagtctttaatccatcttgaattaatttttgtatgaggtgtaaggaaaactggctagccatatgtagaaatcattccctagtttttctaataatgatgtagttagaggaaggtgatatccaaaaacaaacaaacaaacaaacagaacaatagtctggatatgaagggaagacctcaatggtgagaggaccctgtggagtaactgtggtccaggatagctcttccaggttaaaaacttttcttattctcaagagtgatgagcccgtgggatctaacacagaccatctatatttacaagaaattaatttacataccagattatttatctgtgtgtgtgtgtgtgtgtgtgtgtgtgtaaaactgaaatacttgagcttgctatccgagtaagtaacttaattatatcagagcacctatgaaatccatcaaataatcagaaggttatccaatggtggccatggaggtagaacaaaataagttagagtgtttcaaggattattttacccaggctgaggaagagccttgtcacacagaatatggtaatatctccctgatgactaggagaaagtaaacaggttataagatctcaagtatacctttgaaagacttgatgaatttatttgctaacagaaaacaatctttttaatccagaaaaatttcagtggcattttatatatcctaaaatgagtaattgtacaattagattccataattatttgatttccaagatgagttcctgagacaatgacaatgtgatattgccaatgatggtggaaagagagaaagaaagaaagaaaaagaaagaaacaaagaaagaaagaaaggataggaaggagaaagaaagaaagaaaaagaaagagagagagagaaagaaagaaggaaagaaaggaagaaaggaagaaggaaagaaagaaagaaagaaagaaagaaagaaagaaagaaagaaagaaagaaagaaagggaaaggagggagggaggaaggaaggaaggaaggaaagaaagtagaggattgaaattggatggttctctgtaccctttacctactctaagtcaagaatcaccagtctcaatttccttaggaaagttacctgtgtgcttatggttttagctggcttactggccctcctgcacacactggtaatgcataatgatctactaagaattcatcatttatccttttgaagaaactatgaaatgtaggataaatggttatttagcaaaataagttatacctcttgtcaagggctatagtgaaaccttcagccttatctcaaggtactttctattccagaagttggaaacccacatgcctatagaggccaggctgatgggaatgaagcaggaagctattgcagtgaactggagcgccaaatcctttctggaggagcagccactgctccattccagataattgttgcaaggcaggaatgttggcctagtgttaccatattgtccagtttctcaggtaaagcaggaaatagaattgttatgtgaaatcttttgatttaaatattgtcaattaatttacttatattattattcttaaaccatgtgcaagccaaacacttctgtaggtagggtttggcccagagtcctcctgtgtatggctggtcttacattttgcttatctgtttgttaaattagagacttttacagtttttgcttttcttcagtacatcctctaaaacactctatgcctcatttggttatactgaaactccctccctctccaacctgagtactttgtgcctaagatttctgtggctgctacattttctctgccatcctcatcattccaatgagcagtcagtcaagtactgaatggagtctccttgagatacttttcatatgacgccattaaacaaccatgggttttactacttgtttcattcctgatatgtgagctacataaacacagtaaaagatcacttatttcatggggcttagagattatatgctctttgggctcccttttctaaaaactgcacagaaataatcttcctcctcttgtttcttgaaagaccttacccgatactttattagactgtagttatcttgaacatttaattatatttgctggagagattgactggacttgagtgttcctagatacatattcagacacagtgtatttgggtgggtttcttcagtgggtaaggagttgtcttatttttccttttagtaacctgattttcaaggttactagggtactagcagagtattactttacctctgtttggtattgatttatttatatttgtttatatactttatataaagtataaattactttacctctgtttggtattgattaatccaagtaggaacttggcagccattgctaaatgaattgaagagtgctaagtatttttatagtaaaagtgtatataaatattagtgtatatataaatacaccatttggtgtattgcaaacccccaaatggacataatttgcattattttattctcatcctacaggtttgggaataaacaaaattgatatacatcatttttcaacaaagatttgacgttcatatatcaagctgcatcctgagtagacaaaacagtagtaatgcacagataagatgtgaaaattaccccccaaaccttgttggtgtactcttaaattggttatgtaaatgcagccaagttttttttaatcagtattctttatgagaaatcaccatattacagaaaagcaaaaaataacagctgtgctaacagctaacatacaagaataaatcatgaataatttttccttcagaattatagtgagtttatcgttttgttcatagatgttctggtataactcgttgctattctttaaaacaattccctacatttcttgagtacattcctaggtgggtttgcagaaaatataaaaagtaaatttttttaaagatatgtatttgagagctggtaattgttcacttttttggctttaaagaaaggaagtgttgcatagtattttccacacatgcatatagaccttcacttcccacctccttatgtattttcaaaggcacaaagtgaagctttaacctgaacttctctgcctcaactgctttttcttttgcaatcttgtaggatgtcaagggtgaagagaaagctcagttcgtaataatttctgtgaagcaaaagaactggatattatatgggagaattacaaggggaacctaatttaaagacttggaaagttaagtaaagattaggatgatgagggaagacttctctgagaaagtgacatttaaactgagatgaatgggagctattcagtgaagaacaagagggtgagatgggagacaatattccaagcagaaaagtgggcatgacacccagaggcattttagaaccaatctaaaggatagccttaatttttatttgcagtatgtagatcataataggttaatgcagtattctttccgactctccatatctttttctccagttgaataaaacagaaagagaaataatagcatattactgggcatgaagctttccaataaaaagcttccctaatacttctaaggattagggaaacattaattagctcttctacagatataacacttaattttttgaagatagtattttccgtgattatagagctaatatatgtttattatagaaaaatttgaaaatccaaaaaggcaatgagaaagtatgtttttatactaccagagaacatatagagtataatggtgttctattcctatgtctatataaatagtagcatttttgtaaattaagattataattatatgtataattttatagtatgttttttcacctaacaaaatcatggtcctttccctagtgctattaaaatttctgtaatatgactttaatagctatatatgactaataacaatttgggtacttactatgtgctaggcacatctacattaactaacttttttcccagaacaatcctatatggttataatctccattttataagaaattttaaaacttgtgcaaggtcacaagctaataaagggtggagccagggttcaaacccagtcagcttctagcttctgctgttaaccagtaatgctatgtagcctctaaatactatgattaatttaagttaaaccctattttaggctttttaattgtttttagtatggttttggctatttgaaataatatttttgattctgtgagttggcagttaagtctgggcccagctctagcagctcatccctgttccacatagtgctggctatatttacttacaagtctagggcctcagctggactggctggacagcgagacttctctctttacatggtctctcatcctcgatggtgctagctcagattgttcacatgatgatggcattccaagaaacaagagcgaaagttataaggccttttgagttttaggtgcaaaacttgaacagtatcatatgcatcaaattccactggtcaaagcaaatcacaaggcctgccaagattcagcatatggagtgataaattcatctcctgatggaaggaactgcaattttgtggcagcctaccacacttagcatttagttcaatgaagacttctatgtgactagagtgtataagttgctgaatttttgtagcaaaatatggcctggaataaataaacttattgaccaaagatgggcacagacaagcatggctgctactttgactctgaggactggcctcactctcaggagcctgtctctctgtaccttgagagctgatgaaaaatataactttcctacatcattatgatccctcattctcaggttgtgaacttttacacttttctgcagtgaacggtcaaggacatctgaagctagagaatatctctctaatgagtggcaggggcaggagagatttgcctttttaaggtatccctgtacaactacataaaacaaaagtaaatgtgctaggggtagttagagtgattaagtggagcctggcagagttattggatcgcttacaaagggtgtatctgagaggtatattttggaagaagtgactgcacagtgaagataagcaatgaaaataataactaaaccaaaaatggggctagtgtattgcacagtttaaaaaatatgaaaaaagatataactgcaagataagtgtgctcataaagaaaaatgcatgtcttgagtaaataggtcaaaggtgaaacagatggggggaggttgaatgagggattgactaggtactgtgaaggagctgtttgaataattgatatgagggtgaaagataattagaaaggggaaatgtcatttagggttactctaacaagcataattcagccaataatgatggaaagattatgaatatgttcatttattatccaataaaatgataattatgttgtagccactcagacttccctctccacaatagtaatgctattatttttaatccaatcatgtctgttgttacatgtatatattgttttggaatataaacataaaggcgggttttatgtaggacttgttcttaattggagaatatgaggtgttcacttttgcaaatataggaatagagtggacttcttaattatctttaaatattccataagctaagtttataatcataatattaaaagtataagccatgatttacatatatcaaatatctatgttttacctaatgtacatagtctcagcttgataaatcaataattaattgggtgttgattctgtcccactgtgtctcccagtattcccatccactgagcacaagatcattgtgtgatgtcattataaacattttaatagaatttactcataatatcacatgactcaaaaaccaattcattatttttatcattaatcatttaattattcagaagaatttgacatttgatgttattcaaaaagatttatgaagaatagctatttacttattttcatgatgttacttcatgttgttttgagtataactttaaaaatacacatttaagccaagcacggtggctcgcacttgtaatcctagcactttggaaggccaaggcaagaggatcatttgagctcaggagttcaagaccagcctgggcaacaaaaggagactcccatctccacaaaaaataaatcaaaaaattatccaggcctggtttggacacctgtgatcgcagctatacaggaggctgaggcaggaggatagcttgagcccgggaagtcaaagctgcagtgagccgtgattgtgccattgccctacagcctgggcaatggagtgagaccttgtctccaaaaaattaaagtaaaataaaatacccatttaacacttcataaagtagtgagtttattattaggttgacaataatctcattaaagcaaaatgagaaaaaaaaaaggtctatttcattaattagcatcctgttgaaatatgtttaatttttatattgctacacttgtttattttagggattcctttattaatccaattaaaatgtgtctataaaccacttagtaaataaaaccgtgattaactttataaataaaatttaaagttagcatatcagttttcttggaagccctgtcacactttttgaacacagaaattatcactcagagattgtgagatcatcagggaaaaatctagagcaaaaggctcttttgctattttatcaacatgcatagtcattggcttcttttaaaaacctctttcattttagacatgtgttgctaaaattttataagcccacatggtaaaaaatcagaatgtaaaattatattgactaattagaatatgcacagtctttcagaagtacttaagcacctactgtatgctagggatgataccaggaactgggaatatgacaaggtcctgctcttagagtgtttacattccaatggggagagctagtcaataaacacacaaacaaatgataaacagtaataatcatcatcagataatgaaagtatcagtgaattaaagtgtgagagagtacccctagagtttacattacagtcattttgacgagatgatgtctaatttgaatgatgaatggtcagaagaagccaatgtaaagaagaaaatcaagttgctaaaattcaatccaccaaaagccatttccagagactaatttgcatttttaaaggaatcaggaaactgaaaacattggtggaattgtggcaggtatctccctcagaacatacacacaggcacacacacacacatgcacacaactttgcatctcattattattgctactgtttgtgaaataaatataaattaagtcctaagtataagatctattgtagatcctgagtcttagtaagatggaggtaccttcatatcacaaaatctttaatttttgacctatgcttattgggcttaaatgaagccatataaacaaggtgggtctttggggaggtgaggcaagatgctgtgaaataggtacttctaaaagcatagtaatattaaagtgttaaatttggaaaacagcagaagctttagtttttataatattataattataaaattataaaagtaaacctgactacatcttggatgagtctatatagaaggtgaagttatcagaatcatggaggcaagtagaatcaattttaatatttagcaaaagaaggcacgcatcagtttcaaaagtttaagaaacatggcctgaaatgctttcctagttctaccctcctggcactttaagaaatgtatgaaggaccctagaattatataattctatgttagcaaataattttaaatgagttatcaagatgggcatagatttatgtacaggaatatttttatcagatttatttgtcattgtgaaaatttgggagaaaaatctatgtccaccaaaggaaaataagtaaagaaattatatatacatttatcacaaaattatatccaacaattaaagatcatgttttggaaaagtgtttaatgtcatagtaaaatgcccaggaagaaaaaaagtggtaatgattcaatatttaaaagacacacatttacacatagaaaatatttggaatcagtgcaactgcttcagagaacaatttggcaatatctgtagagttgaaaatgtgcagatccattaacatgattgatataccaatagatgaatagttgtataatcatatgatagaatacaatttcaagcttaaaaattcatgaattggaatcctatatctgcaacagagatagatctaggtacctcaatagagatggctctcaaaacatgttgaattttagaaaagcaagttgcagaattatatgtagtatataccagtatttatataaaatttcaaaatacatataacagtaaaatattgtttatgtatacatatataggaaataaacatattaaaacataacccagaaggatacagacgagaatcgtaatactggttgcctctggggtggaagggaggggattgggctgaaaaggaaaatggggtgagggtgagggatagtatttaacttcatctgtaatgttttcatcttatttttttaaataagcaaaaatgacaaaatgtttacattgtaaaattagagtagtggatgttgttgtttattaaactcatttttaatgtaagcttttaaaactttctaaaaacaaatgattgaaaaaaagcatatcaatggttccatagacatttaggatttttttgtttctgtgaagaatgtcattggtgtttgatacagattgcattgaatctgtagattgcttagggtagcattgtcattttaacaatatcaatttttctaatctgtgagcatggaatagctttccatttgtttgtatcctcgcctatttctttaatcagagtttcatagtgtttttgtattttcagtggttattattcagcagtgagattacagttcagtttttattttcatcttcaaacttctctgtattttccaaattcacaagatgagtgttgcgaaaaaaattgccacttaacagataaatgataactatattggatttttgctatgagggcttcctaagacccttacaattgtgctgcctctggaaggctgaagtagcagcaaaaaagggatgatcctcccatactccatccccaaaccctggacaaaagaaattagagggctggctgcctgcaagatgtaaagctgtaaaaccagccttttcttgggaagagaggcagacggattagggtgtcagtcttgatcaggcatcaaacttcgaacaggcatcagaacaagcacctagaggtttactaaaaaatagattgtccctagagtttctgattcactaagtctgagattgggcctgtgaatctgcatttttgacaagttcccaggtgttactggtaatagtgatgtttgtcccagaaccatgttagagaactcctggtttaagcaaaacccagccatcagatattggtatttttgattactgaaatgtgagggaagcatttggcaggaatcactacaatgttattatctggcagatccacaaattacttaatggagtgagccagccagtctcagggaagttggagccacatttaagagcaggcagaaaaaaaaaaaaggtatcaaatagaaagctgaaaagtagggaaaatgggaatgggcccagtgtaatgatgagaccactgaagagatttctttggaaaagcaaggtaataaaacaggcatgaaaagggactgtaaaaaaaacaagtttggtcatcagagtctgttgctatttgacaaaactagaggtccaggatgacacaaagttcataccactttcacaagcgctagaaattccatgaggccacaaactccttgtgaacagggattgacccgtcctaacttcctcatccctcccgtcctctttcctttttgttcttccacattgaatagctcattagtgccaaatattacactgggctttggataaatagtactttgctgtcgtagttcaggctgctataaccaaacactgtaaactggatggcttataaacaacataaacttttttatcataattctggaggctgggagatccaagataaaggcactggcagatccagtgtctggtaagggactactttctggtgcatgtggtcttttcactgcaaactcacatgttggaagagatctctttatggcctaatgccattcatgatggctctgcccccatgacctaatcatctcccaaaggctctatctcctaataccatcaccttgggggttaggatttcaacctacggatttgggggggacacagacattcagaccacagtacttaccatctttgtactcccagcacctagcatagtacctagcacatatagtagctgctcactaactgttgaatgaaatatgaataaacacagacatgaacagcaggagtcatggtcaaaggtatagtgagtggaagatgttatgcctgtagatgggccatttctgtgagaagtataacacagtggactggggccagtggtgcaaatttccagcttgagaccccattggaattgctactacttggtactttttatagtctgaaatttttcccagtaaatttttgatattttccccattgcctgccagtgtttgccacgtccatacccacagttccctgttttcagttgtgagtaaatgcttcattacaacacccttaacctgtctcagagccaaggctgcaaataaggcatatacctgaatatacgatggcctttactgcaaggtggtctcctgctttcctaatgagagatccaaaaaaaggtttcgggccaacttaactacacagacttttaggaatgtagttaagtagttatgtgtctatttacactgtttaatttgttacttgattaagttatgcatgcatctttgaaatacgtgttgtctaaaataatacattagcttcttcacttatgtgttttaaaatgatttcaatttaatactttcataagaatcttaagtcatttaacacagtttttcagagtatatcatcttcacttccatttaaattgtttgaaatatagtattttttgaatctgtggacaatgctgccactgaaatatttatcacaaaccacaagtcccattcattcaacactaggataattgttttttacgcattctttagtgtagtttcatgaatcccacaatgtaactatatacagtatattaaattggtcataaaaaggcttctttacaaaaacaaataatactaacaaatgtgaagttgcattccccacaagattggatactaaatcttctaaaaatttacttgccatgattttttatttaatagctcaatcaagataacttttataagcattccacactatcattgattatggctgtttcaagctagtatgtcctcctcaaatagcacctcataactgaataagggaattaaaagagcaccccataatataaggaattttgtaaattcttgactataaagcaacttccactcatattcagtaatatgggagggaaaccacctcttatatttggaaaagtactataaatttatttccttctaactttttattttaaaaaaataaacattttcttctctagaccaaaactgtataatgattagaaaagaaaactgaatcaaagggttatataatattaaggacttattaaaatatggttggattaacacacaactgtgtagtttacggtcattaagaagtgatggatatatttttatgtcaagttagaaggaggccttatgtgtacgtttgtatgtttgagtgtatgtgtatatgtaatgccataattacgggtctgtctctagtaattagaaagttggatatgccgaagagcaagtagattagtttaattggagtaagtggactaagttggaagaaggaaacaacttgaatttgacgtatgattttgatagcaaaggacatcaatgtgattgggtacacttcgtagtttattctattttaaaactgtaaagcttctcagttttcaacattaaatatacaagttcacatatttacatatgtttcaggctacattattggaattttgaagtcatgaaaacatcagatgaaccaacctgcaacaccttggattcagattggaagataaagagaaagtttaaagaatgtggcctataaaggcgggtacctggaaatattaaccgactcacactgtaaaaatgagaccagtttctaaacaatagagattgtcttagtacaacatcaaggttcaagacaaatgttgaactaaaaactttacactccccacccccacttcagacaggtaccagcattggtgaattatgattttccttagtcagaagcactcatttttacccatgtagaccatccttaggaattaaatattggttatttaatgtagattataatgggaagctgatttttttcacaatggcatatttcaaggacttggttccaaactgagctgaagcttcccaatgcgttttgtacagtctgggaaaaactgtgctgcactggcccacttttgaaggccatcatgctctgtaatataaggatatcatcttattgctgatatctttggagagtccctagcagacacagaaaatgaatggaggcaaagagtgtgacggaggggacaaggaaggaggtcttccagctatacaagttcctgtgggttggcagcgtcgtgtggatcaaaatggagtgctttatgtcaggtaagttcttattattacctgtggtacctgcaaagttgtactccaaagactaaggagagaaccaagcatggtgactgatggcacctcatataaatgtgaaaaagtgacctttgtgctagaaacatatgagaatttttattgccttagatttccagagagaattttttgcattacttgtttatataaggtgtcattctgcttatctctgtaacaagaataaagaaaaataagaagatttctaaaagaaacatgcaatcatcattaccacattcacaggagaatgtaaaatactgggaatatcacttgacctgatatcacttgacagaattactctgtccttcagagtgtgtcagctggcttttttgataaaattgagtttttatccatagaaagtttcaattattagacttcttaatgcctcatgttaactaaaaatacatttctttttttctgcatagtctttaatctatttccttgcgtgtaatagtaaaagtgaaaaagtcatggagaaggctctgcatcttacaagtaaatagtcatacaaataaaatgcctactcttttcaatgtcaatgctatacatctgttgtagaacaagttgaatggaatgactaaactgttaagaagaagttttagtcttactcattaaatagttgacatctaagttccctacttcatagtttttctgtaagtgtctgaaagaagataccataaatctttcttgtgatgtaatgaaaaattttagaaacaacttaaaactttttaaaaggtatcacattccattattagattgatgcatttactttcagtgtggctatttatatcccagcttcaacagaatttgccagtccagcaagaatgtattcatagaaatgagatatttttggttatgtaaacacagactattttatggcataataactcagaaagtcagttcagattctgtcctgagtttgtttgcttgttgtgtgtaaggcgtttctggaggtaaatctaattaccaattaaaagcattttgttgcataaattttacttctataatattaaagatgtgatccatatttattggggtgaagggataagaaagcagagaatatgaagctcatcccatggtagatgagatgaacaagcacacatgagataacttcttcagagtttctattgccagtgctgttaacaaagtaccagaaatactttgttataaatataatatagcaagttatctgtgttatatgtttatacttatggttgttctagtttataaagagcaaatgtatattcagcatagaacaaaagactctaaaatctggataatttttttttcacttcctttttgttcctatgaaagatagatgagctttttcaacttctgcgagcaaaaaccaaagtaaatctgggagtcaaaaaccaagttaaagtctaagaaactgtcaggtatcttgttcatgattttctaagtctgactagactttataccatctgatatccttgttagtatgggttctccaacttcaaatctgtatactgataattattttggaaacaagctttcctagattaggtaaaacactctcaaattaaattaaccagcatagatttaatttgtttgtatataactaaattactacttgaacatgtatagctccttctatagctccctgctcaatgtgcagtttactcataatttttagattggtctccagctgctcctgcctcagggtggcattgaggctacacattaaattttccacctacttccaatcttctaagctttatctatgctgtaagtttttaaacttttttacattaattattactctgagaaattaattaaagagatacaactgaaggaaagaagccaactgactttttgagaggaaatgtttttaaagcatctggagtactttaatagaattaaggaattcatgtcttcaggtttaattttacaattaaattcctctaggattccgtccatatactttcttctaagttaaaatgttgggcagttccttttcaccaaattcatgaatgcttcacatgaaaaatcaacaagacattatactttttttcttgttgtttttgagacaaagtctcactccgtcgcccaggctggagtgtagtggcgcatcttggctcactgcaacctctgcctcttgggttcaaacatttctcatgcctcagcctcccgagtagctggaattacaagcacacactaccatgcccagctaatgtttgtatttttagtagagacggggtttcaccatgttggccaggctggtctcaaattcctgacctcaagtgatccgcctgcctcggcctcccaaagtgctgggtttacaggcgtgagccactgcactcagcctgacttagtttattgaaatcaccagacctccaaagacatcttgttgcccttccctgcagtggttgaactcgtcactaaaatgagaattctctgcatatcacctgaaaaaaaaatagcctaagtaaatgagtaatttgacaaagttgaggatttttgtttagattttctacatgctgaaattactttcataagtgtccataaataaaatatgaattgcattttaaagctagttcactaatagatttttaaaaaatactacttgtgtttttgtagatagaacaatctgtgtccagtattgtaatgttttgtatatgaaatggagattattgtttctggatgaacttggtcagagggcttaagtgaaggttttggtaaatagtcataactaaaagatattctcaagtgaaaagtatataatttcaaagcataatatgtatttaagttcaaacattgacatgttaatgtaaagtcctaaaatgcagattgtccatctcacataaaataactcccattgtaaataaaaatcagagacatctcttgtcatctgaattactacttaatctgtattgatgaatattcacatatcttactgacttttgtgatctgaaacttcgtaacattgaagtacctacacgattattagcccgaagacctgcgaggcacatttctgctgcctaaaaccctatttcctcataagtttcctttcttttgtcaactctgcttaattcctctctctctctctgtacagtttgactcttcagtgtatcttcggatataactgatctattatatctttaaagaaacacatgggtaagggggagataaaagaaacctgtttttacatagggacaacttggttctagattccaagataaacagggacttgctcactccaacttttgtggacttgccaactttctggttcgaacttcaatatgtttctaaatttctgtttttcctcaaagagctttcaaagtagatattctagtttaaaatgagagtcattgcttttatgtagttttcttgttctttgttcctttcttgcctgcttctgtcctttcttaagaatagcatttttaccacctttagtctactcttggttttcagaatacttttatttaattttctatgaagatctgtatttttctgagaaatattttggttcaaaagaaaacacaatattgttaaaggctataatttagtagctaacataatattgacaaagaaaatgcttttccctagtgggaaaatatcccataaaggacagtaagactataaattatgccttttttcatataatatgtgtagtcaaaattatttcctgatgtttttttaaactatttttacagtcccagtgggtctttgttatcttgcttggagcaggttaaaacatacctgcttactgatggaacatgcaagtgtggcttggaatgtcctcttattcttcccaaggtaaccatttcacaatagatctacagcagtgttttattttttaggtattttgtatatttgtttttctcatttggaattttattttttattacttctccaatcatacattttaattctttatctaattctcatattttgcatgtgttttggaatgcttaaaaattgtggaaaataattcatgtctaagagtcattttcaaaggtgtcaaatctatattcatattaaatttcattaaaaccacctttctaccttttcattagagctgtatctaatattgctcggcatttaatagtgcaatattttctctcattactgtaactgctcaaatctgcaatgttattgttagcactggtattgataaatctgccacagatattctcaaaatcacaaaactgaaccctcctagccaaaatatgaaactgttttactcatttgcaaggtaaaaagtaaaatcatgtaaaatggtaaaatattatttgctatagaaataggtcattattttgtgaatgtctattataatgccaattttaaaagtaaaggttagacaatttttacttttcatttgtgtgtcaccgcattccaaaaaaagattaacataataaataaatttaaaacaaaacaagtaatagattttcaaaatcagtgacaagataatattaacgtaataataaaatgaagccaaggaaaaagttaatatgtagaaatatcatagctttttgttttgtcttttttaagtgtacttcatctgtttttacactgttagaacatcaggaggtatctaaaattgagaacattatcagatattataccttttcatatatttatcttggctgtcttagaattaggatagtattcattatttactttgccactaaaagcttgagttcagcagaagtacttactaagttatataaagttgcctttcttaaaaacttgagaaagttttattcagatttatggcttaatctatgcacaactttttttttaaacaaagggatctttttattaaatgtttttacagacatattctaaacaaaggctgtgctttttccaggtatttaattttgatcctggagctgctgtgaaacagagaaccgcagaagatgttaaggcagatgaagatgtcacaaagctatgcatacataaaagaaaaattattgcagtggccacacttcataaaagcatggaagccccacatccttctctggtgctcaccagtcccggaggaggaacaagtatgtaatatggtgaaaggttcaggaattctcctctccctagagaaggagttgctagaaatcattttgcctagcattttctcattctacttttcaggcacgcacaatgcttttaaaattctgtatgtcctgtaattttattacaaatagcaaactagttctgaaaaaatatagtgaggttattttccaaaatttcttacccagagcattcagtttaacaggcagaataaacactaattagtacatacaaatactctgcaagtgtgtaaagctgagctaacaaaagttcccttggtttttaggaaataaatgtagcctttttcctgggggtggattggaatgtgtggtatcaagtccccaaaagcagtgttattcttttagttatttgtcgaacacctactaaacagaaatcaccttgctgaaaactttttatatctccaccaccacacacacgcatgcatgggggctttcttttttaaatatttcaaagctgcagaaaagttgcaagaatagttcatggagtatccttcatctaaatttaccaattaacattttgttgcagaagttgcagttattgtgacaattcaaccctaaatatttcagagtacaagggcacactcttacataaacacgatctaaggctcacattcaggaaatttaacactgacataatattattatctaacatgcaatctgtattcagatttctccaattgtcctaacagtgtctcttatagtttcacagaaattcagtcttgaccaggtgcagtggctcatacctgtaatctcagcactttgggaggctgaagtgggaggatcgcttgaggctaggagtttgagacgagcttagacaatacagcaagacctgtctctaaaataatttaaaaaaaaaaaaaaaactagccaggcatggtggtggctcatacctttagtcttagctacttagaaggctgaggtgggagatctcttgaacccagaagttggaggctgcagtgagccatgatcacaccactgtgctccaacctgagtgatagagcaaaactctgtcttgattaaaaaaaaaaaagaagtcagtctttttaaagattcacattgcaatcaaagattgtacactgcatttagttgttacatatctttatatcaattaagtctttttcaatttttcatgacattgaaatttttgaagagtctaggccaactttgcacgatgttcctcagtttggattttcctcatatttatgttcaggctaaacacattttgctaggaatactgcatagatgatgttagctcctcatcattagacacataatgtcagtttatcccattttgataacattgtttgattgcttagttaaaattatgtccatttgattttcccattattgaagtacccttttccctttatgattaatgtgtactctgtggaattatactttgggactgaggaacttctttttgtaagggatagaatatgaatgctctctaaaatattataatctaatgtttgaatattaattcagaataaaatatggctaaacaccaaagcatttgtttatgagggattattgatactttcccatggaactctgaaaaatagggatgatgagtatacctgtagtgatcagagaaagctttatggcagaactgagatttggaccagtcttagaaaatagtaggatttagacatataagagggataggaaaaaccttctccataatgagtgtcgcataataagggatgttgtagaaactgacttgaatagaagattagaccgatgtaggtaaattggggccaaattactgattgctttggatacaaagaagaacagttgccatgtcatgcaggtaattaaagattcacacttagaattcatgtgaagaggtataactatgttttcattgttgcatattaccgtggacatattcttacctgtgcttgctctcacatcacataatatcatatagatttaccagtttctacagagtctgcttattgcctttctaaagaccctggcagaatctagatctcacttctttgtcatacctatacatacaagtttaattattgaaattaaaggtaaatatataactagcacaggtagtaataggtacacctccattcctttttaaaatgatactctttatgggattgattacttttcctagcttcagacatagcatttattttagtttcctaattttaaactatattatcataaggttgagatttgaataattaaaagttcagaagactgacttagtagtttttcacctcccattatttaaatacataagcatctgtttctgtttattcttttggaaggtactgtttattcttttgaaagcacttgatgggtgcctagcatttccacttgccaactctataacaaaacatcagcctgacttttgtttattttgtatttcagttacttttaaaatggtaactattttcccccaagtttggaagaaattttttctgaaccacagttattatctaaattctgttagttgaatataaaaattccagtgtctgtatttttaatcactgaactgtagataattatataaatacattgatacccaagaaaaaatgcaagtaggttgttttgtcactaaagagaacatggtcagtcataggataatgctaatgacgttaatgttctcactatttgccaagcacagtgcccaaaatattaacgtttttcattttgttcctttaattacaaactttaaaaatctctttttaacaagaaaataagcttcagttgagtttatctactgcaattctctcatatcattggatctcaacttttcatatattatatccagaaatcattctatcaaagaacctctaccatgataaaatcagaaattccacattttccaagaaaaacaaatgttcacagcattctcttactaattgaatgtgctctatgtagatttatttggaccccaggttgagatccactatctcagtaattgttatgatatgatttgacctgtatagtgtctagcagataggaaaaatatatttaatcttaaatgtgtaattatccagttaagtaagcatacctattattgcaaatgaatgtaactctacttgctaatgtaagtctcaaaataggtatggcaggatgtatagtttgaatggtgccattctcatctcctatgcctgtaacagtctcactggcattttctcatggagcccagctagagttcagcttcctttccaacacagctttctaagcagctaccaccaattggtgggaattggcatatgaaacaaattttacttgccattttcattttaaaaggcataactttataaaatagatatcgtaaggggctaaaaaagcgaaacctagaattctgatgtgatagaatgaaaattctgtatgatgaatctgcttgcttttgttgcctgtattctgtctgatctccagaaaaactgaagggattccaaacagccagagaaggagaaatgcactcatgtaaaaagagaatatgcaattggagcccagtactgaaggttttagcacttcaactaaattttacataagaaacctatcctaataaaagaattgaagtctgtggccataccaccctgaatacacccaattgtctaatgaaagaattgcagtcttttacctaagttggtaaaagggtgtggctgtttttacaataatgactaattaagggcaaagaaattacagtgttagaaacatgatgtgaaactaagcatgggttagtttgcaatatcactgcatttattcttcttattactcccattataaaagatttggaatcccattagacagaaatcaagtcttactctcatagtgaaaatgttgggataaggaaatattacggtatctgttctgagaaggttgcagtaagataacaaacattttgttataagggtgaacattttgtggtgaaaatggcaattcatttaaatcacccaagaaaatattatgccacacaaaccacaattttctattgtaactgcattcttaaaaattctaaatccaacaaaatagtaatatcaccatttccatctggactgccagtcttgattttgtatattctaaatattattagaatggctaatgtcattatgtattgctttagatgcccatgctttctcaacagataaagagtaaataagcataatgagcagttactgagaacctttggtcaacaaagggaaaataatgtacattttttaaatcaaatttaaaatagtattaatatatagaactatttttaattgcatagaatcacagcttttatttacagattcctatttccagatgcccatcctccctctcccttcctgatttcctccattccttccctccctcccaccacaaaagagttgagactgttaacagaattctttttttctctttcacatcagatgcaactccagtagtaccttctcgggcagcaactccaagatcagtaagaaataagtctcatgaaggaattacaaattctgtaatgcctgaatgtaagaatcctttcaagttaatgattggatcatcaaatgccatgggaaggctatatgtacaagaactgcctggaagccaacaacaagaactccaccctgtctacccccgacagagattgggcagcagtgaacatggacagaaatctccattccgtggcagccatggaggcctgcccagcccagcgtcatcaggttcccagatatatggagatggttcaatctctccaaggactgacccacttggaagtcctgatgttttcacaagaagtaatcctggttttcatggagctcccaattctagtcctattcacctgaataggactcctctttctccaccttcagtaatgctacatggttctcctgtacagtcatcctgtgcaatggctggaaggactaatatacctctttccccaaccttgactacaaagagtccagtaatgaaaaaaccaatgtgtaatttttcaactaatatggaaataccacgagcaatgttccaccacaaaccaccccaaggcccacctccccctcctccaccttcttgtgctcttcagaaaaagccattaacatctgagaaagatccacttggcattcttgaccctattcctagtaaaccagtgaatcagaaccctgttatcattaatccaaccagtttccattcaaatgtccactctcaggtacctatgatgaatgtaagcatgcctcctgctgttgttcctttgccaagtaatctcccattgccaactgtaaaacctggtcacatgaatcatgggagtcatgtacaaagagttcagcattcagcttcaacctccctgtccccttctccagtgacatcccccgtgcacatgatggggactggaattggaaggattgaggcatcgccccaaagatcacgctcatcttccacatcatcagatcatggaaatttcatgatgccacctgtaggaccccaggccacttctagtggtattaaggttccacccaggtcaccaaggtcaacaatagggtccccaaggccatcaatgccatcaagcccttctaccaagtccgatggacatcatcagtacaaggatatccctaacccattaattgctggaataagtaatgtactaaataccccaagcagtgcagcttttcctactgcatctgccggaagtagttctgtaaagagtcagcctggtttgctgggaatgcctttaaatcagatcttgaaccagcacaatgctgcctcctttccagcaagtagtttactctcagcagcagccaaagcacagctagcaaatcaaaacaaacttgctggtaacaacagtagcagcagtagcaattctggagctgttgccggcagtggcaacactgaaggacatagcactttaaacaccatgttccctcctactgccaacatgcttctcccaacaggtgaagggcaaagtggtcgagcagcactaagagataagctgatgtctcagcaaaaagacgcattgcggaaaagaaaacaaccacctacgacagtgttgagtttgctcagacagtctcaaatggatagttctgcagttcctaaacctggacctgacttgctaaggaagcagggtcagggttcatttcccatcagttcaatgtctcagttactacagtctatgagttgtcaaagctctcacttgagtagcaatagtaccccgggttgtggggcctcaaatactgctttgccttgctctgctaaccagctgcattttacagatcccagtatgaactctagtgttcttcagaacatacctttaagaggggaagccgtgcactgccacaatgcaaacactaactttgttcacagtaacagtccagtccccaaccaccatcttgcaggtttaataaatcagattcaggctagcgggaactgtgggatgctcagtcagtcgggcatggctttaggaaattccttacatcccaatccacctcagtcaagaatttcaacgtcctccactccagtgataccaaacagcattgttagcagctataatcaaacaagttctgaagcaggtatggttttattagaaaaaagtacccaaaggtactaaacttttctacttttttaaaaaatttgtaccaaaatatttattatgataagaaatgatcctttccccattgtgaaattctcttcatttctttagtatttataattttatttacagaatgctagggatttgtctattgggaagattaacagctaagaggatttcatgtgtttccattatttgttgtcaatctgtgtcattttgaatattgttcgactttcacttggttttataaccattggactccaaactgcaaaataagccatacgaggcagggtttcctggtttgtgagacatgtccttggtctatgccaatataaaagccatctccctagcttttgtttgtattcaggtaaatgaagtttatcttggaaaaatccaaaaaggcaaaaataaatggattttttttcttgctgctgaacagaagtaggtgaatggataggaaaaggtaactagaagttgtacgaagtagaaggctgtcttctaatgtgttttcttatcctagtttgctatccttattatttgtttgagaaaactcaaaaatggatattggctactcccttttaaaaaaaaagctaataatttaagctttctaataaaaaaaaggcttgaaaacctgatttccagaatttttaatcttgaaattgttttttgagtttcttgtagaactaaaccatttttatcattgacattaaggttttgaacccaaatctattgtatctcttcagccaccattaaggaaacaaatttatttaaaagtaggcatattagaaaaagacctgtattttgtgcaatagagtcctcagaaattgttataaaaactgtacagaagcacctaagaggtaaatgtgttgaggcatcagaaaatttgactatgaaaacattattcaacactaatgatttatgagaaatgacaaggaggaaataaaagatggttgtaaagacattattgttcactatgaaaacagtgtgctatgaaaaccagattgctactgggaatgagaaaactgctgaggtttttaataataagctagtgtgtaggtataataccgtcatgctggagaagcattctaacccacatgtctttgttgctgatagtaaaagcgttttccttcctagtgttgccatttacacctgccatccttcacatcttgtgttatgtgttatgttttgatgtcactatttaatgaagaactattcaatgatctcttatgttaaatatatatatggtttagaagatatttgaaattattagtgccttcttgatattcttagtttaaagaatctcataaaactttatgttttatgtgtctaacagtatacttatcccatagggggcttccagcttttcactcactcatcatatttctttttagataactcgacacaaatgaaaattttattttatctatttagcagaaaagtcacacaaagttcataactatttaaaagtacaccatatttattgagcataccttaaataattttgatgggacatttttagtctcattgcattatacagttttgatatcccctacctcagtttacttcatttcaggtctgagttcatgtgcaaagtgtatgtatttcattgatgtatttcaattcatctataatggaaaagaccaacatttacttatattcttgtttcttctgatggtcaagtttagacttatttaatactgttttggtcatttattttttttgtttcatgtatctttgtaatacatctgacctgtactgttactgctgggggtgtcaaagcatataggttaaaaatttattagtgtcagaaaagtgtgagcatataaatagctaaaaaggataaggatacatgtctagaaatgatatgaatatgaccaactagtgtaaactaacaggaagtatgtgcttaataaaaatctaagtagaatttttaaagtattaaacctaataaaattaaatactaattaacgtgcataggtctgatgtgcagctggttatgaaaacggattgattcactaatgaacataactctttcgatgagctaaatattgaagcagtctctaatgccatgtttctttttgccatgtagtgaactgtgtcaactcaatgtaccatcactgtaattgcctagcctaaatatctgtttacactgacatttattcattcatcaaataaccgttgagccttaaaggtaggcattcagaatgagacagtaaatgatagtcacagcttttcctctaggagtgttactgagtatttctatgataccagaaagacattagaagaaaaccacattttattcttaaaatgttgctatagctatctatcgtcaagtaccttttatgtaccaggtgatttccctatattatttctaatctgtgcagttttctaaagtataaagtattattgttcaattttacagatcaggagcctgaggctaaaaaaacttaagtaactgttccgtatcatacataactgaatcaggatttgaactgaggttcatctgattctaaaatccattttcctcccagctgcataaattcttcatctgaaacatttagtgctcaaaagtattgtgttccctttcaaaatcttttaaaatgttcaatagataataaattaaatcacattaatgcatgttaaaagccacatttgttaactattgatatacttcagatgaaagtcagttatttttgccaatattatagcaaataatgactagaatttttacgtcagtgcagaagaagaaatacccaaaatgtcaagaaaactgccccttattagtgaatcacatttggtgacctttcttttaattaattatcacctcactcaaattagaatgggtttcctagtaggtgacgtgtcagtaggcctttaaaagagatgtagatgctagtcatgtcattccaagcatggtagcacagtgaggatgaaaaaaaccaacaggtaacatggtccaactgtactctgtggttacagagcttagatacaactcaggtgacctcttgctcaatccagtgcctttttccactcttctaagtaaaagttcaaaaatattacattaagacattaacaagataagaaataactttctctgaaaaatgcttagttccattggtaatctatttttaaatcttcttttaaggagagtcttcctatgcaaaacaatccaaatattgatttttaggcctatatgtgaattctatgggaggcatttaaaacatacaacttaagcatgggaattgaaggcaaagatagtagcaaaatcagataaaagatattaaatactttgaagaatttctaaagcttatgaatatacaaggctttattaattctactttgtgttttcaagttgcctttccactaaagcttcaaaatactttgcattttaaagtttacagttttccactggctttttcaatatcaaattacagataaagtttaatatttccatgtaacagatttagaaactgaccagtaggatacttggtgacattcctcaagttgtaaagcaaatctctgttggatctggcagccaaatcccaaagttcccaattctcagtccaaacactcaaactgccaaatgcaggtatgttctggaaatccatcagtagtagacatttaaagcaactttccatttttaaagagagatgcatttcagcatgtgagtagctatagcacatgtcctataatattatgacttaaggaagactccaaaatcaagtgcccttgcctggcaaacttcaaaatgcccaggcctctttaatcctctgactactgcacacctgcttaccagataacaaaaacacatgccagtaacccaagcctctgcagaggacttagccctgttagtatccacacaatgacccatccattcctttgccctgcagtttttcacgattttcaaagaaggaaaaagatttagattattctgccaacatgcttattagcaaccctaccttcttccaatatgataaagtcactaagtcattcaacacaacataacttttttcactttaaaatgacttttatgttctcttattttttcctaaaaaaaaaccaaaacatttaatcagctcttttaaacacatgaaaatttaatcctctgaggggacacggtatgggtttgtgccagaagagaaaataattcaaacatttatttgccttaactcttaaagatatacatgacaagaatataaataagcctacaaataaataaatgttcttgagtatttatatacttatatttttttaactgcaaaagaaagttttctttcagcacaaaatacatttgattgaaactcaggacagccattaatatggtaggtataagacaatggaatagtgagaccacaaaagaacactttgggtaaaagactacaaagtaatgagtttggtttttatgtcctgtttgttcatttgttcttggaacatagcagtaaagaaaataaagggagttgtcatccctgttttttctagatgaagctacaggggcagaaagattaagggataaaaatgctcaagggtggattatactataaagtatccttctcaggagatgagagatttgtatagaaataattcagtgttatatagattaatgtagactgaagaaagaggaagagcctccttgaaggctgtgactgaataaatatgagttgctagtgaaagtattttcactcaaatttttaaatgcttcgattttatcccccaatcagatgcacaaagtttgtagtttaaaaattgtcctctgcacttgttttttaaccaaacaacagaactatactaaattctggattgtgtgattaaaaatctatgtctattattttagtaaatttttgcaaaatgagccatttattctttgctgtaagacattcttaatatagtcaatgtcttgttgtttaagaaggtctcctaatatcagggtttcaccacttattttgtttacttattccaggtttaacgtttccttgtattaaaaaaaaaaggagttaaaatatgttcagctgtagacgttgagtctatgtaatcaaaggtgataacagaactcagagtggtgatatgtttgctgattcagtgatctattttgtacctttcaagaaataaattgtcccagtgtgcaaattgggagaattttattccattacaacacattgagctcacttataaagccactagaaatccttcagttctctagaagatgcctaagctactatttactaaaatcaagtggtccaaaaaacatttacacagttgcaaaacgtacccagattctatggagtaatgttaattctacaatgtttgagtcataaaaataatgctaaaaaatattcctatgatgtcatcaaaatggatttcattttttcatgcatgtagtactaaataattcaaatcataaataaaattcttaccttctaggaacttctatcaaacaacattaatgccagccaagccaagagtaaagtaaaaattatttctaagccttatactacttgcaaattcaaagtaacaactcacctttttacagattaaaagtggagctagacaacagaagtctgaaggagttgctgaggtattcctggggttggagttagtccagggaagtccgtattatctatccaagacccatgggcacaggtataagagagagtattcatcacagatatactagagcagggctcctgtgctgcataactccacagggacccctttctcaatgtagcctgataaatatgctcccagagcacagctccatagaccatctcctacagagttgagcaactgagaggcctgatcctaaagcagtatttttcagctttttaaaattcttcccacaataggaaattaacttgcattacagtccattagacatacatttataatgtgtaacaaaaagtttcatgaaacaaatacttattacatgtaataacttctgattttttatcccattctattttatcttattctatttggtattttttaataacagccatgactcactgaaatgattttaatcactcacaaaacagatcatgacctagcactcacatatataagctaacagaaagagcttccacaaaatactaccctagctgtgcattgtcctttacatttccttttcaatttcatttatcaaaaatatactagttggggcatactaaattgatgttgcaccccactaatagatctcaataatgtttcagaatatccatgaggtaattaattcagcaaatatttattgagcacctaggatgtgctaggcactgttttagcactgcagataaaacggtatagtagaagaatacaaagctaagcatattcataatctagaaacttagcctgctctgctcattaaacaaaatgagataagacttccaattggaatattgatgaagtgttttaactgttaggtactgtagtgcatattcagagaacagaaattataccagcaagagacttatactcttttctctacatttgttttctcacaaatattaagaaaaatgtgatcaaagaggaattttttaaaaaaaaccctattacttgagtaaactgaaaaatcccaagcattttaaagttaattccaacagttttcagagtaactatatgtgttaagaaaggaaacaaaacattatggggaggggggaagaaaaaaaaacaaactctttttctgactccatcaccaccacgagactgaaaagactgatccccttgatagtcataactacacagacatcatattccaagattcaagctgcatcccttctactgctcttttctcctccccatcctcttggccctgttgagtgtggagagcatttcctcagatactgccatagctccctttcccatcttctctaccttctcctaagtcctttggtttagggccccttcctccctcccttgaatagaacaaagtagcctctagtccctaagatttcgtttctattgctgctaaaagaatgttaatttatatcagaatccagagcacaaagatagagatttgatatgtttttgtaaatacacattaccattccctcttactaaaacttgagaaaataaagtctcgtagaaagatctagtattctcataaaagttatctttcaatttattattgttatcattaaaaatcggtcctttaaatatagaggagaaaatttactatttcaatgggattgaaaagtgaattatatttattagactcactaagccatgatattttctcttatctacatgcatccatttttattaaggattaccattgtccctgtttgcaatgcaagtacacttaccaaagcaaatgataaaggtcagatggtgaaggcatacacattctatatgacttatttcttaggttcttgaattttatagataaaaatcagtgtttggacatattaatttagaaaaggtttcttagcataaagtagtatttgttcaaaattagagctaaacaaaatggtataaggaggttttaaaaatacttcattggtctctttgatatgagctttatatcctatcttgtacacatccaaagacgtgtataacaatattattaatatttaagagacagccatataagagtttagcacaatacaaacaatgaccaggaagaagagaaacgaatcaaaagaggtagacattaactttgttttgaaaagtagttttaaaaatgagacagataaaacatgtcaaggattaaattaatattaggaaaatatcctttaaaatttactcgtgctgtcatgtacacacatatgcatatacatatatcatgaattataaatgtgtgcagaatactgtttacatacagaaatttgtctggagcaggcacagtggctcacgcctgaaatcccagcactttgggaggctgaggcaggtggatcacaaggtcaggagttcgagaccagcctggacaatacggtgaaaccctgtctgtactaaaaatacaaaagttagccgggcgtgcctcaggaggctgaggcaggagaatcacttgaacccaggaggcggaggttgcagtgagccaagatcacatcactgcactccagcctgggcaacagagtgagactccatctcaaaaagaaaagaaaagaaacctgtcctactgggcaagctaccactgtcatttcctcattggactagactgtcttaatctctgggtgtcaaagcatgagatctcgcaccaaagtttgtttaggtggccttccagtcttctctcctactcttgaaaagcaacagagacaatgagaaaaagaaagtatgccagttcatggtgctgctggccagtgtgaaataatcattttttcccagtaaaggacttctccagcttactaacttgttccaggatcccagctgccttttggttatttaactggtaaacacgtaatgaataatttgcttcttaaaaatctcagcgactgtcctttttattcaattaagcacaaaatatcttggctgcaaaaacaaaacaaaacaaaaaaacagctttaacaaaacatttttccccacggtttaacagaccatagggtttttgtgcagaactatgaaatacgttcaccagagagtgcctattcaagattaagtggttcagaaataagcaatttccaaattttcctccatctataaaatttcatacaaattcagggtcctctttgaatgactgtaagcatgaatgagtaactttaagaactcagagtaatttgggatagacctctccctctgtggggtgatttcaacttctcgaaatatctggaagccttcttaggtaatttgtcatcctgcacccatctcctttccaatgtcccttatctcctggcattggactaatacactggagagttcattttcactttctccacaaacgggtggtattctttccctttgtccacaaacacaccaacacatagcatcaaactacctacttctaaacgttgagtgcaagttttatgattttacaatctttttaatactaacaaatattttttgaataccgatcatgtgtcagagactgtattaggtcttggaaatacagtgataaataagaaatgatttttgtctttaatggtttagaaagatgatttcaaatgtcttcactgcttatctaaggcagcaggttcaaccatgggtaggaggagccggaagcatagggaaacctcacaatattttcagtcatatttctttgttttggggaagcacaggactcttcattaccttccatctactttattatgtctttgttgttttttttttttttatcatcttgcttctgcatagaggccctttatatttccttttcatctctcaaattccagaccaaatattataccacttgactagttttccctgacatgttcagttttatagtggtctccttattatacacctgttatacctcttagcatattgccttatagttatactagcaatataagaaatgagctttacatttttctagttcataataaactctgaataaatatatatttgagagaagaaaaagacagagagatttctgtgtttctttctttacctaaactcttagttcctttaggaaagaacaagggtttttttaaaatttttattttcatggttctattctattgtccagcagagtacacctgtttgttgtatagatttgttgaaaattaaagaaaaatttaaaaaactataccttcatctttgtactacatttaagaagcttgtgttattcaccactttcttgatggtaaagcaaaaatacacccagagtatctatacttcgcttcttctaattcttcaataatatttagatatttagagcttttatgttatcccaaaatggctacttccttgaatcataaatgtggatacttgtctgttgcaaaataaagattaaaattataataatctctaaggaaagccttcatctacaaagccttgccatgtacactctagagcattttgaaaatgtgttctccctttggttagagaaattgtgatctctacatctaaatatgtcattattatttagcagagagaaaaacttgccacagatagtgccacaagtagtgattaccagtaaataagactttttatttaaactcttaaaaatatttgtaaaggtttaataaaagttttaaaaaaattaaaaagatggtgtccaaatggaaataatccatactatctatggaaatagcagcaagatttaagaagcagttaaatgtttaaggttttgattattttgtaacaaatctgaattagtatttaaagaattgtatactatatgcctacttcagtatttggtatgttttcttaccctactcttggtgaatgtggtcattatttcataaatatttatatattttcaaagaggagtttttaagatctcattctttaaaacactgaaaacttaaaaaaaaataaaggcagaccaagacagccaggaaaaatgacaaatccttgctatagggatgttctgtaaagtgtgttggatgtgcagatttgtacttactactattagcacagcaccactactatgactactaatgtcaataatgatgataactccttttatttttatagacttttccatatttcagaacttttgcttccctttttttgattctcaaaataatcatgccaattacgaaattttttctaaggaaaaagttcaaaggtagcaaatatcacatgtagaaagatatttatccctgtattatctataatgatgagaaatcaaaatatgaataccaggctttatcagagtggttcaataaatatagtaaatacatacactacacagttaaaatataaatacgaagtctatttatcagaaaggaaaaatccttgtgttattctattaggtgaaaacaagaagaatataaaattatattcatattactgttacaactatggaaacatttctgtgtatttggatgaagcctcaatggtgacatgataaaatgtaaagttttttaggatagcatggcatagcatagcccaaaatgtttgagttattttagattttcagtgacactggtgttgttcattatgccatatatgtgtttagtatttttaaataaaactaaaaatgtgtattcttaaaataataaaatatttgtcaaatgcatgtattacataaaacaatggatttacaacagggaaagactatttacaaaaaagtgattataggttccttttcaatagatgtggttttcaccctatctacctcaccccttgtgcatctggatcaccaggggtgatttcaaagaatactactgcgcaggctgtaccccgagagatgagttttcagcgggtctgggttagggcccaggtattggtttgtttttgtttttttaatttctccagataattctgttgtgcagcttgggttgaacatcacaaaaacagttataaataagtgaaattttatcttttcagatattaaattcccagaattttcatccctagtgtaaggcttttaagaataagaatgctatgtaagactggtctaatttaaaaaatcataagtacaaagtatctttacgcaatcagaatggtaaagattcttaactattgtttttattcattgtcaaaaataatgataaatagagtattggtgagagaaatgagcactgtcttccactgcttataggaatgtaaaaacttcacaggagggtagtttgacaatatgtattcaaagcttctaaaatatgtaaacccttttgtccctggaatttcacttttaagaatttatccttagaaaataattaggtgaactggcaaagaagtgttaataagaataattgtcatagcgttgcttacaatagtaaaagattggaaataataaaaaaactcatgactgtggattgattaaagtacagtatatcatacatgatactaataaaatggttctgtagctatatataagctaacatggaatgataatcacaatatattgataaataaaaaagctacaaaataacattatagcatgattctatttttaaaaaatatatgtaacatatatatgcatatgtgtatatatatatgcatgcctgcatatgtatagacatgcaggtagaaaaagcccagaaagctataaactaaaatgttaatagttaatcttcacaggtactttttattttctgccttatatttttatgtgcattctacttttgtgggtttcttttcactaaaaggaagtagtagttttataaataaagacaaataacttttttaatgaaaaaaatttttaaaataaaactactgcttttatctacccaattgaatgaagaacgtggattctcccatcttcccctttcacttgtctgcctgtgaaaaacaagctatttgatagtcagcaacagctatttctttttttaaaacccccacctctcctgccaccacaactcaccagctatttctcaataaaacgtcttcaatatatttattttcaaaagcatacattctaaacttaagtcccattaacagatgtcaagtgatctgattacaattaatctagttacaatcaatgaaggtgccatggaacaaataaatttaaatttatgttaatgcatttttatgcctagtctcacataacattcatgattaataactgggttttgtgtttttttttttttcattttaggcggttcaggaccatcatcctccatagccatagcgggcaccaaccaccctgccatcacaaagacaacatctgttcttcaagatggcgtcatagtcaccactgcagctggaaacccactgcagagtcagctacccattgggagtgattttccttttgttggccaggagcacgcacttcattttccatccaacagcacttcaaacaaccatcttccacaccccttgaaccccagcctcctcagttctctacctatctctttgccagtgaatcaacagcatctcctaaaccagaatctattaaatatcctccagccttcagcaggagaaggcaagtctgagatcaacctccaccctttaggttttctcaacccgaatgtaaacgctgctttagcttttctctccagtgacatggatgggcaggtattgcagcctgttcactttcagctcttagcagccttgcttcagaaccaagcccaagcagctgccatgcttcccctgccatctttcaatctgaccatctcagatcttttgcaacagcaaaatacccctttaccctcattaacacagatgacagccccaccagaccatttgccaagcaatcagtcagacaacagccgagctgagacccttttaaccagccccctggggaaccctttaccaagctttgcaggcagtgacactacttttaaccccctgttcctcccagctgtcaatggggcctcaggattaatgaccttgaatccccagctgttgggaggtgtcctgaactcggcatcggccaacaccgctaatcatccagaggtttccatagcaacctcctcccaggcaaccactaccacaaccactacatcatcagcagtggcagcactgactgtctcaacacttggtgggacagcagtggtgtcaatggcagaaacattgctgaatatatctaataatgctgggaatacacctggtccagctaaactcaacagtaactctgtggtgccacagctacttaaccctctactggggacaggtctacttggtaagttaaattttttcacaaattttttacaaaagaaacgtttttctaattctattttctcctttttaaaaactccattttgtcacactatttttaaaaatgtttttgttatgtcacagcttgcttaaggaactaaatataacaacacccacacacaaccatagttatacaaacatgagtgactttttcctctttcccctattctagcaatactaaatatcattttaatctgctttctcttctaattctgatgccacctaaacctaacctacccatcacctcttaaaccaagtagagtctcatttttcaaataataaagcacaggtacatcttaaaaatcacttttatttgaattttagttggtgtggcatcacagggttagtatgagcagctgcactgtggatggaaacagattgagaaagtgttttccaggtgaaccctaaataaacaaaactaaatgcttgtctagcaaaacaagaaacaagatgtaaaaacacgcaaagctaaagttttcccaagttcaagggaacagacagcccctctagctgctactagatttcctcagtcagtattaattttttgacttttgtggcttaaaaatacagtttttcatctgtattatcctatcacaaaatagttcgaaaataatgccaggtatatttaactgatggatataggtaactataatataaagtgtggggatggtgtccataaagtctagaaacagggaaatgtacatcatgatgtcaatggcatcttcaaggtgtaaaaaatttgtttattatttatgtgtttttgattttatgaatgcctttataatatagtataattagttctatttggcattgaaatctttgtagttaaataaactacgaagcattacagatttacatgtttcaagttacaagacaatttctatgacattctcctcaagaaaatgtcagagtaatttcaaaataattttgaattttgaatataaatttaattattaatcctactgattatataatatttattttgaatgattatgacaatgaattcttttgtgttgttagctttcttttccatgttaattttaggtgaccaaccttctactgcaaaacaaaatgcacgtttctaaaccaaatcgatgatttgatttggtatctattgatgattatggcttgagaactaaattttgtaaacaaggcctgatcaggctcacttattttaattatctggtcagatacttacaattgctaaaacattataggactaatttcaacctttaattttaggtgctctaaaatagatctaaaatctaaaaatagatgaaggaatcatatgacactgcagctcaatatataaggactgcctaatgaatagagcaaagactaagtagtctttccatgatgtaaaattaaaaaactaattatacaagataaaactaaataataaagctactctttccttaccacttagtaagactttgagaagtaaaaaagaaaagcattacccaagtaagcatagcacttagtttctgtttcaggaattctcgggtacaaagagaggcatcgaatctccgaagaatcacatttatttatattttatgtttttcaaactgtaggtgatatgtcatcaataaacaatactttgagtaaccatcaactgactcatctacagtcgctgttaaacaacaatcagatgtttcctccaaatcagcaacagcagcaacttctccaggggtaccagaatctccaggcgttccaaggacagtccacaattccttgcccagctaacaataaccccatggcttgtctgtttcagaactttcaggtactctcctctgctgtgtcattttagaagaaaacaatgtctgagtttgtttaaatacttaatttgggggaaagggtgaaaaaagtaggttacgtgccctttcacctctatttactgttatttctcagtcatgagtattgttaaacattccagtcttttgtgtgaaggttttctttttttaattttgtctgaagtatctcagcagttcttttggagctgttagtaaaaactgatcgtgtgaccctcataagcccttttgtcatttatcattgttctcatgactgagactcacctcccttgcatgcccacctgtccaccctctccagcctcagctctcaccactcttcccctggcttcagccacatggtatttctttagttccacaaagtgaataaattcctgctaggttaaggaggtaggtggaaagggtaacactaaatccacatagggagaaaatatgggctttttaaaaataatcttggggtagagaaggctctttcagcatgacagaaaaccaaggcagtcaaaaggaaaagtaacaaatttgaatagataaaaatttaaaatctctgtatgatcaagcatattctaaacaaagctaaagacaaatgacaacctggcagaaaatattttcctaatacatattaaataattaacacctacaacataaaaagagctcctacaaatcaggaagaaaaaggacaattgattagaaaaaaattagcaatagatatgaacagacaattcacagaaattgaaagataaagtattaaaaaacatgaaaataacaatcagagttacataaattatcacactaatgtgtccatcagattgatgatacccactgctgacaagggtgcagggaaatagattcactcagattactgttggtctgattatatgctgatacagtccttttggagggtaatttgatagcatatcagattttttaaatatcttttgaccagaagctcagcttctgtgtattaatatctcattttagagaaatcttcaaatgtgaacaaacaagcacatatcaaaatgttcagtgcaatataatttgaggtgtcaaaaattatgaaccactccatcagtagggaaatagttaagtatattatggtacagtatatccatctacctggtggtttagaaaattaggtagacttacataatctgatatggaaagatctgtaagactgcaagactccagtgctatagtattgcagaacagtacttttaaatctggaagctgtaaatataatcatacgctaaaggaaagacccagaaaaggggaacatctttatgttcaagggataataaataaggcaggattcctgaggagggggtgtgggatccagaatctaggaccatcccatttaggttgaaagaaagaaggaggggagcaaggaagggaggtaagaatgatgcactccagtgctggttagttctaagaaaggaaataggactggagtttagggtaagaaactgagtttcagcgagaagtaatgatgaagaaaacttgtatctttatgataatatatatatcttccatagtaaaataatttagaaaggaagaggaagtgctcaaccgtgtcactgagaaaaaaggtaagataaagcctgaagagaatccattagatttagcaattaggacatcatcagtgacttagtggaatgcagttttgctggagtggtgagagcaggagccagatggcaaaatggaggaacagtgaataggaggttaggaattaaagagtatagattaaagaagtagattttagctgttcttgacacacacacacacactactatatgagatgataggctaatttgtttcactctagtaacaactttaccatctgtatacgtattccataacatcatggtgttaacttcaaatacacacaacaaaatttatttctgaaaaaaacttaactttgaagaatgtaagagaaatagggcagtgccccagcagggggtcgggggtaggatgaatgcaaactttaaaatatgtaagccatgaacatagtcatgtgctataggaaagacccagaaaagtggaagagattgaacataaagaagggaaggtataataaataagacaggatccttgaggaaggggcttgggattcagaacataagtggagggcacaccctcagagagcagaagggacccctcatgtgggaagcaggacagaatttaggacgggtatagttgcagagaagtctgctgccagggggcagggagtatcagagtataagaaattgtgagaattcttgcctgatgggctttattttctcattacgtaagatcatctactaagaatagtctcggagatggtgaagaagttggtgaatatttgaatagttgtggaaatgattgataactaactagaagatctaggattgatgggcagcaataagccctcaactgaggttggaagctacaaattcctatagacaaatatcagcatcctcactgtagatgtagataaggcaggcagttgaattgatccaagattgggattttgcctggtaaatgtagacagggtgataatagcaagagagaggctgatgtgtcgacagatcccaggttctggattagcagggaaggatgtaaagaaagagagagatcattgtggaaaaaaatctgaaagttcaaagtatcaagggtctagagcagtaattcttagatggtgcgggggtggggggtggggggtaaaattagaattaccttgggcactttttcaaactgccctcatccttcctatactggaattctgatatgctcccctggtaagtatgctctccttccaccactttccaattgagaatcacttctgcaaacagccattgtcactattgacagcatggggatgtggcctgaaaaggttgaggagcaggtattactaccccatctgaaaactagtgtcatgttattattaagaaaggagtttatatgtttttttaaaattttatattgtatttcacttagttaagtggaaacatcagtgagttagaaatcattttcaaaatctttctcctttgctaatttgattacctgtgacttgactctttttgaatcctaaattgcaaagacctgtaatgacactaaataaatggagtcatcccaacctgagtacgttttctgtccagccacttcaagtttaatttttctagagaatgtttcgcagtgatgatttttaaaaatctgttgaatgattttaatcaaagaaacagcatgcaaatataatcaagacataagctttcctatacaaagtgactttttatttcattttttgagtcttgttctttatatttccttccttgttaatatttgtttgtcttttggtaaattttaaaattatagtctttctctttgaggcctcaaaattatttccctttctctcactgcttcctgtctatttcttcaaggtgagaatgcaggaagatgcagctctcctaaacaaaagaataagcactcagcctgggctcacagcacttcctgagaatccaaacactacacttccaccttttcaagatacaccttgtgagttgcaaccgaggattgacccatctcttggtcaacaggtgaaggatggcctcgttgtgggtggcccaggtgatgcttccgtagatgccatttacaaagcagttgtcgatgcagccagcaaaggaatgcaggttgtcatcaccactgcagtcaacagtacaactcagatcagccccattccagctctgagtgccatgagtgccttcactgcctcaattggtgacccattaaatctctccagtgctgtcagtgcggtcattcatggacggaacatgggaggtgttgatcatgatggtaggctgaggaattcaagaggggctcggctgcccaagaatctagaccatgggaaaaatgtgaacgaaggagatgggtttgaatatttcaagtcagcaagttgccacacatccaaaaaacagtgggacggggagcaaagccccagaggggagcgaaacaggtggaagtacgaggaatttttagatcatccaggccatatccacagtagtccttgtcatgaaaggcccaacaatgtctctacactgccatttctgcctggggaacagcacccaatactgttaccaccaagaaactgtccaggggataaaattctagaggaaaatttcaggtataataactacaaaagaactatgatgagttttaaggagagactagagaacactgtggaaagatgtgcacacataaatgggaatagacctcgacagagtcggggatttggagagctgctaagcactgcaaagcaagacctggtcctagaggagcagtctccaagttcctcaaatagtttggaaaattctctggtcaaagactacatccattacaatggagactttaatgccaaaagcgttaatgggtgtgtgcctagcccttcagatgctaaaagcattagtagtgaagatgacctaaggaacccagactccccctcttcaaatgaattgatacattatagaccaaggacgttcaatgttggcgacttggtctggggccaaatcaaaggactgacttcctggcctggaaaattagtaagagaagacgacgttcacaattcatgtcaacaaagccccgaggaagggaaggtataccaatctttatccattgtcaaatactaacctttgttcagatatcaattattgctttttgttatcatcactttggattctttggatttgaaattaggattcttcatgactcattgaggtctcacaagcttctggagcataaaatgaagaggggatggttatagtcaacaaaatgtcgtatcaacaaggggtgagttgtaaagcatttatagatcacactagggctcagggtggctgtaagccaggaaccagatttccagaatttagtcaactctgccttccctctctacagttacctagttcttcatttcatacacagaggaggaaggcaagtgtcaatgactggggaaaaaaatctggtagcctttggaggtccaggagtgtggcaggggtaaggaccccccaggcaatggttgcgccaggggacggcatctcctccatgtgcttacatgtggcacacacagctgggaagggggtacagtctgggtggagttgcagccatttctggaagcagcaggtaaagtctgagttcagaatgatgtctcctttcaggaaaagttctgggcctttaaaacatatggaaatgtttaacctcatagtctggttctacttaacacaattagatcacataaattaaatgaaagcttctccatgaaactaccgttcaatttaaaagaaattagtaggggtcttctgggcctttttttttttttttttcggcctttacaataatggtggaattggctcactaggcaagaaatatgcagagtgtttaaagtagatagaaaaatttatatctgaccaggaggagataattatgcacattcccccatatgattaaaaacgtataatttttcatcttcttaggtaataaaaattactcttacaggtatatgttattctcgtaaagagtgtattgtataaagcaatttcaactgtgctcaaactttcactggcacttaggtttaatgacaggaaaccaaaagcatttttgccagcacaataaagggattgtctttctccaaatgactaggaggtcctaaaaccttgctcataatgcctaatatatacttgtcaggatacactctggccataatgtttgtacatttgataagaaaatgaattccatacccctattcacaaaatattttattctctatactctctgagttcagacaaacattctttaggttgaaaaacctaaatatttttgacagtttattcaagaaataattagaaacagaaaaagtgggcttttatgatataaatggaactgctacaaatacaagatgtagacattgaactgttttacaatgtctgtgcaaacgaactaagtcttttttatgtgccattttaccaaaagcttaactaaaaaaaaagattatggcctcccttccctggaagcattctccctgtcctaaatgccttgtctaaatatctttttatgcccttaggagaataaaggcatgtacttttaacacatttcacattaaacaatggtctagatcttctgattaatctgtgctcgaaaactcctgagactgaggtattcactgatgttaggggagatgtactttaaaaaaaaaaaacgaagagaaaaatatttttcttcacttaaataagcaaagtagtatgtagtattcattccactataaagtaatatttttaaaatccagattcttcttccttaattttggcaatagatgaattataataggaaacataaaactgttgctgtaaattcatatattcctcctctcactggctgaccttgtcattttggattctcaagtaaaaacctttatatcaagatatactatatactaaaagtatttttagtaattcagagaatttaatttaaagcacacatttagaggtgaaaaactgaaaacatgtaataaaatattaatgataatacatgaaacatttatctatcatttaaaaagcaaggtataacagccttagaagtgctaaggactcagcatttttaaaaacctgttcctttcaggacctaccacacttttgcacataagtaaactaagtactacttcataaacattcttttttcctctatacaacacaaaacaagacttcctaataccttatttagtgatgctccgtgagtcaaagttctcattttacaacaccagaaaaggtaaaaattcaaacagaggtctgtctgacttcaagccaagtgtctgatatattaatggccctagttcaggaagaaaaagtaaaactatgttcaatatctgtataagacaaaacgtgatgtatttcagagagatatctagtagaacactttttaaaatttgttactcattcaggtgaaccaattttgatgtaattttatttatgtagaactccttaatgcccaagaatgttggataaagccttacacactaataactggacttctgcttctagaaaggtaagcattgccttagtttaccttctgtacactatggcaatgcctgacatttttagaaagtctaaagcagaaaggcagagactaggtccaaatctgtttattatagtaaaacttttctcattccgccttgctaatgtgcaatgtgggatcattttccatagtgtttatctttgtagcgtctaggaagaaaaaaattgccaaacaattttcctacattatcactttaaactttcttagcttctcagctttcatactatttctatgtccaccaaagaatccaagattctgtcagatcccaccagataaaaatctacgttaacacaagttttagaatagatttattacccctgactccaccctacaacatatcatttattattttcagttacaggctttgttctcagcaagccactccaaattctttatggaagcaggcaaaatagaaaataaagataattaattgacaggatagaagattactatttcaaaacaagctgggtgcctctcctatttttaggttgcgtgaatggtctctggtctaaggaagtcaatgctgtgtgatcagagcactgataattgccaagggctgagacctccccattgtcaatacattaatattttagcagacactgttggtcataatagtaactgacttggtcagcttatgatcttagaaaggcctttttggtctttggtgggatagtaaatgtagcagattattgatatgcattagtcatgttctgtagtttctgagatgatttcctaaaaggtatggtttttagacatcgaatactgtataaacacagtctgcagagaactagaaaaaaagcagggtgtagcataaagaggcatgggttttgggcactctgatgtgagcctaatcttagctctgccagttacctaagtggtcatagtaggtatattaatctcctagaagctgcaggctactcacccctttcaagtgagaatattaatttctattcaaagagatgccttaagaattcagtgaaatactgtagattattatctagcacatcaaagaggttcagtaaacattaacctcctatcctctgccctttatgttagacagtcttattaatttagattccaccattatggaattgtggtaatttgaccttagttattgtttacctctgcattgtccatgtataaaggatttattaaccaggttgagagtaaaggattataaggattacagtcaatgaatgaaatagttcataactatgtttacagcacatgtacaaattggcatatctgattataagctagtgttagctgttaatttcaagcaggagttccacttgaaagcgttttaaagcactcagtttgttgagtgaacttgaaagttcctctttcctcaatgtttctaaaaaaaaacaactcagactttcttcctctaccttcccacataactctctttcacacgtaaaacaatattaattagtggagatttttaacagcctgtgaaaagttgggatgaattgcctgtatgtattactttcctaagattgaagctatgtgacagcattggaggacattatgtgccttgtattataccactcaggaagtgctatctccttcctaatgtgttttttcccttggttaacaatttgtaataaagtacattctgggccgggcgcggtggctcacgcctgtaatcccagcactttgggaggccgaggcgggcagatcacgaggtcaggagatccagaccatcctggctgacacggtgaaaccccgtctctactaaaaaatacaaaagaattagccgggggtggtggcgggtgcctgtagtcccagctactgcggaggctgaggcaggaaaatgccgtgaacccgggaggtggagctcgcagttagccgagatcgcgccactgcactccagcctgggcgacagagcgaggctctgtctcaaataaaaaaaataaaataaataaaaaaaattgaagtacactctgggagatagttatacttgttctaaataactggtgcaagtttctttctgaaccatgaaccctttactgttcgtggctcagtgaccaggaataagacctcagtgctgtgctccagtgcatagccagaaccagacagattcacttccagatcttggcgtaatgttagggaattcttgggaagaaaatggctacctctgacattacacctctatgccttaatttgcaaacatttttaagcctatgcaacaatggaggaaatggttatctttatgtacctatttcaataactatttaaatttaaagaaaatgctcttgttttctaaaatatattttataattgtcatctgtcatctttaattttatgttaactagcttaaaagggttgcctctcaagcagtaataatcaaaaactaaaatttttatttttttctgcatagatcatttttactttttgagcatcctcccattggtcttcatatatcattgctcttacatttaatgtatattctgacccaagccaaatttaagaaataatttattactagactggcaccaaaaggtttcttttcaaagaaatgactgttcttggacagatacagagacacctgattaccaaaaaaaggtctacatctctgttctacactacctggttaaatgaagacattattttcaaagcataagtgggtagggtgttccctcttcaaaactgctctttgacttttttccatacagttatttctggcaagtagagataaaaacagctctctgaatagtcgttcaaaaccaacaaaacttatctttattaaaactcataaccaaatctattggggggcaatacattttctgtatgtcagttcagcatcacacacacatgtgttttgacagcatggagcataaccagagacaacttaccttgcattctgggggtgtgtaacttaagaagttgagccccaggaactaactttgggaggtgcgtcctcctgtgatgttcagacattttactttgaagaatgttctttctgtgtttatcagtgttagctgtttgtattctttggtactataattctctgttgagaatgttcttggtgtattcactttgccttatacattttcttaaccgctgttggaaatgaatccttttctctctaccatagcatccacaatacttgggttgcattttggttggtggtgtgacagaggcaatcaatgccctgtcagcaccagaatctccttgaaagggagcaaaatagtttttcaaaagtaataagaaagataaaatccaggccaataaagtcaattcctgatcagaatttgaaagataataaaaatgaagaactagcaaagaccaaaaatgtgaatataaagaaaaaaactaagctgagtaaaagaactgtaaactttactatagtgaactgtgaaatattgtgaacttttttcctgagccagattaaagaggactaggaggcctatcttcattcgcataggtaactgagcccaacacagactacatgagcttgttcatataatttcagataggaagcaggaaatagattctcaggtctgaggcaactacttgcttctgttacatgaacttttaaacattgtttccttagaaattacaagtttatctgaaacatttaattctatctatgtgttgtggattgatatgcaaattgtagtcacatttagaatggatttacccccgtcctgtaatgtacttccccagtgcttaaaaacactgctatccaaagtgaagaagaaaggaagcaccgaaaaaggcctcagataatgccactaaattgtgataaagagaatttggttagttcatttgaaaaaaattgggattcatttaaaggaatgattagtactctgccatgagaactattgtactattgttggaaaacaattaggttcatcctgtcacaggtgaatcaactttttactctaaattatttatcatttaatattaattcccagtctttaaaaaatattgaaatattgcacttaagttagcagaaattttttcagtttgaagatgttattttaaaaacatatatattatttttaatatttactatttaataaatgtttgataatgaacctaataaatgcctcatatttgctttctacttcagagctatatttcccagacttcagctaaagctgcatattacatatattattatttacttaaattttttctttaaatttatcacttaattgattcattcaataaatatttattaggcacaaatgtactaggcactattcaagccactttttagatttaaacaacttaagttttatcctaggatattgtatatgtaaaatcataatattacttgtatttttctaatgtaaacttatatgaataatataactattaaaaatatgcaaaggaggccaggcacagtggctcacacctatgatcccagtgctttgggagtctggggtcagaggatcacttgaggccaggagttcaagactagcatgggcaacataatgaaaccctatctctacaaaaaattgttaaaaattagcgagcatgatgctgtgcacctgtggtcccagctacttgggaggctaaggtaggatgatcacttgagcccatgaggtcaaggctgcagtgagcatgccaggcatggtggtgcacccctataattctagctacttggaagactgaggtgggaggatcacttgagttctggaattcaaggttacaatgagctatgatcacaccactgcactccagcctgggtgacagagtggagaccttgtctctaaaaaaaaaaaaaaaaactaaaaaagaatatttaaaggtttgtccatgttttacctaaataattttacataccaccagtggccctttgactgctttggtgttcataaagcaccttcatgttcgtggtcattttagatcctttcagtgacccacaaagatgtgcagaattatccccattttacagatgggagaactgaagctcagagaagtggcatcccaaagaatacaaatcacaggtagttaagccaggtcgcaaccctggtcttctattctatatgtagcactccttacattatgccattccccaacaacaggactttgtagaaatggaatggggaagtaaagactgaaaaggtgagcttgaggtcaactctgttataagatcgatgatgtggctagtgctccattattctttgacgtttgcacaacagctctgcttcagcaataaggagcaccaaagaattcacacagagaggtgttatcaagattaaagcctgcagaaaattttaacatcatctccggttaaccagctctatttaaaagtgatctaggatcattgatccaggttcttcgtttttgtttgtttggtttttgttttgtttttgagatggagtctctcggctcactgcaacctccagcctcccatgttcaaacaattctcctgcctcagcctcctgagtagctgggattacagatgcctgccaccatgcccagctattttttgtatttttagtaaagacagagttttaccatgttggccaggctggtctggaactcctgacctcatgatccacccgcctcgacctcccaaagtgctgggattacaggcgtgagccaccatccccagtcagatccaggttcttcaaatatgtattatacctctctttcgagggttggtttggctctctgaaaggttatgtcttcttttgtcagactttaagtttcttctgagatacatgaggtcccactgtgctgacaccaaatcaaaaacttagttaaattatcaaatgtgtaatatgggccttctgaacaaaataagcaaataagcaaccagagattcagccttgttcagaaaaactcttaatcatctaccacatagtaatgtctggctttatgaatatgtttctatccgcactgaacaaactataaaactatttatgttgaagaattattatatccaaacaatttgaatgaaagaagagtttttaatagtcaaaaagtattggtagggcacggtggctcatgcctttaatcctagcacttttggaggctacggcaagcagatcgcttgagcccaggagtttgagatcagcttgggcaatataatgagaaccctgtttctacaaaaaaataaaaaataaaaaaattagctgggcattgtggcacacagctgtggtcccagctactaaggagactgaggtgggaagattacttgaagcccaggaggtcgaggctgcagtgagccaaggtcacgccactgcattctagcctggccaacagagcaagaccctgttaaaaaaaattaacatttaacatatgtgtatatttatacatgaataagtaaactatgaatacatataaattccaggtagctttatgattcttaaatgacatgagtaaagagttacaccatgatggccagtactattagcatcattgctatcagcatgaaactgtgtgggtagatgatgagtaaagataaatgataaagccctctcctaaattctcactaagatagagttaaataattcatgaaactcctggcttgtgatcgtacaagaatacaagattataattatagataaaagtattatcttaaattagttgctcctttagtgtaagttttataaaaatatttgtgtgtgtttaacctttttaatgttacatttatgtatttgatttcctggtcctttttaaaatttacaagttagctaagtaatttacaagggagtgttcattaaacatgatttctatttaactagaaattgaatttattttgttgttctctgataccattttgggcgggggtatctttaaagtttcttgaatatttttcaaatgtatgaatatttccccagaaaaaacacacactcttcatatatatttcacaacacagtaaagtgctaaaatcctgaaacaaactaaactttcttctgaatatgtatgatcttgttatagcagaaatgcacagtgatatatatcttacttacatttagtttcaggactatatttgctttctttttcgaggtcatttaatcctttataaataatatagttcattataagagtatgttagaggcttagaggcagatttaaatgaagaaaccatggcagagtattagttcagaaaaaatatccctggaaaattattcaagcataaaaaaattgaatataaatttgggcaagttgtcatctaaattttgtagaaatataattttaaatagtttgacctaaatttttgagtgtgcctgtgtgtgtgtattttatatatgtgtgtgtaattttatatatataaatgctatatatatataaaatgactacatttcaatgtatattggagttggtatggtggagagaagttgagcactttggagtcagacctgagtttcagttctggtcacgttatttaaatgcaccgagtcccatctgtaataacataaaagtaatactagtttgcagtagtatcatattaaatgataaaacagtgccttttacataataaatgcacaagaaatgtttttactgtcccttagtccataattaattaaaaataaaaattgaagacttaaaaaaatagttcgacctaactttgttttttaaattaagaccaatggggtaagttttaattgctgtgtcttgctttgtttcactgtgactctgattctgtgacctgatcaaccccttctgaggtccctcgctacaccagtttaagtctaatagaagtttatgttatatagcacagctcctttcctgctgccaagaagcttatttaaatataagtggaatcatttattgattacaaaaatgaaatatgcaaagcatctttcatatccccttcatgtgagtgaatacaagatggaggctcatttctaacatgaaatatgaaagtgcttccaggcatctttttttttaaacaacacatggatacatttagctcactttagcttttccagtggtcccagtaacccaataggacacttttctttatgtgaagtgttattggaacaaagttgtctcttgtgctggcacacagtgagttgggtatgtatgagcttgtgtgtataagacatttgtttgggcaaaatacaaaaacatgaaaaggaaaacaaacatttccatatttgactgtttttctcattgaatattagaaatgcttgttttcagacttaataatgaaaacttcttgttaatcataactgtgttctagatttgaaggggtcatagagaagttatttctaaaggacattcatgagtcaatgttggggacacaaagacaaaagttgataatcatttccttgcttattagtgtttattttcttacccatgaggcattttgtttaactctgtatttttatgtaacagtggattggaggggagtagcaggggttggaggagaaatgggagtaaagtggctggcttttgccccaactgaatagctgagttacttgccttgaaactatgcttacataccaaacaacactatttttacttagattgtgtgtgtgtgtgtttacagaataaaaatagccatgtttttctaaaagtgcttttattcccaagtcacatacaagttttcctaattattgtttttattgtggggaggtggcttcaagaaccatgatagagattctcaggagtgtgcagcaaaggttgcaccctccacacacacacatatccccccaccacacttggtggctgacctctgttgacatagctgaccacacacagactggcagtgataaagcaagacaagacaaaggacacacccacaaggcatagcaacaccctcttctcacgttttatggcctctgcagagccaaatgtgtactaggtcatgatcattactgtatgctaggataagtgttcaacaagacttgtcacattttaattttcacagcagttctagcaggaaggtaggtattattgtcctcattttacagaggagactgaggctcagaaaatgtgttttactcctactaggaagtgaaaagtaggattcaaactttgatctgttggcccaaggcccacccacttcactaactacctctcttgtcttcccctgatacttatatcacagtagtctgatactacagatttgcagttgctaagaaagtgaaccaggatctctgatttttatgattttgtgaattgaaggttgtttaaattccagattttattcccaaaatattattttcaaaatgttgacaattttaaagccaaacagcttttcacttccactgatgctgcagcctggagccacagaatcaacctctaatgattgagtgaggacagaagatttgacaaggtagtgaaggttaaggctcccctccccgccagtgcagcacctgcttgtacggcaggaaagtaaaaaccgtgtttaacaattacaggtctgggtaatgtggtttggtcttcataccttcactcaggtggagcccgagaagttgaagacactaacagaaggtttggaagcctacagccgtgtccggaaaaggaacagaaagtaagcacttttccaaaattttactttgtttttccaggatataatttactgtttttccatcaaagggacaatgaaatctcactgattctgtccacgctgtggcctgcctaagtgaagtttgttaccaccaaagaggaccattatagacaagccaaattagtgattatggaaaatatcctcttaacattttatgtttacactatgtgtaatatttgcctcttcatctgttctttcttcattccctgcatcttcattcctctcatttagtggaaaataaaatataattaatattctcaacatatagcaattaaataggctctggaagtgtagtgaatcaatccatttgcaattcaaatactttggggagtaaatacccctcgttgtacacatgtaaataattttggcagattactagtcaaagtgatgctaaataaagattttttttgttgcatcagggatgtggacttaaaagtaagttttctttggaattacaacaagaagttgaatttcaggccagtattattcaagtttttctaaatctttattttctgagtaaatgtagtacggacaagcagataatattagaaacatagtttttactgtgatacaatgtatgtttatgtatcataactattatttcatattaaggtagaaaactacaaatgtgcttctctatatgtacatagctatttaaacatatgtaattgatatgcctgttcagttgccatactaatttctgcattatcaagcaaccaaaaattatatattagttaatttttattcatttgcaaaatgatcctcacatttccccccaaatattgacacataggcttaatgtgtatatgtattgtcgtctttctaaaaataccattttaacttctgtttgtacatcaagacttacaaagtggagatcagaatgattcgtagtgtatcttgcatagaaggcttatataatgatatcagtaatatctattaaaaagcattctctttcactttatggtgtttcccataattctggccagaggcataattttagaagtcaacaaatcttaggaagactcttcacctcaataaaaggtatctgaaaagatgacagctgcaaggggcaaactcctatgtctctatgtcccggactcctttaaaaggtagcaaattggtactggctgtgtgaaaggccaagttaattgccggataacatccctctagacctgataaggaaaacagggatcaaggtcccttctactcttactgaagcacacttgctatgcagagcttagcaacaagataaggccactaaaattaatacaaggtctggataaaagaaggaaaattgcaaattacctacaccacaaatttgcagtgggccagttgctgtaaactattcaacagtacccatttctttggtgtaaaggagccctgaaaatgtttcctacagtgaaacatgccagttacttggattatgtacaaaataaagttaataacagaaataaaataactcctccaaatattcaaatacactgccttgaaatgagctgtattttccccatgtatttgctattaagcaatttctgaaaggtaatgaaaaacaaactacaattttaaaaatgtttcttcaaagccaatttcctatttgtagtaaattaatgtgagagctatctaaaggaattctcctcatgataaccataaacttaaagtacagtttggagaagtaaaagtagaaaatacaaaactaacatttataaaaagaactttatttaccatactattgtctaagcagacagactttccttttcgatgcccagtagaatgctttacattttgcacatgtaattgcaaattcatcattttattctcccagtcacgagatgggtcaaaattactgagccatttgcagatgcggacactcagactcaaacactttaaataattagttgaaagtcccacaactgataaattatatgttgaaccaaatcattttttaatttatgcatttattcccaatttaagaagacaaatttagcaaaaaaaatctgtgccaggaacagtgctacagtccctgaagctcactgtttagtgaaagagacagatgcagaaacaagtaattcaaatgtcaaaattgcaacaacagcaatatatatactatatttttgggtcacagggaaaaggcaggtaaaggaagggttcctagaggagaagatatgtgggccaagccttaaacactacataggcatcagccacacaaaggaaacaaagacgaagatggggtgggatagtgtttagatgagagcagcagttggatttgggggactgtaaagtatcggatgggaagatataagaggtataagcgggaaccagatcatgaagggcctagtaaggaccaataggatgttttattgttttggaagtgcctaaagggggcaggtggtcagatttttcaccttaggtatggccgtgtacaaggacaattttaaggcaacaatattgaagatgaagagattgttcaggagccatggcagaatacaagggagaacgaggacccaaaccaggagctggtggagttggggatgaggatggaaaagaaggaatgtggtcaagaaatacttaggaggtaaaatagacagaacatggggtgattgatcagaatgtaaaggaaagggaacaaaatcaaggacagctctcaggttttcagcttgggagacttggtaggttgtagaaacactgactgaagtggaggttacagggggaagctgttcagtacagtttggggtgcctgtaggataggctggacatacgtgtctgaaactggggagaagtggtatttgacagtatacaaatgactgcagtcacacaaagatactttgaccaatttgaagaatagtaggctaaggattgaacatgcaatagaatgaagaagatgggaagaatggtcagtgaggaggaggagaatcagggaaagtagacagagtctcagaagtcaaagactgataaaatgatcaacagaggtgcagtaagacaagaactgaaaaatccccatcagattgggcaatttgaaggtcactggtaaacttcagtgagaacagtttccagtagagtgatgggtatacacacaaaatggctattaaataagaataaggaaatagggagaggagatgtagattatttactcttctttctacccataatgtgaaaaattcctgaaaaataacgaagaaagaatttttaaaatgacaaagatttgactacttttgtagactgaggggaagaagaaaagaggaaaaggctgaaaaaggaaggtgtcatttggagcaagataattaagaggttggtttttcacctggactcaagtcctgtttctaccacttcatagctgtgtgttcgtaatctccctgggcctaaattcttcatttctaaaatgggcataatcctattttaggattgttataacatagataatatagagagagcctcagcacagtacttggcacatggcatttagtaaatagctatttttcttataaagatacaggtgaaagaaagaaaattatctgttatttttgccagttgaaacattctaccaccatattagatgtttggtattttatatagtcattttaatcctcagtatcctcaatcaaactgtacaacaaataaatatctttaaacatatgttctaattatatcctagtagtaacatatttatttaatacattacttagggcaattttgtacttaaaagcagaaatagctttattaaagaaaaattccacagcttttacatatgttatagttttcatttaagcgaggagcaaatcttctgtctatatgtacgtatacatttcttgggaaacctgattttttgtgaagctggaaaacaataaagtgattaagtaaatcacattttcactttaaaaccaaggaatgatacttaccatgttaaatttcctgagatctgcatacattccccatggattcagtttcagagctcagggtttttgacttttaggtctcacccaaatttgttacatactgtatgaagtgagtcacttaaactctgaactgacagtgtagaacaacttgcaatttctcatttcccttctatttcttgtactactcatagaggtgtacctggctttttaaaaaattagtgaagataaagataatgtgtgacagtgtaggcaatgaagttgagaagtggcaattatctccattaataattagaaatgtgattatatgaacatctattacttaatcaagtaggttttagagtgtccattagtaaaaatgtttattattaaatgtcagcagggaatagaaaatagtagaagaaactccacagggaggccctctggactgaaagactgaattttgactaattgttcatttcttgaattcatagagctttttcttcctcttttaagttcattcttccctgacctgaccagtagctggtctgcagatatgacatctgggagagtctctctttacctctcaaatctcatgatatatacaaataatttcatgccccacatctatgtatttattttctcttccaaaagtagtcatttctccctctattaactactaagttgtgttaaaggtgaaacattatactaatttagcttgaattaatgcaaggtgtttacaaatattttaaatatcttgaagaatgagatgacaaaactcatgaaattgttttttccaacaagtaatgctgaatcgtttttgtgcttgaatggtaattgttattgcaatttttcatggttaggtaaaaatcttttacccatgactatcacttttgaaaactatagtcaaatatccattttcttcattacaaaattagaattaatttcaccaattcttaaaaagtcatgaagtatcacatacaaacagttgtcataatacctattccatcaaattattgtaaggattaaatgagataatgtatatagagttttaatacaatacttgggccgggcgcggtggctcacgcctgtaatcccagcactttgggaggccgaggcgggcagatcacgaggtcaggagatcgagaccatcctggctaacacggtgaaaccccgtctctactaaaaatacaaaaaattagccgggcgcggtggcgggtgcctgtagtcccagctactcgagggggctgagacaggagaatggcgtgaacccgggaggcggagcttgcagtgagccgagactgcgccactgcactccagcctgggcgacagagcaagactccgtctcaaaaaaaaaaaaaaaaaattcttggcacatagacattttttaataaataacaggtatttcttttactaagattaaatgtgagagaaccaaggttctctggaggtttttcattaaaacattgtaacttcattttaaatatttggaactttatatagtcaattttaaactcctaagatattttaatcaaaatttataataaataaatgtcttataaaacttgttaatacgtcaaacttatgttcatacaaaagaaatagtgaggataaatttatttaacacattacacacagtgcgatattgtcaggcaacgtggcaatgataatactgtcagaacccttgccaagcagcctgcaaaaggggccccagcccagcctcagcaaaccctaggtggccttgcagagtgctcccaggagcttgcttggcagacacctcattaggaaaacaactgagactgactccatgagatgaccagggccccttgaaactggaatgggtaggtaaaaggaagacagtacatacataataaaaaaacttcttatataccagttagaaggaatgaatagattatacaaactagatggtatttaaaacagttataaggagaaaaaagagaagtatgtatatcatgacaccttttgtgtgtgtgtttaaaaaaaaacacacataaaacaatactagattaaagtataaaagcagactaaaagttgaggggggaaggtgagggaaaatgggaccaggataggtaacagggaactccagctttatttttttaatataaaagacttaaaggaatttattaacatttccttccagcgggggaatatattaggtttattttatcctatgtactcctctgcattttaaaatttctaaaaataaatgacaaaaatataaaagctaaagactagcttacagggcagcaaaaggtaggggttgatgccatattccccttataatttggttaaaaccaatacactaatttttcccttcagttaaactgacctaagtacgtatatattttttgaaacataggaccatctgggccacctttgacaaatatttttatttagcaaatacatagagcatctatggtatgtctagcactatagaactcaggggtggaaaactcggagttctcaaagtgtagacagaaactcaatgtatgcattgtccagtcctggtgtgtgaggaaaaaacctagggaaagctatggtaaactgaactaaagttcaaaaatgtttcaaaacactatgctaaccaaactaaatacaacagtaagccaaactctcccacgactgcaaatttccagtctccatggtagatgctaagataggacttaactcatggaaacccatgctaaccacctgttatgaaaacgttacctccagcagcttttctagtaattgtcatgacagggtaaatgaaaagaatcaccttagcacttggaaaaaatgagtaattatttattgcataaaggaggaaaaacaagttaacagtcaggatgggcaaagtgtacataaccacagaggtgggtagcatggatttacctgattttagttcaacagcttcatagatctaagcttcaaaaatggcagatgcaccgtgtgtgttattcgggccaaacatgtgtaatggaatgctaagtggagagaaaaggtcagagaagtgataggcaccctgaggccgtcattctttatctgttcaaatagttacctcattttggcttttggccctggggggcaggctccggagcctcaggtgcgtcagagttaagctgtttcccaccccggaacacgcaccggcatttcagccttcacttgctcaactccagagccaggacgctccagagaggacagagggagctccctagtggccagagcctgcagttcagcccctccgcccttcctctgatcacacagtcaggctgactgagaaagaaacaagaagcaacacagggccggctggagccagggagcatgaggggcgtctctgggagagggaacccgtggcccaactttcttcccaaatcaccagattgtggaagaagcatgtggaagaggaaaaagtccatctccccgccccacaatctgttcaactttttttagtagttctgtgactttaatcattagtattcagtgataagaatcccagagtgatgttttgtcatctgaattttccaaacgcgagtataaattggctttctctcgtggaattggtacttttgttttctgattaggaaattaaattgagttttgtttctttaattttttaatctggtgtgttgttttcattaattccagaagtggaaagctaaataaccatttagaagctgctattcatgaggccatgagtgaactggacaaaatgtctgggactgtaagttaatttatttttccattatactacgtttctttgaaaataaattgtgttacactttttggtaaagtctcttgagtattgtcaaacaactcacatagcaatactaaattactagcctagaaaaaaaagacaaatattagaaaagattcaaagtcatttaagaaaaagaaacctaccacattaactatgtctttcttcctgagataagtaattttgttttgccacataacgttcgtttaaaatatgagcagcaaaatattgaagttcaaaccacagctttctgcacttgactctgtgaatggccatggccattactgttgcttatatatgtagtaatgcaaactttgttctgtccattgaaccaaaaagacagtggggtcaagatcaagagtatatagacctctcatatcccatttttattgaactgtgcatataatagcattgagtgtgagaagtttaatcgttatgctccagttcacatattgactgatgtaaatacttaaaatataattttggtaatctgttaaaaatgtgaattgtctaaggctatttagcatgaaaaataatttcttttatttgaccttatgttacaaggttatctgaatcccaacaaaccatccaatgacaattgaatgatgggattagtataggttttagagattttgtaatccaaccaaaccatcatttcgcagatgggtgaattgaagccctgagacattaaatttcctgataaaattataggaaagatctagattggggattataaactcaaatgttttctagggccaggcaaattatatcagtaagtaaagtgggccaggtatgacagcagttggaatggatgagaaatgccagtgaagatccatgggttagggtaggctaccaatctagaggctcagcacagtataagccattacccacttgagtctggtgctggttgaggaagggttgctccacaccagggcacagattctttctgtatctagtgaccacctctcttaggacctcagagtgctccattatatcctttgcattttgccttgaaggtaaaagaaaagagcgtgctaagaatactgccagcataggttttatgagccagacctggaagctcattctgttgactttccactgacctgacctaatcatatggccttcttaactcaagtagaataggaaatagaacatagaatgtgcctgcccaggaaaaagagaaaatgagtttggccatcatctctctaggctctgcctcgggacatttggtcctggtggaaatcaggtagttgagagtaataaggatcagggcaacctgggagtcatgtgctctctccagaaggcattccttccatgctccagcagatcttagacatctgggaaattgtgttcatgttgcaagatctttccatttttcatataaaactagaagtctagaagtaaattttctcatttttatgggttgacaactgttttaaaaaatattaaagtgccatatggctaaacaaaataccatttcagccacatttggtccacagattactagtttgcagtctcagttataaaaagtttctttcctcagttataaaaagttttggctctttactacagaatagttgttttaaaaaatgtgtatggagaagattaggaggaataggcagattgaaaaacccataaacattatttaaaatttttaaatattattttttaaaagcattctgcatttgagtctggatagcattgccctttgctgctgtctaaacattatttttaagcatgtaattgagccaacttgtagtggatccggagaggcgattgtactcatctcttcctaattctaagtcctgtgacataaggttggccagggtaaaagttttacaccacagaaactggcaaaatgctaaaatggacttgtgtcgaaatgctgattaagcatttgctacaccattgccttgggttcatccctcctctcctaggtcttggaccttgctcctttccaccaatagctacaagacaatttgatcactccctcctccaaattatacctgctatctaatgctgctcagccactgctcaatctgatgaacagcactaaatgttgctagttcctgcattagcacataaagaaaggtgagttgtattaactgctcctcccagactacacaatttcagatctgccaacagatgatagtggtattctcttttccattttgattcttcttatgaacaaacatccttgggctgagctatgtgtgcatgttattataatttgtgacccttcctagtcattgtaaaataagtagggtaacaaagtgagggaaaaaaaggggcatgtttggtgtgtaattattcattcttccaggctgtagtgaaattggtgatctagggtctctgacagggaaggctttatttttgttttaaatggacaatgggggtaacaactgcacattgcatttcccatacttgattttgtccagttcatcctttgttttccactgtctattggcacccgcagagtgttgcactgcttatcagtttctagcattctgcattctctgtagtgactgtgggcacactgacatctggggtcttggtaaacatttgaagtgcctcaggatatcagtaattgaaagtgaaagccagagtctattccctaccctgctcctttgtcagaaattttatggtgtttgtgatttcatcctctgttgttgttgttttttttctacctttttatttccaggtacaccaaatcccacagggtgacagacaaatgagaccccccaaacccaagaggaggaagatctccagataacagagactactccactaatgcgcagtgtttattaaaggaacatgcacagatgtatctgtatataggtattgatatagccacagttatatcaatatttagactatggcagatagctaccaccaccacagggtgctaaaagaaacagtgatacaaaatttttttgatcaggaaggataatgaatgctggaaaagccaatcaaagtctctgtgtgatgagagtgatcaatggtcaagagattactgagaaactctttttctataatactaaattgtgattataagaaatagtccaaatgtttctgaagaattttcaatgttgtatatagaaaatacagaatttcatggtgatatcagaaatgtaaatattgtacagtattgtcatgtacaagcgtacctaatgcacactttatcttttattgtacaaagaaatagtgtacaaaattctttggtttctatggagtacacctaccagagactaccagtgtaaagtgataaataaaaatacaacctaaatgcttttctatgataatgtaaaagatgctgtttttgtatttaacagcagagaaaaggcatgatgatgtaatatctgaattatgacatacactgcacaccactgagtgtccatttatattgtctgtttggaatgaaccttgcctggaagcactggactcaatttcgggtgtctaggaaattgcaactttgcagatttctaaagggatgagggctcacaggtctaaattaagaattcagaaactgcaaccatttgttgcatattttttttacctaagttttaaaatagaataggttttataaaaaaaaatcttagatggaatattttactcagccatttctgtagttaacatttgatagccacctgttgaagcagatagcttatactgactgcaccaccgctggtgctcagaattgagggtttttttgcaaatgatatctgacaaggtaaaactttctatttccgtacatggaggcaaaaaccccactttgcaaccattatcagaggtaagattgataataattcatttttttgtagtggcaaatataaatatgaatcatcaaagcaagtttcatatccattcatcagtattacttaacccagaagttaaggtggcttacggaattattagcaatggtaatttttttatcagtattgtgtaacatatcagatttattttatttaaagaattatttataccattaacagattcttatatatattaatgtggcaaaaatgtgcaggttaaatctattaaccaaattatttatattatattaagtaagaaaaaatgtgaaacaaatgtagagagaaaatactacattacaagtatacaaacctaaaactgtgagccattgtaaagtacaaggtaattaataagaaatgtagcacaacataattttccgtcttcttctcacaatttttgtggtggtggtattaccctatcttccaggcagttaagcaaagtttaggcttccagcctgacttcagttgatggattgtcaaaagaagggatctattatccctttattcttggaaccaccagtccctgccccaaacccttaaacccctagagagcactgcctcgtcctctagcctggggctcacacaacagtctgccactcaggctgctaggagattctccaatagcaggctcagcacctcaaactgcccaccacctctcctactgctcctctcccacccaccacccaaactcctcagtcctgtcatgtagcagagttccagtaactcaggaaaatggagaccaaggtcattccttaagttggtttcttggggccacagcacagagcatgccacctgggctcacttttgatagcaacagctcttagttattcccctaggtctcctgtgtctctctgtccctctgttcctactttcaacctacccccaagcctgatggaatgcaactggctaccctgggcttcatgacctcaaagtaggaacccttcgttctgggggtaggttcattttgtctctcttgtaatggtgggattgcctgcccagttccttcatgcagtcacatgaagtaatcttttgtgtagtttagttgacacatgtttataagttaaaagttgatgtggctagtatgtttaaaccattaatgtccattttttttgcaccaacctgtttttctactgttttttcctacacatttttgtttattcacagacagacagacatgtgtgtttgtatgctgggtgtgtctgtatgtgtgtatgtgttgatatgtaaattttttagcctttgcttttctgtcttcaggctgagtttgtgttgaccaagccttctttttggtattttgagctaattcagtttgtgcttccctcccattgtatactttacataagtagaccatgtaaagtatgtttgtgcccatgatttcactggttgctatggctttgatatgggtgctaggtgtagtagtttcagtccacgtgggtttttttcatctctcttagagttatatggttttgtgtaagcagttaatgtaaatattgttagcattacaggtcatacagtgctgtaacatttttttaaatgttgcacctactttacaattaaaaaattggtcactcgcacttcaattttgcccatagagccatttctttgtctttgtattgaagccaattcatttttttaaatgaaggctaggccttctatgttaccaaaatttttattccctaaaataaactttttaagaaacaaatccaagaatggaaacagatgaaaaattttttcttctttaaagaacataatagttcctgctggaaaaggaaatctaattttattttgtgtcccttaacagtcctaggaagcacaaggagaataaactaaacctctaagaaggttttaaaaattatttcaaatgagtgaaaattaactgagcagcttttgtgtgatttgtcttgtttgtagcattaaaagcaaaccagggtttttatttatttaaaggaacatttttggcttgtacttttcagtgccattatgaatgaaaatgttttaagaacattcatcccttgtgatatcatgggccacttttagtcttttatttggaccctgactttgagtttttgctatgcctgttttttaagtaaacacagccttcttatttgaacgtaacactgcagaattgcaggaagagaaaagggcagttagttatttcactttctgtaagttttaggaagattcttatatcctacgaggtgactcatgtttcattttagaccatgatagcacattgttgttaactttggtaatcttccatgcagtttgcagtgttcccttgcaagtcacaagcatatatgcattaagattttaaaatctaagatgcttaagatgttggtggcattgctctttctgaaaagaaagacaaaatactagaccttgctgaaaattggatatcttatttactttgcccatttatgcccgaatggtgtaatgcaagactcaagacttttcaatgtagtatatcaaatgagttgtgcattgattcatttgggggacatgaacaaaaattatcaaccagccagaactgtaatatttaattagttcatctttttctttcattcactctatcacatttgcattagccaaagagataagaacattagtaattcatatgtgtaaacaacccagaagtgaatattaaatcagtgagccaaaaagcaataaacaactcgagcatgggaaatcctgctaacagtggggagtctgatatagaaaaaatatataaaaagcattatcttcaaatatgaaagattaatttgtatctactgtaaatatgtattaccagccttatctgcatttatacacactgtgtgtgtacctcagtgaccttttataaaccggaaaaatggttgatttaataatttgttatgtaaatacaaagttgtctataaattggaaaatttgatgccagatggcttcataatatacaaatgtgttttgtaacatcatgcctttatggattaagtataaatacactggattgtctatgta

SEQ ID NO: 52 - DNA, 115531 bp, Homo sapiens; identical to SEQ ID NO: 6
  source 1..115531: mol_type = genomic DNA

SEQ ID NO: 53 - DNA, 31720 bp, Homo sapiens
  source 1..31720: mol_type = genomic DNA
ggagacagcggcgtggcggcggcggtggcggtagcgacggcacgccgtagggcggtcagaaggtttccggttccggtgtaacgttcgggctccgtctcaggggctgaagtttgtgaggtgagtagtggccccgggcccacagagggtaattccagtccgcgccactgtggccggggactcagtccaaggggaggaccgaagcgggagggttcagcgggaaggagtgtgaaaggagtacctggtttggtgggagaagaggttggaatgagattgttgagaggaaaagggcgggggcgggaaggagaccgggttgggagaccagctctggggtgaggagtttaggtagaacaaggtagagtaagagactggttggagtgacggagagagtaaaaatgaagattagcgggggagtggggggctgcagagggaaactcaggttgtagcaaacaagagcacggagtaaggaattccttctgaagactggatttggattctgctgcctgctcattgagaggagagatcattgtacctcgctttccttccgcacccccactacccccgcacctcgcagttattgttgagcatttgattagtgacaaggctaattaccgtttgaaacttttttatccattggctgtttagtttgcacgtcatcttatggaggtaacagtggcacctcatttattgctttgggctttcaaattgcttatactttctagcctatcattcaattctagtggaatataagacccgttaaggtgaggactcttgttagttttgctcactgttttatgtatccaccgcacctagtacattgcttgacacttagtagttactcaataaatatttattgaatgaattaggatgtaaatatggcagtactcattttgtaagatggtaaactgtggctccaaagaattacttaacttgcccaagggcttgtaaatggtggggctcagtgtcccaactgtttctgtgtgaactcttgttttcactttctatggcatctggatatgccgcttttgtgcaatacatgtgtaatatgtagaaattggtacgctgtatgtctactcattgtggggtaatagaaccaccatagaattactcacgtaacttgtcactgaggcagaaaatctttcagtcttagtttcatcacttcaatctactagcttcctttggatataccaaaagtgagtctatttggcatcaagtcttatagactctagtatagaggctaaacttaccaagaatgtagaagttaatcagactggattttttggagaaaagatgtcttaaaacatcttgaaagatgattcccagatctttgataagtggcactgctgggaatagctgagcttggaaattgaggtcagtcaatttattgactcccatttagacaccttttttttttttccccgggacggagtcttgctctgtcgcccaggctggagtgcagtggtgcgatctcggctcactgcaacctccgccttccatgttcaagggattctcctgtctcagcctccagagtagctgggattacaggtgcaggtcaccacgcccagctaatatttgtatttttaatagggatgcggtttcaccatgttggccaggctggtctcgaactcctgacgtcagataatccacccgccttggcctcccaaagtgttgggattacaggcgtgagccaccgcacctggcttttttttttttttttttttttttggagacacagtttcactctgtcgctcaggctggagtgcacatgattttggctcaccgcaacctccgcctcctgggttcaagtgattttcctgcctctgcctcataagtagctgggattacaggtgcccaccacctcacctggctaatttttgtatttttagtagagacaggtgcagtgggtcacgcctgtaatcccagaactttcggaggtcaaggtgggcagatcacttgaggtaaggcattacctggccgatatggtgaaaccgtgtctttattaaaactacgaaattggccaggcgtggtggtgcatgcctgtagtcccagctacttgggaggctgaggcaggagaatcaagtgaacccaggagatggaggttgcagtgaaccaagattacgccactgcactccagcctgggcgacggagtgagactctgtctcaaaataaaaatgagggtattcttttctgagctgaaggatcatcaagtcagctgatggagaccctgtagattgaacatgataattacctgtatgcagaattcccactgggatgaatatgaccacagagaaatgtgacagaacattctttttttttttttttgagacggagtcttactctgttgcccaggctggagtgcagtggcgcgatcttggctcactgcaacctctgctgcctgggttcaagtgattctcttgtctcagcctcccgagtagctgggattacaggcgcctgccaccatgcccagctaaatttttttgtagtttttagtagagatggggtttcaccatcttggccaggctggtcttgaactcctgacctcgtgatccacctgcctcagcctcccaaagtgctgggattacaggcgtgagccaccgcgcccggccagaacattcttaaagatcatgagatttaatttaatatctaagatgactgacctggataaaccctcttttacttgcataccttaaaagaagggaatcctacataagtcagggttgggttagggaatgcctgcctggaagtaggaagaatggaaaagctggcctctggatgggcttttttagttctgttttagtgttactaggtttgcaagtccttgttgatatgacaggatcaagaaagaagctagaactaatttctcagacttagcttattcacagagtttgtttattccgcagatttcattgatcaacttaagagttagaattaaaaatcaaatgggatctctttctgctttgagatatggttcttggggaaaatatttgccttcaaatgagttggaaaaacttgtctagggattgagaatagggctggggaatgcattcctgatgtactaaccatttccctggatcactttagtcttttttttttttgtagagagagtcttgctttgtcgcccaggctggagtgcagtggtgcgattttgacttgttgcaagctctacctccctggttattcccctgcctcagcctcccaagtagctgggattacaggcacatgccaccacgcccagctaatttttttgtatttttagtagaggcagggtttcaccatgttggccagactggtctcgaactcttgaccccaggcagtccatccaccttggcctcccaaagtgctgggattacaggcatgagccactgcacccagcccactttagtcttttcttattctctaacttgtctcttttttttttttaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccggtatgtacctttctgcatcttttatcttaacatatagggtgaccccaaacactgctttgaacttcctcaaaattctctctgttgggaacatctaaaaaaatggcaggccatattttattttcacctgtattatagtgaaaataggctaaataataatttgctttttctcttaattgcttattttttatgttatttatgatagattttaaatcttcgtttggctaccatactgagtcacctaagttagatttacttaggaagtatgcttaagtcagataggcatattcagattcagactgaacatctcaacatacaaaaatctttatgaaatacatgaaaaagcttgaaggaggtagattttgttaatggtaggcttctacaacttgctatttgggaaaggtgagggtggttattcatctcaaacttgatgttcaaggtaaacaggttgctctaactgcaccacttcccacgccaaaaaattataactattttcacctcacagggcaaggtcatttagtgtaagagagatgggaatcctacaaaaaacttaaaatttgtttcactcctgggaataaaattccagtgttggtacctgttataggcctagtattagactgtgtactcttacctttccaaccctaccaccgcctttcttcctgtcagatcatctgaaaccttttcttgatgattctactctccgatttgtggacaaactgtttgaggctgtggaggaaggccgaagctctaggcattccaagtctagcagtgacaggagcagaaaacgagagctaaaggtaggttacaatttactgtctaatgagctcaggactgttttgaatggtaacagagttgctgagcttaccagttcacacgttgatatcctctatttagagcagcaaatgttcaagagaggtacttagacattagagtaggagagatgaattagtgtcatcaccatctgaactacctctaagttcatgggttgaaatatccaaagaaataattggcagctttgtctttttttagataacaggagttttgattctcatgtttctccatatttcctttttttccttcttactgttacttataaactgattgctctaagattttatctttgatttatttgaggcctaataagttgttttagaatgtgactccactggtacctgagctgtacacctcattgttgcctctttgtagaggtttctctgcaatgcacttgtagatagaataccaaaaaataactattatttattatattcttgagagcttaccatttgctctatggcatattgctggtcctctgctgccatgagtgaaacacttggaggagttgtcagtacccccttaactactacactttttattctgtagttgccgactgatcctggcctctttcagtattagcagtatcaagtagcctatttttctactcatttcccagtatctctctttaggagaaaaaaaaaagttctgtgactcctatcaaaccttccaaagttcttctgataccttggctatcccattacttttcctgagggaaaagagtgaataagtaatgtctgcttggtcccctggccaggctatggaactaaaaaaaaaagcagagagatttgtgccctttgtgtttggagcattgtagggtggtcagagaaggagagatagtccttgccttaaaacaatttgtaatttgtcaggcagtgtggcatgtgcctgtaatcctagctacttgggaagctgaggcaagaggatctcttgagcccaggagttacaatttagaagaggcaggggtatcacaaaatatatattcacgtattataaaatctaagtagcagtttcatgtaaattttagggttggttatagaatttcagacctatgttgaattttgttatatttaaggtggaatgattgatccacagtatacacagatctgtacagtgaagattatgtcacgatagggcatacttctttttttttttcctttttttttttctaagggtgagtctcactctgtcgcccaggctggagtacagtagcgcaatcttgactcactgcaacttccacctcccaggttcaagtgattctcctgcctcagcctcctgagtagctgggattacaggcacatgccaccatgcctggctaatttttgtatttttagtagagacggggtttcatcatgttgatcaggttggtctcgaactcctgacctcaagatctgctcgcctcggcctcccaaagtgctggaattacaggcatgagccactgcgcctggccagtagggcatacttctgtatgagtgctgagggcatgctgtgaatgaagtgactacattgggtgggattaataaaaatggcttcttgaaggaggtgtctagatagccttgggatacgggtcccatttttggtccattcaggtccccaccccacacaatatattatgggagagtcctttttcttgaactgtaggagttccaggaagcgctcgcccctggccgaggatatgtccttgcaaaacacgagccctcctagtgaagaggggatgtcacccaaagcctaccaccggtgtgtacatttgctttttcccattgtcccttccagttggccactctcggtcctgttaaattcaccttgcaaattagtcatcatatttgagtttccattgtttgatgaaaacaaagtgttaatggggattactgaagaagaaagagaaagcccctgtcctggaagagcttagacttagttgggaaaactatactaacattgaaatacttaacacttggcaaacagaatatcaacaatgtaatttaacctaatatgaaccaagctcttacacgctaagagaatgtgaaacaaaagtttaatcagagtgggataggttataatgaggaaaacttcttggaggaggtgagttttaggcaggatttggaacaggggttgtggaaaagttgagagaaatcattataaatgtgagcagtagcatttgcaaagaccttgagatgggaacatttataagaacatgggaatgaaatttgtttgactggattaggagaatgttgaagttgggtgagatggagagtctagtagaccctgcttctggcaggtggctatttgcaaggttgtgtcatattcccctgggaatagccagaaaatgctggtaggggctaggataattcttcccttctccccacggggagggatacagcttttctttcatcttgggttcccttaggaggtgtttggtgatgactctgagatctctaaagaatcatcaggagtaaagaagcgacgaataccccgttttgaggaggtggaagaagagccagaggtgatccctgggcctccatcagagagccctggcatgctgactaagctccaggttagtgattagggactggaagcaaagtggttttgtgagttgaagaagcaaaaggtgcatgggtctgtatttattgtggaattttttttttttttttttttttgaggtggagttttgctcttgtcacccaggctggaatacagtggcgcgatctcagctcactgcaacctccgcctcccgggttcaagcaaatctcctgtctcagcctactgagtagctgggattagaggcacccaccaccaagcctggctaatttttgtatttttagtagagatggggtttcaccatgttggccaggctggtcttgaactcctgatgtcaggtgatgcactcaccttggcctctcagagtgctagaattacaggagcgagccactgcgcccggctaattttttgtatttcttttagtagagacagggtttcaccatgttgggcaggctggtcttcaacttctgacctcaggtcatctgcccaccttcgcctcccagagtgctgggattataggcgtgagccagcgtgcctcgccttattgtgatcttgatttgaattagtgtttagcatttggggtaaacttttttttttgagatagagtttcactctgttgcccatgctggagtgtagtggcgtgatctcagctcacggcaacctccacctcccaggttcaagcgattctcctgcctaagcctccggagtagctgggactacatgcgaacaccactacgcctggctaatttttgtatttttagtacagatggtattttgtcatgttggccaggctgctctggaactcctggcctcaagtgatctgccacctcagccgcccaaatggctgggattacaggtgtgagccaccatgccaggccagcatttgggaaaattttatttcctgctttatgttttagcgttctttgatttgaccaggagtattctaggtaagggtattgaaattgccatttactgtggcaagcaaagtgtgttatgtacattatttgcctaattacctatgtcgttgagtcattgagaaaattaaatgaaatgatcagaactcatcttaatgacagaggagactctccaaacataatgcaaagaagatataatccactgataaataattttaagttgactttatttttttttaacaggaagtatttgtgttttttcaattggcattgttaaataataccacataagtgtttcttttaccatttaatatttgaggggggtaatagaacatatacagaaatatgggtgggtggatttgcatatatgtgatatttacagaaggaaagaaatggattttttttgtgtgtgtgtgtgagatgttctctctgtcactcaggctggagcgcagtggtgcgatctcggttcactgcagcctctgcctcccaggttcaagtgattctcctgcctcagcctcctaagtagctgggattataggcatgtgccaccacgcacggctaatttttgtatttttagtagagacagggtttcaccatgttgaccaggctggtctggaactcctgacctcaagtgatctgcctaccttggcctcccaaattgctgggattataggcgtgagccaccgtacctagcctgtttttgtttttcaggcaaggtctcacttttttgtccaggctggagttcagtggcgagatcttggcttactgcaacctctgcctcccgggcttgagtgatcctcccaccttggcttcccaagtagctgggactacaggtcaccatgcctggctgatttttgtattttttttaaagattgagttccaccatgttgcccaggctggtcttgaactcctgggctgaaatgatcctcctgcctcagcctcccaaagtgctggacttacaggcgtgagctaccacgcccagccaattattttcttttttggggggtgggggatggagtcttgctctgtcacttaggctggagtacggtggcgcgttctcggctcactgcaacctctgcctcccgggttcacgccattctcctgcctcagcctcctgagtagctgggactacaggtatgtaccaccatgcccgactaattttttgtatttttagtagagatggggtttcaccatgttagccaggatggtcttgatctcctgacctcgtgatccacccgcctcggcctcccaaagtgctgggattacaggcatgagccaccgtgccaggcccaatgatgttttttatggagaatggggatggacgtattcacaacatatccttttgttatgtttctttcttttttttttttgagacggagtctcactctgtcgcccagagtggagtgtaatggcgctatctcggctcactgcaacctccgcctcccgggttcaagctattcttctgcctcagtcccttgagtagctgggattacaggcacgcgccaccacgcctagctaatttttttgtatgtttagtagagacggggtttcaccatgttggtcaggctggtctcgaactcctgacctcgtgatccgcccggctcggcctcccaaagtgctgggattacagacgtgagctgccaggcccagcctgtaatttttcattttattttattttattttttgagacggagtctcgctcttgcactgttgcctaggctggagtgcaatgccgtgatctcagctcactgcaacgtccgcctcctgggttccagcagttctcctgcctcagcctcctgagtagctgagattacagaacgtgcatcaccatgtccagctaatttttgtatttttagtagagatggggtttcaccctgttagccaggatggtctcgatctcctgacctcgtgatccacctgcctcagcctcccaaagtattgggattacaggcgtgagccaccacgcccagccctgtaatttttaatttttttattttctttctttctttacttatttagagatggagtctccccctgttgtccaggctggagtgcagtggcatgatcttggctcactgtaacctccaccttctggattcaagcgcttctcctgcctcagcctcctgagtagctggcattacaggcgcccaccaccacacccggctaatttttgtatttttactagagacggtgtttcaccatgttagccaggctggtcttcagctcctgacctcaagtgattcgcccacctcagcctctcaaagtgctgggattacaggcgtgagccaccatgcctgacccttccgtaatttttgaattttgaatatatcacctattcaagaaaaaatgttaaagacaaatgtttaaaaatatcttgaagcagtttaagaacaggtctgttttgcaaaatgtaagaggagttgtttggccataccctcaaagcttatcattctgaacttctttaggacagaaggggtttatagagactagggagcaggtctttgcaccatcgtctcttgtttcccaaactagtagttcaagtactaatatcatgattttttaaaaaaaattaagtataggctgggtgcggtggctcacacctgtaatcccagcactttgagaggccgaggtgggcggatcacgaggtcaggagatcgagaccatcctggctaacagggtgaaaccccatctctactaaaaatacaaaaaattagccgggcgtggtggtgggcgcctatagtcccagctactcgggatgctgaggcaggagaatggcatgaacccgggaggcagagcttgcagtgagccaagatcgcaccactgcactccagcctgagtgacagagcgagactccatctcaaaaaaaaaaaagaaaattaagtataatattttgtgtaggttctgttaggtttgcatgcattatttaagtggttaacactagacctgtaaggtaggtactgttttcttcccccttctagacacttaggaggtttagagactaagttccttatccaagataacaaaggcattaagtggcagagttaagattcaaactcaggtttctctgactccagagtctcaatcatcacactatattactacctaatatgctaatcttgctttaggaacatgggttgaaaaattccagtgctcacttatcttgactaaattttttgcactgtggtgcaggcagaatgtggtatagtcattcaaaacattttaagtgtctagacctgagagccttgtgggtttaaaaacctgaatgggagaagtaagaaggagaaattaacagtttttcaatttttttcctggagagcagatcaaacagatgatggaggcagcaacacgacaaatcgaggagaggaaaaaacagctgagcttcattagcccccctacacctcaggtattgtgtctagattactctgaacagaataatctttggcacagaatttcttgccatccactcaaaatgagagactagaagaggtgactacatgtttcacttcataatcatctgctacagtctaccatgatgtgtgtgtatatctgtgtgtatgtatgtgtgtttgtctgcctgtcttaattcctctgatttctttttctctatctcacagccaaagactccttcttcctcccaaccagaacgacttcctattggcaacactattcagccctcccaggctgccactttcatgaatgatgccattgagaaggcaaggaaagcagctgaactgcaagctcgaatccaagcccagctggcactgaagccaggactcatcggcaatgccaacatggtgggcctggctaatctccatgccatgggcattgctcccccgtgagtgtctatttcatggaataccttttcatttctgaagtttgagaagcaataaatacctttgaatgttactgatctggctgggcgcagtgcctcaggcctgtaatcgtagcactttgggaggctgaggtaggtggatcacctgaggtcaggagtcaggagttcgagaccagcctggccaatatggtgaaaacccatctctactaaaaatacaaaaattagccaggcgtggtggtgcatgcctgtaatcccagctactcgggaggctgaggcaggagaatcgcttgaacacaggaggcagaggttgcagtgagctgagatcgtgccactgcgtgggtgacagagggagactccggctcaaagaaaacaacaaacaaaatattactgatcctctttttccacagaacctagatcatttctcacagtttcatatttcttaggtgtgattgattaaccagttgaattttttctcgtcttccctgttggagggtttattatcttcttatgatttatataactgagattaaggttattcatctaatgttggagctaggagtatagccaggtttccttcctggtttcaaactcagatttatccattaaaccacattgtgtgagactagatctgaggttcctctgcaactggtcaaagatgttacattttttttagcatctacagttggtctggcatcccatgagtgacataagaattcagggataaggaaagataggattataaattcatataatttataaactcatttcatttggttgtcctgtatactgaaatatccactttgatatttttaatcaagatactattggcagggcgcggtggctcacacctgtaatcccagcactttgggaggccgagactggcagattgcttgagctcaggagttcaagaccagcctaggcaacatggcaaaaccccatctctctaaaatatacaaaaattagccaggcatggtagagcatgcgtgtagttccagctacttaggaggctgaggtgggagaatttctttgggcctgggaggttgaggttgcaatgagctgtgattgtgccactgtactttagcctgggcagcagagtgagaccatgtctcaaaaaaaaagatggtattgctcactgatgagattgttccctagaattattttattgtcctttttgttgttgttgttgttgagagggagtctcactctgtcacccaggctggagtgcagtgatctcggctccctgcaacctctgcctcccaggttcagtagctgggactacaagtgcccgtctaaattttgtattttttgtagagatggggtttcactgtgttgccaaggctggtcttgaactcctgggctcaagccatccacccgcctcagcctcccaaagtgctgggattacagtgtgagccaccacacccgtccatccaaataactcttatagagaaggcactgcagcctcaacttcctgggctcaagtgatcctcctcaacctcctgagtaggtgggaccacaggtatatgccaccgcacccagctaattttaaattttttgttgagatgcagtctccttgtgttggccagactggtctttaactcctgggctcaagtgatccctctgccttggcctcccaaaatgctgtggttccaggcttgagccaccacgcctggctttattttgttttttgcttgccttaatgttccatacaggatttatttctttgcgggctatttttcaggaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggtatctggcttagagtataacacagaatttggaaaaagttaagaagctgacaagaaaacattgttaaatctctgtgttctaggaaattagataaataggtcatttaaagcagcagtcctcaacctttttggcaccagggacttgtttcatggaagataatttttcccctggagtaaggatggtttcgtgatggttcaagcacatagcatttattgtgtactttattattattatttttttcgagatggagtgtcgctcttgttgcccaggctggagtgcaatggggcgatctcggcttgctgcaacctttgcctcccaggttcaagtgattctcctgcctcagcctcccgagtagctgggatcacaggcatgtgccaccacgcctggctaattttgtatttttggtggagacggggtttctccgtgttggtcaggctggtctcgaactcctgacctcaggtgatctgcccactttgtcctcccaaagtgctgggattacaggcgtgagccaccgcccccgccttttttttttttgggcggggagggggatggagtcttgcactgttacctgggctggagtgcagtggtacagtctcagctcactgcaacctctgcctcctgggttcaagcaattctcctgcctcagcctcctgagtagctgggactgcaggcatgcgccgccatgcctgacgaattttttgtatttttagtagagacagggtttcactatgttggcccggctggtcttaaactcctgaccttgtgatctgcctgccttgacctcccaaagtgctgggattataggcgtgagccactgtgctggcctatttctattattattttattgtaatatatgatgaaataattatataactcaccataatataaaatcactgggagccttgagcttgttttcctgctgaaatggtcccatttgggtgtgatgggagacagtgacagatcatcaggcattagattctcataaggaatgtgcaacatagccccctcacatgtacagttcacaatagggttcgcgctcctctgagaatctcatgccaccgatgatctgacaggaggtggagctcaggccataatgcaggtaatagggagcaatcgtaagtacagatgagactgttggcttgcctgctgctcacctcctgttgtgcagcccagttcctaaaagactgttgggttggggacccctgatttaaagcaatgaatactttgaaaaatgtgctggacaagatggctcaagcctgtaatcccagcgctttgggaggccgaggtgggtggatcacgaggtcaggagttcaagaccagcctgcccaacatggtgaaaccccgtctctactaaaagtacaaaaattaaccgagcgtggtggtgggtgcctgtaatcctagctacttgggaggctgagtcaggagaatcacttgaaactggaaggcagaggttgcagtgagctgagatcgcaccactgcactccagcatgggcaaaagagcgaaactccgtctcaaaaaatatatatatatatttattaatataatacataatttttttagcagattttacttcctaattcgtttctacataagtggaaatattatgaaattgagtttgaaaattctccacatacaactaagtggagggaaacaatttgaaacattctgagtgactaaggaaggcttgcctgtagttaaaatttaatgagacagtacacctggagagttgaattgattgtatattgaatgacctttgccgcctttttatcctctcaaagtgaggttttcataaaattccttttttttttttttttgagacggagtctcgctctgtcacccaggctgcagtgcagtggcacgatctcagctcactgaaagctccgccttccaggttcatgccattctcctgcctcagcctgctgagtagctgggactataggcgcccgccaccacgcccggctaatttttttgtatttttagtagagacggggtttcaccgtgttagccaggatggtctcgatctcctgacctcatgatcctcccgcctcggcctctcaaagtgctgggattacaggcgtgagccaccacacccggccataaaattctatttctgcgtatttactgcaggcatatactgtggagtgcagggaggggttgaaggtgagatctatgtatatgaactaaataaaggataaaataaagcagaacaactcctttctaagctttcagaaattatgaacttgttgcgttaggtgtaaagagttcaacggggaagtgttttaaaatttgggattcttggccgaggtgggcgaatcactaggtcaggagatcgagaccatcctggctaacatggtgaaaccacttctctactaaaaatacaaaaaaatgagccgggcgtggtgatgggcgcctgtagtcccagctactcgggaggctgagtcaggagaatggcgtgaacccgggaggtggagcttacactgcactgcactgcagcctgggtgacagagtgagactccgtctacaaaaaaaaaaaaaaatatttgggattctggccgggcacagtggctcatgcctgtaatcccatcactttgggaggccgaggcgggcagatcacctgaggtcgggagtttgagaccaggctgagcaacgtggagaaaccccatctctactaaaaatacaaaattagctgagggtggtggcacatgcctgtaatcccagctactgaggaggcttaggcaggagaatcgcttaaacctggaaggtagaggttgctgttagccaagaccatgccattgcactccagcctgggcaagaagaacgaaactccgtctcaaaaaaaaaaaaaaattgagattctacacattctgttttctatgactccaatttatctttctgtcttggattatcttgtttttaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatctgtgagtttgttttagtacctttttaaaaaaacagtttttaatcagctgagtttaagactcaagttaataccttttagtaaagctatggttttagtgggaaggatggtactcattcattaattaaaatttttaaatccaagagagataagtaactgtacacaaggtcctgttattttttttttttttttttttgagagggagtctcgctctgtcacccaggctggagtgcagtggcacgatctcagctcactgcaacctccacctcccgggttcaagagattctccttgaattctccttgaatctcagcccctcaagtagctgggactacaggtgtgtgccaccatgcccatctgctttttgtatttttgatagagacagggttttgccatgttggccaggctggtctcgaactcctgacctcaggtgatccgcccaccttagcctcccaaagtgctgggattacaggcgtgagccactgcacctggccaagctcctgcatttgtaagtgatgtatcatatatataggctgtttttagcttttggggttaatgtaggataaccagggacacaatctacaaaagcaaagtctagaattctttttgctctgttacacattgttgcctgtttttagcattattttccttaattacattcttttgctacgtattataggtgtttacatttcctaaagatctcattgtgatagagcaaggattattagttggtaggtgagataatagtaaatatagcatataaggctgggctcggtggctgacacctgttattccagcactttgggaggctgagggctgaaggattgcttgagcccaggagttaaagaccagcttgggcaatatggtgagacctcgtttctacaaagattaaaaaaaaaaaaaaagtagctgggcatggtggcttgtgcctgtagtcctggctacccaggaggctgatgtgagagaatcacttgagcccaggagggtctgtgctgcagtcagctatgatcatgaccactgcactctatcctggacaacagggtgaaactctgtctcaaaaaaaaaaaggatataagacacatttgaagagctttaaatatatctgctccatccattttttttttttttttcctgagacggagtttcgctcttgttgcccaggctggagtgcagtggagcaatcttggttcaccacagcctccgcctcctgggttcaagtgattctcctgcctcagcctcccaagtagctgagattataggcatgcaccaccacgcctggctaatttttggtgtttttagtagagacgaggtttctccatgttggtcaggctggtcccaaattcccgacctcaggtgatccacccgcctcagcctcccaaagggctgggattacaggcatgagccaccacgcctggcgttttttttttttttttttttttttaagacagagtctcactctgttgcacaatctcggctcgctgcaacctctgtctcctgggttgaagcagttcttctagctcagcctcataagtatccgggactacaggcaaataccaccacacctggccagtttttatatttttagtagacaagagtttcactatttggccaaactggtctcaaactcctgacctcaggtgatccacctgccttcatctcccaaagtgctgggattataggcataagccacatcacctggccctgctccatcattctgatacatggctttagtagattttgtcttagcctttcgttgccccttctttgtcagccactgttccagggacttattgtcactaatgagagaacatagcgtctgtcagctgtggcatggtagaaaaaaggttgagaatgattgctgtggagagtgtgttcaaccatagagggactcagttttctcatcatgaaaattatgtgtaatttaactatatattttaggtacctaaatgctattttaggtatatcaagcacaagaacccattatagagagtgggttttttcattgtatttctgagactcctctcttagaatcatctctacccgcatatcgtgttttcttttcttcctacaattttagtacagaggaaaatcccaagagagaagattattttggaatcacaaatcttgttgaacatccagcccagctcaatcctccaggtaatgtatagattcctgaatcaagtctctagagcagcattacccattggaaatttatacagtgaggaacatgttctgtatctatgctgttcaatacaatagccactacccatgtgtaattcttttttttaattcagtttttttcctgacaatagtttgttgtttgaccagtgaacatacattttaagtgcatattcctgtgcttagaatttcatgagacagccaagcatggtggctcatgcctctaatccaaacactttcggaggccaaggcaggaggattgcttgaggccaagaattcaagaccagtctgggcaacacagtgagacccatctcaaggaaaaaaaatttggctgggtatggtggcttatgcctgtaatcactgcactttgggaggctgaggtgggcagattgcttgagctcaggagttcgagatctaggcaacatggcaaaaccccatctctacaaaaaataaaaaatcagccgggcatggtggtgtgcatctgtagtcccagcctcttgggaggctgaggtgtggaggatggcttgagcctgggaggtggaagttgcagtgagctgagatggtgctgctgcactccagcctggatgatactgccagaccttgtctcaaaaaaaaaaaaaaaaaaaaaagaagaaagaaagaaagaaaaaaacccaaaatttcatgaagctttacatttacagttccctggttgttcctaggaaagagccctcagcttgctccttttatagaaccacatgttgttgtggcatccacagctaaatgcaaatgcaagagccaaactcttgggttggtgtgttattagatgcgatatgctccactacccactgtgagggatgctaattccaaagggctttttgttagtttcccaaagttgaaactgggaaacaaagttgcttctattttttttttttttttttttttgaggaggagtttcgctcttgtggtccaggctgcagtgcaacggcatgatctcagctcaccacaacctctgcctcctgggttcaagcaattctcctgcctcagcctcctgagtagctgggattacaggcatgtgccaccacgcccagctaattttgtatttttagtagagacagggtttcaccatgtttggtcaggctggtcttgaactcctgacctcaggtgatctgccagccttggcctcccaaagtgctgggattataggtgtgagccaccgcgcccggccttttttttttttttgagttggagtttcgcttttgtcacccaggctggagtgcaatggcactatctccgttcactgcaactttcacccccctgggttgaagctattctccggccttagcctccggagtagcttggattataggtgcctgccaccacacctggctagtttttgaacttttagtagagacagggttttgccatgttggtcatgcttgtcttgaactcctgacctcaagtgatctgcccacctaggcttcccaaagtgctgggtttaccggcgtgagccaccgcacctggccctaattttgttttctacatttgccaggtatcattgaatgagggggtttaacagcttaaaggaaaacaactaagaacactacttaagaaagataagaggccaggcgaggtggctcatgcctgtaatcccagcactttgggaggccgaggcgggcagatcacgaggtcaagaaatcaacaccatcctggctaacaaggtgaaaccccgtctctactaaaaatacaaaaattagccagacgtggtggcgggtgcctgtagtcccagctactcaggaggctgaggcaggagaatggtgtgaacccaggaggcagagcttgcagtgagctgagattgcgccactgcactccagcctgggcagcagagcgagactccgtctcaacaaaaggaaagataagaatgttttttaaaaacatagccatattgccgggcaccaggcctgaactgattttaatcttactgatcccttattaacgagttttcttcattttctatttaaagtttatacacacacacacacacacacatgttttttgaaatggagtctcgctgtgttgccaggctagagtgcagtggcaagtggcacaatctcggctcactgcaacctccacctcccggattcaagtgattctcctgcctcagcctcccgagtagctgggactacaggtgcgtgccaccacgcccagctaatttttgtatttttagtggagtcagggtttcaccatgttggccaggctggtctcgatctcttgacctcgtgatctgcccacccgtgcctcccaaagtgctgggattacaggtgtgatccaccgcacctggcctcaatatattttttacataaaatgtttataatagagttgggtctcacttggttgtccaggctggtctcgaactcttgggctcacgccatcctcccaccttggcctatcaaagtgctagaattacaggcataagccactgtgtccagcctaaagtttcttttaatgatattgatatttacctaggtttctttaatatttttattgctgtccgggcctggtggctcatgcctggccaacatggtgaaaccccatctctactaaaaatacaaacattagccaggcatggtggcgtgtgcctgtaatcctagctactcgggaggctgaggcaggagaattacttgaacccaggaggcagaggctacagtgagctgagatcgtgccattgcactccaacctgggtgacagagtgagagagagaaaaaaaaaaaatatatatatatatatatgtattcttactgctttggtatactaatatctctgcctgacagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaaggtgcatttctcagtggcctcttctgttaaaaagagtggcaagtttatgtctttaatcctggaggaactttaacatctctgtgtttgagtgatttctgtttctaagaattattcttggggtcctttttctccaagttttctaccatcttttcatattaagataggtcaacacattcattatagaggccatttatggcttatttttaagcatactgatcatacaacactctggttttcctggaagaatacaggtcttgaaattcatggagatagtagttgcagtatttgcgtagactttttatgtacataattcttaatgttttaatttttacaatgaaagtacaggataaaaaacttgaccctgtagttacattctcgttcagcagtattttgactgagcactattatttataagctctttcactagatgctgtgatcagtgtgaaaaatatgaaaggaattaagttccacgtccttcataaattttcagataatgtaaatgcataccaatcttcaacttaattgtgtgaacttctgcaaatgctgaagtgattggatgggattttcaagataggagttattggaggaagtgagtttagagcagagatttgaaataggtaaataatatgaattggtatggaagaaataacaagttactccagctggagaagtgacttcaaagactgattgttgtcctctcttcactgcagtgagaatttctaatttgatgcgagtattaggaacagaagctgttcaagaccccacgaaggtagaagcccacgtcagagctcagatggcaaaaagacagaagtaagtgccatgggattgggtggaaacctcgggcaagtacctttcccaaactcttctggggggtccatatttggagggaggggagagttctccgttgctctctctttccctcagccctgcctctgatcttcaatgcctttctcacttgtggatgtccttcctgtcacgacagagcgcatgaagaggccaacgctgcccgaaaactcacagcagaacagagaaaggtcaagaaaattaaaaagcttaaagaagacatttcacagggggtacacatatctgtatataggtaggtgtccatactgggccaaacttccccttagaattactaaaacattttccaagtgcttgaggcagaatcattgtggcctaaaagcatacctaacaccagttcctactctcttttaatgaccctagtgtggatcaagagctagtaaatcttgtaaaatagcgagagttaatgacttatgtttatggttacccagttcttccctctcaagtcttctttttttttttaccagaatattagttctgaacaagtcaatatacttgttcaggccaagatgtgaactaaagattgtatgtcctttgagaactataaaatatcatcctatttcttttttttttcatctttttttttttaaatggtctgagtttgcttccaacatccatggaagcattacaaattttctttcctccgtagtcatatccttaccctgatgtattgctgtgtttcatcctcactccaaaatgcattttatatgttgtaaatatttttctacctttgtgttgatttaatgtttttattcttttatgttgagtacatgtgtatcttctatttttaaaatgtgcttatttctattaactagttctttattataaaagtggtacattatcacaaaaatagtgaatgcttattaagatttaaaaaattgtctgacaacacagaagaatacttactcaaaatgtctcctttctattctctgatcccttagaaccactctctttaggtaattgctattaacagtttttcacatatcctcctagaaaattttcatgcctatatagtgatcctatatatatattttatttatttatttatttattttgagacggagtttcagtcttgttgcccaggcaggagtgcaatggcgcgatctcagcgcactgcaacctctgcctcccaagttcaagcaattctcctgcctcagcctcctgagtagctaggattacaggcacgcacccccacgcccggctaatttttgtatttttagtagagatggggtttcaccatgttggccaggctggtcttaaactcctgacctcgtgatctgcccactttggcctcccaaagtgctgggattacaggcatgagccaccgcacccagccaagtaatcctatattataagagtctaagggtctagaggacaaaaagtctgtaggtctttacattgtcaagaacaatgagattgtaagtatttttggatgatagtaaatacctctccctgactcttagagtaaactttggttagtaatgtaatggttaatgtaaagtgctagactttgaagaaatgtaagagtgtggaaatatttctagactcatcaactctaccttttaagcattcatctatttgtttactccagaggcctttgtttatagagaggaaaccattttggattcatctttttacttgccactccattcaggcagctgctgatgctaaaatggaagacataactaaactttcccttctccagagttcgaaatttgagcaacccagccaagaagttcaagattgaagccaatgctgggcaactgtacctgacaggggtggtggtactgcacaaggatgtcaacgtggtagtagtggaagggggtgagtctgaaaaacttgagggagactgtccccagacaaccctaggcttagagtgattagcattgtggggagaaaggagaaaaagatcgtattttagtgccatacctgatataatatgctaggtctctgcttctgtgttttttggagtagaaggccctaagatgtggttcctgagattgcttcaactaccacattaatgtctgagctcagaggttctttctaccccatcatcttccacagttctggcaaaattattcttctctgtttccaggccccaaggcccagaagaaatttaagcgtcttatgctgcatcggataaagtgggatgaacagacatctaacacaaagggagatggtgaatgggggttagaggggattaagggggagagctatgggaggtggggatggtgcatctgtccgttcatcttatttcctccctgtgacactcttgataacactagatagtgttcaggaattttagaaagacccgtttagactttgagcctcctagacattcatacaatatttactacatgattatatgcatgaatggtaaagctatttttttgcctatcatttaaggcttttctaccagctggtttctgtgtctgtcctggatctgagtaccggttacatgaatttattcagtatttgaaaattcagcaagcagctaggcatggtggctcatgcctgtaatcctagcactttgggaggctgaggcgggcagattgcctgaggccaggagttcgagaccagcctgggcaaacaacgtggtgaaaccccatatctacaaaaagtacaaaaattagctggatgtggtggcacacacctgtattcccagctactcaggaagctgaggtgggaggatcacttgagcttggggaggtcgaggctgcagtaagctgtgatcgtgccactgcaatccagcctgggtgacagaatgagaccctgtctcaaaaaaaagaaaaagcaaatctagtaagctatacattcatgtgtacagtgtctatattatattattatttgatttttttttttttaaggattgaagccaaaaagatcttcaggtcaaaaaagctctgctttgatcaaactatttcttttgtctgatatatatatatacacacatacacatacatacacacacacacacatacatacacacatgtacacacacatacacatacacacaatacacacacatacatgtacatgtacatactcacacatatgctcttcaacttaatgatggggttagttccaataaacctgagataaattgaaaatattgttaagtcaaaaatgcatttaaggccaggcacggtggctcacacttataatctgagcactttgggaggccgaggcgagcagatcatttgaggtcaggagttcgtaacagcctggccaacatggtgaaaccccgtctctactgaaaacacaaaaattcggggcgtggtggtggacctctgtaatcccagctactcgggaggctgaggcaggagaatcgcttgaacctggcaggcggaggttgcagtaagctgtgatcgcaccactgcactgcagcctaagcgacagagcaagactccatctcaaaaaaaaaaaaatgcatttaatacatctgacctacaggacatcataacagcctagccttccttatactttctcagaatacttagattagcctacagttgggcaaaatcatctaacacaaagcctatttttatctcatgtaagagtattttactgcatattgctagcccaggaaaatctcaaaatttaaaatttgaagtacattttctactaaatatttatcactttcacactatactcaaggcaaaaaattgtaagtcaaggactgtctgtctatatttgaaggccagacattcttctggccatcatactcccattagtgttcattcttctcatctttgaacacctggattagcatttaaaatctgcagagaggcctggtgtgatggcttatgcctgtaatcccagcactttgggaggccgaggcgggtggatcacctgaggtcaggagtttgagaccagcctgacatggtgaaaccccgtctctactaaaaaatacaaaaatgagctgggcgtggcagcgtgcgcctgtaatcccagctactcgggaggcctaggcaggagaatcacttgaacccaggaagcggttgcagtgagctgagatcataccacttcactccagcctgagtgacagagcaagactccgtctcaaaaaaataaaaatataaataaaatctgcagagagttcatcttaagatacctgagaataaaaaatattttgttctacacgtgcatttttttttttttttttttgagatggagtctttgctcttttgcccaggctggagtgcagtggcaccatcttggctcactgcagcctccgcctcccaggttcaagtgattctcctgcctcggcctcctgataagctcggattacaggcacctgccaccacacctggctaatttttgtatttttagtagagatgaggtttcgccatgttggctaggctggtctcaaactcttgacctcaggtgatccactcacctcagcctcccaaagcgctaggattacaggcgtgagccaccacgctggccgataattttgatttggtatatctgccctcctcctccattgggtgaaagttttttgagagtaatatatgatgttgacatatgaagcctgcctcccaaagtgcctaggacaagtttttattcttgactgcttgtcttttatttccttattcccagtacctggtggagctcttgattcataacaagtgctatgtaaatgctaattgtatcaattaatattactgcctacttggagcttcaagtctaatttggggaaaataaagagcaacagaaaagagaacacttggtccaacacataaaaagggtgataatattttagagagtttgggtagacttgaatattatttgtttagaacctgaatctcaagtctaagtctgtaacaagatttctcttccagatgatgaggagtctgatgaggaagctgtgaagaaaaccaacaaatgtgtactagtctgggaggtaggtgatcctttgtaaaacattgtaaaactttagccaactcctgaatatttatactatttgagtggagcaatggaatgtaagatgtaatcagtgaataatgttttaaataatttatgtttctttttggaatccatttttaaatggttggcagtaaattcttcctgatcatctgtttaattaaattcgtgagtatttagtatatgctatctggggaagtgcgtggacagtgctgctggtagcaggaatacaaattctctaccgaaaattatttatttcacagtcatgaatatgagacttggaaacgggaatgaattgttgttggatttacctttggatatagtgaaggaagtactagacttaagaatataaagttaggaggctgggcagtgctgcttattagctgtgcaatctgggcaagacacttaatgtcaaattctgttgccttagctattgttctctatattgtcaagtttttgagaatgaaattagataattatgtgatagtgcttcataaaatgtgactgaatcactcttcaagtggaatattttttatggttatctagttctttaacccctgaagccttcttagagaaccagtattaaaaccagtattaatgttttcatgtttgcttttaggtatagtacatgtatatctttttttgggggcgggggggcggggggcggtatggagtttcgctcttgttgctcttgttgcccaggctggagtgcgatggcgtgatctcggctcaccgcaacctctacctcccaggttcaaacgattctcctgcctcagcctcccaagtagctgggattacaggtgcacgccaccatgcccgactaatttttgtatttatagtagagacagggtttctccatgttggtcaggctggtcttgaactcccaacctcaggtgatccgcctgcctcggcctcccaaagtgctgggattacaggcatgagccactgtgcccagcccctccatttctttttttttttttttgagagagttttgcccttgttacccaggctggagtgcaatggtgcaatctcagctcaccgcaaccaccgcctcctgggttcaagtgattctcctgcctcggcctcccgagtagctggaattacaggcatgagccaccacgcctggctaattttgtatttttagtagagacggggtttcgccatattggtcaagctggtctcgaactcctgacctgaggtccgactgccttggcctcccaaagtgctgggattacaggcatgagtcactgcgcccggccatatatcttctatttttaaaatgtgcttatttctagtatatgtgctgctgaagcgagcagtaaaatgtgcttatttctattaatgaattctttattataaaagtggtacattattacaaaagtagtaaatgtttattaagattagaaacaaattctaattatacagaagagtacttactgagacccagcacagtggctcacgcctataatcccagcactttgggaggatgaggtggttggatcacttgagctcaggagttcaagaccagcctgggcaatatggcgaaaccccgtctctacaaaaaatacaaaaattagcctggcctggtggcgtctgcctgtagtcccagctacttgagaggctgaggtgggaagattgcttcagctttggagtttgaagctgcagtgagctgtgactatgccactgcactccagcctgggcaccagagtgaaaccctgtcttaaaaaaaaaaaagaaaaagtctcaggccaggtgcagtggctcatgcctatactcccaacactttgggaggctgaggtgggcggattacgaggtcaggaattcgagactaacctggccaacatggtgaaacccagtctctactaaaaatacaaaaattagtggggcgtggtggccagtgcctataatcccagctacttgggaggctgaggcaggagaatcgcttgaatctgggaagcggaggttgcagtgagccgagatcgcaccattgcactccagcctgggtgacagtgcgagactgtgtctcaaaacaaaagtctcttcctattcgctgatctcttcagaccagtctttataggtaattgctattaatagtttttcttctgaaggagcaatcaaaaaataaaaattaaaaaaaaaggttttcatgtatcctgccttatcccagattcttcaatttatgcatacaaattagatgataataaccatagtatttgttctctgttttataagttcccacctgcatatttgttatctttttttaatcaacttttttttttagagatagggtcttgctctattgctcaggctggtgtgcagtggcgcagtcatagctcgctacagccttgaactcctagggacaagcaatcctccagtctcagcttctcaagtatctgagacctcaggtccacaccactgtgcctggctaattttttttttttttttttttttttttagaaatggatctcactatgttgcctaggcttgtcttgaactcttagccttgagtgatcctcccacctcagcctcccaaagtgctgggattataggcatgagctactgtgcccagccctaccttcacatatctcagcaccctcatctttcaattttcttctatttatctctgaagagtacttactgaaaaagtcccggcttcttagagaaccagtattaatgttgtaggaatttagttttcaggaattgtctctcatgttcagaaataagccaagttctgctccagcctccttattggagtctactccctgaacgcctcttgaggtattgctttatgactgccattgctgctggtaactttggcaagaatgccattctgcccagtactgtctttttctgttgtaattctctgctggtacctgctcttcttctgttccccgcccccagttgttctttgttgctgggccccaaagcctcctgcttatataaatagtttctggggcctttttgaaggctcagatttagtccttaaggcctggtaggagataagtttatctcattccaccttccatagttcttcctgacttgctgttccacccaggcaccagagcaaataattcctcacttcatttcaaaaaactaaaagccttatgcatatgaattcgtaaaatctcatacaaatatccaaggaggccgggcgcggtggctcacgcctataatcccagcactttgggaggctgaggcgggaggatcacgaggtcaggagatcgagaccatcctggctaacacggtgaaaccccgtctctactagaaatacaaaaaatcagctgggcgtggtagcgggcgcctgtagtcccagctactccagaggctgaggcaggagaatggtgtgaacccgggaggcggagcttgcagtgagccgagatcgtgccactgcactccagcctgggcgacagagcgagactctgtctcagaaaaacacaaatatccaaggaaatggaggtcacaatttttttttaaccataaaatcacgttcagctgggcacatgtctcacaaatgttactaggtcttcttataaaagaatattatctgatttaaataagaaattgaagtgtttttattatatatctcttttctagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaa

SEQ ID NO: 54 - DNA, 16310 bp, Homo sapiens
  source 1..16310: mol_type = genomic DNA
tagtttcctgtttccggcttcgcttcggcccacccccacgtccaccccgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccctttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggtgagtgtgatggggaccacggggagcgggaggctgggctcctgggtctgggagaagaagtgtgtgaggaaaaaggcgggtctttacagcttggtttttgtttttttgttgtttgtttgttttgagacggagtctcgttctgttgcccaggttggagagcagtggcgcgatctcggctcattgcaacctccgtctcccgggttcaaacgattcttctgcctcagcctccagagtagctgggattacaggcgcccgccaccacccctgactaatttttgtatttttagtagagacggggtttccccatgttggtcaggctggtctcgaactcctgatctcgtgatccgcccgcctcggcctcccaaagtgctgtgattacaggcatgatccaccgcgcctggccagttgtttgtttgttttgtctgagacggagtttcgctcttgttgcccaggctggagtgcagtggcgcgatctcggttcactgcaacctccgcctcccggattcaagcgattctcctgcctcagcctcccgagtagctgggattacaggcgcgcaccaccacgcccggctagttttttgtatttttagtagagacggggtttcactatgttggccaggctggtctccaactcctgacctcagatgatccacccgcctgggcctcccaaagtgctgggattacaggcatgagccaccgctcccggccttttacagcctgtttacccaaaagtcttaatatgcgcctaccatggtgtggccctggggatgtggaaggagcaaaaattgttcgctaccctcttagagctttggttgatgcctggcagacaggctttatcaaataattacttcattaatcacaaatgtgtgaagtgccttactgtagacacgcagagcgtgcgggacacgttatcacaaagcaacctcctgtagtctagagtggggcgtgtgggtcagggaggtggaacgtgagagctgaaggctgaggagatgctgggctactaagaagtgaggagagccagacgccatggctcactcctgtaatcccagcactttgggtggcccaggcgaaaggatcgcttgagcccaggagtttgagaccagcctgagcaacacagtgagaccctgtctctacagaaaaatttaaaaattagccgggcgtgctggtgcgtgcctgtcatctcagctatcgggaggctgaggcgggagaatcgcttgagcccaggtgatcgaggctgccgtgagctatgatggcgccactgcactgcagcctaggtgacagagcaagacatggtctcaaaaaaaagaaaagaaaagaaaaaacaaagtgaaggaaagggccactttagttacaagggactcctgtacaaagacctggaggcgggaagagaccgataatgtaaccaactcaagtttctgctactcagaggcagaggaagtggggggtggtgaaagtaaagcagctttactgatcaaatgctcgcagatgagaaatggccaagctaatgtctttagaagaccatttcaagctttaggctggggagaggggcttaaaaaggggaactttgaatgggaggcatacaggagtggtgctgggtacaaggtatgtgtgtcttgctccgaaggctgtcttgagtcacgggccacctggagcatgggctggtgtcaagtcaacaatggccacgttgtagattgatcgccttgaggtgatctctggagttttgcagctgggtttccatacctagtttgtttcaagattagcccctgcggcgaggcgcggtggcttacgcctgtaatcccaacagtttgggaggccaaggtgggtcgctcacttgaggtcaagagttcaagaccagcctggcttacatagtgaaaccttgactctacaaaaaaaaaaaaaaaaaattagctgggcatggtggcaggtgcctgtagtcccagctactcaggaggctgaggcaggagaatcgcttgaacccaggaggtggaggttgcaagtgagccaagactgcgccactgcactccaacctgggtgtcagagccagactccatctttaaaaaataaataaataaagattagcccctggaacttctaagtaagcacatagataagccagcagtgcaagacagtatctagtgggaaaggagggaaacaaagaatttcaaagtatgttttcaaggctaaaggcaagaaaggaataagaaagtttgcaaatgcatttggaatctacaccacttggttccagtaagtcttagcaaggtggcggtcataggggtgtgctgcgtcttgcacaggtcggagctggagactcgccagtgaacaaaacaaactaaagcacctgttgtcgtggagcctgcatgctagtggggttgataaagaaggaccagggtcttctgggggagaatcatcgctcagtaataaggagggactttgtcggggcaagtttttagggaacgctgctgtccctccccaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatggtaagaggacaagaggtgttcctagcagggggctctagacagaatctcccagaagggggtgatacaggcttctttttgaagagtgctggattctgactgtcttctcctttcctacagtttgctgagattatgatgaagattgaggagtatatcagcaagcaagccaaagcttcagaaggtgcttcctcccactctgtgcccctccccatctcctgtctctcctgccaggccccctggctccctggctgcttgtggctgggtatatctccttctcagccttttccagagccttcttttttttttgtttcaccccaacccgttcccttttccactaaatatatattgcattgtaaagctcatgcttcttaagtccttcctgtgtgctgagcttactgatcatgataggactcagcttgaggtttcccagacttcactgattcacatgaccggttacagggtttttgccacatctataagccgcttatcctattatttgcttaacatattctttgagtctaggactttttttcttaaatttatctgagaaggaagcaaattgctaccatgaatggaaaactggtatcatttggcaaagacaaagtcactgtataaaaatagatatataattatttaggaaccacctaaggccgggcgccgtggctcacgcctgtaatcccagcactttgggaggcggaggcaggtggatcatgagttcaggagatcgagaccatcctggctaacacggtgacaccccgtctctactaaaaatacaaaaaattagccaggcgtggtggcgggtgcctgtagtcccagctactcaggaggctgaggcgggagaatggcgtgaacctgggaggcggagcttgcagtgagccgagatcgtgccactgcactccagcctgggcgacagagcaagactccgtctcaaaaaaaaaaaaaataacctaaaaccttttctcatgcccaaattgagagaacactagcttatctcatgagtgctcagactcactcttaagagggcagtcctgttaccattcctattcttttttttttttccttgagatagagtctccctctgtcgcccaggctggagtgcagtgatgtgttcttggctcattgcaacctccacctcccgggttcaagcgattctcctccctcagccttatgtatagctgggattacaggtatgcaacaccatgcctggctattttgtattttttagtagagatggggtttcaccatgttgaccaggctagtctcgaactcctgacctcaagtaatccgcccacctcggcctcccaaagtgctgggattacaggcatgagccactacgcccagccttcccattcttcttgaatggaatttgttgatgacaggaagccataggaggtttctggggaaagaagtgtagtgagagggcagagtttcgggagactcactgcttgctttctttaacgtttacctgggcacccagttgaatcgcccaggtctttgctctcaaagtactcaaggtctagtggaagaggcaggccaggttccagacagctatcagtggtggtaccaagctggggacaccggagccacaggagggactggctgaccctgccccaggtgtcaggaagaatcgatagctgaattggactgtagagcatgaatgcatgtgccaggcaaagaaagggagaagggggcccagggaaagacagcggcaggcccggggcctcagatatccggagagagaatcctgcagagttccagatgccaggccaaggaatttctccctccagagggttatgggacacagaaagtgacatttcctgatgtcaggccaggctcagggatggagtcagaccccgtcacacccggtgtctggttgaggaggcagaggtgaaacatctcacaagctgtggcagtccctgtttactggaggtgcacaagtgctgcgggtacacagaggaggcgtctgatccttccagaaagggagggaaggattctgagtcgctgcctgagtcttaaggacttaaagagccatttgagcatcagggttaggagtgcagactctgacgccgccctgcctggtgtcagatctgagctctgccttctactggctgtgacatcaggcagttagtatttgcatgacttttaaacacaacatctttttgtttgtttgttttttgagacagggtctcactctgtcacccaggccagaatgcagtggcacgatcccagctcactgcagccttgaccttgtgggctcaggcgttcctgcctcagcctcccaggcagctgggaccacaggtgtacaccaccatgcctggctaattttttttctttaattatgtgtagagatggggtctccctatgtcgcccaggttgctctccaactcctgggctcaagcagttctcctgcctcagcctcccaaagtgctgggattacaggtatgagccactgtgcctgacctcttattactaaagcacaaagaagcgttttccagaaacagacgtggggtaagggatgctctggggagagggagcagcacatgcagaggccaggaggggtctggcgcggtggctcacgcctgtcatcccagcactttgggtggtcaaggcagatggatcacctgaggtcgggagttcgagaccagcctgcccaacatggtgaaaccccgtctctactaaaaatacaaacaaacaaaaaaaattagccgggcatggtggcacatgcctgtaatcccagctactcaggaggctgaggcaggagaatcgcttgaacccaggaggcggaggttgcagtgagctgagatcatgccactatactctagcctgggcaaccagagcgaaattatgtctcaaaaaaaaaaaaaaaaggctaggaggagtgggtgtctggggcactgtgatcactcctttatggctggagtggaataaaatgaggtgtggtgagaggatggggcgggaagggcgggaggccagactgcagagctgctgagtcagcaaacaggaacgggggaactccctgtgtgccaggtgctgtcctgggtactcggctgtgggtacagccaacgcaggcacagcactggtccctgcagagcttccggagttggggaggccctgaatgtcagtctgaggactcggtcattagccttggggctgtggggagccgtaggaggtttcacacggtcagttctggggtagatggggtcaagtctagactggtgtggagggagagggattgaaggcaggaacacaagttcagggatgtctgcagacatcagcctgtccctggtttactcttcagcccctccttcctgacccctcccaacttcatcctccgcctcctccagctgcgggacccgagagggggtagggatttagatactcacacccatgcctccgtgtcctcacagtgatgggaccagtggaggccgcgcctgaataccgcgtcatcgtggatgccaacaacctgaccgtggagatcgaaaacgagctgagtgagtgctggggggcaggcggagacagccccgtgtgacgtccctcacgccccctctcccttccccactggcctttcccagggtcctgcccctaagcccaagctcagatcgaggttgacctgctgtcacagagtggctgaaataagaaggaagtgcgttctctcgcgtatgagtctgaggagcactcggggatggtgtggccgcttggctgcctgtagggccccggctctttccatcctgttggtcggccacctgcctcacggtgcgaggtgactgccccacctccagccatcacctccgcattcccaccagcaaggcgcttcttttctttaagaacatgtcactgcagctcacgttttacagaccagaactaattcccctggtcacacctagcggtaaggacggctgagaaaggctgtatgctggtgcccgtgtgccaggccacaagccagggcttcagttactaaaggaagaaggggacatgggtgttagggccaaccagcagagtctaccttccatctcacccgacaacctcctgtcccgtttaccctagacatcatccataagttcatccgggataagtactcaaagagattccctgaactggagtccttggtccccaatgcactggattacatccgcacggtcaaggtgagcgcagagaaggtggggtgcttctgctggcgtgaaggggcaggcggggctcactctcggaccccctcccagaggcctgagggtctggagacgatggagaggagtggacgagggctcagtggtctgctctgcccagcgtgggagggacggagcctggacaggactttctcagggctcccctccaaccccagtctcccgagagggcttccccgctggcctgacccacgctgctcccgctgtggttggagccggtggcattggagttgacatccgaaggttgacacagggcaggcacacggagatttgggggagagagacgtctaagtgcagagagctggagagggaacaagtggggaggaagtgaggcggggaaggaggggacggggaagaggtcggatcacgtccagcctttgggtcttaggagaaagccaaggaagggtttcggaaaagaggggcaggtgtgcgtgagggcggggagaggaggaggtccccacgcatgtccaggaaaggattaggatggcggtggggaagcccctgcagggaagcgaggccgcggatttgcactccgacttgacgcaggccagaggcttgtgaggccacagtctttccagacgccactctgcccgggctccgtttccaggtcagcgaaagcagggcagatggtgtggatgcttgacgtggtggaggcaggaatggtgtggatgcttcaggcggtggaggcaggagaggcccccagtgcagagaccctgactgtcccagtgtccctaagaagagacctgaggaggtgctgagcaagagaggttctcgagccttcctgagttcccgagcctcccctatcttctctgctcgcccccaggagctgggcaacagcctggacaagtgcaagaacaatgagaacctgcagcagatcctcaccaatgccaccatcatggtcgtcagcgtcaccgcctccaccacccaggggtatgtccgcttcgagggaggcgccgggccctaatgggattggggattaggctggagctacacacgcaggtgtacacacgcacacacacatacacacatgcacacacacacacagaaccgagagggctggggctgggcacaccaggcaggcgggagacccaggaggctgggcccacccgcccctgcaggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgagtccccgggctgggtcccatggagcgggggtctgctgacactgtgaccttgggaaagctacatccttttctgtagaatgggggctttggcacctggacctcagcaccccgtctccctggacatcacagaggtcagccagcctggcacacagcaaagcctcatctgtgggaaaaacactcacccacagctccttctccctcccctgtgccggaaacccagagatgaccacacccaggccctgttgtcagggagctcctggtttggtgaaaatggttccaaaacacagccatccctggaacggcgttagtgtggcttagcacaaacgtggtggtcagcttcctgttgggggcctcctccctgcacccccaggccagctgccctccctctctgagcctcctttgcatctgccccttgcggaatgggccaggtcgcccgcctggcagggccatcgaggaatccaaccagaacttcatgtaaaggtgcccagcacacgtcgagcccccaggcagatttactcacccccacctctctgctttcttctgaccgcccccccttcctccctccctcccaccgcaggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggtgagcccactgcgtcatggcccctcccccggcccccctggagccttccgctgtgcccagacagcctgagcagccacccaccatctggcccagctgacggtagcactcaggagctgggaacagggtggcatgggacgtgagagccagggctctgcagcagaccagctccagcacccaccagtcaggtgactgtgggcaagaggcatgagcgccctgtgcctcagtctcctcccctatcaaatgggagcacagcgcctgcttcatgagttgggacgagggctcagtgcacatgaagcacttacagttcaggcctagctcacgacaagcagcgtcgggttagcgtgcaactgctccgaagaccaccctcaggtttgaccattcactagaaagactcacagaatccactgagggctgcacatcagccatggggagagacacacaggaggggcaggagaggtcaccaacctcggagcttcccgggtcctctccctgcagtcgggacacatcaccatcccagcatcgacgcctgacagcacacacacaggcccgctagcctggcggggcgcagtggctcgtgcctgtcatcccagcactttgggaggccgaggcgggcagatcacctgaggtcaggtgttcgagaccagcctggccaacatggtgaaaccccatctctaccaaaaatacaaaaaactagctgggtatagtggcacacacttataatcccagctacttgggaggctgaggcaggagaatcgcttgaacccaggaggtggaggttgcagtgagctaagatcataccactgccctccagcctgggtgacagagtgagactctgtctcaaaaaaaaaaaaaaacaagcaagacaggttctgggacagacaggcctgggtccagaccctgctctgtccaactgtggcgagttacctcaggctcacggccctgtgccctgcctggcctcccccagggatggggagaacaatagcactgatggccaaggctgggcaggcacttcctggccccaccccccagccctgtgtggggttttttttgtggtcttttctgcgaccctttaggtcaggcactgctactggaacacacccagggaggctggcaggtcaccccatcctgggaggagagagagtgggcgatagaacccaggacgggtgggcctggggctcggggctccagctgcctcactgcacccctgccatcgccaccgcctcacagccctgggcatatgggttaaacctgccccagggagcctgatgtcttgtcacccaggcctctgcctcttcatttggccatctcacatcggtccaggcacaggccgtagacaccacaggcctgtaagggaggccagggctggccatcgcttcactgtggctgacagctgggctctgtttgcagtttggattggaaccctggctccatcacctgctggctgtctccctggccacatgacttgaagccttggtttccacatctgaaaagggggtgcaatgatcacaccagcccgatatttgaatatttgatgagatgatccgaggggcgtgcttagcatggggctggcatccaggccgagtgcactccccccggcgtctccacagtcaccaccgtcctcgttgtcagcgtgccttactgtcatccttacctgatggccacttatcagctgggacatggctctgtgccctgccctcatcccctcttcctgtgaagtaggagctgagagcacacacctctagagcccaagggtggaaagcccccttccaggaccccaggtagagccagaggaggagcgcgcgcggttgctttgctgttacctctgtctgtctgtctcacacagattccacccccgttttccgttgctccaggatctgcggcggaaagcggcccggctggtggccgccaagtgcacactggcagcccgtgtggacagtttccacgagagcacagaagggaaggtgaggagggaaaggtgaggggcggccgggcgtcttttcctctgggcctggggtgtctctgcagggagaccctcagcagggagcccaccccagcgagcactgtcctaccaaggcggaggcagtgcttctgcccaccctccctggggtcaggcacccccttccccagtggggtttcctaggtctgctgttggaaggtagcatgaacctactggcttaaaacagtgcaggtgtggccgggtgcagtagctcacgcctgtaatcccagcactttgggaggccagggtgggcgggtcacaaggtcaggagtttgagaccagcctggccaacatggtgaaaccccatctctaccaaaattagccgggtgtggtggcacgcacctgtaatcccagttactcaggaggctgaggcaggagaattgcttgaacctgggagacggaggttgcagtgaactgagattgcatcattgcactccagcttgggtgacatagcgagactccatctaaaaacaaaaacaaaaaacagtacaggtttattatctgtggtcctgtaggtcagaagtccaaaatgagtttcactgggctgaagtcagggtgtcatcctggagcgttccttctgggggattcaagggataatccattccctggtcttttccagcttctaggggtcactggcaccccttagctcgtggccctccctctgtctgcggagccagccacatagcaccctcagacctctctctgactctgcttctgtcttcatatctccgcctctgtttttgttcccctcttctattttaagggcccctgtggctatactgagcctactcagatggtccaggatagtcttcccagctcacaatccttaaaatccttcttaacctcttcacgtcccttttgccctgtgattctgggaattagaacatgggcctctttgggcatgtgtgtgttggtgggggcgtaatttgccttccacaccaggatctgtccccgctgcaacaggggatgttattcaagtaattattcagttaccttctgtcttccttggtagatgtactcgggagaggagacgttttctgtcttgtgaactgtcgtttgccaagcacccggcctggcacagcgttcaggtgttccgtgtccccttctcctttccctctccccatctcacccctggtctgggtgtgggggtgcagctgtgagtagcacagacaggacccctgccccgtggcgtggacattcttgttggggccgggtcaaagagacagtcaacaggtgaactctgtcctgcgtctagcggtgctaagtcaacaccaagaagaaaaagaaagggggtggcggtgaggcagcattaggtgctgatttaactaaggcacgtggatactcggggggcccgctcagaggaggcctgggtgggcagcccacgcgagcagctgcaggacctccccctcgccctccccaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtgaggggccctgggggtccggtaggcatgggggtcatggaggggagaagccggcgtcctcctcccagccgactccctggcgccgcccacccacccgtccccaggtaccgcaagatgaaggagcggctggggctgacggagatccggaagcaggccaaccgtatgagcttcggagaggtcagactcccagagcgccctcctcaaccccacagccagccagccgccaccgccctctgcctcctgccaccgcccctcctctcgtcctgtggccctggctcatgtctagggcgctgccccagcctccccccccccggcctctattctcgtttccatccgttcagccccaaagcgaccctcgcgacccttggagcctgtgtctccgctgcttagagcccccgcggcttcccatcgccccgggctccttggccggttcctccctgcccagaggctccttagtgccctgctgcacggccgccccgtccctgggccccgccagtctcctctgttatcccagcgtcatccccttggtcctgcaggaccgaactcagaggccacctcatcctattaaacctgttctggttcctgacatcccccgacccacacgagtaaggaaggaatggcctcccaactctgagctcacagagcagtgctgggaccgggcccctctcaggctccccagcatcccccgcgtgtgtgggcccccaggcctcagccgggccgagtgggtaccggagcaggtgcccgtgggaccggccggctggtgaccgctgggcttcgggctggtggagggggtgcctcggtggctggagggcagggcctggtcgctgaactgcagggcgcctcctctcccccctagatcgaggaggacgcctaccaggaggacctgggattcagcctgggccacctgggcaagtcgggcagtgggcgtgtgcggcagacacaggtaaacgaggccaccaaggccaggatctccaagacgctgcaggtatgggccagacccaggtggggctggggaccgagggacacaaggtggggggagcccagatcgcagcctccctgtcctccccacagcggaccctgcagaagcagagcgtcgtatatggcgggaagtccaccatccgcgaccgctcctcgggcacggcctccagcgtggccttcaccccactccaggtacctcccctgggccggctctgtccccagccctgagaccttggcaaggccccttgccctctgcccctgtgaagaaggccaggatgagtctcctcatggggctgttgtggagggtgtggtgacgaggtatgcagaggacgtagacagctcctggcacacaggaagaggttagcagagacgagagcccagcgctgagcagtcctcgtgagcacgcactgctttagaaccaggcccacagctgtgttcagggcacccagttcctctgtcgggctgtgagcgggtaacactgctcagcctccaggccctccagttcaaaacggccaggacggttaaggtaacctcaggaccccactcgagaaagttcccggctaggcgggcttggatgtcaagtgtgggtccaggccccagccagtcagcagtgagcagcgtggagcatggcagtcaccgcatcgtcggagcctcggtttaccatccacagagcagggcgagcctgcaccacggaggcgagacagcagcgagctcatctgcccagtcagcgggtgtctacgcagcacctgctgagttctgtcagtgttcccggctctggggatgaagcaacgaatgagagacaagtcttaccttcttggagccagtgggtggccgggcgcagacagctcagtaagatgtccagtgtaggagaaggcagaaatgccaggccgggcgcagacagctcagtaagatgtccagtgtaggagaaggcagaaatgccaggccgggcgcagacagctcagtaagatgtccagtgtaggagaaggcagaaatgccaggccgggcgcagacagctcagtaagatgtccagtgtaggagaaggcagaaatgccaggctgggcgcagacagctcagtaagatgtccagtgtaggagaaggcagaaatgccaggccgggcgcagacagctcagtaagatgcccagtgtagtagaaggcagaaatgccaggccgggcgcggtggctcacgcctgtaatcccagcactttgggaggccgaggcaggtggatcatgaggtcaggagatcgagaccatcctggctaacacggtgaaaccccgtctctactaaaaatacaaaaacttagccgggcgtggtggcgggcgcctgtagtcccagctacttgggaggctgaggcaggagaatggcgtgaacccgggaggcggagcttgcagtgagccgagatcgcgccactgcacttcagcctgggcgacagagccagactctgtctcaaaaaaaaaaaaaagaaggcagaaatgccagggaggggaggaggtggaaggtaggaggtgggacaggggaggctctcgtttcggagcagccagggagggcctctttgagaagatgaggccagtggctgtgcctttccaagcctcccctcctccatcatgaggtgctcaggactgaaaagaacgcacaggaagcacttggcactgggctcaccattagagcccaatgactgggtcctgttattatttttagagacgggggctcgctctgttgccttgaaaatatttaggaagtgccagccaggtgttggctcccattgctgccactatgatcgtcagtggtgttggtgtgatttgtgctaggacctcgggccagccatgtcccccagggactcagtttccttatgcagaaactgggcaggattggctgtcctcaagcattggttgtttttagcacccctgaggaacttcgtacaaatccaggcgccctggttcctccccaccctctccctctagacccactgagtcagaatctcccaagacagggcaactccagggacaggcaaactgtctcatgcccaccaaggcctgagtgccatggggaagggcctggggggctctgatgggtcacagttggggccttctcctcacctaacccatcatcctctctccctcacctgcccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaagatctgtc

SEQ ID NO: 55 - DNA, 12010 bp, Homo sapiens
  source 1..12010: mol_type = genomic DNA
tgaagaaatagggcctttccgcctgcgggcccagtgagtcgacacggtgggggcccgcgatccccgggacttaccactgaataaatccagtccagcgtgcgacgacttactggcttcatggtaaggaggcggcagcagtccgcgggagctggcgggagctgcgggccttacagtaacctcccaggcggtggctgccaggcgccagcagccatcttttagccgggcacgagcgcccgcccactcgcttcgtgcagcgctgtcgctggcctcttccgcccggagttggggggcggtatcacgtgatcgggggccttgcccgccttttagagaggggaataaacgagaaaatgttaaaaattgcttttttttttttttttttgccaactaaggagataggcgtacctccactggttttctttctagttgcaatgcaatattaatgcaggataaggtgctgtcgtgtccatttaaaagttaatttgaaaaacaatccacgttttaaatattacgtctggctctaaagctggaagaattaacgctttctcccccgctccctcccccacgcctccccgcatctgataccacacgatttagatggacgttcgcctgttcatctttgacgtaaaaataccacccactcttttatatgtgacaaatcgttgtgggaacccctgtaaatcgagccattcttcagaaacgtatagcgtaatgtatatctctaagaagaaatacgtgggacgcgttacccgccataatgtatcagtcaagcaacaagtgtttgttgagcgtgtctgatgttcttgaactgccgcgcgtgagatactaagccccgagcacggcagtttggtgggcgagcgtaccaggttcagctctagaatgtttggggcgctcacatttgaggcctgaggagtagaatctggcaacgggccgcttaggctctagacgttctttatacctcgcagttatcttaaaagagttttagtctagatttcagggagtgggaaggggaagagcggagaaaaacgtggtctgtttagggaggagtccaggccctgttttgttaggttgtcctgtttctccccagcctggaggggatccctctctgaagactttataggatactggttgggctctggtttgggatcccgttggactcctggtgttgcttccgggaggcgtacaacaggaggtgagagacttcaagtccatctaacaattcccctatctagacactaaagataatttcctaagtttccgcagagtttggtaaggttgaaacgacatcgaactagttctcgtgttttccgggtaagttaggggcgaacattcagtcagtgtccccagtggctgagtaccagtaacaagatggggagggtcgcgctgccctcctccggggtctggagcggcgggggaggggccgcatttgggccggtgcgctgagccccgcccccgaggccggcgtccatctgctgcgcatgcgtgaggaaggcgggtgttgtgttttgatgcgcgggagctggggggtgggtctcgctctctgccctgcttccgagctgccattggtgatgagccctttgcgtcacaggggtcgcagccgccgctggggtctccgctgtctcgcgaggagggtgaagcgcccccgcctgctcccgcttcggagggtaggcggagaagtcgccgggtacgccttcgcggatcctgccgacaccgacctagctttctgggctgccgggagctcgcggcgagcgccccagccaggcctgcgccggcatcctccgaggtgagtgagattcggaacaatgggacgcgggggtcggaagggccgtgggagttggcgctcccgcctggagcggcgcctcgggacccgagggttgcggtcatggcctgcggggctgtccgggcctcggcgggccagggccagggcccccgagcggctcctgcgcgcacctgtggattggtgcgggcaggcgagggttgcgcttcccacaagcgctcccgaggggcgcgagcctggccgtgtactggaaagagcttggtctcagggaaaagcaaaaaagcaatgagactgaatcgtggcgtcaccacttacaggatatgtgaccttgcctaggtcccttaaatccctgagcctgtctgtaaaatgggaataacaatatttaagttcgttgtggttatgtaatgctcatggtgcttatcttagtctagtggcagttctgaaccaaagtaaacgactatcaccgtggctttgggagttgggacttgtctgtgttgtgttaaacattctgagcagaaattgcccgtgacttgttcatccatccatttactgcagctttcctcatgggttgctgattgtaggctggaagggggcagtgctgagatgagccacatagtgatttaagaggaaaacggagtagaccttttgataggtaattttcaagattatttaagataaattaagaaacagctgcccaagatttaagttaatagtggtgagagctttctgggttttgtccatgaaatgcaaagaaagctatacaatcagctaaaatcaatcatacttgtctggaatgagtggttttagaggcgaacggttcccagccaattctttttgctggaattggattaaatttgataggatctggataaatttgataggatctactgagatcctgtgacttttgtatcttcttttggagttgattaaatgcagttcagagaggtacagtgatttctttaaggtggcaagaggtaggaaccagtttatttttaatacttgggtgatctttctatttcatctattcgtgaaccctttttagtcactttgcctagaaatattaagtataataattatattaagtatgatgattattttgttgttataaactatcctctgtctggacccatataatcagttatgggtgatgagctaccgaaattcacttcgtgttcacgtaacatagagaacattgttgagttcttactgtgcatcaagcactgtgctaagggtttttatgaaatatgtcccgtcacacaaccaccttttcaattccattttagaattgagaaaacgtgagattttgagaaaaaacttcctccaggttacacacctactaagtggtggcgattctcagccttggctctgcagcaaaattaacatcactcccgcaaatgtaatcagcagatgattaaattttatatacagtgtatgccatagatgacttttgatttttattgatttattttttttgagacggagtcttgctctttcgcccaggctggagtgcagtggcgcagtctcggctcactgcaagctccgcctgccaggttcacgccattcccctgcctcagtctcccgactagctgggactacaggcgcccgtcgctacgcccagctaattttttgtatttttagtagagacggtttcaccgtgttagccaggatggtctcgatctcctgaccttgtgatccgctcacctcggcctcccaaagtgctgggattacaggcatgagccaccacgcccggccatagatgacttttgtagtaagtctaactttaattctacagagcagttatacttcgtttatatcattgtgcagtttttcaaatatccagtctcctgaaatgtagattcgagcttcctgattctttatctcccccatccattttccctagacgtgtgtccatattaattagctgaaatttccccgaattgttattatccttgttaaagccagatttgaggatttttcgggaaagggaagttttggcttaatcagtttatactaaagatggtgaacttcatttaggatttgggagacagtttaggaagtgtgactggaagaactgattgtctcctgtgaggaaatgtcctaattcctagagtgctaggatggaaaacccgtaacacaggcttcttacagaacctgaagcactgtgtttttcatcgggtctacctttgctacttaaattcagaacgtctcttgcagatcagccactcttttgtgtgtgtgtgtgtgtttgtgtgtgaggcagagtttcgctcttgttgcccaggttggagtgcagtggcgtaatctcggctcactgcaacctccgcctcccgggggttcaagtgattctcctgcttcagcctcccgagtagctgggattccaggcatgcgccaccacgcccggcgaatttttgtgtttttagtagagaccgggtttctccatgttggtcaggctggtctcgaactcccgacctcaggtgatctgcccgcctcagcctcccaaagtgttgagattacaggcgtgagccaccgcgcccggccagcaaatcaaccactcttaatctgtatctagtcatcccagtttttatgccttaatttgtatttttaaacagctttgttaagattacattccgggctgggcgcggtggcttacgcctgtaatcccagcactttgggaggccgagacgggcggatctcaaggtcaggagatcgagaccatcctggctaacacggtgaaaccccgtctctactaaaaatacaaaaaaaaaaaaaaaaaaaaaaaatgccgagcgtggtggcgggcgcctgtaatcccagctactactgggaaggctgaggcaggagaatggtgtgaacccgggaggcggagcttgcagtgagccacgatcgcgccactgcattccagcctgggcgacacagcaagactctgtctcaaaaaaataaaataaaagattacattccatccataaagttcacccgtttaaagtttgtaggtcaatgattttttagtatatttacagagttgtacaaccatcacaataattaattgtagaacgttttcatcaccccagaaataaacctctttactgccccagcagcagccaccagcctcatttcatctctctagatttgcctattctggacatttcatataaaaggtatcatacaatatgtgggttcttgtgaattttttttttcattcatttagcataataaaaagtttcatccatgttacaacatggtaccagtactttgttcctttttattgccaaataaaattccatagtgtggatagaccacattttattagtctgttaatcaattgatgggtatttgagtttctccttttgaggtattatgactaaagttgctgtgaatattcatatacagtttttttgtgtggacaagttttcgtttcccttgggtatatctaggtgtgtaattgccgggtcatatgttcgacttcatttgcgttttaaaaaacattttaatttagtatttagtgatgattttgaagagctaataacttatttgatctacatgcattccaattgtttgatgtttctttttcttttttaaaatagagactggatctcgctttgttgcctaggctgtttcaaattcctggcctcaagggtctcctgccttggcttcccaaagtgatgggattacaggcgtgagccaccgtgccccgcctctttgatgtttctgatgaagactgtttgtttgtttgtttgtttgttttgaaacagggtctcattctgtcacccaggctggagtgaggtggtgcaattatggctcactgcagcctggacctcccaggctcagttaatcctcctgcctcagcctcctgagtagctgggactacaggtgtgcccatcatgcccggctaagattattcttttcagctaatgattcctgtgtagaaatacaagaatgaattctaatttattattattttttaacctgttatggaggacattaccagtcattcattcaccttttactgtcaaagtggttaacaggcttataaaactagagaagggaagggtaaggtttcatttttttaaaaaaatcatactttgttgagattttattttatttgaacttcaagtttactacctaataattccctttaataaattcattttcagctgtaatttttatgtgaactggaagtgttcagaaaacactaaaattctatttcagagaactaagtgaagataaaatgtattaacttggaattcacgggtcttttttccaagtccagtaatcccttcattatatagaggagaaaactaaagtctagagtaatgtggttttcttcacattaactagagctagttctaggtgaagcctggtcttcagtccagatcttttgataacctctttgattccctcccaacttttctctgttccttccctctaccacacacacagtctctgaactgaaaggtttttatttttatgtgtgtgtttctttaaatttcttgagtaggcagattaaaaaatgttaaaagtagagggaaatgctgagaaggttgtgcagtattagggttttagactgtttatgaacaaaaaagcagtattatgtatttataatcctgcttttccagaccttccaggacagtgatgatgtttttgcattttcagtccagtaaatagaagactagacatacctggacccctgaagaaacgcttatttagcattaattgattctctattaagttatggttctgagaaagccaagatgccctaaagtgagcaggtttaatatgaaagctatggtggaatacttgtatttcagtcatgagtttttgttgtgggttttgtttattggtttttcttatagtttgttaaggccaatgagtctatttagaaaattacaattctgttatttgattaacttgaccccagttgactagtgatggaacctcctgtgataaaggaggtggaggaagatgaatattaggccctgggaaaccaagggcctagtagttttttgttgttgtttgtttatttgttttgagacagagtttcactcttgtcacccactgcaatggtgcagtctcagctcactgcaacctctgcctcctgggttcaagcgattctcctgtctcagcctcccaagtagctgggattacaggtgcctgccaccatgcccggctaatttttgtattcttagtagagacaaggtttcacaacgttggccaggctggtcttgaactcctgacctcaggtgatctgcctgccttggcctcccaaagtgctggattacaggcatgagccaccgcgcctgactccccaatagtcaatatactcaaaatgattagtataaaatgcagctttggagtttatgagataaagtcaaaacgcatactagatttcaagctctagcaaagttttgagccaatgtaaactgataaaacaaactaatctttaatattctagtcatccttatgggaaaggataatagggaaggggaccaaaaacatgatttcaagatattctgtggcctgacttttggattaaagaaaaaagctaaaggaaggcttattaggaatgctgaatggaatgagtgattaactgaatataatagtgtagtaataataacagctgacatttactcagcacctactgtgagccaggcactgcctcttggctgctttttcatttattatttaatcttcactaaaagtttcctctccctttttaaaattagctttctaaggttgaaaaaagaatctttcactaaaaatcataggattggtttaaacaggtgaactttctggtatgtaagttatgtcaccaaagttgttttagaaaagtacatacaaaatatcacagataaatcagtagtctgtattgttagtggcatatgtatatgaaaggtataaagccatgcatagaaataacatcaactgaggagtgtggtgtttttgttttttgttttctagagagtgataggaggggaagataaggggcataacataagtggtggatacatgggtatttggtactttttttttttatatgtcagatatttctcaaattatttttaaaaagaataatagaatgttacataatatttgagagctttactatgtagcaggtgccttttctaagggctttttacatcttcacaaaccctgtaaggcagattctgttatcactgacctgcagatgaaattaaagcacagagatactaactggcacatagtcacgctggtagtgtggaaccaggattcagtcttaggaaatctgacttcagagcttatgctttaagcactatattactatgctacagtgcccctttataaaataaaacaaaagtaatgggtcacttaagtattttcaccaaaataagtttcaaggtctttatttgcatttttgttgagactatttagtcattcctctattatcaggttactgatatatttctttcccttttacagataatggcatcagctgctaaggaatttaaaatggacaacttttcacctaaagctggcactagcaaattgcaacagacagtaccagctgatgcatctcctgattctaagtgtcctatatgcttggatagatttgataatgtgtcttacttagatcgctgcttacataagttctgttttcgctgtgtacaggagtggtcaaaaaacaaagctgaatgcccactatgtaaacagccctttgattctattttccattctgtgagggcagaagatgacttcaaggagtatgtcctaaggccttcgtataatggttcttttgtcacccctgatcgacgatttcgctaccgtacaactctgacaagggaacgaaatgcttctgtgtattcacctagtggtcctgtgaacagaagaacaacaactccaccggatagtggagtactgtttgaagggttaggcatttcaacaagacctagagatgttgaaattcctcagtttatgagacagattgcagtaaggaggccaactacggcagatgaaagatctttgcggaaaattcaagaacaagatattattaattttagacgaactctttatcgtgctggtgctcgagttagaaatattgaagatggtggccgctacagggatatttcagctgaatttttccgtagaaatccagcttgccttcacagattagtcccctggttaaaacgtgaacttacagttctttttggagctcatggatctttagtgaatattgtccagcatattatcatgagtaatgttactcgctatgacttggagagtcaggcatttgtgtctgatttaagaccatttttacttaatcgaactgagcattttatacatgaatttatcagttttgcccgatctccttttaacatggcagcctttgaccagcatgccaattatgattgccctgctccttcatacgaagaaggcagccattctgattcttcagtcataacaatatctccagatgaggctgagacccaagagctggatattaatgtagccactgttagtcaggcaccatgggatgatgaaactccaggaccatcttactcaagctcagagcaggtacacgttactatgtcttctcttttaaatacttctgacagttcagatgaagaacttgtcacaggaggagccacgtctcagatacaaggagtacaaaccaatgacgacctaaataatgacagtgatgattcttcagataattgtgtcattgttgggtttgttaaaccactagctgagaggaccccagaacttgttgaactgtcctctgattctgaggacttaggttcttatgagaaaatggagacagtgaagacacaagaacaggagcaatcttacagttctggtgatagcgatgttagtagatgctcatctccacactctgtccttggaaaggatgaacaaataaataaaggtcattgtgattctagtacaagaatcaaatcaaagaaggaagagaaacgatctacatcattgtcatctcccagaaacctgaactcatctgtaagaggagacagagtatattctccatataaccatagacacagaaagaggggaagatcaagaagttcagattcacgttctcagagtagaagtgggcatgatcagaagaatcatagaaagcatcatgggaagaaaagaatgaaaagtaaacgatccagaagcagggaaagtagcagacctagagggagaagagacaaaaagagatcaagaactagagatagcagttggtccagaagaagccaaactctgtctctaagtagtgaaagcacaagcagatcaaggtctcgtagcagtgatcatggtaaaagaagatcacggagcagaaatagagatcgttattatttaagaaataattatggaagcagatacaaatgggagtatacttattacagtagaaacaaggacagggatgggtacgaatcatcttacaggaggaggactctgtccagagctcattattctagacagtcttcaagtccagaatttagagttcagtccttttctgaaagaacaaatgctaggaaaaaaaataatcacagtgagaggaagtattactactatgaaaggcacagatcaaggagcctgtctagtaacagatcaaggactgcatctaccgggactgaccgggtgagaaatgaaaagcctggagggaaacgaaaatacaaaacacggcatttggagggtactaacgaagtggctcagccatctcgtgaatttgcttctaaagcaaaggacagtcattaccaaaaatcttcatcaaaattggatggaaactacaaaaatgagagtgataccttttcagacagccgatcatcagacagagagacaaaacacaaaaggagaaaaaggaagacccggagcctaagtgtagagatagtttatgaaggaaaagctactgatacaactaaacaccataaaaagaaaaagaagaaacataagaagaagcataagaaacaccatggagataatgcttcacgttccccagttgtaattaccattgacagtgacagtgataaggattctgaagtaaaggaggatacagaatgtgacaatagtggtcctcaagaccctctacaaaatgagtttttggctccttccttggaaccatttgaaactaaagatgtagttacaatagaagctgaatttggtgtgctggacaaggaatgtgatattgccacacttagtaacaacttgaataatgccaacaaaactgtagataatattccacctctggcagcttcagttgaacaaactctcgatgtaagagaagagagcacctttgtttctgatttggagaaccagcccagtaacattgtgtctcttcaaactgagccatcaaggcaattgccatcgccacggacatcattaatgtcagtatgtcttggtagagactgtgatatgtcttaaaactgccaaagcatttcattgagaattatgatgttataaaaaggaaaaaggaagaatgtcgtctactgcagtctatttaaagatgacatttggtgaaaactctcttcctccttacaatattttaaatgattttttttttggtgttaatttgtaaaaatcattatttgttcaaaatgtatgtcccaccctcaaagatatgcacttttaagtgaagaaaatgatactgctagcagcttatttaaaacttggggtcctttttaaataagaaaaattatataaattttagaagttatttcataaagccatacggtattgacatatttttaaggtagtcaatgagtatttttgaattttttttttttgagagttattctggaaatgtgttataagctaggagaatccctttggacagtctttatttttcttcttaaaaatttatatgattcaaaaccatttcttcaggttaaattgaggcattttaatctgcacagtttatcttctgccaaaataaaaatttactatttcctttatatacttgtttatctggactgccagtaaaacaaatgtgtattcaacaaaagaaaaaaaataaaacagtaacactttaaaacaagaatcagacattttcctatgcagtatttttttttaaagtttattttagtaaagttaaaatcttgaaagtagctaagggcataattatgtcataaatactgaacttcaggtgaacaaatactttatagttttaattattttctttgattttgaggagtatcttatttgctttctatcatcagtaaaaacagcatttaacttgctaaataaacatgaaaaacccttgtcata

SEQ ID NO: 56 - DNA, 441423 bp, Homo sapiens
  source 1..441423: mol_type = genomic DNA
ggcatcgggtttctggctcgtgatttgccggagctcctgcgctccccttctccaccccctccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaaggtgaggagcaacggggcctcgcgggtccgggcttcactgggcttctagccgtgccgcctctgggcggctggcgccgggagagcgctggctgggtccggctgcccccgcgccccggttccgcatcagctacaccgcttgctttcctccctcccggagttcgcgtggcagcgggctcaggaggcatccctcgttgcagctgttcctcgcggggatcctgcggagcagagaggcctagggcagaggcagttgggtgcccgcacgccctccgaggcggctgatggctttgggcaggcatattgctcgaggtctgcttccagggccccgcggcattggctttgtcttaagctttccagggtgtctttttaggtgtccttatagtttccgtgttctgttgcctctttccagcatttttgaagggacactgtgaactgttgcttaagtagtgttagggttgtgagtttgtcttatcttttaaagtattataccatgtcaggactgccaatagattttacgtttcatttgaaagcctgttttaattgtatgacaccccagtctactgtgtaccaaatgcatcccgtgaacttactttccttttcggtatagtggtgagcctgattttggcactgttctaaacacatttcatgactgttctgtatacctaggctgtcatgatggcagattgacaaacaggttggagtgcttgtgtgtgcttctgagctctgtctccagtcaatgtcgagtctgtcgttaattctggggcacagaccacctaacctactttataaggtttgttgaggcacttgaacacattctttaaaatgaaggtcccctgaaaaccatctgtcagctggttcagtgtgcttgttaaacttccttttaaaaaataattattaaaacattgccacataacttgatttatagtcatttaattttagacgttgaagacactttagagacgacctgccccatcctactctttaaagaggagggaaccgagccccaggtgggcagtatgagagctggagcttatcgacatggaagtgagtggcacctatgtttgttttgtgtccaattcagcgtgcggactttcactgttttctgtgttcccatacagtttagtgttctttaatctttatcattctgttcatctgtgttggccacttcaattgcagctgtaagacttatgcatttacataggaggcaagttagtatggtgtaaagtgtgggctttggggtcaggcgcatgaggctttgtatattggacaggtctcttccttgggcgtcagcttcgtccttgtagctatttttttcaacaaatatttactgaatatctcctgtcttccacttctggggaatgaatatggtttctgctttcttagaaattttactctagtagggagactgtaacaagtgtaaaatggtattaggggagatgcccgggtgctataagaaaataaaatagagggatttgaccaagccaagattttgaattctgtgttctagatactgttctgttgctttgcttgaactaatttattcaatctcacaacagtcgtatgtcccccatttacagaagatgaaagtgaggcactgagtgttaatgtgacttgctcgaagctatagtgccaataagtggcaaacaggatttagaactccagaacctgtgctcttaatcatactatgctatctacggtaagggagtgttttcctttggaactgaaaattgagacaagttttgaaggatgaagtgaccttttctaacaaacagagatgaatgttataggtgagagagcagtgtatgcaaaggtcctgtggccagagggaatgacaggttagaagaactgaaaaaagcctacagaggctctgatgcagagagtagatggtgttggggaagctggcaggagtcagaccatctggctcttatagatcacattatgaggtttggtgtttgtcttagagcagtgggaagacattgatgttggaggtgggagggatgacactgacattttagattggagaggctgagaggaaggctgttactgtacttactgttgtacacttgttatacacttactgtgtaatacatacgctttgatgattcttacctggttttttccttttaatgtgttggcagagactgcatcttgtctatttctgtgttcttagtacaatgtttgacacaataggtgctgaatgtgtaacaatagagtagcattatgtttgtgccggtaaagaattcctccttggggtgggaagcatctctgaagttcactatcactctaggggaacttgagctgctgcttagcttctctctgcgcttctcttctatgaacttgaaatatgctctactgagtctgtttgaagctgaatcttttgaagattttaacccctcccatccctccctccacctctgcaaaccttttggttggttgaaaagcagccagctaactctagggtctagtctagagaattctgaccattcttttagccagtcaacagagtttatttatttttagggtatatgtagagttcaccttttagtcttatttgttttgtgtatcagctttttaagcacattctgttttaatgcctagttttttcttctgcgtaaatgttttcagtggctctaggatgttggttttatggtaattgctatagttattattgaactcttatatgccttgcatgatttttctttgcttttctttttttttgagatggggtctcgctctgttgccaggctggagtgcagtggcgcgatctcagctcactgtaacctccacctcctgggttcaagtgattcccttgcctcagcctcccaagtggctgggactacaggcgcacgccaccaccaccggctaatttttttttgtattttagtagagatggggtttcaccatgttggccacctcgatcttctgacctcttgatccactgccttggcctcccaaagtgcttggaattacaggcatgagccaccgagcccaatggtgtgatttttcatatatcttttatccttataacaactaggtaaaaaatcccaattttacagtagaggaaacaaagctcagggcagttaagtagttgcttaaaagcacaattggctgaagtagaatttgaaccttagataatatgattctgaaggctttcttttctttcttccttttttttttttgagatggggtctggctctgttggccaggctggagtgcagtggcatgatcttggcctactgcagcctctgcctcctgggctcaagccatcctcccatctcagcctcccaagtaggtgggaccacaggcacgtacgaccacacctggctattttttaattttaatttttattttttgtagagatggggttttgctatgttgcccaggctggtctcaaactcctgaactcaagcaatccacccacctcagcttgcttttctaattacaaattgtctcatttgaatcatggtctcattgtgtgatgcattcatgaaatttgaatgtttaagccctgtgttacttgacatccattattttcttttgtaatcagtaaatatggaaaagaatgtttaggcttatatgaatgctttagaattgcctggaggttaatgtttccaacatgctgataaatttctgacaaatcatttgggaaaagaaatttctgagattattacagaaactagtttctggtgtaaaaaaatgtttatagacatttatatatttatacatctaccatttggattttattctgttcctgagaggttcagaacagaggtaaaaactgctctagtccttttctaagaggaaaagatgtgacatttttgatgaagagtgagggaaaaggatttgtttaaatgattccaaactttaaaaaatgtaggtgggagaacaaggatgaaaaaggaatttgggaagaaacacttttttggtggggctggaaacatagtgtttcattgtaggtatctggagttagatgcccgcaggagccatgctgaggtgctgggtatcagtggctggcttttgggccagggatacgaggctagagttagagttagaactgtgagccctgacggatatagtgagtcagttaatatttaattgaataaatgcttcgttttataaccctaaattaggatttggaagaaggaagaagagacaagaggagttagaggtatggtttgagaggagccaatgtagtgtagtgttaccaaacctaggaaagaaatttcaagaagtagttagcattcattcattcatttgtctagagatctagctctttactcagaaagtgtttgtggagcattttctaagttccaggtactatggcacgtacagaggagagaaaaagaaattaaaacatattccctaactatgtcccaggtgcagagaggctaaggaataaaagattgatgaggccaggtgtggtagctcacgcctgcaatctcaaccctttgggaggccaaagtgggaggatttcttgagctcaggagtttgagaccagcctaggcaacataatgataccacccccacccccggctatctctacaaaataaaataaaataaaataaaaattagctgggtgtggtggcacgtgcctgtggttctaggtacttgggaggctgaggagggaggatcacttgagcccaggaggtcaaggctgcagtgagctgtgatcacaccaatgtactacagcctgggtgacacagcaagaccctgtctcaaaaaaaagtctgggcacgatggctcatgcctgtaatcccagcactttgggaggccgaggcaggcagatcacctgaggtcgggagttcaagaccagcctgaccaacatggagaaatcccgtctctactaaaaatacaaaattagccgggcatggtggcgcatgcctgtaatctcagctacttgggaggctgaggcaggagaatcacttgaacccaggaggtggaggttgcagtgagccgagattgcaccactgcactccagcctgggcaacaagagcgaaaatctgtctcaaaaaaaaaaaaaaaaaaaaaagattggtgaaagaatttgaaaagatctttgatctttaatgagaataattttagtagcatggtaaagtgttatatacaaaaaatactgcttttgacaacactcttgaatagttgaagcaaaattatattttttgaaagataagcatattgcataactttcaaaaattagtttctttattttaaatgcctattgacattttcgttagaaaaaaccccacaaactgatgggatcaacctaataagatcaaaataaaagtgaatttaaagaatgttggaagatacagttttgtgatttcattcacaaaacctaatacagcatccatgtggcatactctctttggtattgtttgtttgtttttgagatagagtctcatgttgtccaggctggagttcagtggtgtgatctccgctcacggcaacctccgcctccggggttcaagtgattctcctgcctcagcctcctgagtagctgggattacaggcatgtgccaccatgcccagctaatttttatatttttagtagagacggggtttcaccatgtcggcctggctggtcttgaactcttgacctcaattgatccgcctgcctcggcctcccaaagtgctgggattacagatgtgagccaccgtgcctgccctctctttggtattatttattcaagaaacctttggtttcctagagctgctgtacaaatgaccatggacctggtggcttaaaacaacaaattcattctcccacagtactaaaggcctgaagtctgaaatcaaggcatgagcagggccatgcttcgcctgaaggctctaggggagaatcctttcttgcctctttgagcttctggtggctgcattcattccttggcttgtggctgcatcactccagtctctgcctctgtcttcacatggctgccttctcctcctccttcttgtgcgtctttccctctcattcttttataaagacacttttcattggatttagggccatgacaagatctaggatgatttcatctcaagatccttcactttgttgtattggcaaagacactttatcacaggttccaggacgtggacacatcattttaggggctatcgttcaattcacctacacgtagtatgtgtcagacactacttagagctgggaatataattgtgactgtttctgctcccattgtggttacatttgagtaaggagactgtgctcgtataaatagaaaagttcagagagtgagaagtgctctcgaaggaaaaagataggttaatgggatagagagtggtagtggtgctgagttggggatgttacctaatgagaccatgggggacatttctgagcatgtggcatttggacaggaaactgagccagccagccatgtgactatatgggggcctagcattgcagaccaaggagtgccagggcaaaagctctgaggggagattgcatttggcataattaagggatgaatgtggctgctgtggttggagtgaactgaatgagggggtgatcttaggagatgagggaggaggagtgggtaggcgggacagagtcatcaggggcttgtatttggaatttagtaatgagagtccagttggaggcatttaagcacattgaatttatgtttggaaaagacgtttgtgactagtacgtagcgaatgtcttagtaggggtgggagtaggattggggactggggtgggaagagtggaaacagagagacccatcaggaagctgttgtagaagaccaagctagagatgatggtaacttgtgctagggcactggagttgctgagaactggtcagacttggaatgtattttggagctagagccagtatcttgctgtggggtttgaaggcagatacagatgtacctcatatcttggctttattgaccctgcagatactgctttttttttgttgtttttacagattgagggtttgtggcaaccctgctttgagcaactgtattggtgtcatctttccaatagcacatacttacttggtgtctctgtgaaacattttgataattttttcattattactatgtctgttatggtgatctgtgatcagtgatcttcgatattcttattgtaaatattttggggtgccgtgaaccacgcccatataagttggagaaacataattgataaatgtgtgagttttgacttctccaagcagttattcccctatgtctctccctctcctcaggcttccctaattctctgagatacaacaatattgaaattaggccaattaataatcttctaagcgttctagtgaaaggaagagtcacacatctctcactttgaatcaaaaactagaaatcattaagcttagtgaggaaggcctgtcaaaagccaagatagactgaaagttgggcctcttgtgccaaattgtaaatgcaaaggaaaagttctggaaggaaattagaagtgctactccagtgagcgcacaactgattaaaaaaagtgaaacagctttattgctgatatggcgaaagctttagtggtttggatagaagatcaaaccagccacaacatttccttaagccatagcctaatccagcgcaaggtcctcgcttcagttctgcgaaggctgagagaggtgaggatgctgcagaagaaaacttggaagcagaggttggttcatggggtttaagaaaagaagtgaggccgggcgcagtggttcacacctgtaatcccagtactttgggaggccgaggcgagtggatcacaaggtcaagagattgagaccattctggctaacatggtgaaggatcagatgattgttagcatttttgagcaataactgttttgaacaataattaattggacctgaacctacagtatctgtaaggtatgtacaaacagggaaaggaaggaattaagagtgacttttgaagggtagacacacaaggtcgctattgtgtgattttgtgtttatatgcagtctccagaatagactgatccatgaagacagaaagtagattagtggttgcccagggcctggaggagaggggatgggagtgactgcgaatagttaagggttgtctttttggggtgataaaaaatgtcctggaatcagtagccatcatggttccatgccttgtggatatactaaaaaccacggagttgtatacttttttaaaagggtgaattttatggtatgtgaattacatctcaattaaaaaataaaagaatggtccgggtgcagtggctcacacctgtaatcccagcactttgggaggccgaggcaggtggatcacctgaggtcgggagttcgagaccagcctgaccaacatgaagaaaccccatctctactaaaaatacaaaattagccaggcatggtggcacatgcctgtaatcccagctactcgggaggctgagacgggagaattgcttgaacctgggaggcagaggttgcagtgagccaagatggcaccactgcactccagcctggcgacagagtgagactccgtctcaaaaaacaaacaaacacaaatcttcgaatacttatgttaacaaagtaaagcaaagaggccaaggtgggaggatcacttgaggccagcagttcaagaccagcctggggaaaatagtgagaaccccccagccgcccagtctctacaaaaaataaaaaaattagtggggcatggtgacatgcatccatagtcccagctattcaggaggctgaggtgggaggattgcttgaatgcaggagttcaaggctgcagtgagctatgatcctatcactacacttcagtctgggcaacatagtgagatcctgtctcaaaaaaaaaaagtacaatgaagctaggtgtggtggcagggatgtgtagtctcagctacttaggaggctgaggtgggaagatcatttaagcctaggagttagaggctgccatgggctataattgtgcctgtgagtagtcactgcagtccagcctgggcaaacatagtgagacccccatctcttaaaaaaacaaaaaaagtaaaataaggtgaaattaatatattttacttaatatattcaaatattcaaagtattatttgaatatgtaaatgtaaaaattcactaatgaggtcttttacattttctgggtactaagttttcaaaatccagtgtgtagtttactcttagagcacatctgaatgtggctcgtggctgccatattggatggaacagctctagggcacagattgtgctactaatcaagtcccaccttgaggtgctgggactggccttttgaatgcagtgttagtcagcccttggccaggcagggtcgggggagctctcaggcttgatggagagctgtatagttgaggaacatggtcgagatgagggtgcaggtgtgagccgttagttgtcaacacagcagttagagaggatctgagtggccactgacaacatctgctacagcgggatggggaagaatggcctggcggaagagtcaagggtgggatgatggagctctagagttgacatgtatagtttcctggtgcttgagcttagtacagaggcagagcccagagaatcttgagtcttgaacatctctctcaaatattaggtgttcaacttggcttttggcagacactgaagattggaatggtctctaagatcctgaagactaaatagtctatttgaaagaaaagctgtgcttccaggaaaaagccagacctaattaagtgtcttcagagaagggcatgggctctgttacaatgcatgatgaaataccgtgtcataatacatggataagaccttcacctggaattttagagatgaagcaagatgaagtaaactaatgtttactttgaccttggtgagatcattttatagctccattaacccagttttgaggatagtttcttctttgaagcagaatgcattctgataatgaatttatctcataatgagttatttagtattattcatctgaatgctactgcgggtatgttaacaacagtagttttggttttggcagaaatagtgttcagattgttctttaagatatttgccagtggatttaccagttttaactgccacgtgaggccacatcttgcttatgaaagtaggtgctatctaatcttttttttttttttttttttgagatggagtcttgctctgtcacccagactggagtgcagtggcgtgatctcggctcactacaacctctgcctcccgggttcacgccattctcccgcctcagtctcccgagtagctgggactacaggcgcctgccaccacacccggctaattttttgtatttttcgtagagacagggtttcactgtgttagccaggatggtctcaatctcctgaccttgtgatccacctgcctcggcctctcaaagtgctgggattacaggcgtgagccactgtgcccagctggtgctatctaatcttaagaaaggatttttttccagccactgcaaacaggatttgtttccctgtttgcagtggctggaaggcatgcatccagtttgtctaaaagcctaccatttcccccgctttttgtgtaagttattgtgtgctgatgataatatatgcaagactgtgctagccatgttagacattctcatttaatcctcatagcagcattatgacctagataagtactattattatccccagtgtacaaatgaagaaactttctatatatctaggaaatgtcagagccaagatttgaatccaggtcagaatctgagtctagaccagaactcttattgactatattattctctaatggtaattcccaagtggttctggtataattttaagaaagaaggtgacagttacatatttggatttagttttcatgtaaaaccttacattttttggcactttactgtttataaaaactcatttgatccttttaataactccctaggaaatcagggaggtgtcatcacctacattttgtagatggaaacgggggcccagagaaatgattagctcaatgactcacagctgagagttgacccaagtcttgtgactctgagggtcaatgccacttcctatgtgccaagccattttcaggcatttcttttctatgtgtggaaaatacaggaaatcattattcctgtgggagagaaccagtggcaatatgttactggggagtcattttgcacacgctgacctctctcattttggctgtgattggctagcctttataaacagaattgattaaagttctttctcagaacctttgttgctaggaaataccttacaaagaattttggactgggcgtgtagccagtttgttacatgcttaacaaaaacaacaaacgttaaaattctgtgtagaggtccaaattagcagacttcttcaaacgttttccttcatttagaaaataaactttatgttgtggctttacacaaatggtctgagtgttgacctgattcttcatttttgaccttccatgaatgtctcccaggaggaaacaggaacagagcctttatggggctcattccaaaccagttcagacttgtcgtgggaatggttcacattggtagttgttctgttatagttgtgtttgcttgtacgagttctacttcttcttttttttttttttgttgagacagtgtttcgctctttttgcccaggctggagtgcaacggtacaaacttggctcactgcaacctcggctcactgcaacctccgcctcccgggttcaagcgattctcctgcctcagccatccgagtagctgggattacgggcatgcaccaccatgcccagctaattttgtatttttagtagagatggggtttctccatgttggtcaggctggtctcgaactcccaacctcaagtgatctgcccgcctcagcctcccaaagtgttgggattacaggcatgagccaccgtgcccggcccgagttctacttctagttactgggtaaccgggaggcatctatgctttttacagctttaggccacattattacaagttcacatgtgtgcaagctctgtggaacaatatcatatctttgagtagatattagtgtttatctgggaattgccactgtttttcttatctagaaataaaaaatttcagaaagctcttgaccaatctgtggttaaatcttataaccattacagcctcagcctgtgacctttgaaaagttaaagtccttgggactcaactttgtcataaaattggggataatactcttgtaactcacagttatgcttgaaggaatatatgagagatagtcttgatctttaatagggacacagtaataatttcccgttcacagttccttcttgttcttggtcttttacttggtaaaggttttattttataaactatatctttttgtatcttttacctccacttttatacagagattacattttttaaattaattaaataattaattaattttttctgaggagtttcgctcttgttgcccaggctggagtgcaatggcaggatctaggctcacagcaacctccacctcctgggttcaagcaattctacctcagcctcctgagtagctgggactacaggtgtgtgccaccatgccccgctaatttttttgtgtgtgtttttagtagagacgggatttcgccattttggccagtctggtcgcaaactcctgacctcaggtgatccacctgccttgacctcccaaagtgctaggattacaggcatgagccatggtgcccgactctttaaaaaatagttgtacaaatttttcagttcatttaaaaatgttgctataagaacattttgtttcttatttgagtcgttatcatcttagaaagttctaagaggtggtacctgttggttgccttttgctggtttttttcctccatttttttccttctagctttaacagtgactactgggaagttctctctctgtctctgtctgtctctctgtatctctctatctcttttctttttctcctttcttttctctcttttcagtggggtcttgctctgttgcctaggctggagtacagtggtgtgatcttggctcactgccacctcaaactctggggctcaagtaatactcccacctctgcctcctgagtagctgggattccaggctgtaccaccgtgcctggcttagtcacttttcttaatgtttttaagcattaagatacgctttcttcacaaacagttcaatgaatgagaaatatccttgattactgatattgctttttcatatttatcagccaaaccacttctgtaccagaaaatgtgaaataagaaatcatgctgaagacatcagcaaatataaaaagaatattttattatgttctggccactgttaaatttgaagctccttgagaccaagactctcgttttgtgtttttaaaagttctgtgtggtctgtgacatttctgaccctgctctatccttttgaatgatcagaaaggctttcttcaaatttgcttggcccctcgacaattcttgttttgcttttctggagatcgttttgatgcttttggtttctcttacataccaaggggctgtgtctgtagatatgatttcccttttgtaattatatttatggtatattgcctagaactacatttattgatcagacacgttcgctagaacctaactggaagaaatatcctgaaaaaatgttctaaagcccatcaagtatttgcaatttattttgctttcctttttttgtagcatgttctgtactattcaagacagtgcttaatggtgtcccgtaatcttggttcagtgggatatgatcctaatgaaaaagtaagtatttaaaagatattctcaacaactaaattaaacttatcatggttttactttctcgtctccacactgtgttcagtggacagatgagattttgttaaggctgtgtggtcattgatcactctagcattgtgtgtttctataggtgctcagtctttaggtattctgtttttcattgtgggccacagtctgaatctttttaattttgtatttatatctttagcaaaaattgaatgcatttacaatgtgtttcctttgtttccagcagaataactaagaaaacatttgttcttaaagactgggcatttgagagatttaattaaactattgagtttttctttcatttacttaatacttttttttttttttgagatggagtcatgctctatcacccaggctggagtgcagtggtgtgatctaggctcactgcaacctacgcctctggggttcaaacaattctcccacctcagcctcctgagtagctgggattacaggcgcccaccactgcacctggctaacatttatatttttagtagagatggggtttcaccatgttggccaggatggtctcgaactcctgacctcaggtgatccacctgcctcagcctcccaaagtgctgggatttcaggcatgagccaccgtgcacctggcctcatttacttaatatttatattatttatttatttatttgtgagatggagtcttgctcttttgcccaggctggagtacagtggtgtgatcttagctcactgcaacctccgcctcccggcttcaagagattctcctgtctcagcctcctgagtagctgggattacaggtgcgccccaccacgcccgtctaatttttgtgtttgtagtagagacagggtttcaccatgttggccaggctggtctcaaactcctgacctcaggtcatccgcctgcctcgagctcccaaagtgctgggattacaggcgtgagccactgtgcccggcctatatgattcatttagattgaaggtaattttgtgtattataaatttcaggacaaggggtttctaattaaaatgctattacaataatgtttgagccttgtagggactagaagaagtgattggaaataaaatatggtttcatgccttcatggcaatgaaggcatcgaagtgggcgggagttttggttaagaagggattgttcaaggtgagtgtcatcaaaatacaactgacaggaatgattatttgagaatgacatgtctgaggtatcttctgaatcatgtgctgaagtgcgcaatactgctttccagattcttttgaatctggaggcctggaggaagaaagagtctacatatcttcagttcagtagaaatacaatgtgaaacacagttgcagggtgatatggtttggctctgtccccatccaaatctcatctcgacctgtaatccccatgtgttgagggagggaggtgattggatcatgggggcagtttcttccatgtttttctcatgacagtgagttggttctcacaggatcttaagatcttacaagtgtttggaagttcctcctttgcactactctcccctgctgccttgtgaagaagggtcctgctttccttctgccatgattgtaagtttcctgaagtctccccagccatgcggaactgggagtcaattaaacctttgtttataaattacctagtcttgggtagtatcttcatagcaatgtaaaaaccaattaatacacagggcaaatgtgattttcaattttcctttttattttttatttttgagatggagtcttgctctgtcacccaggctgtagtgcagtggtgtgatcttggctcactgcaacctccacctcccaggttcaagcaattctcttgcctcagcctcccgagtagctgggattacaggtgtacgtcaccatgcccggctaatttttgtatttttagtagagacagggtttcaccatgttgggcaggctggtctcgaactcctgacctcaaatgtcttcctgcctcagcctcccaaagtgttgggattacaggcatgagccactgcacttggccaattttcaattttctaatagccacattaaaaaaaagtaaacaggcaaaattaataatatctcaatatctaaaatgttatttaagtacataatcagtataaaaagtattaacaagacaccttagattcttttttttgggccctaagtcttctaaatccagtgtatattttatacctctggcatatctcagtttgattagccacatttgaagagcccaataacctcatgtggccagtggctactatattggatagtgcaggtctattgaattagttatgataaactccctgttatgaaagctgtagtttaatttaaaatcttcatcataggtgatatgctttggggttcatgtatccatgtgttgcattccaatctcgaagtaatcagctatcctaagtggctacactcttaagagtaattaactaacatttgttgaagaggacacattatagaggggtggaatactacaaacggttcagccatctttctccttatacactggtagccttcctcattagcgtaataactgttagaagtgggctatcagccaggtgtgatggcccacgcctgtaatcccagcactttgggagtttgaggccagtggattgcttgaggtcaggaacttgagaccagcctggcgaaaccctgtctctaccaaaaaaaaaaaaaaaaaaaaaacaccccacaaaaattagctgggtgtggtggcgtgcaccagtagttccagctacacaggaagctaagttgggaggatcacttgagcccaggaggtcagggcttcagtgagccatgattgcaccactgtactccagactgctaggctaaagggcaagatcctgtctcaaaaaaaaaaaaaaaaaaaaaaaaaaaaaaaaagaaaagaaaaggaaaaaaagaaacgggctgtcattgaggaagtttgtggtattcgtcaatatatgttattggctattgctttagggaaattctgtgcctttgtactattagaatgtaataatgtagttggcctttaattctttacctttaaggataatactcgggcccgatccctaaatgaatagttctgtgttcagccacttgtctggtggattcttgatggcttagtctgacagtatggttagccaaagcagaatattgtttttttttgcctatggtgagcctttcttgcagtcttttggagccttacaaagtacaggaagttaagattccactgaacttatcaagcaggttttatgattctttttatgtcttaataaatgtttgtatgtgtggacagagtttggtctggtacttgctttcattataacctcatagtgaagttacagaaatagctaactgacctcccacattggtgaccactggtaattactaaaaataaataaatgtatgtaactgtctgggtttagcacatttatttatttatttttgagacagagtctcgctctgtcacccaggctggagtgcagtggcatgatcttggctcactgcaacctccaccttccgagttcaagcgattctcctgcctcagcctcccgagtagctgggattacaggcacacaccaccacatccggctaatttttttttgtatttttagtagagatggagtttcaccatgttggccaggctggtctcgaactcctgacctcaggtgatccacctgtctccacctcccaaagtgctggcattgtaggcatgagcgaccgtgcctggcccaggtttagcacatttaaagagatacgagggataaaggtgtagaagtggaatctccttggaattcacttagcatgtttcgtcataaatcctgaaatcaattctgctccctgctatctttgccatctcctttgctgtgcccttgcctaaggtgactgtggagaaactgtgtttccctcagtgagtgatgaatattctttggcacctattcatagtacaggtacatgttcagactaagttggtcgcttcacccttcacttgagggctgcacttaatcagacctttctccttcccggattcctgctgtccttgtaaccattcattaaatactgacctggtttgtttatacctactgtcccaagtgcaagtagacttggtctttggtgtaatacatatttgttaaataaattgattctcgtttgaatctgttattaactcatttcttattccacattttatcagtgacttacatcatgtgcaaattatccgggtgaaatttaatcattactgaaaacgttattttttttaacttgagttttaacaagctaacttgttgtcttatgtatgttcatgagaataaggaagatttaacttatggtagcttgcttggatcaagaccattaagtttcagttggccttaagttagtgtgagccagtacagtactgtgttgttcctgtcacactgatgtgagctggctgggctcagtggcttacgcctacagtccctgcgctctgggaggccgagacacgggattccttgagaccgagagttccatatcaacctgggtaacagagcaaaaccccgtctcttaagaaaaaaaaaagtgatcttaggtgttattaataacatagtgtttagagcttgcattgttatactctgattacattatatcatgatatttctgacatgaatacctggatgtgaactctctgactttgccactagtgaactttgtaagtgatttaaggcaagtgatttggcctcatcaagccttagttttcttatttgtaaaacggagatattatcagaactgacttcgtgggattattatgctaaatattgtcatcatagccattacctgatagatgagataatgcacagaagagattcatcacagtgcctgctgtatacaaaacgtgtcctaagtgtcggctgcttaatgtccttaactgaattttgcacatttggaaagcaagactcaaagcccatggatagtgagtagctgggtgtaaactcatgcctgtccttttccagagctggtggacttacccattgtgctgtatcctttctcagaagagttgggcaagtgacccagtgtccagagttctgccgtcattccaacaagtacccagtgcagggccagctcagtcctcttggtctctgaatggagtgtggtgctagctatggagttagagcctgggagagagcatctaaacctagggaagggaaaggaagaaggagggatagagagagaatgggttaagagaaaaataacaacagcaaaaaagatccttaggaaatcttttacttcagatgacattattagtacagttatagagcagctactgccaaagttcttcattatctcttctggtacctgaattctcatctatcttcaaggatccaggatcctaatttatagttgttttttcctgagtgtcttcagggtgccttatgagtgactctccacatataggatcaagtcccagttccttgaatggcatatgagtccttccatcatctggacttttttttatcctagctttatttgctacaactctcctaagcataccatgcgcttcagtcatattgagaattccttgtagttgcttagtgctaccctcttcttccagtgtcacggcctttacacatgctgttcatgtgctcccttctctgtgtgtagcatcctgcacaaagccttattagagcatttaacacaatttgttgtgtttgtgccatattttactttgaagttgccaaatgcacttgatatttacctgtaattgttgatgcagaggggcagttttaaggttgggtttaattgatttgtatgcatattcttttataggcatagcctacctggaagaatatataggagaccagtaacagtggttgccttttgggcagggacttgggtgtctcttcagtgtatccccttttgtactttaaaaattctgaattatatgcatctatgatttatttagaagaaaattttatgtatggaagattaattgatatgattagttttattgggttttatgcgctaattggtaatacattaatagcccttaacagagaagatgtgtcaggtgcaggtatttgttttgttatagcttttccccagttagacagataggggcacactcctaaattcataacagtctggcatgtagcccaaaggggtgaagaacagtagccatagctaatgctgaatgagtatatattacatgctagacattattctaaacactttaagagtgttaattcaaatcattctcacaacctcttgtggcaggtgctgtttttacccttattttacataccaggaaatgagaggcaagaagggtgacttgttcatagcaggacacacaggaggagaacatagaatgttgggagttcagcctgggtggcttggctgcagactgactcgtaatgaccattctgctgcctgaacagaaattagaatggggattcttgcttaattcttccattgttatcatgatttgttgtattcgctgtaacaattgcttaatatgtaatttctaggagtggtgtttgtggtgattatcagatgtggtctgtttcacagttaatattaacatcatattttaaaacccatttaagaaagtgtaaacattgtgttctcaggatatgcttactgtttaagaggggtttaccatgaccatttaaatacagaaaagtagatgattatgcattctcagacctgagatgtgagcaaggctctgagtggcttcgagttttatcacattagaagtttacctatttttaaggcaggggcttggctcgggttggaggagttaagacatatatgatgtaaaggttaaaccaagacctagcaagcttttttcacttctgagattctggactttttcctgtatgttaaaatactgctctaggccgggtgtggtggctcaggcttgtaatcccagcactttgggaggccgaggcaggcggatcacctgaagtcaggagttcgaggccggcctgaccaacatggggaaaccccatctctactaaaaatacaaagaaattagccgggcttggtggtgcgcacctgtaatcccagctattaggaggctgaggcaggagaatatgttgaacctgggagacggaggttactgtgagctgagatcgtaccactgcactccagcctgggcgacagagtgagactccatctcaaaaaacaaacaaacaaacaaactgctctaggttatataagagtactttttaaaaggtcatttataactctaactcttcttttagaaatataactgacactttttttctgtagttccgttgaacttaaaaataattcacaaatacagaaattaccgtgtgctaatgtgtattacatccaaattacttggaatggtgtgttttgaaaaacgattagcttgtacaattttagagtaggaagaaaaccttactaaatagctttccatttgagtgctaccagtttatgtggaaatcaaggcctacagagattgatttacttaaagttaaataggtcattagtggcaaagctggacttgggtttaggtctctagataaacacaggatacacaacttctctactgtttggtctcagctgcttcaaaatttggtggttattcaaacttaacattggattcaaatggtgtaatctgcttagtctgggcatttttggatatatgcacaattaggtacctattctgagttactgaaaatatgccctgtcccaacagagatagcagataaattatacttacttagtatcagacttccctttgaaaacaactcatgacacttagaatttcccagaatttagaaaataaattgtcaagtaattttggccaaagtgttttttttgtttatttatttatttattttttgagacggaatcttgctctgtcacccaggctggagtgcagtggcacgattttagctcactgcaacctccgcctcccaggttcaagtgattcctgcctcagcctcccaagtagctgggattacttgggattaccagcacttgggattacgggcatgcaccatcacgccggctaatttttgtatttaaattatttatttatttatttagagatggagactcgctttgtcaccagacaggagtgcagtggcgtgatctcagctcactgcagtctccgcctcccgggttcaagccattctcctgcctcagcctcccgagtagctgagattagaggcgcgtaccactagacccagctccttttttttttttttttttttttttttgtatttttagtagagacagggtttcaccatattggtcaggatggtctcgatctcctgacctcgtgatccacccaccttggcctcccaaagtgctggattacaggcgtgagccaccgtgcccagcctttttgtatttttagtagagatggggttttaccgtgttggtcaggctggtctcgagctcctgacctcgtgatccacctgccttggcctcccaaagtgctgggattacaggcgtgagccactgcacccgggcttgaccaaagtcttttagtgtctgaaatatcatttgaagattttcttttggctacagaatatgtagatacccccattgtgaatacattaacctactatgctttaacaaagtaattatagaacccgatcatatcagatgaattttgtagttccctggttgtaaacggttatactatttaataacctattttaatattaccctaagtatttatagtacatttaatattactgtaagtaatatagtatttaatgttactctaggaagtaatgtttattagggttatattcagtgttgatgttggaaaaacttggtgttttttggtcttaaaccatcggtttaaaagtaacaatttctaatgaatgtgttttttctctcttcagacttttgataaaattcttgttgctaatagaggagaaattgcatgtcgggtgagtagaattttcgtcttattttccattttactctgaaattatttattaaacccctttaagtgtgaatcactattaatagacattaatatattttaaaataggttattagaacttgcaagaagatgggcattaagacagttgccatccacagtgatgttgatgctagttctgtaagtatatttttgctttgtttaaatcaggacttaattttgggtcaagcagaaaaagtgagacatacaggctttttttcttggcctgcacaagatacattcaagtttaaaaactgtttacttgttcactgttgtgttaagcaaaacgacagtatcacagtatcttctatatgtgccgtaagtattttcttttcatagctttaaaaacttagacagaaaaattgccaggctgattgctggtcaccaagtagatttaagcaaagcatgagaaaatttgagtcaaagattaatgaaatgtttacacagtgctcccttatgagagcactttcccccagcatagcttcagtatcactaagggaatgctacaattgtttaacctttcctaaatgcttcaacgtgttcagctgaaagtttgacaaaaatgaaaggtaggctaatgctaattggatacaaacaaaagaaggtttagcataaagcagatatacttttatttggtacttttaacacagcaggccttttttttttttttttttgggacagagtcttgctttgttgtccaggctggagtgcagtggtgtgatctcacctcactacaacctctgcctcctgggttcaagcgattctcccgcctcagcctccggagtagctgggattacaagcacctgccatcatgcctggctgatttttgtatttttgtagagacagggtttcaccaagttggccaggctggtgttgaactcctgaccttaggtgatctgcctgccccggcctcccaaagtgctgggattacaggcttgagccaccacacccggcccacagcagggattttttttagtagtaatgttatgaatgagtagaaaaaaatcccatggggaaagaatgtaaattattaaatctttatggcatgaaatataagtagttgaatactaatgcaagcattgtttctcattgtctcatactacttttgataatgggaccctttggtagggtccatcagttaatgacagggatatgttctgagaaatgcatcgttaggtgaattcaatattgtgtgaccatcacagaatgtacttacacaaaccttgatgatacagcctagtacacacctatatagtatagcctattcctcctgtgctacaaacctgtgcagcacgtgactgtactaaatactgtaggcaattgtaacacaatggtaagtatttgtgtatataagtgtatctaaacacagaaaaggtacagtaaaaatatagtataaaagataaaaaatggtacacttgtatagggcacttactgtgaatggagcttgcaggactggaagctggtctggatgagtcagggagtgatcaaaggcctaggacattaccgtcactactatagacttcataaacactgtatacttaggctacacgacatttatagaaaaatagttttctttcttcaataataaattaaccttagcataccataacttttttaaattataaacttttaaattttgtctttactctttgactctttcttttttttttttttttgagacagagtcttgctctgttggccaagctagagtgcagtggtgcagtcttggctcactgcaacctctgtctcccgggttcaagccattctcctgcctcatcctctccagtagctgggattacaggcatgtgtcaccacgctcggctaatttttgtatttttagtagagacggggtttcaccatgttggccaggctggtcttgaactcctgacctcaggtaatccacctgctttggcctcccaacgtgctgggattacaagcgtgagccaccacgcccggtttactctttgactctttcataataaaacagcataaaatgcaaacactgtataactgtacaaaaatgttttctttatatccttattttataagcttttttctgtttttaaagttttttatttttcatttatttttgactttttgaacttttttggtaaaaacgaagactcaaatgcacacattagcctagacctgcagaggatcaggctcatcaagacatcagtaggcatgggatcacatcaagttagaaagcttctacacagccaaggaaacaacaaaatgaagagacaacccacagaatgggagaagatatttgcaaactacccatctgatgagggattagtaactagaatgtataaggagctcaaacaactctataggaaaaaaatctagtaatttgattaaaaaatgggcaaaatggccaggtgtggtggttcacacctgtaatcccagcactttgggaggccaagcgggcagatcacttgaggtcatgagtttgagacctagaataaataaatggatgtttaaccagcctggctaagatggtgaaaccctgtctctactaaaaatacaaaaattagccgcgtgtggtggcacacatctgtagtcccagctacttggagactggggcaagaagcttgaacctgggaggtggaggttgctgtgagccaagatcgtgccactgcgctgtagcgtgggcgaccaggcgagactatgtccaaaggaaaataaaaaggggcaaaagatctgaatagtcatttctcaaaagaagacatacaaatcacaaacaggtatatgtaaaggtgctcgacattactgatcattacggaaatgcaaatcaaaagtacaatgagataaaatcttaccccggttaaaacggcttttatccaaaagacataacgagtactggcgaggatgtagagaaagaaccctcatatgctgttggtgggaatgtaaattaatacaaccactataaagaacagtatggaggtttctcaaaaaactaaaactatcatatgatccggctgctagatgtacatctgcttctaggtgtacacctagcaccagggaaatcagtatatggaggagatatctgcactcccatgtttattgtagcatttttcacaatagccaagatttggaggcaacttaagtatccatcaacagatgaatggataaagaaaatgtacatatgtacggtaccattcagccatagaaaagaatgagatcttgtcatttgcaatagcatggatggaactggtggaggacatgttaagtgaaataagccaggcacagaaagacaagttttgcatgtactcactcatttgtgggagctaaaaatgaaaacaattggactcatagagagagagtagaaggatggttaccagaggcttggcagggtgtatggagcgggaggggtggggatgattaatgagtacaagaatatagttagatggaataaataagatcttgtatttgatagcacaacagggtgactacagtctgcagtaatttgtggtacattttagaataatttagggaatagaattgggatgcttgtaacacaaataaatgaatgatttagatgatggctaccccatttatcctgatgtgattattatacattgtatgcttgtatcaaaatatttcatgtactccataaacatatacacctcctgtatacccacaaaaataaaaaaagacatcactaggcaaataggaatttttcagctccattattggagctgaaatgtagatgcagtacattaccgaccaagctgtcatatggcgcatgattgaattctgatctacaggtagacttttcagactttgcaaaagtggtttcaaaagaattgttgttaggtttttctcatttgtaccttccctgaagcagatgtggtagttttacattttagagacttttcaccacttctggctgaaagcagtagggaatataccagagattatgatacataatttataataaaatttaccagaccccacaatggaagcaattgcacactcagtcaaaactttctcttactatgacctactttaggtcaatttctagaaagatactataagtaaaagcaggataatgatggtgggaatgtcaaaagtttcatttaaacctcaacagtagggtcaaatctgctatgtggtttctgtttcagtctcaaggaggctgaaaaggtgaattcctgtaacagcatcttttgcatcctcagcacgtgatcacagaggttactatcatagctaatcagctttataatatcagtaatatgaaaaagccatgctattcagatgtattaatttttgcatgtttgttttcaagaggtgagcattttaaatgtaacttggagtaaaaaactttataggctttgtatgttaatttcacatgtggaaatgtaaatactattccagtaggaaaatactgcaacaattgattgcaaaagctattcattgtctattataaacaactaatttttaaggtaattatgcaaggaaaaagatgaatggatactgcacatatcaactaataagtcacacaaggaaggaaagccagctaacttgcaaacaattaatgtttgatagaaaaatgttggcttttagagatgattatgcagtttacctctgttggtcccttccctccaacatgttcttcaaaattgtcttcagtattcttggtccttcgctcttccatgtgaattttaggatgagctggccaattaccccccttccccaatttttagataccatgaacaagatttttataagtataacttttgcatgtctttttgtgaacataattttgattttttttgggtaaatatctaggagtggagtagctgggtcttagggtagataaggagttggcaacctttttttgtttgaaagtaaatacatttttgtctggatagcaaatatattttagattttgcaggcccctgtggtcgctgttacatatgcttctttttgttttgttttgttttgttttaacaacactttaaaaatgtgaaaactattgttagcttgagagctgtgcaaaaacagcccttggatcagatttggccagtgggtagacagtattttgctgatgcctagaataaatacatgcatgtttaaatttataagaagctgctaaatagttctccttcatggttgtatcatattttactccctccagaaatgtctaggtcagggtgcttttgtgtccttgccaacacttggtgttttcagtccatttgattttgtgttttatttttaagtggttgtgaagcagtatgtcattgtgtttttaattttagattttcctgatgaatactgatgttgagtacttttttgtgttattggtcattcatttatatttttttctgaagcatttcttcaaacataatgaaaaaaattagaaaagtagtaccagtatattggtatcagtttactgttatataccagtataacggtatctgtatacccttcacctagattcagcaattgttaacattttggcttgtttgctttatatttgtatccatatgtacattgtgtgtgtgcattttttttttttttggctaaacaatttgaaaataagttacaggacatggatgaagctggaaaccatcattctcagcaaactatcacagggacagaaaacaaaacactgcacgttctcactcataggtgggaattgaacaatgaagacacttggacacagggtagggaacatcacacactgtgtcctgttgtggggttgggggatgggggagggatagcattaggggaaatacctaatgtaaatgacgagttgatgggtgcagcaaaacaacatgagacatgtatacctatgtaacaaacctgcacgttgtgcacatgtaccctagaacttaaagtatatatatatatgtaaaaaaagcagcattaaaaagaatcccctggacaggaaaaagaaaaaaaaagaggccgggcgtagtggctcacgcctgtaatcccagcactttgggaggctgaggcgggcagatcatgagggcaggagatcgagaccatcctggctaacacggtgaaaccctgtctctactaaaaatacaaaaaattagccaggcgtggtggcaggctcctgtggtcccagctacttgggaggctgaggcaggagaatggtgtgaacccgggaggcggagcttgcagtgagctgagatcgtgccactgcagtccagcctgggcgacagagcaagactccatctcaaaaaaaaagaaaaaaaaaaaaaaagaaaataagttacagacattgtggcattttacccgtaaatactattcatctcgcagtaataagtatggttttctacatatctataataccttatgaaacctaagaaaataactcattattctataatatcatgtaatatgcctaccacattcaggtttttccagttgaccccagttgtcctttttaatatttttctttgatccacagttcaatcaaggttcatgagttacatttgtttattatacctctttagtctcttaatctaaaatagtgcccctattctccctctttttttgtttgatttttattatgttggcttttagatattttggctttgtatggaatctattttctcatgaatagattcagattaaatatttgacaagactacttcataagtgatgttctttctttttttcttttttttgtgacagagtctctctcagttgcccgggctggagtgcagtggtgagattataactcactgcagcctgacttcctgggcacaagcgatcctcccaccttagtttcccaagtagttgtgactacaggtgcatgccaccacgcctggctgatttttgtattttttgtaaagatggggtttcaccatctttcccaggctggtcttgaactcctgggctcaagagatcctcttgccttggcctcccaaagtgctaggattacaggcgtgagccaccgtaccccagccagtaatgttattttttttaatagtaatatcataacaagaggttcttaatgttgaattgttctgttgttatgctaagtatgatcatttggtttcatcaggtcttcccattataatggtacattttctttttttttattaaataatttttggggtgagtttttgaatccttgtgaatattttgtccctcaaccacctctcatctaatgtttttgcatcgataatgaaaattgcctgagcctgattactttggttacatttgtcttgtttgctgtctgtggagtaagctgttgattttctgctcctttttgaatctgcctgtttttatgtattatcttttttcttatgtatttgaggcctttagtatatttatttttagcatatttaatttaaagaatctatcatattattgtattatttcaagtttgtgggtgtttatttctattcctgactcttcctcataacatattgtttcctcgcatgtttaaattttggtgtgtgattctatgtttggtgcttttgttgttgaatttcaagatggtttgggttatggatttggccaggtaggataggtggtatatttgtttccatcacaccctccagggtatcactcatctgggactaatttttatattaaatttttggcataaagattgtcaaattttgaagataatgggaagaacaaaatgagattgcacacacacagatacacacctgttgaataggctcatggtttctaatatctagagacattttcgtttactttgaaccacagagatacgagcatagggtttatcctctctatttcgtaggttgattcctcccccacaacctttcactgagaatgtaatctttgagcctcctggctttagacagaagggtttccttcaaacctccaactcacacgggatctgtttcctttctctgatcgttaaaacccaatcttctagattattgagattcccaccttcactctccaagactggctcttgtggatgcagactgattttcatttttatattatttatttatttatttatttgagccggagttttgctcttgttgtccaggctggaatgcaatggcgcaatctcagctcactgcaacctccatctcctgggttcaagcgattctcctgcctcagcctcccgagtagctgggcttacaggcatgcatcaccaaactactgaattttcagtagagacagggtttcaccatgttggccaggctggtctcgaactcctgacctcaagtgatccacccgcctcagcctcccaaagtgctgggattacaggtttgagccaccatgcccagccagattttcagattactttttttttttttttttttgagacagagccttactctgttgcccaggctggagtgcagtggtgtgatcatagcaaactacagccatgaactcctgggctcaagtgattgtcctgcttcagcctcctgagtagctgggactacatgcacatgccgttgtgccctgcttcctttttctttttcatcccttgtagtttttttgtgagccaagctcttcatttgaaggatgtttgttatatttaatctaggtctttagatgtttctaaggaggatttgcaggttatttagttggcttattgttggtttgtcttaaaacaatatgacatcctattctttgttgaggaaattcccttaatttctttgagaaataaagactgatctagagcagtcttaaagtcaggctttccctaggaaaacaattcatttataatgatgagattaatgtgcctgaatccaggggatgaggctatagggaagcagtataaaatactccaatgggaattggtcagggcaggagaaagcaaaatgggagttaagcctcttattaagtcatgaatttttttttatgtttcattttccaggccctaggaaagcacgcttattattctctgggaagatttgtggagaatagtttatgaagagaagacaattctagtgcaagaatgtaaccagctgggattttgattgatattgcattgtgtctgtagatcattttggagtgtatagctatctcaacgtttttaagtcttcctatccatgaacatgtgatattcttccatatttaggtcacttggatttctttcagcaatgttttgtagtttcatactactataagtgtaattagttttttaatttcaattttttaaattagttgcaagtctgtagaaatacaaatgattttcatataatgattttgattcctgtaaacttgctgaactcttttattagttctaatagttttttagtggatttcttaggttttttttttttttttttttttttaaagatggagtttctgtcacccaggctggagtgtcgtggcatgatcttggcccactgcaacctccacctcccgggggtcaagtgattctcctgcctcagcctcctgcgtagctggggttacaggcatgcgccaccacgcacagctaatttttttgtacttttagtagagatggggtttcaccatgttggccaggctggtctcgaactcctgacctcaagtgatcctcccgctgtggcctcccaaagtgctgggattacaggtgtgagccactgcgtctgggccttaggattcttttttttttttttttctctcttgagaccgagtctcattctgttgcccaggctggagtgcaatggtgcgatcttggctcactgtaacctccgcctcccaggttcaagcaattctcctgcttcagcctccggaatagctgggactacaggcatctgccaccacacccggctaattttttgtatttttagtagaggtggagtttcaccacgttgaccaggctgggctcaaactcctgaccttgtgatctgcccacctcagcctcccaaagtgctgggattacaggcatgagctactgtgcccggccaggattctttatataagatcatgtcatgtgtgaatagagatagttttacttctttccatctggatgctttttatttcatattcttgcctgatttctctggctttaacttccagaacaatgttgaagaggtgagaggaggcatccttgtcttgttcttcatcttagggggaaagcattcagcatttcacccttaaatttgatttaggctctggtattttcatagactttcattatcaggtggaagaagttaattgctattcctagtttactgagggatttttatcaagaacaggtgttgcattttttcaaatgctttttctgtgtttactgagatgatcatgtggtttttgtcctttatttatatggtgtattgttacattaattgatttttttgggtgttaaaccagccttgaattcctgagattaatcccacttggtcatgctgtgtaatcctttgtatatattgctggattcagtttgttagtattttattaattttgtgttcatatttacaagagatattgtctgcagttttcttatgatgtctttgcttggttttggtgttagtgtgatcctggcctcatgaattggaaacctttctctcatcttctagtttttttggaagaattggtattaacttttctttaaatgtctggtagaaatcaccagtgaagccatctgaatctgggcttctctttggttagtttttgattgttaaatctacctttttacttattgtaggttttttcagatattctgtttctttaatcagtgtctgtagtttatgtctttctacaaatgtgtccatttcatcaaagtttctagcttattggtatagtattttcttatttttattttataaggtcagtagtaatgtctcctctttcattcctaaatttagacatttgagccttcccttttttcttggtcactggcctagtctgttcaggcttgttatggattgtcatagtctgggtggcttataaacaacaggaatttatttctcatagttctggaggctgataagtcaagattgaggcactgttagatgttgtccctggtgagggctcctttcttagtttcttagtggagccttcttgctgtgtcctcacatggtggaaggagcaagggaaggatctcattcatgaggtctctgccacaagtgttctgaaatagcattccagaagtacaaggtgatacagttagtcaagagctataaattggtggataggaaaggcaaaaataagaagattgtattgagtttctagttatacaatgaactgaataactccttttcttttgagacaaattctcactctgtcgtccaggctggagtgcaatggcaccatcttggttcattgcaacctccgcctcacaggttcaagcattctcatgcctcagcctcccgagtagctaggattacaggtgcctgccaccatgcctggctaggatttgtattttagtagagttggggtttcaccatattggccaggctggtctcaaactactgacctcaggtgatccaccctcctcggcttcccaaagtgctgggattacaggcgtgagccactgcacctggccctgaataactctttagaaacagaaaaaatctctggtggttggttaaatagtaaatataaataaatctataaatttcctatatatcaataaggtagaaaatacaacaagaaatgtaacctcgtagaagcaatggaaatgataaaacactgtatgatgtgaatttaaaatgaaatttttaggacttacatgaggacttcttatttttgtatagggaaaccgatttttaaaaatgctcttttctgtacattttctattaaatcctaatataacaacataatggggggggattgacaaagagtaaatatgcaagaatagcctagataattctgaggaaaattgatggggagtagcctaacatattaaaatacattttaatacattgtaagtcagcaagaagacataggtctatggaatacatttgttagattttaggcagtgggatgatgtgggaggatttttgagttgttaaagagggtctcatgaatattatgtggatttagaagacaaggtaattctaggattgcttgcctctaatttactgagatttttaggtatctcagagaagataagaaatataaggaatgagaaatgtttaatggctttagtgactaggagtttctaaatggacacatgggcccatttcattagtttggtgaatagtgagagcaaagaatttgggaatttaagattgttgtacttctccaaatgaatgttttaagtataaagactagtatgtctttccacaaaaatggtaaaatatattgtcacatttatatcaaactgctaaaataagttttgatattttttaaaaaatgagatctcatcaggttaaatgaaaagagttgagaatcttcattcccaaagaggaaaatgattctgtatatcaacagaatcattcaacctttgactgtattctctatctacgttcctaaattgaacctatctatacatattttgttgctttgtctgtgtacagtcatgttggatttaaatgagaaatatctgattttaccacgttgaaacaagaacctaaaattagggaagtattcactgtgactcacatcttacccaggcagcctgctgttgaaaggatgatccctggtgcgcactgtagtctcagcctcaggattctataatgagattgagtggggtttcctgtgagcactctggggtgattgacagtaaggtgagggcagtcatcactttttatgcctacccttgatgatatgtccctgctgtctggggagggaccgaggacgaataggacttggtgatgtctaagtaattagtgtatgttggttccagctgaacaaactggagggtaatgatcaggtaaatggaaatggaacacattaatgcagactaaggtataaaagaccttagggttaaacttttcaacattttatgggattattagaatatctttatttcattttttatatttacatgtctctgtatatacatacacttatttatatttttgtcagtgtatcttcagttttaccttagatgtatatagagatgaaagcaacttaaatgtgaaaacctcaaacgcattttttctcctttacatgatttcagaatattttcaaactttttctgtttggaaaggagttaaggttcttaattaaacattttctttttaatttcacaaaaattgttaatggacttgtttggagctgatgcctatcactgatcctcaaataggagcaaatgactaaagtcaggcttggaaaacttttttggggtgttaactgaaaagtatcaggtgaccttttatttgtgtgtgtgtgtgtgtgtgtgtgtgtacttgagaatgttatatttcagtaacattttcttaaactgccttttcttagtaaaggatattttaagatgatggctgtcctggtccatgtttcacagttggtcttaattagatcagaaatatttccagacatttaggttgcaataggaaatctataggattcttaatttattcttacaaaaggtatttatagttgccattcttcaatattaactttccttatcaacagcaaaaagtcttacggcaaagcctctggagagtgactgcagtactgcatttaatgggaagggaggaattgtttgccttagtatatggttttgaatctgggagtctggtaattaggtaatcaaagggtttaaaaaatggcataatggctttaaaacttgctattgctcacttttcttataaaacttagctttcagaaatctttttagattaagaatacaatgtacctactatgcaaatttaaaacaatagacttttcattaaagaactaaccaggagaagaaagcatttaagatgtgtagacatttcttttccttttctttttttcttttattgtctttggaaaaacttattttgcagaaacagtatactgtatcaattttaagtgttttgattatctttgacttggctaaattattttctctgcatttttgggtaaaatggaataggatgggattcctggtaggtatttgttcacattaatactatatttaattggagatcctgcagaatagtagcaggaggctgaagagaattatttagcattagcaatggctcgtctgggagttgtggactaatcaaggcgctgtagtgttagtggtggggatgatgggaattatgacgattatgacatgtaagcatgtctgtgtacgaattggacaggcaatgagttaatcaagaagtatgttaaatggctcccatgctgattcattattatctaccatagtgcctgtcaggttgtgtatttaaaaaacacaatcattgccaaattcaatatgtatatgagctgaattcagccattgtttgcttttccataaaataacctcagatttccttatatgtataaaaatagaaaattgtgtcaactgtgctgtgatttgtgtttatagtatggtatcttttttttttaacagagtcatttaaacctatgtttgctttgccctttcatatattcgtgtaaatattctctggcttgttttctatgcataaagggtttgggtttgaaagtgaaatttatgtgtctttacttttcaagatgaaaaaataattccagtatttcagagacaaattaatatttaacacatgaactatggacaaatcaaagcatgaatcttttccaccatcaaaatgcttgaatttaaattgggggtgggggtggaaacctcctttgctgtagcggggggtctctttgtgccaggtagacagacccattctgtgcccagcatggttggggttatctgtcaggaaactatctattagaaatgctagaaatgtatgtattttgggggaatggaactaataaattgaattccttttagaaaataaattgaaatgcagcataaatccatgagcaaactggattatatctctaggcaaatttaaagagttattgtacagatgaacaccatttttttttattattgtgagcactgccaaatttaataaaactttctaccaaactgtgactttcatgtattaacttaattaaagcagtgttatgggtaatactcagtgttaacctgtggatggctgttattgaaatccattatcaatggagtcagtattagtggtcagcagcatcagaagtaaaacttgcaaccaagaccctcccatgggtgctgtgagctcagcaggttaaattgtcaaaaaccagtaaagcttcttaaaggactgatagcttaagccacccggagttaaaggtaaactagtcattccagtcaagatggactatgactttatttagcagtcaggcaaaaattatatttgggcaggatttatatcagtatcttcatgtatgacttattcatttgtatgttcatgtaccttgctatttaaattcaataaaaccatccagctttttttaatctgtgggaagtgacttgtggatattttcttttataaaacgttaaggagatgtcttaagactttctgaattttttgttaataacttatactgaagttactttttacttatactaaaattttaaattaagaaaaaagtgaaatattgtattaatatatctttttggttttgtttattttataatttctggtaaacttaaacaacatggttttaaagggaatttatgtatttcagtgtaattagtacctgctgttatgaaaaagcacctaatcatggatttatttttctctaagcagctatttgggaaggatcagaagtcctatcttactgaaaaagcatacatataataaaagatttgagggccgggcgtggtggctcacgcccgtaatcccagcactttgggaggccgaggcaggcggatcatgaggtcaggagatcgagaccatcctggctaacacagtgaaaccccgtctctactaaaaatacaaaaagttagccgggcgtggtggtgggtgcgtgtagtcccagcttctcgggaggctgaggcaggagaatggcgtgaacctgagaagcagagcttgcactgagccgagatcgcgccactgcacttcagcctgggcgacagagctagactccgtctcaaaaaacaaaaaacaaaaaaaaagatttgatatacagtttaccttattctatgttccagtgtttctaaggccatgacttaactcatttttacagcctccctcattcagactccttagtggagggaaaggacatgattattccaaataatgcctctcactcattcagaatctatggtgtactggaaaagcacataattacataaggattgaattactgttactgttttaaattgagaaaattggggcttcaagtataaagccaatcttcgggttgccaaagatcactgggctagtaagtagtggagctgagattcaaattatgtgtaacttctaagttgtactgtttccactgtgcatgttgcttctcatactaagtatgaggaaaagtcccctcccaccacaaaacgaagtgaagtttattactttgaaggcagagtttttattagtgcctgttggaggctgggtactatgataggtactggaactagaagagtgactggaagtgataggattgctgctttagagatgggtatagagaaataaaacataaataattacaaattgtgataagtgttatgagggaaacaagttgttgagagagaatcatggttcccttcagtaatagggtgctcagggaaagtcttgctgaggggtaaaatgtaagctgagaatgatggatgagaaggagtcagccagctaggcagacaagaccgcgtgcgcaaaggctctgagtcaccccagtctgcttctgtcctcagtactctactatagagttcttgctagtgtgaccaccagttttctcatgttaagtccagtggacatttttcagtcctcttctgtttgacttcccagaatcttttaacactattaccctttttcagacactctcatcctctggctttggtgccattttaatctcctagttttctctctacttctgtggccctcctctgtgtcccctctacaggaatcactcaaggtttgattggtgggctcttcttaaaattgttttattttttgtactttctctacccttaccctgaaagatggcattctcttccacttctgtttctgtggttttaatcaaccctagactccaactctgttttctctctctctgtgacgtctctagttgaatgttttaccactacctcaaacccagcattacccaaactgaactttgatccttcgggcttcttgtatctgaatcctcctgcagaagcacaagatgtaggaatttatgttcaccatcattctttctttcatttctcatttccaatttatgagcaagtccttttcataaataattttggaatctagtcacctatcttcacttcgttattgcttctttagcaaggtcttttaaaatcttctagtgaatcttttaatcttttagactgataaaattaatttcatctggggcagtttatctaatgtgaactgtttcagtttctgaagttttgtttgatagcgaatgctttcttactctgttttggaattttagttcataggctcttttttctggtgaaagttaaaaatgtttattgctcttcatgcttcatcttctcccttccctttgcttccttgaccttcctcttcctctctctttcctagtttctctctcaccccggccattgctgcctcccaccttctccctgaccagtagttttgtgggtgcccccccgccggcattttggattcctaatctacatccaggtcttatggtgatagtttggacacatggcagattagtcccagcagcttgttcagattttgaccctgaagctgtggttctgcctccctaggtccacagtctccaggagttgtagtgagctgtagttgcagacaatacttggtggcctcctcttcaggccaagggcagttcctctttggcctggtcttcaccagtggctctggctctcttctcagtcttgtgagaacattctcgccatctgtactttgcatttggcacttcctgcttctgaggaaccagccagtggttagcattgttatgcgtttttctcctgttttgagtttgtgaaatgtttaccatttatttctgcttacctgttttcttagttttcctttctgggttttattgtcattgttgtacatttgaagtagagagagcttttgaaatatgaactcactgtgccatcctttttttgtgctaaatttattgaagtccacaaaaaccagagaaaaatgtcagatctcaaaattgtgtttttgctcaatttcaagcatcaatttatccaagttacccacttgatacctgacttgccctacttagcaagtcgaggcattgttttgctggctctggcactctggctatagccagtcactcaccccacttgggattgcttcctttgctgcttgttcctgctgctgctcagtggcagctgccaagttggagtagcaaagggaaaagtttagtaggcatcttttaggaagacagaatgctgtctggagatggcagtggtggatttatatctgagtcattcatctgaattggaacctgtacaaaggaaaagaggttctagctcagataaatagatataaattcattgttgctatcttcaggcattcatttatttaattagatgcactgaaaagcactctcgaggtgtggggacagggtgtggtgtatccaatggagagtttgtagaaattgttaagttgaggtacaactgcttataaatagtatttgaaaatgtcttattttgtaaacaactgagtatttagttgattgcaaatcttcctgtaaatcaatgatagattagtttagtttccgggtctatagtatattcctcaaatggatagtaggtatttttgtaaaggggactttataattaaatatagcaaagtgtcttccgtggactgtattaattaaatgttacagatccccaggctgcactgatgaaactcagctgggatgctctacatgtgatagggaaatttggtttcaaaattacacaacctatttgtgaaggtttcgtgtaatttttcttttcagtaagaagtgtttccatgtatcagtttttttacatttaaaaaagtaatttattttcaattgtggtaaagtatacataacataaaagtttaccattttaaccatttgttatcaaaagatgatgagatctgtggaggaaaaaatggagagctttattttctatagaaaaaacttgcagactggggaggcatagttttcactagtgaaaatgttgctctaaagagaaaaaaaaaggggcttggcttaagtagggaaagttcttgccctcattctctgtgaggtctgtgcaaacgaaggattcaagcttgttcggttcagattgaaccctaatctggtgccagaagtgtctctgtcagatgttccttcgaaaggctggtgcaggggaggtttctgctgcaattcttcttggccccagtcacaggaactgttctggcttaagaacagttcttaatcaagagccgtgatttccaagaacgaagggtggtgaccactcttctctcactctgctatggccgcttggacccattgtctaaatgtgggtatattagccacagggagtgcatctcatctggagagcttgcagttttatttacaattttatttcacacatttttaagcatacagttcagtaacattaagcacattcacattgttttgcaggatgaaaagttctggaaacgggtggtggcgatggtttcgcattatcaatttttacctagtatgcttttttttatacagtgttttaaagtgttggaaaaaacttatgcctttacagtattttattatattagcttatgttcattgtatggggttgtaggcagtgacagatactcaacctttaacaaataccgttgagcacttgttatgtgaagatgctccacatcttttgaactaggcagttgtggttcctgcactcttgtggcttccagttcagtggaagaagcagacattttataattacatacatttatgacattagtgtaatgaaaaattatagggtgttttgtaagtgtggaacaggaggatctgaaccagcctggggagtcagggaatgcttttttgaggaattcacattttggcagagacctgaagggggtgacaagagttaggtgaagctgggagaggacaatactagggcagaatagagcttggtaatttccagaaagttagatagggctaatgtactcttaaacaggaggcctgcagtgttgttcacaatgttcacctatatgtagttgtgtttgttttttaaatttttaaaaattatcctatagtaataggatacccatctttcatacccttctgtggatatcagcacatgtgtagattatgtcactactagcacaatcagaatgcagagtagttccattacccctcagactcccttgtgagtcattacccctcagactcccttgtgtatcccattagtgtcacatccttttccaccctgacactggcaaccacggatgtgtttcccatcactatagcattgtcatttccacacagcgtgtaaccttttgagactggctactttcactcagaatatgtttttgtgattcatccaaactgttgtgtgtatcaatagaatgttccttttttattaccgagtagtgttgcattgtgtggatgcacaggtttttttaaatccatttacctgttgaaggacatttgggttgtttccagcttttgacaattatgaatagaactgttgtaaacatttgtgtacagattctgtttctctagtataaatatctaggagtgggattgctggtcatatggtaagtataagaaactgctagacttttccagagttgctataccagaatacaatgagagttgtagtggttcttcatccacttcagcagtcttgtcagtatttttttttttgagacagagtctcactctgtcaccggggctagagtgtagtggcaccatcttggctcactgcaacctccacctcccgggttcaagcgattctcctgcctcagcgtcctgagtagctgtagctggcattacaggcacctgtcactatgcccagctaactttttgtatttttactagagacggggtttcaccatgttggccaggctggtcttgaactcctgacctcgtgattcacctgcctcagcctcccaaactgctaggattatagacatgagccaccatgcccggcctcattttaaccactctaatatggtttggaagtagtatctcattgtggttttaatttgcatttgcctaatggttaatgatgatgaccttcttctcatgtgcttatttgccatccatgtatccttttcagtgaataagctttgcctgttttttaattcatttgtttgtttgtttttctgttgttgagtttagagtgttctttatgtattccgaatacaggtcctttgttggatgtatgattggcaaatagtttcttccagttggtaggttgtcttttttgtcctcttgacagtgtctactgcagatcacttgtttttaattttgataaagtcagctgatcacttttttcatctataggttgtgttttactgtcatgtctaagaactctttacctaacttcaggccacgaagattttcttcaagatttttgtagttttgccctttattgttagatatgtgatccatcttgagttaattctctgtaagatttgcagtcggtttttttgttttttgtttttttgcatatagatgttgaattatttcaacaccattcattgaaaatagtatttctctattgtgatggttaatattgagtgtcaacttgattgggttgaaggatgcaaagtattgtgtgtctgcaagggtgttaccaaaggaggttgacatttgagtcagtggactgagagaggcagacccacccccaatctgggtgggcaccctctaatcagctgccagcgtggctagaatgaagcaggcagaagagtgtggaaggacttgacttgctgagtcttccggccttcatctttctcttgtgctgcatgcttcctgacctcgaacatcagactccaagttcttcagcctttggactcttggacttaactggtttgccaggggctctgaggccttcagccacagactgaaggctgtactgtcggctttcctacttttgaggttttgggactcagactggcttccctgctcttagcttgcagatggcctgttgtggtacttcaccttgtgatcatgcgagtcaatactctttaataaactccccttcatatgtacatccatactgttagttctgtccctttagagaaccctgactaatacaattacttttgcacctctgtcaaaaatcaaatggggtgatatttggatgggtttcttgactctgttctttttcattcatctgtgtctattcccttgtcagtactacatagtgttaaaattggattcctctacctttctttttctccccccatttttccaaaactgcttcagctattctggttcatttgccttttcgtatacattttagaatcagcttatgtttatgtacacacacaaaaaaaatcctgctgagattttgattagaattttgttgaatctacatcagtttgggaagaattgacattttccactgtgttgagtcttccaatccatgaacatggcatgtctcttaatttatttaggttttctttgttggtggtggtattcttagacagggtcttgctctgttgcccaggctggagtgcagttgtgtgatcatagctcactgtaggcttgaccacctgggctcaaacctcccacctcagcctcctgagtagctgggattacaggcttgtgccaccatgcccagctaggtttttaatttttttgtagagacagggtctccctatattgtcaaggctggtcctgaactcctgtgctcaagcagttctcttgctttgggattacaggtgtgagccaccatgcctagcctgtttaggtctgctttgatttctttcattagcatttcatagttttcaatatgcagatcctgcacatgctttgttttgtttgttttttgtagacagggtcttactgtgttgcccaggctggcctcaaactcctgggctcaagtgatcctcccaccacagcctcccaaatagctcccaactgtaggtacatgccaccatgcccagcttgtactgttttgttagatttttaacctaagtgtaatttttttttggagactcttaaaattgtattgtttggccaggcgtggtggctcgcatctgtaatcctagcactttgggaggctgaggtgggaggatcattgagccaggagtttgagaccagcctgggcaacatagccagaccctgtctctacaaacaaacaaaaatatagtagggtgtaggggcacatacctgtagtcctagctgctctggaggctgagagggagaattgcttgagcccaggagtttaaggctgcaatgagttatgatcacaacacttacattccagcctgggtgacagagtgagactctgtctctttaaaaaaattattgtttaggccggtgacagagtgagactccgttattgtttaaaaaattttggtttccagttgtacattgctagtagtagaagtatgattaatgtttgaatgttgaccttgcattctgtgatcttgctaaactcattagttctaggagtattttcgtaggttccttggggttgtctatgtagataatcatgttgtctgtgaacagagacagttcgatttttttttctttataatttgtatgtcttttattttatttttttctgttgctctagttaggaattccagtatgaagaggaagaggagtagcagtggtgcacattcttgccttattcccaatcttagtggaaaagtgttcagtcattcagaattaagtatggtattagctgtgggttttttgtggttgctttttatcaggttgaggaagatcctgtctactcctaatctgccaatgaatgttgaatgttgtcttacacttttcctaaatcaattgatatgatcatgtggggtttttttccttttgattgtaatatgctattttacgctgagcgattgatttttttagtatgaagctacttttgcattttggttgtggtgtattgttttttatatattgctggattggacttcttaattttttgttaaggattttttacatcattattatgagggacattggtctgcagttttctttttgtgtactgtctttggtattagcataatgttgtccttataaaattaattgggaaatgtttcttctctgaatgagagtgtataaaattgtttttttttttttttttttgagatggagtttcactcttgttgcccaggctggagtgcaatggtgtgatctcggctcactgcaacctccacctcccgggttcaagtgattctcctgcctcagcatctcaagtagctggggttacaggcgtgcaccaccacgcctggctaatttttgtatttttagtagaggtggggtttctccatgttggtcaggctggtctcaaactcccaacctcaggtgatccacctgtcttggcctcccaaagtgctgggattacaggtgtgagccacgcgcccggcctataaaattgttcagaattctccagtgaaaccatctgggcctggagatttcttcttcagaaggttttaaatgacgtattcaagttctttaatagttattggagtattcaggttatctatcttattttgagtgtgttttgttagctttgtgttttgccatttttgaggaattggttcatttcatctaaattgtccaatttatgcacatagaattattcttagaaaccttttattatccttttaatatctgcatagtttgtagtgataacctctttcctttcttattttggatgtcgtttttttcttcttttcttagtctttttagagatttatcagttttattgatgctttagaataactagcttaggttgcattgatgtcttttttctctattttctcttttaaaaattattgatatctcctctgttgtgttcttccttctactttaggtttattttgcttttctttttctggtttgtaaggtaggagcttagattattgatttgagatatatcttcttatttaatactataattttctctctaagcactctaagtgcatctaatatttttttttatatattgtgttttcatttttgttaagaatgttttctgagacttccttttttgcacataggttatttaaaattgtttaatttccaagcatttggagatttttctactgtctttctgttatttatttctaatactaattctctttgttcagagatcatattttgtattattatagtttttttcagtgtgttaagttcattttctgatccaggtatgacctgttttgttgcatgtttcatgtgcacttgtaaagattgtgtcttctgttgttagacttcagtactgtataaatgtcagtgagatacaactggtttgtggtattgtccagttcctctatatccatgccaattttctactacttgtctttcttttgagagtcttgatgtttccaacgatgactgggttattgtctgtttctcctctcagttctgccagtttttgctttatgaagcactgttgttaggaacatacacattaaggattattgtatctttttggtgaattgaccctgttactattaggtaatgttcttctctatcccttgtaaatttctttgctctgaagcctactttttctgatactaacctaggcattccagcctttatttgcttgatgtttgcatcgtattttttcccatcattttacctttaaactacatatgtcattatatttgatgtgactctcttgtacacagcatatacttgggtcatattttgacaatctcttttaatttgtatgtttaagtcttttttttttttttatttttttcgagacagggtctcactctgtcatccaggctggagtgcagtggcgcgattatggcccactgcagcctcagcctcctgggcccaagtgatcctttcacctcagcctcctgagtaactgggaacacctctagctaattttctttcgtggagtcgtggtctccctatgttgtccaggctggtcttgaactcctggactcaagcattcctctcatttcagcctcccaaagtgttgggattaaggcatgaaccaccacacctggccacttttatgtttaatgtagttattgaaatgtttggcttttgggctactgttttattattttgtttttctatctagtttttttcactgtttcactctttgtgtcttcttttgcattatttgaactttttaaaagtattcctttgaaatttattgtgtttatgactatctcgtgtagtttttcttcaaattaatactttattgattataatatacatacttaacttcctatggtctattgaaaattcatattttaccaccttaattggaatatgtcagtcttaccatcatgcaggtatctacattctcttcttatgttatggttttcttacgtgttatatctgcatgcattgaaaaccccatcagacaatgttaaaatttttgctttcaacagttaaacgtatttcaaaagcaatgttatcatttctgttgctcttccttcattccttatgttccagatttccttctaatgttattttccttctgtctgaagaacttccttaagcagttttagagctgatctgctagcaactaatgctcttagttttcctttatttgaaaatgtcttggctgggtgcaatagctcacgcctgtaatcacagcactttgggaggccgaagcgggtggatcacgaggtcaggagttcaagaccagcctggccaagatggtgaaactctgtctctaccaaaactacaaaaaaattagccaggcgcagtggtaggcgtctgtaatcccagctacttgggaggctgaggcaggagaaaggcttgaaccaggacagtagaggttgcagtgagccaagatcacaccactgcactccagcctgggagacagagcaaaactccatctcaaaaaaaaaaaaaaaaaaaaaaagaaagaaagaaaatgtctttatttcgccttcattcttagaggatatttgcactgaatatagagtactgagttgacagttctttctttccagcacttgaaaaacattatgtcacttccttctggtctttgtggcttctgatgtgaaatccatagtagtttgagtatcattcctttatagttaatgtgttgtttttctttgtttactttcaggaattttgtctttaattttcagtggtttgattatgttttctgatttctttttgttaccctgtttgagattcactgaccttcttgaatatgtaggtttatgtcttttaccaaacttgggaagttttcagtccttattaaaaaaaatattttctcagcatggtgctgagaacattttttttcttcttttctctgatagacatgtatgttagacctttaagtattgttccatagtctcttgttaattttttctactctttttttctctcttgtttcagattgtataatttctgttgatcagtcttcagatttattgactctttcctttgtcatctgtagtctacccttgagcccatccagtatgttttttttaatttgattattgcatattttagtttaaaattttccattggtttctttttacaaattctgtttcttttctgatactttcaaagtttccatttgtttcaagagtgttcataattgcttgttggaaaactttaataataacttccttaaaatctttgtgagataatttcaacatttttgttactttggtcttggtatttgatttttccttccctgtaagagatttacttggttcttgggttaattttagatattttgagtatgatgttatgagacataatcctctgaatttagttcatttctttttaggatgttaatatttttgtttcagtagcaattaacttggttggcttcagagtgcacattccagtttttttttgtttttttttttcctgtgggcggtgggtctttgtactcctatacagatccaccccacatatgtgtcaacaactcatcagtctgggatctgtggttagttcagtgtttaaattctttggtatacttattagaattacatccatacatgcccaacctagggatgagctcagaagttcataaacaactttattgtgtcacttctccatgctagcttctcccattctggttctttaggccttcacttttcagtcttcttacttagaaatctgaggttttattaccttgctctgctgttcaaattttgtgtttgtgtccaggacgtgtaaagagcacagagagagcagaaaaaaccttggggttttacctgccctcttgagactgcagtttcactgattgaagaagaatgtttcttctctcattgttttggctcttgctggcatctatgtctgcctctggtaccacagccacaaaattacttgggggttggggcaaaaaagaatagagcaaaaggaaaaaaaatatgggaattgagatttccataatgttgtaagtatcaggagctccctttcctgccttttgagtgagatgaataggggttctcctggagttctctccatcagtgtccccatgcctactttgcatttcaggcttttccaaggtcggtcagggagatcatgggaggaaaagaaaatgataaaactcaccacttgtttatagtaatttgaattcttttcttccttgatctgcctgctactgtttgcttttccaagtctataaatacttgattcgtgcattcttttgaggtttcatagttgaattcagtgggatagttggggtggagcatgcttagtccatcttacctgcagttagaatggccaggggtgtttcttgaaagctacttagaaaacaaatgtgggaaggaattagcagaatgcatctttgcatcctgtatactatgttgtgtatcctatattatggtaaaagtttggttagataacagaggaaaataaaggaggttttcattgttgatagcactatgtcctaaccttcatctgaggttactgggagagaaaggaaagtgttacagctaattgcttgaatgactcaactgcagtaatatatagtaagctgctattaatgatgcagtatagcttgcctcctgtggatgttattttctttccataggagataaacattgagaatcacagacttcccaaaatccaaacactttaccgtgacattcaagatccattcaagttcctactgatttttcttctaccatcctttcccatcagtcccttttcatacactttattttcaagccatctcacagatttctatactggcacctttcacatttccaccatttcgaatgtactctttctctgttagttctctctcactttttttcatttattagaaatccagttttattgttcaatagccaattctctgtgaaaccatttgtacatgttattttttattacatttatttatttatgtatttatttatttatcagacagagtctcactctgtctcccaggctggagtgcagtggcgtgatctcggctcactgcaacctccacctcccaggttcaagtgattattatgcctcagcctcccgagtagctgggattacaggcatgcaccaccatgtccagctgatttttttgtatttttaatagagacagtgtttcaccatgttggccaggctggtttcaaactactgacctcaagtgatctgcccgccttggcctcccaaagtgctaagtttacaggcgtgaaccaccacacccagcctttattactcttaattgcagttggtgtataagtctttcataccagaccaaactcctggaggggtagaggactgtgatttatcatctttttataccttgctgtaataaagtatacctgtaataaatttttgagtggatcagggaaaagaaaggaagtgttcatgatttagttaatgttaaagggatatgatgggtggaacatcaaatagttgaattacataagagagtggaaaacaaaggcaagtactgtttaaatggaattaggaactaatgttttgggaaatatgtttcgatgactttgagtgttggcaataatacttggaaattcattttttctgatctttttattatatacagtttttcttccagtagggcagattttttttttctctagtcttttctcttctgagggccagctgccacctcctataaggtagagtttttctaccttgtgctgtccagatgtttctttttatttgaatttatttatttactcttttacacaaaagaggcatgccaacagctgcactaagtgttctttcctaagccagccagatgtttggacttggagaaaagttagattttgaaataaaagacaggtggattatagcccttcattcaaccattcagtttttccttgcctattgctgctgccaggtagggtgtctttaacccgtctttatagtacctcttgtcacaaatttagttccagaaattaaaggactaactcctcctgaaatctctatgagatgaaatgagccttctttttttttttttttttgagatggagtcttgctctgtctcccaggctggcgtgcagtggcatgatctcggctcatgcaacctccgcctcctgggttcaagtgattctcctacctcagcctcccgagtagttaggattacaagtgcgtgccacgacatccagctaatttttatatttttagtagagatggggttttgccatgttggccaggctggtctcaaactgctgacctcaggtgatccacccgcctcggcctcccaaagtgctgggattacaggcatgagccaccacacccagctgaaatgaaccttcttacagactagattctatgtggttgtcctagtatgaggctggtaagcttgctgacatcatgcttgggttttcatctgatgaggttcagctggtggcccagcatagcgtatcaggctccctgtgtatgacagtgccgctggagatgggtcattcttcgactagtaggtgatttgatctcccctgatacatttatgttttttcacattttgggctctgattctcccccttacatgggcttcaattccaaggaaggtaggagttgagatacaggtacccttctgtttttcaatcctgctactcttgctgtgtttatctgagtgtggttctcttatactctgtaaactaagtccctaaagaggaacttctgttcctggtagctggacctacttaaggagttgcaggtaaattcagtgaatggcatagtcactttgggtctttaactattgagttaaaatatctttggccaggtgcggtggctcatgcctgtaatcccagcattttgggatgctgaggtgggtggatcatttgagggtcaggagtttgagactagcctgaccaacatggtgaaaccccgtctctactaaaaatacaaaaaaaaattagctagctgtggtggtgcacgcctgtagtcccagctacttgggaggctgaggcatgagaattgtttgcacgtgggaggcagagattgcagtgagctgagattgcgccactgtactccagcctgggtgacagagcgagactctgcatccacaaaaaaaaaaaaataaaaaaaaaaaataaaaatctttattaattattagtcttggatgaataggaagaaataaaaattgtttcttgagctccttcaaagtacttattctgtcttcgggtatagaatgattttcttttttgggaaatggggagaaagaatatttatttttgaagagaaaataaaacacttctagacatttttgttttctttttgttgttgttgtttgtttggttttgagtcagggtcttgctctgtcacccaggctaaagtgtagtggcacgaccatagctcactgcaacttccaactcatgggctcatgcaatcattctgcctcagcctcccaagcagctgggattacaggtgccagccaccatgtctggctaattaagagaaatttttttttttttttgtagagatggggcctctgtgttgcccaagctggtctggaactcctgggctcaaatgatcctcccatcttggcctccgaaagtgttgggtttacaggcatgagccaccatgcccggccccagatatttctgatgtctttaaatttcataccactgcttggtgaaaaatgactgtgctaaggaaaacttcttgagctccgtaactgcttttcatgattaccttcaatgtctgggagctaactataccaggaagcttttgagtggttgattttgctgctatttgtaatactcatctgatagtttttggtaagaaactaaacagccatataccgtaaatcaagagctgtcctgtcttttgggatcccagcaaaaatattggataatgtgggaaatggaatctgagcccagaaagccagcttttagagtttctaggaatgccatgatgtctgcatagatactaggagaaagatactcaccattaagatacataaatagaggaatggctgtagtaatttaggactggtatgatcactttcatgtactcatttttatatcatattagatgctcactagattagttgatgcttttcatgacagtcttaaaaataagttttaactgattaattgtagaaaactatgttcttgtttataatctttgatttttaaattaaaaatacatacactatatatttcctatgttaagaaatgaaaaaatttaaaagtcctgacttataattaaggctgttgggatgagccagacttcatcttcctgtcccaaattcccagggatgagaaaaagttgaagagaaaagacctaaagataaacaacaaaccagaattttgatggaaaatggtaaagagtactcatgggatcctggaaatgctggtcctggaaacagtgaggaattttgcaagagagatggctgatgggatcatgccccaggaaaccccagtctgaaacacagataggagaggatggctgcaaagatgggagcagctccagaggagacagccttgagcacaagaagtgacatccagctaggtgattcttccacactcagtgtccatgagggagcagatgattcgtaaacaggtagagccatatcttggaattctttagtagttaaaaagactgaggtggatctctgtatatcaacagagaacatctctaagacattaaaaatggaaagagaacttgtgtaaggacacatatggtataatgataccattaatggtaaaagaatcccaacctaaaatatctttatagttacctatgtaaaagcatacagcataggttctcaacagtggcattgttcacattatgggttagaggactctgtcatgggcgactgtcctgcacactagagggtttttagcagcatccctggcgtcttaccctctagatactagtcgtgtcccctcaggccccagtagtgacagccaaaactatctacagacattgccaactgtgtcctgggggacaaaattgctccaagttgggatcccttggcatatattgaagtctaataatgcatattcacctgttaagtgattaccggagagagacattgtaatggggacaggtgtggtcagtggagttgttagctttattttgaataagaatgtttaggtataacggtagggcgcagtggctcacgcctgtaatcccagcactttggaaggccaaggcaggcagatcatgaggttaggagatggagaccatcctggctaagatggtgaaacccatctctactaaaaatacaaaaaaatagctgggcatggtgacatacacctgtagtccctgcgactcaggaggctgaggcaggagaatcgcttgaacccaggaggtggaggttgcggtgagccaagattgcaccattgcactccagcctgggcgacagagtgagactccgtctcaaaaaaaaaaaaaaagtttagctattacatatatttacatatattacatgtaattaaaaacaaaacaaaagatagttttgcttttttttttttgagacagagtctcactctatcgcccaggctggagtgcgctggtgcaatctcggcagctcgctgcaatctctgcctcctgggttcaagtgattcttgtgcctcagtctcccaagcagctgggaccatagatatgcgccaccacactcggctaattttttgtatttttagcagagatggggttttgccatgctggccaggctgatctcaaactcctggcctcaagcgatctgcctgcctccacctcccaaagtgctgggattacaggcgtgagccaccgcaccggccagctttgcttttttataagatatctgttgtattaaatttaaaaatggttaatggtggctgggcgcggtggctcatgcctgtaatcccagcactttgggaggccgaggcagacggatcacggggtcaggagtttgagaccagcctgaccaacatggtgaaaccccgtctccactaaaactacaaaaattagccaggtgttgtggcacatgcctgtaatcccagctactcaggaggctgaggcaggagaatcacttgaacccaagaggcggaggttgcagtgagccaagatcgtgccactgcactccagcctaggcaacagagtgagactctgtctcaaaaaaaaaaaaaaatggttaatagttagaagaaatacaggtagcttacaaacgtgcaaatgtgcccaaactcactaataaccaggaaaatgcgaattaaaaaaatgaatcatttttctccattacattaataaaattagaaagataaatcatgttcagtgatggtgtagtgttgggaaattaatctctaatagtagtgtaagttgacctaagattttaaatgtgtagtttgtggtatttgtatttaaattaaatatttttcttatagaaatatacatatgtatgcagattggcatgtttagggaagcttattgcagcgcacaatacctgcaaattggaaccatgtccaatactaggagaatggttaaataagttatggttcatctagattactagaaatactgggtagcagttaaaaattatgaggtagaattctaaaaaaaaaaaaaactgagtgataaaattagttgtagaataaaatgtagtgtgattcagtttataccaagaaaaatcttaaacatgaaataaaactctgcacctttatttctgcatatccatatgaaaatgcttaggtaagtttggaaggacacatgcaaaactgatcatggctggataacaggaaatgggactaggagcctttaaaacggggcagggaataatggttatctggtatctatactgcttaagctttttttctttttaaccaaaggagtaactcatacattacttgggtaattacaataaaattgaaaaatgtaagaacatctaaatgacttgctttatatgcatagtgtcatcatttagtggcctgtgttgagcagtgatagctgctgctggggctctggtagggctttaagatcccatgacttttggtggctctccatattttgtggaattggcattagctgttcatatggtttggaaacacttttttaaaaatattgatttcagtggagattatttcccaaccctattcctagaatttcactctgttattgcttcagaaagatgtattcagaaatatatgcctgtgtatttatgacttcatcactagactttgaatgcatgtgtgatagctttctctttagtaagtggaaattaatcttaaagattgcaagctagagctgagcccacactcttactggtattttcttgtttcctcccctaacctaacttgtcatagtttttcttaggtagtattatttatttctttttttactacgtagtgacattcttcaaatgtatactttcactctggcttgtccgtaattggctggaaattgtgatggatctatatagttttttttgtgtttttaataaaatctgtataacataaagtttactattttgctcattttatttcatttatttaattattattttatatttttacagatggggtcacactgtgttgcccaggttggactcgaactcctgggcttgagtgatcctcctgcctcagcctcctaagccgtggggactacaggaactgggccactgcacacggcagttttagtctttttattttttattttttgagacagggtctcactctgttagccaggatggagtgcagtggtggaatcacagctcactgccaccttagcctccacttgggaagcctcttgggtctgccactgcttgtcagaaactttttactctgaattatgtcatatctcaggtgtttttacctagttattttgcacattacccttctcaaaggcatttgttcaagtttttcctaagctaatgaaggaaaacaaacctgagtcatctcttggctgtcactctgcctctcctactctttacatccagccatatgtacagtcctcaccccacccaccccacccctactctactttttcctctgctttattccgcagtcctttcatttgtggtctggtacccaccagctacactgacatgactcttgctaaggttttgcttgaatacttgatgtctcctttctctctgtcattcctccccttctcccttgatgcttctactaaggggtcagtggtatgagaagatagttctcctcctgctggttttcattattttgttgtttactgtatcgtcaggaatgcatgcttgcaagacaaagactaaaacaaaaaacaaaaaacccaaacagcaaaaaaaccccaaaacacctttgttttggttccgagatcgattcagtattagttcccttttgtgaaatgaaaacaggattgtagaaaatgggctgggaattttgcaactggcaaaaacgtattctctttttttcctgtagtttaaaattttaccactttgaaaatcatgtaagttatcttagaagaaaaatagtagtccactaattctaccatccaaaataaccatgaataaatatgtcttggtgctacacatgtagtttttcaaaatggaatcaaagcgaatctttaaaaaaaatcattttgttttctatgatcaaattgcctttctgggaaaggacatgccagaatgttagttttttaaaacttataaaagtatctttagatactttgaatgaaatagaaagagttctattctttttttttttagaaataggattttatctggttgtttgattttttttttttttttcagttattcaaatgaagattgatgcagttggctttcctttaaccttttagtctttcagggtaattttctttctttttttttttgagactcccaacaagtttattattttttaaattgtggtaaaatgcttataaggaaacttgccatcttaactatttttaagtgtacagttcagtggcattaagtacattcacattgttgtgcagccatcactataatctatctccagaactctcttcatattccaaactgaaactctgtacccatttaacagtaactccccattccaggctcgccacagtctctggcaaccactattctactttcaggataattttcattggttagtaatgtttggataatttgattagatttggtggatactgaagactggccgggttatgtaagctgttgctactttcagccaaggagtgcatctagtccgtattacatcatccttggagtgttctacccagtgtcttgcattgaaggacatcagaaggaaaactcctgtattctcagtcgtggtaaatagtgtccacttcattacagatctccttgagtgataggtttcaaaatatctctaggcatgaagaaacatttccaaacctgcttgtcttctctacctttctcagtatgtactagtttagaaggtattcaaaatgtttcactgagaccattgagttttatgctaaatataacatctggcctagcactttttatcactcatatgcaatctatttgataaggacagggaccaaatagaatgtctttttcaatgtattttaggcatctaattgactaatatgaaattttctattaatccagagtttttaaatgcaggcataattcccccccaccccgcccgcaaagattcagtcttgctctgttgcccaggctggagtgcagtggcctgatcggctcactgcaacctctgcctcccaggttcagcaattctcctgcctcagcctcccgagtagctgggattacaggcatgcaccattacgcccaggtaatttttcttttgtattttttggtagagacagggtttcaccatgttggtcaggctggtcttgaacccctgaccttgtgatccacccgcctcggcctcccaaagtgctgggattgcaggcgtgagctactgcacctggctgcaggcatactttttaacctatttatatccaaacatttaaatttattttttatttttattatttttaatatttttatcattgtatatgtttatttatattattatttcaaattgtttattaggtatgaattttacaaactttacttatattagcggtaacggtggagcgggagagtattgcgccttctccaagctccccggcgagaaccaccaatagtgtggtggaacttacggccgtttccaagggccagggctcttttggcctgcagatgtcagcccacacatctccctgtgctgtggactgatttggtgatccattaggtgtcaggatttcttctgatagctttatggaatggatcagtgaggataacctcaaaaaatttgtatgtggaatcttcaccaacccagtaagaattcaggactctcaaagccccacagtggcgtccagcttgctcctctgcaacggactgaaggcttggagcaaactttagctggttaacaccatgatggacaggcttgccataagttgcacccttaggaactgggcgttttcggccaccacggcaaacacgaatcctatatataacgtaaccttgcttggcctcgcagcccagtcagcgcgctttatcaggctgggtggggcggagagccctgtggagagcagagagctggcggtactgccagcagcggaccctcagaagaaagcgcatgacatcagactgctgctttctccgtagctcctggatgtactcgtatgcacccatcttggcttacctgatggctgctgccagacggaagaaaagaagtttaatttattttttaaaagttaataaagaagatgatttttctcagtcctgtaagatgaaaaacacatctgttgttctagttatttggaaattaggctcatacgggtaatagttgatgctagtaatttttctctgaagaataaaataattcaaaatagaaaactaaatgcttggctgggcgcggtggctcacacctgtaatcccagcactttgggaggctgaggtaggcggatcacctgaggtcgggagttcgagaccagcctgacccacatggagaaaccctatctctactaaaaatacaaagttagccggggttggtggcgcatgcctgtaatcccagctacttgggaaggctgaggcaggagaatcgcttgaacctgggaggtggaggttgcgatgagccgagatcgcgccattgcactccagcctgggcaagagcaaaaactctgtctcaaaaaaaaaaccaaacaaacagaaaacaaaacaaaacaaaaaaaaccctaaatgcttgatgggaaagctaataatctgctttaaaaatctctattggttttctgagaacggagaagtttatgaagacaaactatacttagtgttagtatttaaaatgctttacttttctttttgaaacatatagccagtaaatcctgcttagttgattagtgtacctcagtttaaactttccatggttgttatgtatttcctttgccattaaaatatataaaaaggaatttatatttttcaagatgttgaaatttttgaaacaaatatatctactcagcctatgcaatattaagtcattctgcagaatagcatctgcattgcttgaatattgtttgtttgttttgtattattaagccaaaaaaaacacctcacacatttcatacaacaatgacaacaaaattgaaatagagtttcaaaagtttgttagattgttctttccaggttgactcttaagtgtctctttaactaaggcagtagagaattcaaatgttttcttttgcatggccttttgctactagtgaccctgggctagactgtgggcttgttgagatgtgaatgtaccctgccccctgaagtaagatttgttcctgcaaatggaggaaaagaagccaaccaatcctttataaacaatttgtgtttagtccttctttgtaaagtccatagcagttttgacctgcttttaatgcatgatttattcaattgtttattggagcactcttttttttttttttttaaactggaacaatcttaatcacccagtaaaatatattaggctctgagctagttcttgataggtttattttatttatttatttatttttttgagacagagtctcactctgttgcccaggctggagtgcagtggcgcaatctcggctcactgcaagctccgcctcccgggttcacgccattctcctgcctcagcctcccgagtagctgggactacaggcgtccgccaccacgcctggctaattttttgtgtttttagtagaaacggggtttcaccatgttagccaggatggtctcggtctcctgacctcgtgatccgcccacctcagcctcccaaagtgctgggattacaggcatgagccaccgcgcccggcctagttcttggtatgtttataaaacgtttgtgataacataggaaaaatgtctattatgctagttaaaaaacaaaagggtgaaaattatatatgcggtatcattacgaaagtgtatttagagaaaagactaaaaatgtcaatactattaggattctctctctcctttttacttttgaatgcatgttcattatagaaattttggacacataaacacatgtgcctatgtgtatcttttaatttcttttccttgataaaccaccaattgccatatgtattgccaagattaagaagactttatgtaggtgtagatttttaccttaaacataatgaaaaaaaaataataaaagttgcaactttttgtacctcaaagacaatggcttttaacatttgataatgaaagttattaagcaagctgctatccaagtgtatctatgagtaaatagctttaatcacataacattgggctaggggagattaaaaaaagaatttaaggcgtaaccttatgatctggtggaggagaaattgtaactgtgcaaagcagttaaaatgagattgttgggtagatgagattatatgctaaaatctgcactaactactctcagagtttagattagaggagattcatcctaaattgaagtacttgggaaagatccagtggtagatgtgaaacttggagtccatcttctataataggtggtatctgaggacaataaaacaagtgtggatttaagtttaaacaaagacttaaatgtattctttttaaaggattgtgaagtactcaatttctttcttacagaagaaaactacaatcacaattacaacaacaaaattgacagtaacaggatctgaagtggacagagggcaatagggcaatagaggagggggcatcctggtctgagggcagaagagcaacttgaggttgggggcataccaggcaacgataaccacgaggaaggccttgctttgaacacagggatatttagaagccctttgcaagcagggctgcttttccctacaattggtattattaaataattaccgaatgtatatatttggatattttatagtaagatattgacctgaaaatcccttgggcatttacctgatcttttacctttcaatactcaatataattttttactaaagtggaaaatatttattgaattgacaaagagaattcttagctttctaaaagactacttttttagttttttaagatctcatttaaaacaaagtatttaaaaattatttcataactgaagactctaacagaaatactcaggtatttgccacctttgacttttttttttggtagaaggtgggtcataaatgtttaggtatatgtttgtgttccagtttttatatctgccttgcaaaataattgtaatctggaagtttctgaaactggaaagccattaggaaattaggaaaagtcatttaaaaagatagtaatcctttcatcagttaaaaagaatagactccttttagaactaagcagtttactctttttcatattgaatgcttagcttctattatgcaaaataaatagatttaaacattatagagtgagtagtcttaaaaatggagcatacattcctgaattttgagtagctttagaacttaatacacatatcatttcttttaggaataaatgtaaaatggatgaagattgaatgtgagagtatttaaatgattctcaagattttctggttcatgtgttgtgatattgaactctttctttcgtcttaggctttaatttgtgcctggtgctgacctgatgctgtgcagggacactcactgcatccctccattcagtccctctaattatcccaacttcctggggagcttgcttagaactgggcatgagtgctctttattaaaatattgggctaccctggctacatgtaacaaggtagtttttgatatcaaatttatgtattgatgaacggaataggaagctaaaattgtttgctgtgattttacataaagagataggggatattatggaaattatttggttagacaatgaattaggctgtaataaatgaaatcatggttaatagagttcctgagtttatttgttgcattgttgctttttagtgcatactcaaaaagaaatacgactctataaatgataggcagaacaatcagatttgcaattttgtgtgtatttgcagatgatggtaattctttttgctgggcgcatctgttaatgcagaaatttgtctcctcaggttcatgtgaaaatggcggatgaggctgtctgtgttggcccagctcccaccagtaaaagctacctcaacatggatgccatcatggaagccattaagaaaaccagggcccaagctgtgagtctgaatgaatctatctactgcagctgtttcatatgtagtgagcagaaagctagagtttgtatttaaaaaaaaaaataggaaagaatgattgaaaatgctgttgcagttagttcatgtcacatgagttaaatgtggtcgaattcgctactggaaatcaaaggctttgtagcatctggcagtgttggttgctgatcctgcaggtggctgctggattcagctttcacaccagggagcagtttcagttcatttccaaatttgctaggaaaaaagaaatcccaattagttttgagtattaaccctttccgtgtaataagagcattttaaaaaattctgtgttataaacaggatccaaagactgtgttcaaattccattttaataatttaaaaattacttatacctagtacacttccagaaataaaaacagcacatttggtaattattttagtttgttaatgtcagtagaatgctcataatttacaaggataaatcattctctccacccccagttctgtttgaatagagtggaatccaaggaaaaaaatgatttctgatatcagaaacagtgttttttcttctattttcttttttctttttttaattatcagaactaattatatatagtgttaaaaactatgcaaagttatctctaaaactggatggaaacatccaacaccagcaattaagcctggagcgcttcaattagcgctcacatttcttttgaaagaaatgttttagtaagatgaatgtttaaataaaaagcctaattcgtgaacccatattatagatgtttacagtttattagcacagttagtgaaggtaaaacactttaaccttttaactatagcttgccaaaataaatatgtagttgagtgttgataaaatgaagttggtggaatgaaaactcttcttctctgatacagtagtttaaattcttctgtaccatgctcataaagcttagttcagctttttttttgttttgttttttgagatggagtttcgctcttgttgcccaggccagagtgcgatggcgtgatcttggctcactgcaacctctgtcccgccaggttcaagcgattctcttgcctcagcctcccaagtagctgggattacaggtgcctgccaccatgcccagctaattttgtatttttagtagagaaggggtttcaccatgttggtcaggctggtcttgaactcctgacctcaggtgatctgcctgcctcagccttctaaactgctgggattacaggcaggagccactgtgcccagcccgagttcagcatttaaaagtcgctgatacgtagctatttctggattatgatactggttcctttagaaatttgactctctttttagcagaattattttactagaagtatgttcaacactggctgatactgaagtggcgaaatttatgtttggccagtctgggagagccaaaaattacttgattggatcaggctggtagattgtagcaatgtggcttgtgggtgaggatagtataaagtagttgtggatggcaaagtttggggtgaggaaggaaagaagagtagacattagaagaaaaaaaattcagagcacaaaataaaagtaaaaccacacctccattttagttcagtttgatagaaacggcttgttggtagttgccgagtattattaatgccatcaggaataaaatgtgttagctgtcctagtagtctgggttttggaaattaccagttcgtgagtactgtaaagaaaggagaatttagagtttttcatccatctttgccaaggttccttttacataattctttgatgcaccagccattgtgaaattctccagaattgtgggcaaagttagcctcaggaaaaggagagagagttttgttgaatagtgtagacaaatgccagtgggcaggaagctatgtgggcatatactccccattgtggttaggacaaaggtagtgtgtggaaaatgaatcagttaggacaaagggagtgtggagaaagtaaatataagaggcagtttcttggaatttgattctgatcctagaaatgtgagttagaactgatcagtgtataagagaagtgtacttattcaagggctcttgaacagtaaatattaatacataaatgcactgtacattttgcttataaagcttttgcaatatgataaaattgaaagtgctttttgctttcatttctaaggtacatccaggttatggattcctttcagaaaacaaagaatttgccagatgtttggtaagttggtaatgaaccagaaactgttcatttctttttcagaaagcagtgtggtagcatggctttgtaaatgtgggtagtgatggattatagaattttaattaacccagcagttctttgaaaattgtgacaagtgaagtggttttagtctgaaactcaactgtttatttgaagagtaattataaaaacagaaaagtttacaaaatcaccattacactgaatgaatgatacctggtttattatatactgcatgatatttgaattaaagttaaaaacttcagatttttaactgtaaatatgttagggagtttagtgagttattgtagtgatttaattattttgtggcatttaatatcaaatcttaccaatgcctctattttgggtgaagttgtttttaatgatctaaatgtccccttccagctaggtgaattaacgtatgtttgttattaaattgatttttccaggtatatttataacttcattcaagatggtactgaaaccttattttttaggtactagaatatgattttgattaatgtttgtacatatgtttgttattagatcaattatgccaggtactatcttaatttattctaatatgttatacttgtttctgtggcatacagtcatgtgttgcttaacagcgtgaatacattctgagaaatgcatcattaggcgagttcatccttgtgtgaacatcacagagtctacttacagaaatctacatggtagagtctcccacacacttaggctaagtgtgttatagcctattgctcctaggctacaaacctatacgtgttgctgtactggatcctgtaggctgttgtaatacagtggtagatatttgtgtatctaaacatgtaaacagggaagatacagttaaaaatacagtattagaatctatggaaccactgtcatacgtgtggtgcctcattgaaatattctgtggagcataactgtactcgtattctgttcttccacggattggaaattatttgtgaatgttgttattttctagatggaatttccacttaaaatctataactttaacttgaaacaattattaagatcacagaattgtctatttgaaccaccttgctttgtgggtccaaaactaaggcctaaagagatatcctgagggggcaaattacatggacacatccagaggttccagtttcccaggttttatgcagcatatctacatttttttgtttatatccctttttattttttatcttccttggaattttgaccaagattctgttattataaaaactatttgaatataatacttaaatttagatgtgtatgtgtgtatatatataatgtaatgtattacatttaagtccgtatagatgagaggtcggcacactacagtccacaggacaaatgcagcctgctgcctgtttttgtcaataaaattttattgaaacacagccatgctctttcatttatgcattgtctatgctgcttttgtcctgtgacagcagagttgagtagttgtgacagagaccatttggcctatcaagcctaaaatactttttctatggtcctttatacaaaaagtttgggaactcctgctataaatgaatatccaaatccaaattatatgagtaggataagtgatgtggtgccagtattatacatttattcctatacagttaatacatttatttattttatatattatatataatattatatacagtttatgcattttttcagttattaaaaaaatgctgcctttttttttttttttttttttttttttgagacatagccttgctctgtcacccaggctggaatgtagtggcatgatctcggctcactgcaacctctgtctcctgggttcaagctattctgcctcagcctcctgagtagctgggattacaggcacacaccaccacgcctggctaatttttgtatttttagtagagacggggtttcaccattttagtcaggctggtcttgaactcctgatgtcgtgatccgcccacctcagcttcccaaagtgctgggattacaggcgtgagccactgtgtctggccaaaaaatgcttctttaaagtctgtttaaggcctttgagaaggatatattaataaaaatgaatccaatctggttcccgcgcagaatgctgcagtccatgggtgctatgagtcctgggtgctcatagtcatgttacggaaaataagttgatacacaaataacttcacttcagggaagaaaatactgtgagataagatcaatatctttgtaaatgaaagtaagaaggatgatttccatctggggttctacattagagaaaaacctgtagaatatacaacctcctcctttctttcacacgagttttctttccaaacctatttccccatttcccttttatcagtgctgtgcctccacccagcctgactgtgcgctgctcccatgcgtggctggctctgccctcagtgctttcctcactctctctgggtgggtgtgcctggcctcccacccaccgtgtctaactgctgcctgcccttgaaggcacagttcatatgcagcctctgcggggaaagggttctagatccttctgttgagaagtaatttctttccttggactttttgtttcagtttgattggaatgtttttgtttttggaaaaatgatttgtgctttatctgatacattgtttttacttaatatccaggactaaaatgattttttgattttttttgcataactgctgtgtatttgctttagaaagtgtacaataggccaaattcccccaatgtaaaaacacaccaaactttacaagactgataattttttatgctgagtttacgcgaagtgggattggattttatacagtccctgctgtccatgacttgaaaaagatcatgtgggccgggcgcggtggctcatgcctgtaatccctgcactttgggaggctgaggtgggcagatcacttgaggtcaggaattcgagaccagcttggacaacatggcgaaaccccatctctactaaaaacataaaaattggccaggtatggtggcacgagcctttgatcccagctacgtgggtggctgaggcaggagaatcgtttgagcccgggaggtggaggttgcagtgagctgagatcacgctactgcactccagcctaggcaacagagcgagactctgtctaaaaaagaaaaaaaaaaaaagatcatgtctttttgttattgcttagatagttcatagaaaaaacaaagctacacataatcctcataaaaatagcaattttcaataattttaatgtgctgagctaacagattttatttccaagctgttttctattctgtattttccctgcaggcttcttttattatgagcattaaaggaccatccatgggagactatgaggattgttaggatgaggcaaagacatcttaacagagtttacaaagagctttgaaacgtgaaactaccttctctggaaaaatgggatgttggcttgaagatatttcttagtattctgtgttttctttctggtttttctatgttgttttaatcatattatcataccttgtcatttcaggtaacatagcataagttatagtaattagtttcaagagaaacatatgttagaatttgtgttttgtgtttggatcctatctgtgtacttgaaagatacacgtatatgtagatggatagtgagttccatcaggatgctcagcgttgaaagcataggagggaactgtgctgagcgtgtgaggtttggcgattgtgctcttttatcttctttctttcttgagtttttagcaagataagacatgtaactactgtaaaatgagaggtaatttttaaaatagccactgggttaaccaaaaaccttttaaatagctgtggcatccagtgtgggcaagggtcacatagttttgttcctggaagtgtaaattgtttcagacctcccccggcccccagaaatttgctagtatttatcaaaatttaaaacatctatatgttctttaatttaacagttccacccttaagaatctcacttacaaagatatacttgagaaaatgttcatggtaaggtgtttcataatagcaaaatttagaaagtgttcaaaagtaaaatgtggagaatggtggcttccctgcagggtcattggtcctcagttacaaggctgcagtccatgatgtgttatagtttaaagtgtgttgtaagcactttgtaactaatactaaaattctgaagttagcaagtttgccagtgactttgtttaacaatttttttgtttataaaataaagtggattaaaaatgatccatatgatactctactcattcatatttggactttttttttatttgagtaggaaaaaataggagagacttagaccttgcaagcccagggttgtttataactcttattttcactatatgggctataatctgcatagctcatggaaatacattatttttatatatcgcagcttaagaagggttgagaattgttactgtagtgtattttgtgtagacatcattttaatgacataaattttcttattaacattattatattttccattttggacacagacctttgattttagtatcttaaaatttttaatttttgagaatgtaaaatgctaagaaatttaagcacatgaaaacattgaaaattaggatttctttccatctttgaaccttcgaaacaagaccccaatttaagtctttagaggtcaccactgttaccttctggagcatgtgtgtctgtatgtgtgtgtgtgtgtgtgtgtgtgtgtgtgtctgtctgtctgcgtgtgctagaattttgctatcatttgttttgtaagatactcttagttgcttaagtaggacttactttttttatatgaaaagaagtggcatagaacttttcttatataagaaaacagtggtccctaggcttttaaaaataagtatggaatacctacctgcaggtaagttatttaatctttatgacaacttatgatgtattcttatttttattcttggttttatggaagagagaacaatctctgaaagtttaaataaatgccttgtccagtgtcacatagctggtaaatgagagagtatggatccgttgtttagtatatgttccagactgactctcagatgcattggaactgggctgggccgttagtggtatttgtttttgatcgatagctttagctggcatctgttcttgctgttggtggaggcttctctctttctgcttccttcccctcttccccattggtgtatcatcatagagatctaaaaagtagagttgtttcttttgtttttctcatcttgtaacttggatgccagtgaaggcaaatcctcacttggatttgctaacttactaagtaaggtaactgagtgagctttgctcagttaactgagtgccagagctacagcatagagatattgatgcctttaaccactcgttgatattcttaagtggaactaataaagtctccctggatttggaggagaaagttctgtgactcctttttccttttcataataattttataatatttttctagttgtgacttgtacatatgtgatgttcaaaagaattgataagaactaatgaatgcaacttcataaaacccttattatgacagaatatcttttgaaatgtttgagaacgtttcctttcctatatgttggcttaaggtcagcttttagaatatttgaagattttgaatgcgatgtggaatactaaatgctctaaagtgaatgcctgaaaaaggaaaactctccctttacagttagggagtcttttaaggatgtagataggtcagatacttttagggcttgtgggattttggggagtggtttcaataggaaaagtctgggatttgatgaggctgggatttttttccctttgcttgaggttaaaacagattgaagtgttacgttctagttttcctattacgctctctccttactgccctatgtatctattagctcattctggagtcagaatgacagctaaattctttctctgccacttagtagctgtgtgatcttggacaggttgtttaatgtcggcctctgaagattgtgttttattcttactatttgcatgatatgtatttctccatctgtgattttatgttgaaaatactgtgtgtttcttgtagccaggatgtagttgtgtcatgcttttgaaataattctgatggtctctatttttaaattgtagtgtttagactatgaagttttttcttctttagtttgccttagtgtattttcttaaatagcagctttattgagatttaattcatgtgtcatcaggctcaccctttaaaagtatacaattgagtgatttgtagtatagtcacagagttatgtaaccatcactgctatgcaatgtcagtaaaatccattaacatttaataaatgatcaaggtggttggatttatgtctagcattttattatttgttttctctcagtctcccctttttttccttctgttttccttttctgacttggattattttagtaatttttgaaattccattaaaatttatctattggatctatctatttttcagtgttttttctaggattgcaatatccatcctaacatttcatattctagttagagctaatatgataccatttcaagtaaaatgtagaaattttgcgatcatatagtccatcctccttctcttcccatcactatcctctatgttatagttgtcatatgtatttcatctgcatgtattataaattctatgtgaaaatgttataattttgttataaacatgttgaggtgagttaggacatttctttaaattgatctgtcaaatttaaaatatagagacaaatctctagattaaatattttatttgagaatcacagaattggaatttgagacatacacatggggtcttcagtatatccaaggaacaaagagaaggttgaaggttttattagatagaaaaaaaatgttactgattattttgaaagaaagttcattggtacttgaaaagctttgggagctggcaggctcggataggagagtggcagtggtagtttaaaaactagtcttagagtgatagcaggttgtttcagcagttactaggtaaagctggtcttagggttacagcaggctgtttcagcaactgggcctctggatagttcagttcttggagcctgtgctatgtgccctgagtgcttttttcccctgactccttgactcttatgtagttgggtatacaagaatgacccaattcatgtaatcaactttcacagatccaaatatcattcagttgaaattaagactcattttattttggtccatttaaaaaatgttgtcttttaaaattacatatgtatttttattgtggtaaagcagacataacataaaatttaccctttcaccaattttaagagtgtggctcagtggctttaattttattcacaatgttttgcaatcatcagctccagaactttataatcaccccaaactgaaactgtacatattaaacactaattccccatttcccacctactcctagcccctggtaaccttccttttactttctgtctctgtgagtttacctattctaggtacctcacataagtggaatcatataagatttgttcttttatgtctggcttatttcactcagcataatattttcaaggttcatccaagttccttcctctttaagactgaataatagtctactctgtggatataccatattttgtttcttcatcacctgttgatggacatttgggctgtttgtaccttttggctgttgtgaataatgctgctatgaacactggtgtataagtatctgtttgggtccctgcttttgcttctttttagtatatagctaggagaggaattgctgggtcctatggtaattctatgtttaactttttgaggttctgccctactgttttccatagtggctgtaccatttctcattcccattgttttattgtttttaataaccaccaaatcatgcctttccttaatgcaagctctgggtaattagttgactcattggatatttgtaatgtccgctttacataagtttaagaggtttaatttgacagtatcttcctaaccaatatgtttatgcttgttagtctagtgttactgccagagacctattgcacagacttgtgggagtattaatattttttcccctcacattttctttaatgaaaaatttaagaaatacagaaaagtttgaagaattgtactactacaaatgccagtagattctataattaacattttcttatttgtttttaacatatttattcatttgtgttttcctctactcatctatcaatctcattttcattttgcacgtcaacttaagttgtagataatagtacaattcactctcctgtacacttcagcatgcagtttttaaagcagagttcaggccaggtgtggtatcttacacctataatcccatcactttgggaggccgagataggaggatcacttgaggccagaagtttgagggtgtagcgagctatgaatccagcctgggtgacagagcaagaccctgtctcaaaaaaataaataagtaaataagtacaataaaaaaataaaccagagttcattattcatttacagcttttccaagaaagccttattgaaatataattgctattcaataaagtgcacatatataagaaattaattgtacacttatatgtgtacacttatgaaatcataatcacaatcagaataaagaatgtatccttcaactccaaagacttcctggtgctccttcgctggctctttcggccacttcctagccttcctcttcccctttaggcaactactgatctgttttcttatcatagattattttgcatttactagaattttatataggtggaataacacaagttatgctgttttttggatttttttttcacccagcaaaattattttgaaattgatgcatgtaattgtgtcagtacttcattccctgttttgttttgttttgttttggagacagagtttcccctcttttgcccaggctagagtgcagtggcacaacttccgcctcctgggctcaagtaattcttgtgcctcagcttcccaagtagctgggattacaggtgtgcaccaccatgcccagctaatttttgtatttttagtagagacgggattttgtcatgttggccaggctggtttcgaactcctggcctcaagtgagctgcctgcctcagcctcccaaagtgctgggattacaggtgtgagccaccgtgcctagcctgcattcctttttattgctgcattcatttctttttattccattgtatgggtttaccaccatatttttagtagccattcatctgttggtggacatgtgagttgtttccagcttttaactacaactagaggtgctatgaacaagtagttatgtgggcatatgctttcatttttttttggtaaatgcctaggagtggaatggctagatcatttgtatgttttatcttcttagaatctgcaaactcgttggtacaattttacatttccgccaacaatgtatgagtgtactagttgctccacattcttaccaccctttaaatttaactgttatactatgtagtgatgtcttattgtggttttgatttgcatttgtctgatgattaataatgttgagctcatttgctttatatctttgtcgatgtgtttgtgaagtcttttgtccatttttaaattgagttgcttgtcttatttagacatattagggttctttattctaggaaaaatcttttgtctggtacatgtcattgcaaatattttctcccatgatgtggttctgttttcatttactcagcagtatcttttgaagagcaacagcttttagtcttgttgaagtccaggttattaatttttttttcttttatagtttgaaccttttgagtcttaaaaatatgggccaggtgcagtggctcacacctgtaattctagcactttgggagactgaggtaggtggatctcttgagtccaagagttccagactagcctgggcaacatggtgaaaccccatctctacaaaaagtaacaaaaattagatgggcttggtggcatgcagctgtagtcctagctgcttgggaggctgaggtgggaggatcacttgagccttggagtttgaggctgcagtgagctgtggagtgttactgcagtccagcctgggtgacaaaagaagaatgtgtctcaaaataatgaattatttaaaaaaatagatatatgtaatttcttgccaaactcaaggtcactgagactttcttgttttttgttttgtatttttaatgttttatagttttagatctctgatcaattttgagttaatttttatatgtggtgtgaagtagggtctaaattaatcttttttgcatgtggctattcagtttgctatacaatctcttgaagaggttatcccttcctctttgaattgccttggcacccttgcagaaaaagtaatgggacatacatgtgcgatctcggctctctgcaagctctgcctcccgggttcatgccattctcctgcctcagcctcctgagtagctgggattataggcgcccaccaccacaactggctagataatgaactcttaaaaatactttgtccacaccccctttcatttactcccatgtattactaatcctgctgaggccgtcttggtgtgacctccttcctcaccactgaccccctcttttctctctcagaacttccttactttaacaatccagttgaacacatatgccaccttattcagcagttgaatctcaacctgagagattctagtgttcattcttcagttccacacataaccatcgtgagtaagagaggctcattcccatagaaggatgaggtttaagattgctccagtcattaacagtatacaagatgtcagatagcgttttactgggtctaagataaattaggctgtaaccaagaatatttatatatcaaaccagcctctccacacatcccaattataaattctggacaaaatagaaaaagctacataatacctatgggtaccagagagcagccacaattagacagaaataggaaggcgactacccttggaaggaggaaatggcatgggggcagtttccttttttggccttttttgaacagttcctggaatgaattctggagtgttccatgtatgcatgggtcagattccaagcactccagctgaggctaaaagaaccaaagagaattattagctgttacttatgctagtattgggggaaaatattcaagttctacctaggtgactcttgaaccccttttgaaatgtgacaacgtagcagatgctgttgatgctgctgtccaccctttctgcccggttgttagcgtcaccttaggtgaccatcccttccctgtgagtctcagtggtaaattctgactagtgaaatcctgaccaggattcattctcttccttaccaatgaccagtttatgggaggctcatggtccagtttgattcctggcaagtgaggggacctttcaagaaaaggtttcttttcattgtgtgaaataagcctttttaaaattattttaagccattgtaaactgagggtttttattgttgttgggatttttgttttgttattttaattttggccaaaactaccgggttgaaagaccagtgttttacagactgacattctattgaatcttaaaatagaatatagcttctgattcttgtgttaagctttctgaagtaatttagaaacaaaaccctctatggattacatggcaaaaaaggcatgtttcaaccataaagtaaattgttttaaaaatttcccttaatttggccaggcgcagtggctcacgcttgtaatcccagcactttcggaggccgaggtgggcggatcacctgaggtcagcagtttgagaccaacctggccaacatggtgaaaccccgtctctactaataatacaaaaattagccaggttggtggcgggtgcctgtaatcccagctactcaggaagctgaggtaggagaatcgctggaacccaggaggcagaggttgcagtgagctgagatcgtgccactacactccagcctgggcgacagagcgagactgtctcaaaaaaaaaaaaaaaaatcccttgatttatgtaaggattagtcacttttgtatgcaagtagaaggctgaactcatgctttttattttttattttattattattttttgagacggagtcttgctctgttgcccaggctagggtgcagtggcacgatcttggctcactgcaatctccgtctcccaggttcaagtgattctcctgcctcaggctcctgagtagctggaactacaggtgagcgccaccatgcctggctaatttctgtatttttttttttttttgagatggagtttcgctcttgttgcccagctggagtgcaatggtgcgatctcagttcgctacagactccgcctcccaggttcaagcaattctcctgcctcagcctcctgagtagctgggattacagatgcctaccaccttgcctggctaatttttgtatttttagtagagacggagtttcaccttgttgaccaggctggtctcaaactgctgacctcaggtgatcctcccacctcagcctccggaagtgctgggattataggcatgagccaccacacccagcctgaactcatgctttttgattcttctgtatcactcaggctttctggaggtgcttattaactctttgctagattagataagttgctgaattcaaatttagaattctggaaataaatgtagaagggatgctttgagaagcatccttgtgctttcattgtgttatgctattttaaacttacggtaacttcgtgatgtcttaaaatttattttcattgatttatttgtatgtgactcctaagcttagaattcagttggaaagatttttgtttttgttctagtgaaggaagtacattgctcgaggatttttttgggttaactgaagtaatgctagttatctctgttacatgtagttaatgattcttgttgcccccagatttgttctaaacttaaacttttaaatgcatgctttctaaaacaggcaaagaagcagaaataatgaaatgatcactggggctttgtttctgtactggtccttatttaaggatattacaatgttcctaagttaccattttgactcataatatgtgatatgctaatgttccaagcacagagtattcttttctgtatgtttccacttcccaacctacctatggtgtagcgcctgtctgtaccactacgtgtgtgcatgtgtacatgttcctagctttttattcagtcctttatgtgctagttgattgttgagtgcagataaaaataatgtgttgtatttcttaaccacaatatttgatttataaggaaatattttgataacagcatttatagtaatatatgctcttactgattagaatgccacaattgatagaaaatatattggatgtaaattagttacatatttacataatctatacacaagtaacagcatattttgtcagcatagcgtacagtagccataaaataagagtgggtgatacaatagagcattggttcccagtatgttctgtggtacctggggactcttgagaccctttcagacactctgaagtaaacaattttccataatagtttttcctgctctcattctctgaggattgtgcagtagagttttccatgtaacagtagagttatatgatatatgttatcacagcagattgaatgcaggaaccagatttgagaatccagctgtcttaagccacatgttaaagagatttgtgaaaatgtaaaacatttctactctaatgaatttgtcataaaaatgttacttctaattgttaacattaaatgggctattcttttgaaatacatttttaaaaatttcttaattttaacatggtaaatattgatatatacaacatgtataagccaaagctccttgagattgtcaatatttaaaactgtaaagcccagaaaatttgataggcactgtcctgaaaggtgactgggtagcctcttgagatagggtgatgacagtcttctctgagagtgtggcctttaagctgagattctagacagaatgagcatgcctcctctgactactatgccccactccacttccacattcttttttagccttagtataattacttccatgtcaagtcaaggacttttactcattcatttctgaattcctgttgcttaccactttacttactagtcattaataattctttacggccagacgcagtggcctacgcctgtaatcctagcagttcgggaggctgaagccagaggatcacttgagtccaggagttcaagaccagcctgggcacataggaaaaccccatctctacaaataatttaaaaattagctgggtgtggctgggcgcggtggctcacgcctgtaatctcagcactttgggaagccaaggtggacagatcacgaggtcaggagatggagaccatcctggctaacacggtgaaaccctgtctctactacaagtacaaaaaattagccgggcgtggtggcaggcacctgtagtcccagctactcgggaggctgaggcaggagaatggcgtgaacacaggaggcagagcttgcagtgagcggagttctcgccactgcattccagcttgggtgacagagtgagactctgtctcaaaaaaaaaaaaaaaaaatattagctgggtgtgttggcatgcgcctctggtcccagctgcttgggaagctgaggtgggaggattgcttgagcccaggagatggaggctgcagtgagctgagattgcaccactacactccagcctgggtgacagagcaaaaccctgtctcaaaaaaaaaaaaaaaatttacctttcagtggaattatttatatacatttctacacatgagacaaacttttgaaggaagtttaatgtctttggtattcacatcaaactaatttgacatatatttttatttagttttttttaaaaacaaatattttttaggatctgttatttcctattaaattccttttacatgaaagatcataaattgatttttaaaaatgacttctaatgttaatagggctttgtcttttagacatatttgttaatgataaatttgtttctgtaatttttatgctttgtagctttaatttgggcccatacgtaaagactatgtagttttattatcattcctgccgtcatcatccttgatcataccatttaaaagcaatagaagttttaaatggagtagtagagaaagacaatcaggaattaatgagtttagataaaataagagtacaagcaaacaaagttgattgtggccatgttatgaatgcgtgagatttcaacttttaacaaattaataactttttttgaacacttagtgtgtgccaggcactattcccacccctctgcatgtactaactcatttgctcttcctagcagccctatagacaggtactattatttctgcttttcaggcgaagaagcagaagttgctcaggatcacacagctgttagtgccagggcaaggatttgaaccccgtcattaccatgctcataactaccggactatgctacctctgaagaagagattatacagcttgttgtggcacaacacaaaaccttaaaatgttttcagctcttttttttttacccatccttattttttccccatatgactattatttattcagccttttggtatctagcttgcagaatatttcagggtcccaaagggactatataaagagctgtctgtaaaagttctgctttcctcccaaaagctagcagtgggaaaaacaggcaggagagataaggtgcaaagcacagggaggaagaaagagaatagtggaagcagcagtggtgatctgtagtggtgtctacagtgtgctggttctggttgagttggtacgggcagccatgtcagcaaccaagtcttcacttgttggaggactcgctttttacatgctctggctgggatggttttagttactaggatgtaggggacaggaataacggcatttggtagagattcaaaacagcaaccagggatgacgagctgcagacattgatcgatatcaagtaaataataagagatagaagataaaacagctctcaggtgccagaaagcaacttggtaatggagaaatacatatcctagagaaaggtagacaagtgtatttatcctctcaggaaattacctggataagtgtacatttctgcaaagcaaaatagagtcaagctcctgaactcctgctgcataggctggtaggtgttaatgggtgtctgaatggagaaggatgaggacttcaggtttctagtaaacttaaatgtgatatggtttggctgtgtccccacccaaatctcatcttgaattgtagctcctctaatccccacgtgttgtgggaggaacctggtggaaggtaattgaatcatggggggcaggtttctcctgtgttgttcttgtgatagtgaatcagtttcatgaaatctgatggttttataaatggcagttcccctgcacaagctctcttgcctgctgccatgtaagacatgcctttactccgccttcacttgccaccatgattgtggggcctccccagccatgtggagctgtaagtcaattaaacctttttctttataaattacccagttgtgggtatttcttcatagcagtatgaaaatggactaatacataatgattcccttgtttggaggattgtcagatactatatgaaaagcggtttcacatgtgcttaaaaaaacctgtatatgtgccttatggtgtcattatttctaatttatagatgtagaaataataatatttagagaaataaaatgctttttctaatcacatgccagtaggagatcagcaagctgggactagaactcaggttattttgattgaaattcttttttacgaagccctgagggttctaaaaagctcgagtttcactgtgaaccattgtatggaaaacttaaatgtagccagaaaccacatagagaaaataaccaggttttaaatgttttatagtataatatttgttgtggtactcttttatgggctttaagaatctagtatgctggagggctggggtggctcacgcctgtaatcccagcactttggggaggccaaatcaggcagatcacttgaggtcaggagttcaagatcagcctggccaacatggcgaaaccccgtccctactaaaaacacaaaaattagccaggcatggtggcgcatgcctgtagtcttagctactcaggaggctgaggcaggagaattgcttggacctggaaggtggaggttgcagtgagccaagattgcaccattgcactccagcctgggcaacaaagcaagaccccatctcaaaaaaaaaaaaaagaaaaaaaaagaaagagaatttagcatgcatttaggtaaccacagagataaaatcatattcaaatgtgcttgtattatgagtattactcttctttatgagtattctttggaaaaactattgtcacacaataacatattaattatatctttattcatttaccatatttgaaattctcattaaagttttaaaatgtattttaattataaaaataatttacttaaaaagttaataaatactagatgtctgttcacacttcatttttccactgtaagttgcagattagattatgatgaacagactataatcttctaatattctgtgccctagtaaatgagtccttgcttatgtaagtcagatattttgttattttgatatctaagtaattggttattatgatttatttttttcttgacaagcttctgagctttgttcagtcttgtcaagtccctggtgagttttagatctctgagtctagagtttgttgatcgaattaatgaataaaccaatagattagtacattgttgatttttttttcccccaaaccttagatcctatttgctctcttaggaaactgtttgaaagtattgcaacttttagagaagttttgcaaatcttagccacatgtctactaatgttttgcacactatttttagttgatgaaatgtaagcaatttatatttgtcttaactttccatctataaggtagtgagagtggtgacaggctgctctgttttgcagctagcatctttaattgatgttgaattgtggctttccgtgcacacagggttaagtgaaaaggttgcagtcatctagtgagcattttcctttaatgtgctcattagtggtggcaagtccaggtttcagcacatgtcagtaatttacatttcattgtggagaggctgcccttgttcaagagttgtttctaagcctgatgaatatatattgggaataaacagagtagaagaattgaaagccaaataccctgccaggcctttcagttggttctgaagcttccagtggatctctgattagcaatgcataaagcaggatgaaaatgcaaagatgaggcctacaaaagttgtcgcaggtagcttctccccttaaatcctctttttgtgactgcttttccatttcatcttctccaaattcttttttcatggcagacttcgttaaagtgaaaatactctgtgttagacgtaagatgtgaatactacaggatctacctggttcctgtaccccttctaactatgaagccaagtctgatcgttatgcaatgagttttcagaagcaaagggcttgataggcctcggttcttagggatcagatgattgtgattggaatctttgtgatgattccttctgggactcattttttccatctttgcctgattggtaggtaccagcttgttctggcttttgaaagcttgcatagatcagtaaagaataactgtggaggctgtggtcagtgttgttggggatagagacaggactctgaaattgtggtgtttgggaaaatccagaaattttctttttgtagaaaaacttcatatattaaaatgaagcatttttggaacttgggatttgattacaagttacttcatgcatagatggtgtagctttagaaaactcaggcctagctgtttttagaagaaaatgttataattctttatacattttaagtttaattatttacatgtgtataaaaatttgggtttattgcaagaaggtacgttttgatattgctgtttctgtgtgtttgtatgatacatctacccatgtatctgtctacttatttatctttgtggtgctagtcaaaacttgcagcttaagagaatttgttcagaattggtggttagaatcaaaagtgagtgaatttatgacttacattattgaaaaacattgacaaatgtcaggactcaagtccgatttttattattttactgtaaatccagttagatgtgatttagcacttggatcatttaaatataaaggcatgttagtcacagtttaagtctttatattagtttttttaattaggtagagttttaacagaggagcaacatggaaaatgtttatgtgtatgaggataaaaatgcaagtcttgagaatattagtttagtaatgttctgattagtgtttgtagcctttgtaaaaaatgtaaatttaccttctagatgactacttgaaactgttgtttttggatgcttgccagataaaagccctgtgggattaagttctggtaaatcgcttgcaaatttgtgagggatatcagtgactttgagtgtttaactgtccaagctgtcatctacatgcgtcctatcactgcattgggtgaaaaaattaagtttctcagccagttagaattaaaggtgacatctgcttttaattggtgttttattttcttccaagtcagtaaaaattcagtaagacatgaattatcaaattttgcaatgctaagcaacttgtcaagtgacagtaagcactaccttgagcagttgtacagatgggaagtgttaaaatgttgattaatcttccagagttctgattatgagaagactaaagcttatatcatcattgccagctttctagtgtcagagtagtatttatttgttaattttgtagacctttttcaattactgacaaattgtgtcttgcataatgaaaattttactagttttaataagacttggtctattagactaagggtcatagatggcaatgtagaattcatgtttctgttgtctattatttagtaaacatattagattctttttagtaaaaaactgaaaaaaatctaaacgtgagctttaagttttattctgttatacacattcatcctgtgttgagaagggagtatctgtttgaatcttggcaaaggaagtcttgcctgggccccctgttgaaaaagaaaatggattatttctgtttttaccatttataaaacattttaagatgtaaaacataaggacgaaaaaaatcatcaccttcaagtagtccatgtaaaaataactcaagtcttcaaacattctcagaactaaaaaagaccaaagaaaatattcccatcatactgattatgtttcaattttctagttactaaaaattagaacatggcactaagtagactatataaagtatgtctttaaaaattcaactgtgaaggagatcttttttttttgataatcattaatatgaaagtgaagtttctcttttccctgttataacagttctatgtagtagtagaggtagaattctgaattgaaggtggttaggacttatagcaacatttctgggatgagtttttcagtattcccagacttcaatttaattcagggtttcttttttgctctccacttatgaatatgtgataaatattttatgtagtcgtgtacttttgctatagaaaatcagtggattatttaatttgattcaggaaatctaccctgtatggttatttcgatgttgggtagattttatttcaacttaaaacgtagaaaagatgcttaggcaaatgatctaatagttttagatacatttggtaacttgtatcttaaaccccagggccaagtttagcagtcttacacatgtttagaaaatagttgaaaaatagaaaatttaggtctttttaggtaaactatacaaaacacttttatagtcattttgatgcctgataacttcagggttcattgcccctgtacatttttcaaattatttgcttctcaatccataaggctttaatttaccccctactgacaaatcccaaatgggtttttaagaattttgagagtggtctgctgtagttgtgcttcagcactggcttcaattgctgacacagaatctcttaagatgcaccaaatttagaaggataggaggttcaggcagcatttcctctggcaaatactaagattttatttgcggagggtggggacggagatacagaattactgttttctgtaatatttttctttctttgatcctgttttaatgcctgtttattaaaaaaaaataatttagacacaagatttagccacatttttttaattaattaaaatgtgtgggccgggcgcggtggctcatgcctgtaatcccagcactttgggaggctgaggcgggcggatcacaaggtcaggagatcgagaccatcttggctaacactgtgaaaccccatctctactaaaaatacaaaatattagctgggcgtggtggcaggcgcctgtaatcccagctactcgggaggctgaggcaggagaatggcatgaacccgggaggtggagcttgcagtgagccgagatcgtgccactgcactccagcctgggtgacagagcgagactccttctcaaaaaaaaaaaaaaaatatatatatatatatatttgtgcttgtttggatgggcttttttaatcttgaattttatagaataataaagttaagtatttgtaccttgacataccctaacacaattaagtattgcttccataaataattttgatcttataataaacataccttacatactgacgaataatattaacacaaatgtatactcccttagaggtgctcaaaatgactttcatgccacccttcatgcctgctgggttttaaggcataagagaaacagatgatttctgcattttactggaaaaaaaagactaaaatgtacagctagtattgaattggggtaataatctgccacttttttgcccttcaatgctgtcgtgatcttttagggaagtgaggtcatggtagacccgcttgttaatcatttctgcgttttcagctcagtttggtcatgaatacttgacttgctacctatagtcttgcttctgtttgcctctttgcatgcagctccttaaattgtttaaattaccatgctttctttatcatgtgatcctgtcatctattgacaattgattggatcaaggattagtgcctgacccaaggcagacatctacagaagggtcatcctcttcccacaatggtttattttcctgtctgtgtgtgtgtgtgtttgtgtgtgtgtgtacgtgtgtgtgtggtggtcatgaatggtggtggtgccaagaaggttgtgacatttgactaataactgatgatgagagaagcagccagcacttggagatctagagtaagagctctccaggcagagggaatagcaggtttaaatgttctgaggctggaatgagatttgagacatagaatatagagattggatatagagaaaggaactggtgtggcaggagaatcatgaatgagaaaacacgtggtacaagatgaggttgaaagggtaggtggctcagggcagatcagttagggtcattctaagaagctgggatttaggtctgagtgcattggggagctgctggaggagttttaagcatgtggtgcacttctgtatcacttctgacctaatgtgatgcacttctgtatcactgtaacaacagtgcatatcagactgaagaactatgtgattaagaacactttgctacataggagcagaaaaatttaaagaagaaacagtgccctagaagaagttaaattctcttgggcatccacctgtagacgtcctcactccttaatttgtcctgctgttcttagcatcatagctctctgtgaaaacaaagctatcttctaatttatactttgcaaatcatttgcttttccgtaaaccccattcttgcctattggggttaatctaataccaagatccaagattcctcttcccacaatggtttattttcctcaggctggattattcagtattgaaaaacagccccataagacaacccatgggaaccattgaccattcaggtcctaagaacagttagagttagggggtaggtgtggatacagaggttgtatgtatgtggtattccagtttaaggtggccactctcttctgatttctttctcctctgattttgtctcctccgatttctttcccctggtattaattactaatacgcttctttgactttctgtctggctagtaggtgaggttacgttgcacaaatgcttaaatgaatgcatgtatattggcatccttgtatatgggcttatgtttgcacacaaatactcaaattccagtgaagtttgctttgccaacatcctttccaccacaggtgatttgtggaagccagtcaggatcattttatcttccctgacaattattgattcagggattaatcaaggcttaagccattgtgggccactgaaacatgatgaaaggctttcctgggattcctggaaaaggaacctccttattcttaagagaaagacattggaagccaggttctcttgcattctcccccacccaccaccttgtgaatgagagagcttagttgctgctggcagccatattgtgaccatgagggtagctagcctgagggtaaagctgacttacagaataaggcagatctgagagaatggcagagaaatccagaattgggagatatatttttggaagaatttctgtctaaaagtgttggtggggtatgtgttatggcaagaagagagctgggatgtttaatgggttaacagcattttgttctttatcatatatttattgaaaaattttcctatcccattgtgctaggcactgaggaaattatttaaaaaataaagtagggcacagaacttgcctttccaggaaactcatttacaggtattgggttttgattctttctttctttcttctttggaaacagggtgttgctctgccgcctagccggccaggctagagtgtggtagggtgctcatggctcactgcaccttctgcctcctgggctcaagcaatcctcccaccgtagcctcctgagtaactgggactacaggcgtgcaccaccatgcctggctaatttttgtattttttgtagagatgtggtctcgccatgttactcaggctggtctcgaactcctgggctcaagtgatccgcttgtcttgattccttgtataactgccccttgtattggatttggggactgaaagaacacttagttactaatattcttttttttgtttttctttttctttttttctttttttttttttgagatggaatctcgctctgtcgcccaggctggagtgcagtggcgtgatcttggcttactgcaacctctgcctctgtgttcaagcgattctcctgcctcagcctcctgagtagctgggattacaggcacgcgccaccacacctggctaatttttgtatttttttgtagagatggggtctcgccatgtttctcaggctggtcttgaactccagggctcaagtgatctgcttgtcttgattccttctataactgccccttgtattagatttggggactgaaagaacacttagttactaatattgtttttttctttttctttttttttttttttttgagatggagtcttgctctgttgcccaggctggagtgcagtggcttgatcttggcttactgcaacctccacctccccgttcaagcgattctcctgcctcagcctcctgagtagctggaattacaggtgtgcgccaccacacctggctcatttttgtatttttagtagagacggggtttcaccatgttggccaggctgatctcaaactcctgacctcaggtgatcctcctgcctcggcctcccaaagtgctaggattacagcactgtgcctggccagttactaatattcagttttaaattttagaaacctagtacttaaagcacattaaactttgcttactgtggaaccagtgtcagggctgtgagttgccttcagtgatgttgctgggtagccaggcttatctgtgcgttatacgtgggtgctttgaggaatccaacaatgagaagatagctagccttgaagacagcactggaagcagagagtagccagcagtcagtcagtcttctctctgagtttatgctccattctttgaggtgtttctgcaagcctctctgctttccacctctgcttgtctggcttgcggccctgttggaacatgctgacttcattgctcctaagcctacatgatatagaccagggatcctgaaaagaggaaagcctctttttctctctgtccccatgccccattcctaggaaagggaccctgataggtctagtttgggccagctgccttttgccactcccgtctgttcagagagcaagattatgccattcacaaggtctacaactgaagaggtcttttgctgagtttgggaaaagggcagttcaggaaaatcagactaactctgccaccaaatgtctcttaaaccacataattatgggacagtatgataattgcagcaatcaaaggctgttgagtgttgtgtacaggaaggtagtggttaactctggtaggttgggggttgggtacagctgaagagaagattgtcaaacttcacataaagggtctgtgtgtgtgcgtgtgggtgcatgcatgcgtgtgtacgaaggattcatgagggggagtattttatattggtgtaggtgttggtttcctccccaagaatttattcctatcataaatactctctgtgcccctgtgacagtttcataactgtggtatcattagcgttacaaagtacagaagacagaataaaatcatggactttttgagctggaaagaccttgaaacttatctaatttgtttgacatacatcttttgatgtggcagattctggtaaatataaagacaaagcaggttccctaccctgaagaagtttatagggggactacagcagggaagaaatactgggaggagtttctctgattcccaggagaggatagctggccatcgggggaagtcagatgacgaagtcatccattttgatggaggagatgtgcccagaaaggcttcatgacgaaggtggcatttgaagtaggtcttgaagataggtagtgtttaggcaggggagatgatagaggagaagaatgggacacacaggtggaggggacattccaggaaggggctgtagtgtcgggatggcagaaaaaggggtgctgcattgagccatgagctgtgacagacctttgagtgtaagagtgtaagagtaagcccggaaggcgaggggccctgggtactgggcttgaatttgtttataccattcaagctttccagaaaacccctgtgagctttgaaatgcttcaggggagcattctgtgtgaggctggctttttctgcccttttcctcaattcagcaaatggcaagaaacttggtatcatctttgcccacctttgctgttaggccgtgtgctagtctgttcttgccttgctataaagaaatgcctgagactgggtaatttataagaaaagaggtttaattggctcacgattctacaggctgtacaagaagcgtggtgtcatctgcttctgaggaggcctcaggaaacttacagtcatggtggagggcaaagaggaagcaggcacgtcttacatgaacagagcaggactaagagagagagggggaaggttataactatagtagttattgcttcctgatagataatttgtttgtttctctttctcctctgctgaaatacagcctacacaaccataggagttcctgtctcttgattgttgctgtttcctcagtacctaggacagtgtctggctcatatatatttgtttaatgaacaaatgaataagagatgggttatttagctttaggccattcatggaaagtttaataccataaattctctgttaagtaggcagatatttataaatacagaaatggcttctaaggtgtctccgtaagatagctattcaactgttgcacgagcttatgatgactggaatcgtacgccctttcatcatatagaccagcatttggcaggctttttttctgtaaagggccagataataagtgttttaggctttgtgggccatactgtcacaaccattcaactccattctaaatactcagctcttctgttgtagtgtgaaagcagccctagactataggtaaatgaatgggtatggctgtgtttcaatacaactttcattatgaatacttaaatgggaatttcatgtaattttaacatgtcacgaagtattactctgcttttgatttttttcaactatttaaaaacataaaaaacctttcttagctcatagactacaaacgtggtgggctggatttggcctgtaggctgtaattggccagtacttgttatagagctttctgtcttcctcatctttaatggttagaaaattcttcattgtattaactgaaatctatctgtttagaatatttacctattttttcagtagtgaaataggacatatataccgaaaaatgcacataatgtaaatgtacagctttacaaattattgtgggcacccacataatattacctaggtcaaaaagtaagacaaatgtctgcaccctagaagccctttgcatgttcccttcaaatgatgctccttcctcccatcccaggaacactgtcctaactattatgggaatcattttcttgcttctctttatactttcacctccttaatatgcatcctatgaccctggagtttagttttgcctatttttttgaactttctatagatagaatcatatagttaaaaaaatttgctttctgtctttgtttctttctctctttttatcttttctttctttctaatattttctttttttctttcttttgacagttttgctctgtctcccaggctggagtgcagtggtatgatcatggctcactgcagcctcaccctcttgggctcaggtgattctcccacctcagcctcccgggtagctgggaccacaggcacaagccaccgtgcctggctaattttatgttttgcagagacaaggtctcaccatgttgcccaggctggtcttgaactcctgggctcaagtaatatgcctgccttggcgcctcccaaagtgttgggattacaagttttcttaaatttctttttctttttttttttttttgtgagacggagttttgctcttgttgcccacgctggagtgcaatggtgcgatctcggctcaccgcagcctccacctccgaggttcaagtggttctcctgcctcagccgctcaagtagctgggattacaggcatgtgccaccccgcctgactaattttgtatttttagtagagatggggtttctccatgttggtgaggctcgtctcgaactcccgacctcaggcgatccacccgccttggcctcccaaagtgctgggattacaggcgtaagccactgtgcccggctaaatttctttcagtaacatttattagtttcctgcttagaagtattgtgcattttcactgtatttattattagaagtttgagtcttaaaaattattcagttttctctttgatttcagtcttaccattccatctagttaaaatagctttgaatcaatattttatcattctttttcagcattggttcatcattgaattaggcaatcagtgtctttgtgtggcgttatacaagtatttagtaaaaatatccattagggaagggccaaaagtagagtagggctttttagttagacaaaaatggactattcaatgatctggatatggcgtttgaaacaattgtgtatctgtacaaatatatttagtttaatacacacttgtctgtgttgtccataagcacacatttgaatatggccacgagaaagattttgggtgaccatgtggataaaaaaattatttggtacagttatttctgctaatggatggggaatgtatagtaatatggaaagtacaaaataggggccgggcgtggtggctcatgcctgtaatccagcactctgggaggttgaggtgggtggatcacttgaggccaggagtttgagacctccctgggcaaaatgacgaaaccctgtctctactaaaaatacaaaaatggttcaggtgtggtggcacgtgcctgtagtcccagctactcaggaggctgaggcaggagaatcacttgaacagggaggtggaggttgcagtgagccaagatcgcatcactgcactccagcctgggtgagagtgagattccatctcaaaaaaaaaacaaaaaaaaaaagaaaatacaaaatagggatagtgtagaagaaatctgagaatgttttctacaatttaatgtgtatcacctagtaactatatttaataatactagatttatattctcttaagtatatgccaattgagaattgtgcagtgagttcagggatgctgtgaaggaattattttcagaattcaaaattttcaatggataattgagaattaattgcaatgatgaaacatatgtaacatgtagtagcttatgtaaacattagtgttagattagatttgtaaaattcctagttttcccaaaatatttgaattatgctgtagaaaagtccagggactcactcctgcaaccctaaatgtagctatactgatacaggatttggcagcctaatagatgtagggttggagcacaaagaagtttaaaaatactccattccatggatgtttaatagatttatacctgttgattattaatttttgagtttgtggattaggtattatcctccatgattaaaaaaattggagaaagaggataatcactgtaagaacgaatcaagattatgactttgtatgttcagaccaacatgggaagaagaaattcttggtaatacgtcaattgggatctgcgataggctggagaggtttttgggcagatatgggaaataatgctatttttagtctgttcactttcatcaagctgaccacaaggtggggaataatacattatatgaggtctggatgacctgcgatatcatccagagttataatagagaattatattactttaaagaatgtattttttaaatttggatatttacacatgagttagagtcaaacagtgtttttatagctatatcttgactagttatgccaacaataattattttttaaaattgtttctcagtactgtaaggttcttattttattgttgaaaaaaacttattttaagttcaggggtacatgtgcaagttcgttacataggtaaatgtgtgtcatgggggtggcactctttttatttcagtaaatttttgggaaacaggtggtatttgattacatgaataagttctttagtggcgatttctgagattttggtgcaccagccacccaagcagtgtacactgtacccaaggtgtagtcttttatcccccgcccccttcccaccctttcccccaagtccccaaagtccattgtatcattcctatacctttgcctcctcgtagcttagctcctacttatgggtgagaacatacgatgtttggttttccattcctgagttacttcacttagaataatggtctccactttgggaggccgaggtgggcggatcacgaggtcaagagatcgagaccaccctggccaacatggtgaaaccccgtctctactaaaaatacaaaaaatagctggatgtggtggcacatgcctgtaatcccagctacttgggaggctgaggcaggagaatcgcttgaagccgggaggtggaggttgcagtgagccgagatcgtgccactgcactccagcctggcgacagagcaagactctgtctcaaaaaaacaaaacaaaacaaaacaaaacaaaacaaaaacacaaagaaagaaagaaagaataatgaattccatctggattgctgcaaatgccattttttcattcctttttatggctgagtggtcgtattccatggtgtagatataccagtatttatctactcgtcaattgatgggtatttgggctggctccatatttttgcaattgcaaattgtgctgctataaacatgcatatgcaagtatcttttttgtataatgatttattttcctctgggtagacacccaataatgggattgctggatcacatggtagttctacttttagttctttaaggaatctccacactgttttccatagtggttgtactagcttacattcccaatagcagtgtaaaagtgttcccttttcaccacatccacgccaacatctaatattttttgattttttgattatggccattcttgcaggagtaaggtggtatctattgtattgtggttttgaattgcatttccctgatctttagtgagcatatattgaagtttgttggccatctgtatatcttcttttgagaattgtctgtacatgtccttagcccactttttttttttaaattatactttaagttctggggtacatgtgcagaatgtgcagttttgttatataggtatacatgtgccatggtggtttgctgcacccatcaacccgtcagctacattaggtatttctcgtaatcctatccatctcctagccccccaccccctgacaggccccggtgtgtgatgttcccctccctgtgtccatgtcttctcattgttcaactcccacttatgagtgaaaacatgcggtgtttggttttctgatcttgtgatagtttgctgagaatgatggtttccagcttcatccatgtccctgcaaaggacatgaactcgtctttcttatggttgcatagtattccatggtatatgtatgtgccacattttcttaatccattctatcattgatggacatttcggttggttccatgtctttgctactgtgaatagtgccgtagtaaacatacgtgtgcatgtgtgtttatcgtagaacgatttataatcctttgagtatatgcccagtaatggaattgctgcttagcctactttttgatgggattgttcatttttttattgctgatttgtttgagttcgttgtacattctggatattagtcgtttgttggatgtttagattgcgaaggttttctcccactctgtgggttttctgtttgctgattgtttattttgctgtacagaagctttttagtttaattaagtcgcatcttttatctttgtttttgttgcattttcttttgggttcttggtcttgaagtctttgcttaagctctttgcctaagactttgtctctatatttaaaaaaatatatgttgcccaggctgctcttgaactcctgaactcaagcaatccccttgctttggcctcccaaagtgctgggattacaggcatgaggcactgtgcctggctgcattattattttaaatccataaaatcacacctttttcagcttaagatcatttctagactgtcctctcactaaaaataccctggaatcaatatacatgttgttagtttgaaaattctttgctaggttgaacagccatattggaaaagtaccaaatccctttagggttttgttattggtaatataaagaggacagagaatgtatttcaaattagttgtcatttcatgaggtgttgcccttcatttcttggcaggtcttaactagaatctagcctcctcttataatagttgaaaatgtgtcatgactaattaatatgatacaatgagagcactgttttctgattaataaggtgggtggaccttatgaaatgttatctgaagatcacgcacgtaatctttgatggctgttattgcgttatattgacttgtgattcctgtgtgttcaacttctagtgtgaatagtaaggccaaaaattcaaaagggcttttgaagttgatttgtaattaaatagcattattaaaataaagagtcaaagcattgtcaagtgtgataaattcagtgtcaaaactgagcctttaaaaccaaaaagcgtggctgggcgtggtggctcacgcatgtaatcccagcattttgggaggcctgggcaggtggatcacttgaggtcaggagttcgagaccagcctggccaacatggtgaaaccctgtctctactaaaaattagccagatgtgatggcatatacctgtagtcccagctacttgggaggctgaggcgggagaactgcttgaacctgggaggtggaggctgcagtgagccgagattgtgctattgcactccagcctgggcgacagagcgagaccctgtctccaaaacaaaacaccaaaaagctcatgcctgttatgctagcactttgggaggccaaggcatgaggattgcttgagcctaggagtttgggaccagcctggacaaaataaggagaccccatcactacaaaaagtaagaaaaaggggctggtcgtggtggttcacacctgtaatcccagcactttgggaagctgagataggtggatcatgaggtcaggaattcgagaacagcctggtcccatggtgaaaccccatctctactaaaaatacaaaaaaattagccaggcatggtggtgtgcgcctgtagtcccagctactttggaggctgatgtgggaggatggcttgagccctaggtgtcaaagctgcagtgatcacactactgcactctagcctgggcaacagagagagagatcctgcttccaataaaacaaaacaaaacgccctcctcaaatcagaaagcattctcaaccatagtacttccaagcaccctatttgtgttagaagtgtttaaggcaatgataaagtcagtaaactatttcaagctgttggaagtgcatctcagcacacgacagttgtgatttcataagcttcttaaggtttcaagtgcacagcattttaccgcagaactattactgtctcaggaatgaggcccatggaacacaggaaaattctccacccagggaggaaggctgggaggcctcagcagccaatagtggtgtgactgagactctggagtcccttcacacttgtgtcgcagcttactacgggtcacctccgtcctaagtgtcttacatttattaatcatatatcctcacagatagggaaactgaggcacacagcagccaaggaactcgtccaaggccaaccaggtagtatatggtggaactggagtgaaggcaggctccacagtccctgttcttaacctttatactccactgcttctaattccttactttcttttatacaagaatataatttaaaatcctgcccaacacttgttttgtaagattctagtggcatgggaagtgaggggttacagttggtgtcagtcatatttcaaatggctgggaataggggtgataacatacacccaaggaagtcacgctggctgctacaacattgtgagaatatcattctgctgagattttacgcttgctggtagttgacataaaatgaagcttagtctattatatacaatgccagctttttccttcatcagttacaaggcttgactttaatgaaaggagaagactgcattttcaagtttgatctagaaggctatgaaggctctggttggaattattgagaaagacaaatctcaggtgatctgaacgtgttaaattgtaagagtacttaatgtgaattggaggaagcaattctctgaagcaaagggggaggaatttgtatcttggaaagaattgcctttgtcttttattatttatgcagttgataattgcaatattgccacttcacatatgaaaatatcattgtagtaaatttatgtagagttggctaacaaagttcccatccatctttgctttagttcaattgccattagtttcccagagtactttctaattcctctaccacagtactcatgctttattttgattttaattgtgttatattttctcttctagttagtcaaataagcgaggtcctggtgcacctctgtcttgtccatcattgaattcctaggcttaccacagtgcctgacgtagagttggtgttggcagctatttgtaggatgaatgaatacatgactgtgttaagcagacatcaaaggcgtataaaattgaaatctagttgttgtaagacttaaaaagagaggagatccttatagatgagtgctggttgtttgcaggatcattattattctctgatgatcaaaaaactgtttacgcatgcaccagtagtcccagctactcaggaggctgaggcgggaggatcccttgagcttgggaggcagaggttgcagtgagctgagatcacgccactgcactccatagagccagaccctgtcttaaaaagaaaagaacggtttacagatcagtgagagaggtgttttcctaaatatttaaatgtttgcttgcccatgctacttttccaaatcctaattgtccttttccccctcaaatgctccttcctttgtgaagccgtccttgattcccttgttggactctgttcaccgtgtctgatttttacctcttctagtgcactgactattcttaccgtgtattgtttttattttttggtacatgtgttgttgtttgttctactagactataaactcttgagtgtgaaaaccatgtctacttaaccagcctgcttccgagagtgaaaagggacgctaatcagataggacaccgagtaatagatgtgttcaaggctgtgcgaggcaaacctgatggctggttactctccagtaatctttagcttattgaaaaagcagaggccacttgcacctgtttacaagcaggtgagatgggcctgagaaggtgattgaattgcagattcaaaacgctggtttgtgtcttagtcttatctctgtcacttcactagtctaatgactgtgggtaatttatttcatcttgaagaccctcattttactgacatgttaagtagtgatgaccatttatttcctgctgtttcttaggccccctcctttttgtgttttgaggaagagaagatataaaaaaacgcccttgagagctgtgaagtgtcatagatactacaatatcgttttagaatcaattgaagactttctaactttgtaaacaaatttgaatctgatgactgaaatgctaatctataaaatggttttttagtaataaagtgagacttaatacagtgcttttaaatagtatgaaataagtaaataaatattgtagtttttgttagtatcattatattccttgttcttttaattcatttttaaacttagaattgtttcctacagataaacaaatgtcagcttgggtccatctactacatcttattgtcactttcacttcattgcatcattgctcttaatcagaataaagggtgaatttagcaggttgtagggtttgagtagtgctaagtattgtgaggaattgtgctcaaggtaattaattataaatcatagtccgggtgcggtggctcatgcctgtaatcccagcactttgggaggccaaggcaggcagatcatgaggtcaggagatagagaccatcctggctaatatggtgaaaccccgtctctacaaaaaaattatcctggcgtggtagcgggctcatgtagtcccagctactcgggaggctgaggcaggaaaacggcacaaacctgggaagcggagcatgcagtgagccgagattgtgccactgcactccagcctgggtgacagagcaagcctccgtctcaaaaaaaaaaaaagaaatcatgatctctgctattttaatattttgctcagtatttgaaataagctttataatgtaggctatagtaaaacacagcaattaagtgcttaaaacaagaatatcccaactgtaggtacagcatactttacctaaactatatgactcttatttctatccagcaatgggatcaaaaacttgatgcatttcagaaaacacgaggttaagcaagacgtgggaggattttgacttgtggtaaattttgaaagaaattgtaaatattttcaaagaaaatagaaaaagcacacaattcagagaatatacaaagccaattaaaaagttgtaaaattattattattattattatttttgagacggagtctccctctgtcgcccaggctggagtgcagtggtgcaacttcagctcactgcaacctccgcctcccgggttcaagcaattctcctgcctcagcctcccgagtagctgggattacaggcgtgtgccaccacacccagctaattttttttgtatttttattagagacggggtttcaccatattggccaggctggtctcgaactcctgaccttgtgatctgcccaccttggcctcccaaagtgctgggattacaggcgtgagccactgcgcccggccgtaaaattaaatttaatatctgatctgacggactaaacaaaagatctcttgcctttcaccagtttaccagctttctgttctttttcactcttagttcactaagtgtgagtggactgtgaggcatgagcaggaaggggtggcattgggcatttacagcaagagaccctcatgctaagtgaagtgttatcaaatcttcatttttttgcttatactgtaaaattgccaattatattcatagttattgtaagttatattccaaagtttaactggaaaaatattattttgcaaccaaaaaggtaccaattaatattcctgttcatgaaacaataaaaagaattgaatcagggagaaatgaaaacagctcattttaaatattcaaatttaaaatgatataaaatagggatataaaataaaagcattttatatgaggtatagaggaaagaaattacaacttcaaaacaaatccttgtgatcagcttccatgaggaggaccttagcaatgtataccaaatttaaatgtgaagcttcttaccttcttcttacctcatcttcttaaaagatacatctaaaagaaaaactaaaatttgtatcgatatgtttaattaaagcattattgttattattatgtaaagcagaaagaaacttctgaaaaatagttgagtgatacatttaagcatttcacctaaggaaatttagtgttatttaaactgattaacagtatttggcaaagtattttcattagcgttctaatattaaagctagcatttccttaaaggagggaggctaaaattcatcccaaagcttgtttttgttaactcaaattttctcagtgttattgctgaacaagttactgaattttctctgggtatcttctatattgcctttctttgattcttgtcagtgcaaccagtctaaggttttacatgataaaggaaatctgtggagctaatcctagaaacctctttctattttcttacctaacacctccaggcacagagaagacaaaatacttcatttgcattcttaaacattaggaactcagaataagtctttcaactggaaatgttattgcatctacatttcccgaagagaaaaaggttaacagcctactcaggtttatgttaactcatctctttttagtatcctgatgtgcacaaagagtgaagaatgtgaggcttacccacccaggctctttcttctttacaatcaatgagactctggaagtggtatcagtgctgattacagggaaataaaaagaaaaaatcaaatatgcacaaaagaaatggaaaacactaacatactttaatcttagtcttctaggaatagaaagaacatttccaaaattaataacgaacatagtaattcaaattttttaaaataaaaagtttcctccataaatttgaaaagcttaccaggaaagtacaaagatattgagatttatagtttgtttgttgaaatggtttttattaaagtaatcaataccaaaaaactcttgtttgttctaagtaccttggtcagaaacccgaaacatttaataaaagaaattgaacaattttttgacttaatgtttgctaaaaagtagaaatggaaatcatttaattgccagatattaaaaacagaaagttttctattgctgtaatactcactccccatcagtgtaggagaaacaaggttttatatttaactataatatattccttaaaatatacttaagtgggaaacttaacttctgccgacagttacagtggggaaagttaccactgttctctttccctaactaaataccgtacatagctatcatctggaagtaatagtattacttcagtgcattgtgccagtagacacttaatacagaatatactttagactaaatgaaatccagatcccagtaatactgaaacagaaagacacaggttcctttggttaaactaagtcatagtgtacagtgtactataaattaaatacagtttgtgagtatgtcattagattttaattgaatttgcaattagcatcccaaacatttaaaaatcgtgtgggtttataagtttttacttttgaattttaaaataatagaacctttacccccttccactacccatctcccatagcaatcacatccatttatgttcttatcctaatgaatcagctaaattgggttttaatttacaatgagctggtaagagttaaagaaaatgactcctataaatgtagtaggtgagaggctgagggcatcctcttctaggttattctgctccttcctacctttgttgatgccccacagtcaatgttggggaaaattaattaggatttatattccagtcttctctaatgtgttgtcaccattgcacagactcaggacttccagtgcagtgttgactagtaccagtgcacatccttacccaggggactggaacttacccaggatcacaaaaatgacactaggaatgtttctcccctctcagcattcaaatgttctccttatcttttatttttatatatttatttttgagacaagattttgctctgttgcccaggctggagtgcagtggtgtgaacatggctcactgcagccttgacctcctgggctcaagcagtcctcctgccctggcctcctgtgtagctgggaccatgcctggttaatttttaaatttttttttgtagaaacagggccccactgtgttgtccaggctgatcttgaactcctgggctttaccttttattattttaatttaattttattttttgagacagagtgtcgctttgtcacccaggctggagcacagtggtgtgatcttggctcactgcaacctctgtctcccaggttcaatagattctcctgcctcagctcctgagttgctaggattacaggagcatgccaccatgcccagctaatttttgtagttttagtagagatggtttcaccctgttggtcaggctgtgatccaggcaccttggcctcccaaagtgctgagattacaggcatgagccactgtgcccagccttatcttttatttttaatgattattgtttaaagtacactgagttcaggttaaaaaccaactgccaaagtaaattttaacacctaaaagctgggagaaggggccattcttcttttatgcagtaactctttggagtccagatactaacatgccccagatttcatcctggtgctaaactgacttgttttccaattaaaaaaaataaaagtctgagtaatattgcgtaggagtaccagaaatggccttgttggaaaccaaaactatttacattcgttaagaaatctgtttgcaggtgtgtctgccacatttacagcacagtgtacagctcctggcactcaatacacagtgttgcacagcttgccgcaggagcataaagtggaggtagtaaaaaggtaaggaagaaagagggaggaggatgagttgttctctattcatttgcttctcatttcatcactgatttggtggtacccagacctttacagagccggtctccataatactggtgcaggtggcctgatgcccagtttctgttgctcagataatgcagtctcatctcgtctgtgatttcagcagcactcatggcaatgggaacattcttcttctttgcaacccaggagtgagattgaatctctgattaaagagcaaagcttgagtgttttggacatggtaatgctgcagaggtgagttcctgttctggctgtccatgtccaaacaagtgaaacaaatgttttcatactttgcagttgccacgttcattcattcattcattcattcattcattcattcattcattcatttttgagacgagtttcgctcttgttgcccaggctggaatgcaatggcatgatcttggctcactgcaacctctgcctgctggctcaagtgattctcctgcctcagccttccgagtagctgggataacaggtgcacaccaccatgcctggctattttttatatttttagtagagacggggtttcaccatgttgaccaggctggtctcaaactcctgacctcaggtaatctgcccgcctcggcctcccaaagtgctgggattacaggagtgagccaccacacccggtctgcagttgccacatttaacctttagtgctaagtaaacatttcaccatggttcactttgtacaaaatgagaatctttactgaagcatcccagccaaacataagaatgtactttacaattttttttttttttttttttaagcctaaagtccctggaagaggctggcaaactggcttgagaaacacttcactgggcatagagctgctgaagctgctcctagtccgtgtgttgatttcactcctataagttggtggctactctgaaatagttttcaaaatttttattgtaaaataaaaggcagttacaggagaactatacaaaagaaacctatggcttaatgaactattatagggcgaactattttgaaatcatgaaataggtccagacgcagatgtttaccctgaatcctggaaagctgtgtgacccatctcagtgctaacctccggcctctctctaaacatacccattcctttggcttttatagtaatcatttttttttgcgtttaaaaataattttattgtccaaatgtgccaccttggacacaatatttaagtcttgtccatttatttttaaatttgataagtctttaaaatcttagtctgtaggctcctcttgcttccttttcttcatgacttatctgttgaagaacttgggtgtttgacttacagagtcttaccccagtcttgacttagctcactgcatggcgatgctatagctcagtggtttcccccattcttggtgtttcctacaaattggcacttgaattcagagatgggatcagacttggatttgatgcctttgatgaagactataggaggcacataatgtctttttagctctttttaagatataagcagactttgatgcttactgcccatatctagtaatttattggattacaaaattttggtagtttaatgctaacatttttttcattagttaattggaatatatttagaaagaaacccttcttctcatttactgttttattaccactggtacaattcatatatgagaagcaagataaatgcttaattctttacctttatttactatttctgaagtaatgattggttccttatcatccctcgaagttagccaattcttttgaagaaatcactatgaagtcatactgttgaaattactgtgaagtcaagttgttcctctttggtccgtggggcttaagttgactcacgggtctttttgacttgacctcataatcttctctagcttccttactatctgatctgacaggacattccaggctcatgttttacattttctgttccaactctttatttttatttatttatttatttatttttgagacagagtctcactctgtcacccaggctggagtgcagtggcgcaatcttggctcactgcaagctctgcctcccgggttcacactgttctcctgcctcagcctcctgagtaggactgctggagcctgccaccatgcctggctaattttgtttttgtatttttagtatagatggggtttcaccatgttagctagaatggtctcgatttcctgacctcgtgatccacccgccttggcctcccaaagtgctgggattacaggcgtgagccacagtgcctggccttctgttcaactctaatcagccatcttttcaaaatgccttggcttcttctaatggtatttggagatcacagttggggtactaggcatggtcattgctactgattggtcattttaagcctttttagttgcaggctaggaaaaaaaatatacatatatattaacaggtttttaacatatacgttttatgttatatatgtatattgcttataatacaatatgttatcttaactatattatattaataaaatatataccatatggcaatatatttactatataaatatgtttaaatataatgccaaccctaacccaaaatagggtatgtatataaaacaaatttatattataataatcatactgtattaataaaatgcacataacatttttctcatatataatgtatataacaatatagaagtataattaaataaagtctacattttatgtgagacaaaacaactcctgtgttcatagcaatattttccattacaattcaaaattgcagaactttaacctctttgttgcctctgtgtatcttcattcttctggattcagaattctgactctcaaggataggggaaatgacagaattagagtatctcacaattgcttatttgtcttgtcctgtgctatacacagagcaatctcaggataacaatgttaataccactaccaatatgattactaaaaacattaaaaatgtatttgtacataatcttcctgtaatattaaaaaaaaagttgtactatatctatattgtcagaaaatgtggctgttatctataaggttttatatatatatctccttagctttcatttagttttagctctacaagtaaatcccgactctttttgttgatatctcttttgtcattttagtttcctgaagctcattctctagtacaggagtgggcaaaccttttctgtaaggagccagaggggaaatatttttggctttgtaggccctatgatctctgctagtactcattcttattcttatagtgagaaagcaatcacagacagtgtaaactatgagcatggtggctacgtttcagtttcatataatttttatgtgtaatgatacagtatttaaaaaaatttttgcctaacccccacccccaataattagtaaaatcttttcttagatcatggactgtacaaaaacaggcagtgaggctaggtgtggtggctgtcacctgtaatccctgcattttgagaggctgaggtgggcggatcatctgaagtaggagtttgagaccagcctgaccaacatggtgaaaccccgtccctactaaaaatacaaaattagctgggcgtggtggtgcatgcctgtaatcccagctacttgggaggctgaggcaggagaatcgcttgaacccgggagctggaggttgcagtgagctgagattgcaccattgcactccagcctgggcaacaagactgaaactgcgtctcaaaaaaaaaaaaaaaaaaaaaaaaaaaaaaaccaaaagcagggagtgaatgggccagatttggcctacacactagtttgcaaacctctgttgtattggacttctcagagtttatgagttcttgcatgttgttaaattttctctgcctttcatagttgcactgacttctatggatttaaaattcttagcttgactcagcctggtggctcatgcctgcaatcccaacactttgggagactgaggcaggaggatcacttgaggccaggagtttgagaccatcataggcaacatagcaagactccatctctacccaaaaaaaaaaaaaaaaaaaactgggcacagcagtacacatctgtaggcctagctacttgggaggtcaagatgggaggatcacttgagcccaggagtttgaggctgcagtgaactataatggcacccctgcactccaggctgggtaacagagcaagaccctgttccacgaaaagaacataaaattattagctcatactttctttccttgaatttcttactcaaaagagtttattattccattttcttttggtataaaatgttgctgtcaaagtctgatgattatttaaatttctcttttgtataagttacctattcctgtttttttttttttcattttcttttacttaagtaatattgctagaatttttcttggtatgttggtcatcctggaatgaatttctcctgtagtgtggtcttttaatatgtatttttagttcaagtaaattttcttgagttgtatttttaatatttgctcttttttttgctttggttctcttcaaggattcctattattcatatgttggatgttcttttttattttcaatatttctcatcttctgtattatttattcattttttatatttaaattaaatatttttattttcaatttgtctttctcataaggcattgtctgttttccttattcactcttacattctttgtagctgttttcatttctggaatgattttctttttcatttctagttgtatcctgagttctgtcatctcatttctgagcttttctaaatctgatttatactattttatgttatgtgtcacttaaaaatgtcttttaacttgttttgaaatattagatgataggccaggtgcggtggctcacgcttgtaatcccagcactttgggaggccaaggtaggcggatcacgagatcaggagttcgataccagcttggccaacataatgaaactccgtctctactaaaaatacaaaaaaaattagccgggcgtggtggtgcgcgtctgtagtcccagctacttgggaggctgaggcaggagaattgcttgaacctgggaggtggaggttgcagtgagctgaggtcgcgccactgcactccagcctgggtgacagagtgagactccgtctcaaaaaaaaaaaaaaaaagaaatgagatgatagttttgatctattgtattggtatgtttttctcctgtgctttcctgccctacatggatgttactctggtccctttttctttgccttataaaaacattgtattggggccaggcatggtggctcacgcctttaatcccagaactttgggaggccgaggcgggtggatcacttgaggtcaggatttcgagaccagctcggccaacatggtgaaaccctgtctctactaaaaatataaaaccatattagcccggcatggtggggggtgcctgtagtcccagctacttggaggctgaggcaggagaattgcttgaacccaagaggcggagattgcaatgagccaggattgcaccgctgcactccggagtgagacttcgtatcaagacaaaaaacaaaaaaaattatgttggattttaccttgatattttatttcacttagtttaatgtgtaaaattggtttttctctacatttctttttaaagagccatgtattttaaaatcagtgactcatgtccaagaagttcaaacacgagtagagatagcaggaagtggtttattctgaggtcttgaaaagaatgaattaaccctgtaatctccccagtattctttttgatgttcctattgacatcactatattcagtgggtgctcctttctatctgctacattagtttttgaaagctttctttctgactcagtttatctcatgtgctaacttcctgaaccaatcctggaactggccttttctaccagaaacactcttttcttttatcatggaatagtattaaaaaccacaatctggatcttttggacagttcagctgtttttccgtggcttttttttttttttcgagacagggtcttgctctgtcatccaggctggagtgcagcggtgcagtctcggctcactgcagcctctacccgctgggctcaagcaatcctcctacctcagcttcctgagtagctgggaccacatgggaccacaggtatacaccaccatgcctggctaatttttatattttttgtagagaaaagtttttgccatgttgctcagcctggtttcaaactcctgagctcgtgcagctcacctgcctcggcctcccaaagtgctgagattacaggcgtgacccactgtgcccagccccatggctgtctttttcttctgaccctggttttgtagttatccaagtagcaactcttggtaagcctaaaatctatacgctttaaaatctgaattcataatatagcaatttactaacttgtggtatttctaagaatgaaatatgtatcatacattttaatttttacaatgattctttctgtccttcattcctgacataaagcctatggtaaattaaatctcatttccttaacatactgctcaaacccaaccctttcccccattcttctattaaaatttgtccagaaccatagagtcacagaatttaggaaatgagtagaattttggagcagtgatttcagcttttcataatttctttctcttcttttgtcttgctgtgttgcccatgctgaagtgtagtggctagtcataggtgccatcatagcgcacaacagctttgaacagtatctgggctcaagagatactcctggctcagccttccaagtacctgggactacaggcacacttggctcataattttttttttttaaatgaatcactttaatgatgaaaaatgcccactttttgtgatcataagacatttacttgtattcagatattatatgtatcatgcaaggtaaatttaaaaggaccttaaaaagcatatttttggaaacaaatttagttgctattgcataacaaaaaacttacagtgattaagggaaactgataattagatggataacaaaaaataccgggttaacagaagagtatcgaaggttactagtggataaaatctggccttttattctaagtcacaccgctgcctggtcaagaactgaaaacatttgaaacatgctccatcacactgcagttaccatactctcttatcctgacctcatcctttttggttacagatttatgggagccaagagcctctaatgttgctttctcattttgctttaattacttttaaaggccaatctagggagcacttccaaaacacattgataaaaaggaagttaagtctttgaaacatttgtagttatccagcatactactggctatttttcttttgtattgggtgggacaaaaaatagtcactaaatacttgatataagcttttttttttttttttttgacaattttacatttttgggtgagtaattttcctcaaattagaatgcacaagaaaaatctggttaatcagtgttccaggtcgttgggctcctgttaatcagaagttttactgtataatcataatgtattttggatgttctcatttatgttatttcttcaattctttgtgtgggtactctgattgcttgattacatctgcctggcatagtcgtttttaaagcagcatttataataaaattttccatctttgcaagtaaaatgagaatatggaaagacaattgatggttgaagcatgattgtttcctcttgtctttacttagtgtttagtgggtttcaggttttggataaagagaaatgaatatgattattgtcctggtccgaaatgattcatgtatccacctggagacgtagagttgatagaggtgtaggcttacctctattatctcctcatacagagcagcgctacttcctacgtatgtgctttacatttttggggatttgcataagattttttttttccatgaaaataaggttctactaaaaccaaatacagaaacatttgatagagagatactttataagcacctcttagggctgaaagggtttcttgtctagcatcctgccacttgtaacaccagcaaattctaggcatttgggttcctataatattattttagagtcctgtggacctagctatcttattattctagtgtcctcttttttttctggagacagagtctcactctgttgcccaggctggagtgcagtggtgcaatcttggctcactgcaaactctacctcccaggttcaagcaattctcctgcctcaacctccagagtagttgggattacaggcgtgcaccaccatgcctagctgatttttgtatttttagtagaggccactatgttggtcaggctggtctcaaactcctgacctcaggtgatctgcctgccttggcctcccaaagtgctgggattacaggtgtgagccactgtgcccggccattctaatgtcttctttttatcaagacttctggagagtggacaaaaactaacagttgtggcactcaacttggtgctttatattattattgatggggtttaggacatgctactcccaaatttggcaccttggcatataagctgaaggatttggagaaaacagcagaagcacgaaggtctctgaccttccccttcctctcttccctgaagcaggtcctaagacctaggagggactttctgaccttctctgaaccagatcctaagaccttcatgtgagagatgcccttcctgtatctggaagagaggagcatcctcatccccatagagaaaaggacgcagagtaatctgagtagtttcccccagtttatgatacttacctcttgctctccgtgctatcatttctccataactcaccagtcctcatcaaccctgtataaaaacactcaagtttaactgtttctttggattttcatttccttatgcaggctccggtgtcacgtacaacttacaattaagtaaatgtgtatgcttgtttttttggtaaactatcttttgtaataggtgccctagccataaacttagaagggtagaaggaaaataatagttttcctcctgtacattattttatttaattctttaatcaaacttaaaagtcagatattatccacattgtcactcaaagaaatgggtgctttagactcagggtctaaaatttcccttttcttttgttttgcttttgggtaggagagaagcatacctcttgaatttaaagacattggcttttctactcattttctctgaatgatttcattcacaacttttatttttgtatttatttttttgagatggagtctcgctctgtcgccaggctggagtgtagtggctccatctcggctcactgcaacctctgactcctgggttcaagcagttctcccacctcagcctcccaagtagctgggattacaggcgcatgccaccacgcccagctaatttttggtagttttagtagagacgggctttcactgtgttggtcaggatggtctcgatctcctgacctcaagatctgccctcctcggcctcccaaagtgctgggagtacaggtatgagccaccacacccggactgccattcacagcttttaattccgtcctgtatttgatgcctttaaaaatctgtattttggccaggcgtggtggctcatgcctgtaatcctagcactttgggaggcggaggctggtggatcatgagattaagaggtcgagatcatcctggccaatatggtgaaaccccatctctactaaaaatacaaaaattagctgggcgtggtggcgcgctcctgtagtcccagctactcgggaggctgaggcaggagaatcgcttgaacccgggagacggaggttgcagtgagccaagattgtgccattgcactccagcctggtgacagagtgagactctgtctcaaaaaagaaaaaatctgtgtttcagcctggacttgtctaataacccctatacctctatatctgcctcctgaacatgaatacttgactattgcagaggcctgtcagctcagcgtgtgcaaagttggagtcatcatctcgcctcttaaatatttatctccttgtatattctttgtgtttattccttgttctacttctacttcctgctcggggtgggtttaatcctcttggtcatgatggccaggagagcagtccaagcaacaggctactcagctgccctggtcaccaggagaatgaaccttttttcccaagtcaagattctttgcaggcagcaacgctaacatggaatgaacaggtgatgtaaaagtgatatacaaatatgcagtttattgtttataccaactctgacaaggtcgtaggacaatcagcagttaggcgccttcctcgaggaaggcctgcatataggtctggtttttcccattttatatttaccttcagttctttatgtaatgacttcatcctttatctcagcaaatacccccattacttttctagaccatgccctgtggtggagctaatggcatcatattttgttctgtctctagatctatttaagtcactagcttttttttttaaattagagtggcataaacaagagaggtagatccattgtcaaggtattcagtgtggtttgtgcagagtggttttgattgaaactgaactctacccagttaaattcccactggatttttgactcatcttttatagtcacaggatgcaaacatgtactttcttttgtctatttctctgaggtgtcagtgatctgttcacgtttcctggaaattgttgatatcctgttgtcttcatccatgttatctcctgtgtttagctcagagcctggcacagaattggtattcaggaaatatggatatttgtgttatactaggcattatgctgcaggctattgagaacacagagatttataaggtgtttacgggtgaccttactggctagattaggtggtgtaggacgttatatacaaatacagtgtcatagagtgacttttccgaggcacactgtttacccagaaggagttcttcagtgcttttggttgttttcatttgactttgttgcatgcatctatccacacatgtactatatgcaatatagtattttaatgtgttggctcaaaaactgttgtttctgcaataaaaataattagaaaatacacatatgggcttttcttttataaaattgtgactccacatcatgctccgtaatgttcttgttataaattttgacttgtttttctccacaggcagcagaagatgtcgttttcattggacctgacacacatgctattcaagccatgggcgacaagattgaaagcaaattattagctaagaaagcagaggttaatacaatccctggctttgatggagtagtcaaggtgagaagctactttaacttttattgtatatgtcttcaagttaaacattttgtcaaaagtataagataaaatgtaactattgcttttttgggatatacacacacacacacacatatgcacgcacatacatacatgtatatatgtttaaaaaatcagtgtttttacatttatttatttatttatttgagatggagtcttgctcttgtcgcccaggctggagtgcaatgatgcaatctcggttcactgcaacctctgcctcctgggttcaagcgattctcctgcctcagcctcccgagtagctgggattgcaggtgcctgccaccatgcccagctaatttttgtatttttagtagagacagggtttcaccatgttggccaggctggtctcgaactcctgaccccaggtgatctgcctgcttcatcctcccaaggtgctgggattacaggcgtgagtcactgcatccggccagaaatcagtgtttttaactggattattttattatttttagagatggaggtctcactctgttgcccaggctggagtgcagtggtgcagtcatagctcactgtaaccttgaactcttaggctcaaatgatcctctcgccatgactcaagaatccctccttctttagcctcccaagtagctaggactgcagacacacaccaccacacctgactaattatttttattttgtagagatgagggtctcaccgtgttgcccaggctggtctcaaactcctgggctgaagtgattctcccgccttggccttcccaagtgttgggattacagatgtgaaccattgtgcctggccaacttggattgttttaaatagcataagttaaaaagagtgagaaactgtttgagcattgtatttaatgaatcagcagtgactcagactttcataggaaaaaatttggtgattaaaaaatgtactgtcagatctctggactgcatttaatagtggtatgtgtttcatgtgttaaacattaagagtttctctgtatatctttatcttgagcttctctccatgtgcataatatgtaagttaggatcatgtttctggtgaaagtggtatagctataggtaattgtatattgcaaacatttagcaagggccttctgcagctgaaggcttctgagggagaaatgcagaaattgaagtatgcaacttctccttttcccatgagaaattattctgtttttttctagttagaagagagtcctcatgtagagttttaaccttgcgatttgacttagcctgcaggaactcttcatttcagcatttcgtattgttacttttggcattctgtgttgggttgttcttcattgtgcaagatcatttcatgcattagaggacgattagaaaacttgccccctagttaataaatatcctcagcttcttgcccatatttacctgcatttacttttatctatgtgtatccatgttgtttcttcccacttgttacaaggaagaggtgttccacatcctctggaaagccagttcctcctcctacgctccaaatgtattctttatagccttcacaggctatggttttactgattatcttttctctcttctgtgtcttaaaattctcctcatcttttagctccttttgttatcattgctattaaaaatgctcagtgaacaaatgtgttggtcactcagttatgtgggaaggatgtggtgatgagatacacatgatctgcgtatcatagttctcacagtttagtgggaaagaaacaaacatttcttccattcgtaaagcaccatcacccctatcactctacagctagttgccaccttctttctctcttcccctttcagtgccaaagctcttagaattgtccttcctcactttcatttctgtatctttcacttaatcttttcttgccgtctagcttctttcctcattcctactgaatttctcttgcaaagctaccagcaacctcttccctttgttaaatcaatatgtaattttgaattctgatcttatatcaatctttgagcaacatttgagtctcttggtcagtccatacttctctcatgagatactcacttttggcacattactcagttctagtttttgtgttttttggcttttttgaatgccattcttagattccttcccgattgttcttcctatctttgttccttaaatgggggttttattctgggtcctgagtaggacatttcctctttttattgtgctaacttgccctgggcaatcttactttttttcatggcgtcaattgccaccttttcttttttcttttactattattattattttttgagacaaggtcttgttctatcacccaggctagagtgcagtggcatagtcatggctcactgcaacgtcaacctcgtgggctcaagtgctcctcccacgtcagcttcttgaataggtgagactataggtgtgtgccaccacagctgcctacttttttatattttgtagagacgggggtctcactattttgcctagactggtctcaaattcctgggctcaagcagtccttcccctcggcctcccaaagtgctgggattacaggcatgagccactacacttggcctattgccacttttctgaccaatctcaaatgtatgtatctgttctgaacttcaggattacatatccagttgcttcttatatagctctcactacttgatgcctctgaggcaccttgaaactaacaattaaaagctgaactcatctttctcctgaaactagagattggtactatagcccatgcacacctatttttataaataaaggtttattggagggcaaccatgttcatccctttacatattgtctgtggttgcttttccactacagtggtagagctgagtagtagactcaatatgtggagtagactcaactacatgggacacatagtagactatgtgactcacaaagcctaaaatatttacttcctgatccattaagaaaaagtttgcctatccctgctctaaaattcttatccttcattcttttccgcctaggaaggtggtggctagaaacatagagtaattcttaacaaatgcgactgtggagaattcactcagatagctttctaatccatttacttctttctttgcccgtactaaccaaccccagattccagctactatcatctagtctggattacttcatctgccttctaattagtctccttgtagtcattcttgcttccatccaattaattttttaaaaattcttcacctcaagtatttataatgtctttgtgttacaaacagtctaatatacttttagttatttaaaaatgtacaataaattattgttgactgtaatcactttgttgtgctgtcgaatactagatcttacccattctatctaactggacccatttttgtacccattaaccatccccacatcacccacccccactcctccccactacccttcccagcctctggcaatcatcattctactctctatcactgtgagttcaactatgttaatttttagctcccacagatgagtgagaacatgtcaaatttgtctttctatgtctgacttagttcatttaacataatgtcctccagttccatctatgttgttgcaagtgacaggacctcattctttttggtggctgaatagtactccattgtatatatgtaccacattttaaaaatccattcgtctgttgatggacatttaggttgcttccaaatgttggctattgtggatagtgttgtggtaaacatggtagtgtagatatctctttgatagactgctttcctttcttttgggtatatacctagcagtgggattgctggatcatatggcagctctatttttagtgttttgaggaacctctatactgttctccacagtggctttactaatttgcattccccccaacactatacaagagttcccttttctctatatcctcgccagcatttgttattgcctgtcttttggataaaagccaatttaactggggtgagatgatctctcattgtattgcatttctctgatgatcagtgatgttgagcacctttttatatgcctgtttaacatttgtatgtcttcttttgagaaatgtctattcagatcttttgcccatttaaaaaattggattattagattttttttcttgttgagttgtttgagctccttatatattctggttattaatctcttgtcagatggatagtttgcaaatattttgctcccattccatgagttgtctcttgactgttgatttccttggctgtgtggaagctttttaacttgatgtgaccccatttatttatttttgctttgcttgcctgggcttgtggggaattactcaagaaatttttgcccagaccagcatcttacagagtttttgcaatgttttcttttggtagtttcataatttgaggttttaggtttaaattttcaatccattttgatttgatttttgtatatggcaagagataagggtctagttttgttcttctgcatctggttatccggttctccgagcaccatttattgaagagaccgtcctttccctaaggtatattcttggcacctttgtcaagtgaattcactatagatatatggatttatttctgggttctctattctgttctattggtctatgccagtactatgctgttttgattgctatagctctgtagtataattttaagtcaagtagtgtgattcctccagttttgttcattttcctcaggatagctttgcctatcctgggtcttttgtggttctatataaattttaggatttttttttctatttctgtgaagattgtcattggtattttgataaggattatattgaatcggtagattgctttaggtagtatggacattttaacaatattgattcttccaacccatgaatgtagaatctctttgcatcttttgtgtccttttcaatttctcgcatcaacgttttatagttgtttttttgtgtgtgtgtgtgtgtgtttttttttttagatggaacctcgctctgttgccaggctggagtgcagtggtgcaatctcggctcactgcaacctctgcctcccgggttcaagcgattctcctgcctccggctccctggtatctgggactataggcatgcaccaccacgcccaactaatttttgctttgtttttagtagagacggggttttaccatgttggccatgatggtcttgatctcctgaccttgtgatccacccacctctgcctcccaaagtgctgggattacaggcatgagccactgaacctggcctatagttttcattgtagagacctttcacttctttggttaagtttattcctaggtattttattttattttattttattcatagctattgtaaatgggattattttcttgatatcgtcttcactgttggcatataggaattcccatccattaattaatgatacttcagtttgagtgaccaaaaatccagatttgatcgtatgcctatctttaataacttttgaatgactactcatataaatgttttaaatggttggattttgcttagctctccaaactgatactgtgccagtctatcctttgcattgtatgtatccgccatacttgacatcgttcagattcttgaaacttatgtgcttagtcatatctgcttctgtcttcattcctgattgtctcttagtcattgtttaggtcttggcttaaatgtaaattcctcacataggcattccttaactgtcttcattagattaggctctctgctgtatttttccttaggaccctacacttaactcatcacattttaaatcatttattcattcatctattcagtagatatttaccaagtgcacgcaatttgtctgacactgtttgaagtgctgttgatatagtagtgaacaaaagagactgaacatatttttatgccctcaaggagcttacactatagaaggaaacagatgataaataataaaacatatgttctatgttgaaacataagagaaaaagactgctggaaggtggggctatattcacaattttatatacaggcatgtcttcatatctacaagggattggttccaagacctaccccctcagataccaaaatttgttgatgctcaagtgccttatatgaaatggggtagtgtttgcatatatcctacgctcatccttctgtatactttattttattttttatttttatatatttatttttttgaggtggagtctcactttattgcccaggctagagtgcagtgtcatgatctcggctcactgtaacctccgtccaccctgggttcaagcaattctcccacctcagcctctcaagtagctgggattacaggcatgcaccaccatgcccagctgttttttgtatttttagtagagatgaagtttcaccacgttggccaggctggtcttgaactcctgacctcaagtgattcacctgccttggcctcccaagtgctgggattgcaggtgtgagccactgtgcgcagccctgccgtatactttaaatcatctctagattacttataataccctaaaacaatgtaaatgctatgtaaatagttgtcccactgtgttttaaaatatgcagtattttaattttcctccctttcccttccccttcccctccccttccccttcccctctccttcccctttcccttccccttcccttttttgggtttaatccatggatacagaacccaaggatatagagggccaagtgcatgtttagcagaccatctaaggaagtggcaggacaagtcatgttgctatcctggagaagagcaaagcatattaggcagaaagaataacaagcgcaagattgttggttgaggttgaagtgtacctgctactgaataaacaccgaggaagcatgtgattggaatcatcgagagagacaatttagagataaggtaaaaaaagataatggtgtagtagggagcttagatttttagggccttacaggccatttcagtattaggtaaatgtctccttcctacacggagcgtaagcttctgatggcagggatgctgctctctttattactgtatcacatgcacatggtgcctgacatattgtcagtgcttaagtcaatgctcagtcagtgctcactaggtatttgttgaatgaataatattctaggagataaattttatacatatactcattttatatacgttgccatttagtacatattgtttagtcacatctattagaggcaccaaaagaaaccaaaaaccaagagaaaaaattaaaagacaatagaaacatatccacatatgcttcagatattggaattggctgagataactacgatttatatgctaaagaaatccaaggaaaatatggagaaaatagataagtatataaagaatttcatccgggtatggtggctcatgcctgtaatcccagcactttgggaggccgaggtgggcggatcacctgaggtcaggagttcaagatcagcctgatcaacatggcgaaaccccgtctctactgaaaatacaaaaaatatttgagtgttgtggcaggtgcctgtaatcccagctactcgggaggctgaggcctgagaatcccttgaacctgggaggtggaggttgcagtgagccgagatcacgccattgcactccagcctgggcaacaagagcggaactctgtctaaaaaaaacaagaatttcacaagagaatttgaatctattttaaaaattaaatacaagactgggtgcagtggcttacgcctgtaatcccagcactttgggaggccgaggtgggtggatcatgaggtcaggagttcgagaccagcctggccagcatgatgaaaccccgtctctactaaaaatagaaaaattagctgggcgtggtggtgcgcacctgtaatcccagccactcgggaggctgagtaggagaatcgctggaccacaggaggtggagcttgcagtgagccgagatcatgccactgcaccccagcctgggtgacagagcgagactccatctcaaaaaaaaaaaaattaaatagaaattctgtaactgcaaatatatgaaaataaggactttagatagacttaacattggactcaaccaagcaaaatatagtatccatgttatagcatgtatcagtttttgtgtgtgtgtgtgtgtggctgagtgatattcagttgtatgaatatgcttcttaaaaaaatccacctgaggtcaggagttcaagaccagcctggccaacatggtgaaaccctgtctctactaaaaatacaaaaaaattagttgggcgtggtggcaggcacctgtaatgtcagctacttgggaggctgaggcaggagaatcgctagaaccctgggggcggaggttttttgtgtgtgtgtggctgagtgatattcaattgtatgaatataccacttaaaaaaatccatctgaggtcaggagttcaagaccagcctggccagcatggtgaaatcccgactctactaaaaatagaaaaaaataagctgggcgtggtggcaggccctgtaatgtcagctactcgggaggctgaggcaggagaatcactagaaccctgggggaggaggttgcagtgagctgagatggcaccactgcactccagcctgggcaacagagtaagactctgtctaaaaaaaaaaaaaaatccattcattagttgaaagacatttgggttacattttgaccattgcaattagtattgctacaaatatttgtatgcaagtatttgcttatatatttgtttgttttgagatggtatttcactcttgttgcccaggctggagtgcagtggcgtgatcttgactcactgcaacctctgctgagttcaagtgattctcctgcctcagtctcccaagtagctgggattacaggcacccaccaccatgtctggctatgggttgtttttttttttttttgtatttagcagagacgggttttcaccatgttagactggtcttgaactcctgacctcaggttatccacccgccttggcctcccaaagtgctgggattacaggcgcgtgccactgcgcccagccatatgtctgttttttaagttatttggggtatgtacccaagagtggaattcctgggtcatgtggtaattctttgttcagctttttgaggaactgtcaggcatccaaacctttatgtactcccttcctcttgtataatccactcctcttcaatttgggtagaacctgtgaattgcttctctaactaatagaatatggcaaaggtgatgtgatattactcccttaattaggttgcattatatggcaaaagtgatgggatgtcactgcattcaattacattatgtggcaaagtggttgggtgtcactcttgtgattatgtttcattatatagtacttgatcttaacagactagagaacaagattctttttgctggcttgataaagtaagcagccatattaaggaagcctacttggcagtgaatggtgggcagattctaaggatctatgtaaggacagtctctacccaagagctagcaaaaggctggggtccttcatcatgcagctacaaggacataattctgccaactacctgaaagagcttggcagcaaatttctccccatttgagtctccagtgacaatgcagcctggttcactccctgattgcagccttgcaaacccctgagcagtgtatgatgaaattattattattatttccttatgaggtcttgtcctctttacctttttgttttagacatttgtgtgaatttgggtaggggtttggatgtgtcattatgaaccttgatctactcagcctgaatatttctaccagtataattatatatttttttgatgaggaatgttgcctttttgatatcttcaatttggacttgatttattcccaagaatactgatgtgtcactgtccaaattatttctggcttgatgatgaatggtggagtcctcaagggttcaaggaagagaccatcaggagagtgtttgatctggaaattctgtttacacgggagatttttccttatgaaattagtgaatgtagtgtctcctaggaagggaatgtttcttggctaaaggtccaaaggtgaccgttgtgtgctgggacatgggaaatgtgacgggtattatccatatctgtcaactgagtagtttgttgattccgagggagagcttgtggaacaatggcaggaattaaggtaaatatactgccacccatatcaataaaatttttacttgtttctccgctaataattagtgaaaattcgtcttgtgagttgaagagtaaaaggagaaatgggtacttgatttgctgttagaacatttgcctactatcattttttcccaattctcttgaataaaacagaacaattatttttccattgtaatttcttcttacaatctctgcaggtttctttatcaaaagactggtgtttaatttttggagtgggagcatctagttttatcttcaagggtatcatcttattctgggtcttatactgcctttgttttcaggctcttttgaaatgtgtaatatggagttacattgtttgacaatgtggtgccttcccagccagtttttgcttgtttataacattttctttttctggcttaaggctgttcacaagaagtgaggaaggagctggggtcacaactacttgagggcttactcctgaatgctaactgaaggtagtaagagcccaccctggaagtctgcaaggggcttatccttcgtctgctagaacaactgaattagagttacctgttttcacaggaaagattttggtaatagccttcaaaagaccgtgtccaatatttacagtttcttttttttgtttttgttttttttgagacaagagtctctttctgtcacccaggctggagtgcagtggcgcaatcttggctaactgcaacctccacctcccgggttgaagcagttctcctgcctcagcctcccaagtagctgggaccacatgtctgagccaccatgcctgactaatttttttttttttttttttggtatttctagtagagactgggtttcaccatgttggccgggtcttgaactccttacttcaagtgatccacctgcctcggcctcccaaagtgttgggattacaggcatgtgccaccgcgccccgtcattcacagtttttctaaaccccactggctttctgtgcatttggggtctgaagtcactctcaggatatttgtttcccctttctaataggtcttcctatttccctctccttgctccccactttgtaactatccttggtgaaatgatgccatttataaagagaagaccatgaatttgcattacatatttaatgcatttaaagaaacagaagtctgactctgagagaccacagacttagtctgagccaaactcatgggagtctcctaatggcatattgaatatgttgtttgtgcacctcctgtcttgggctcacagcctaatggttggccatctctaactgcaaacctgacagtgccttgttggtttaagatttggagagactgtctctcctaggcccagacttccatggacaaagcaagtcaagacagaggaaaatactcaaggttcccaggtaaattgtgttctatttggatgatgatctgatgaaaccttctgaactcactggcttctagagtcagcatgaaaatgggcttatgaaacctatgcctgtcttctttcaggtgaactttgacttatggacttagaataaaaaatgttgaggacagtatattagtaatatgggaggtttcttccaatattaaacattttcaaatgtgataagaaattcagtgggtctttattcctacagttgttgaaaaggaaattggacctctacccagtgtgactcatctcaccattgtggttggggagacccctgagggggtcgctcagtgggcctcagagaagcatgcagatgccagatctaagatcttgaactgtggcttttagtgggcttcgaacatgtgtctgtgggtaatacacttggttttgcttgttcaacaggttattttggttatcttcttaggaggctgcatctgaatttgcagcctctgttctagtaaatttggaaaatatggaaaggtagacaggagaaaagaaatctcatcttttcagtttttttccttgtatgcattagatgatttgtaacatcctattacactctcaaatgattgattctcattatctgcactaacgactatttctgaatttgtgacgccacagctgaacctgcaggttatagtttccagataagcatttacaaataatttttaaggaatgtccttttgtttccctgggaaatttttttttttttttttttttgagacggagtctcaccctggagtgcagtggtgcgatctcagctcactgcaacctctgcatcccgggttcaagcaattctcctgcctcagcctcccgagtaattgggattacagacatgaaccaccatgtccagctaattttgcatttttagtagagacagggtttcgccatattggccaggctggtctcaaactcctgacctcaagtgatccacctgccttggctccccaaagtgctaggattataggtgtccaggtgtgagccactgcgcctggtggaaataattttttttgagacagagtctcactctgttgcccagactggagtacagtggcacaatctggactcactccatccccgccccctgggttcaagcgattctcctgcctcagcctccggagtagctgggattacagatatgcgccaccatgcctggctaatttttgtatttttagtaattagtaattttttagtaatttttgtatttttagtagagatgaggtttcaccatgttggccaggctggttttgaactcctgagcttgggtgatccgccctcctcagcctcccaaagtgttgggattagaggtgtgagccaccgtgcctgactggaaataatttttaatactagttttatttttagtttgtttttatttctgatacaagaggctgtacatatttttcttttaaatttggctattaatttaggtttctggtatagtgactccacattcacttggagctacaccattcacatttactagtttagatatattgagtataagattacttttgagagtatctatgcagatagaagtttgctgatggaaataaatagtaccgaattttggaatatcttgggtttttagcaacagtttttcattggcagagtgcatatgccaattacaggtaattctgtcttttaaaaaatgtttagtgttctttaaaattagtctacagtgtttttaagactaaagtcttttccttgataactatattctattttttttccccaagtagtttccaccagttatgatacaattttagtttgttacatttctccttcaaacatttgttcctttcttatttgaatatgtaggatgttacatggagacagtttacccatacccctttaaagcattgtgtgcagtacttcagtggtcttctgcaactcttctttttaatggcttattaatctgtccttgaatcatccttttccttagagagaaactaatgttttaaaatgtaattatcaagtaatcgtttggtatcaagtatttgcctttaacaaatttaattttattcaacatttcattaccttgatctcaggaactggagagcagagtgaaaggcatgcacattaagatattggagacaggaattgggatcacagcttttttttttttaaatcaatgaataacatgccacagatcctgctttcaaagagcttaaagccttctgtgtccggaattggtgggttcttggtctcactgacttcaagaatgaagccgcggaccctcgcggtgagtgttacagctcttaaggtggcgcgtctggagtttgttccttctgatgttgggatgtgttcggagtttcttccttctggtgggttcgtggtcttgctggctcaggagtgaagctgcagacctttgcagtgagcattacagctcttaaggtggcacgtctggagttgttcgttcctcccggtgggcttgtggtctcgctggcttcagcagtgaagctccagaccttcgcggtgagcgttatagctcataaaggcagagtggacccaaagagtgagcagcagcaagatttattgcaaagaactaaagaacaaagcttccacagtgtggaaggggacccgagcgtgttgccactgctggctcgggcagcctgcttttattctcttatccggccccacccacatcctgctgattggtagagcctggtggtctgttttgacagggcactgattggtgcgtttataatccctgagctagacacaaaggttctccacatccccaccagattagctagatacagagtgtcaacacaaaggttctccaagtccccaccagagtagctagatacagagtgtcgattggtgcattcacaaaccctgagctagacacagggtgctgattggtgtatttacaatccctgagctagacataaaggttctccatgtcctcaccagactcaggagcccagctggcttcacccagtggatcccgcaccggggctgcaggtggagctgcctgccagtcccgcgccgtgcgcccgcactcctcagcccttgggtggtcgatgggactgggcaccgtggagcagggggcggcgcacatcagggaggctctggccccacaggagcccagggagggggtgggaggctcaggcatggcgggctgcaggtcccgagccctgcccggcgggaaggcagctaaggctgggcgagaaatcgagcgcagtgctggtgggctggcactgctgggtaacccagtacaccctctgcagctgctggccagggtgctaagtccctcattgcccggggccggcagggccagccggctgctccgagtgcggggcctgccaagcccacgcccacccggaactccagctggcccgcaagcgcagctagcagccctggttcccgctggcgcctctccctccacacctccgtggaagctgagggagctggctctggccttggccagcccagaaaggggctcccacagtgcaggggtgggctgatcaggtccctcaagtgctgccaaagtgggagcgccaagagcgagcgagggctgtgaggactgccagcacgctgtcacctctcacttcttcaggaggactgcaagtattcaggcaattgactacattttgataatgctaagctcaaggcgcaggggcctatgcatataggatgggcatgtaacctagttttaggtatcattgcagattttccaatggaaatgatagctaagtgaaacctcaagtctgagtggtagtgagttagctgaaaagtgagattgatgatggacacagctctaatgtcagtgaaaacatcttattgcaaaagcctggaggtgagagacagtgagaactctggaaaactgcagatttgtagtatgaggggctgcagttagaaagggagctagagagaaaattaggatccagatatgtatgggctggaatgtgatgtaacttattttgaaggctattcttgtggtttggggagcctctgaataatttcatgcagaagagttaacatgacagaattgtggcattagaaaactcattttggtttgttgtgtggaaagtaaattggagcatggcaaaacttgaagttggtagacaaattaggatcctcttctaatccaggatagaaacggtagacccctaaaataaagtattgtatgcaacaaagtagatggtgttgagaaagatagtggaagtggaatccatgggattatgtgatctgttcaatgtcaggtgtgaagtggagggaaggatcattgatgattattttactgcatttggttgtaatacctattaacacaccagtttcagaagaaatttatttaatgtcctttagttctaattgttcgttaagaggaaatagtaatacccgtttacaccacagaacagagtatggccgtgtatttgaatgagttttgtaaattaggcagtgtagatttaaagtagtaattgtttttatcacctaattggccagactttaaaaactgtactcttgctttagcagaaggaggcaaataactaagaaagctagtgtgaaggaaatcatttaaaaaagaccctaaaaacaaaaaccaaaaaattggagacaagctgtgtctcagcaattagaaagtataacattaaacattagtgtatttgtccctgctaaaccaagaataatcagttttcctgatgaagcctcaaaggttttatattttggaaaaaaagactcaattatttttactatgctgtttttacaatgatagaaaagtgtactaaattttagaaagcttttttttttctttgagacgaagagtgtcgctcagtcacccaggctggagtgcagtggcgcgatcttggctcactgaaaagcaccaccttccggtttcaagtgattcttgtgcctcagcctctcaagtagctgagtttacaggtgtgggctgccacacctggctaacttttgtgtttttagtagagatagggttttgccatgttgcccaggcttgtctggaactcctggtctcaagtgatccaccttcacgacctcccaaagtgctggaattgcaggcatgagccactgtgcccggccgaaagatttggaagtatattaaaacagaaagaatcttctgcctgactttgagttaactggattatgtggaagctagaaagccattcctgagcccaggattgtttaaaagtttctgctttactttatatatgaatgcagaatagtttgaggacagcttttagggtacagatataactcttacctgtagtgtcttgaaacaaattattatttttttttaataaacagtcactgattcccttctagaaccagctgtaaactcctaagtggctttcatatgaatgggtagcaggattctcatccacagaatagaaaattaaggattggtaagtaggcagtagcaagtgagaaggatgtctgaatcatgaatggtggtcggcgttgacactaataccactatcaaaatgtatgggtgtttagcatctgggaagaatgattcgaatgtgcctgtctttgttgtagtgttttctgcgcttccttgtgttttgccctgttcaccagcaataccgagttcgtagatcgtctgatccagtgcattataagagaggaagtacatgttttttccagtattgtagcgccagggttagttctatgttatctaggttcagaagatgagtaatgacacaggatataacaagtaaggccaggcagggaaggtaccaacatggtagtttggggtggcgggctgcccattttctcataattactaaccttaattgagtacctactgtgggccaggtgctgttctaatgtgtttcagccttgactaatttcatcttcttaataaccctatgagatagatactgttattatgtccattttacagatgaggaaaccgaataccagagaggcactctagtaactcagtcacagtcacagaagcagtattggagcccaagccttctggcatagcgcctgtgttctttttttctttgagacgaagtcttgctctgtcgcccatactggagtgcagtggcactatcttggctcactgcaacctccgcctcctgagtagctgggattgcaggcatgcgccaccacgcccggctaatttttttgttttttttttggtagagacggggtttcaccatattggccaggctggtcttgaattcctgacctcaggtgatccgcctgcctctgcctcccaaagtgctgggattacaggcaggagccgttgtgcccagcccacacctgagctcttaactgcaaggcttggttaccccacaggccatgttctaggtattaacaaataaatgacatttgcagaaaaggcaccagatttttgttaactcttttcacgttttttctggttagtttttactaccatttagttagtttttgtagcatcatccaccactcccatcatattcacagttaaatagtactttttactgttactattcttgggttgggtgatagagcccacttaatgtgagttgttttgtaatagaggaataagaggaataaaagaaatgggtactggtttgcttggtttctttcccttttctccgtttcttaagctactcttttggcattgtattcttagtactttcctgtaactctttccccatcggtgctcaaaagagttaaatagcttcagaacctgagtgtgccttccctcaggacaagctgggattacagaaagaatggaccaccaggtagtttatcacttagaagaatagaataaaatgatatcattggactcttttttccctacctcctgattggaaaccatcaggaataccatcatctgagcattgttgctgacacatttttaatttttttgtgtactttttgttttctcaattgtattacttgtgatatgaaaataaaactattctaaagacttcaaatgaaaaatttttaagggaaaatgaatagcatcaaatttgttttaacaattctgctgaaatttttatatttgactttttcttttttttttccagacagggtcttgctctttcacccaggctggagtgcagtggtgccatctcggctcactgcaacttctgcctcccgggttcaatcaattcccctgcctcagcccccggagtagctgggattaaaggcgcatgccaccacgcccagctgatttttgtatttttagtaaatatgggatttcaccatgtcggccaggctggtctcgaactcctgacctcagatgatccgcctgcctcagcctcccagagtgctgggattacaggcgtgagccaccatgcctggcatatttgacttttcttccactttggggaggattattatgtaatgtgtcagaaattttcttttaataaattataggatattattgaacattatgttaacagagtttattgttctaagccctttcatattttcatgtattgtgtgtcatgtaatcatagatgtgagagctgtcttaagaatattttaaagagtgttaagaataatcagctccactttttcttcaaatattgccaagctgtatttgtgaagagataatgttgttttgtttaaaatatatttattttatataaataaagaacaaaggctgggcgcggtggctcactcctgtaatcctagcactttgggaggctgaggtgggaggatcacttgaggtcaggagttcgaaaccagcctgccaagatggtgaaaccccatctctactaaaaatacaaaaaaaattagtcatacgtggtggtgtgtgcctataatcccagctacttgggaggctgaggcaggagaatcgtttgaacctgggaggtggaggttgcaatgagcggggatcgctccattgcactccagcctgggtaacacagtgagactctttctcaaaaaaaaaaaaaaaaaagcacaaagtatatttagtaaaataaagtttaaccttttacatttttatgaaataaagtttgatatctatacattgaaatgagctgctttcttttgttttgtattataacttaaacttgtggcttttcaatttgaaaacttattgccatgtagaatttgattttttttttttcctaatgcaacactttacttaaaaattatggagtagaactatattttttagaagagcaggttttacaaaacctaaaattcaaactctggaagttgcatgatgtggtggaagaagtgctggactgagaatcccaaaaatattgggcttggttttgcccaatgccaacagtatttcactgagtgcaccttgttttaaactgaagcaaaactgaagtgtaaaaagtaaagtagaggttcctcttcaaagactttcctccccatctaattaggaataaatagtaacttctcttagaagcaaaatttattctaagacctgtgctaacattcttaaatatctgctagctgtaataaagaaatcaatgtactttatgttctcagctcccacaatttagcctaaatatttgccctggcatgcttatactggtccaagcaagcattaagtcatagcctgttcctcttccttatttgaaggtgtttttacctttctcagtattccacaagttacttcctccttcctttgttctcctctgccgttgcctcttttaaaaagttctatgttgttagccaattgggacaaatacaaaatgtgaggtcctgttccagccaatggaaaccggacacagcagtagggtgggcgcctcaggttataaatgaccctgtctcctttgttcaatgtactctcgtggcaaaactgctggcgaatgtaccctttctgcagaaagtaaacatggccttgctgaggaaattaaatttatgttccagtgctgtttctttacggcactggggaacaagcatttctaacagaagcctgtctggttctgagtccctgccctgaacccctgcctttggatgtcagttaactcacttataaaaccgctgctctggagatgaatagttctgttggcatttgtgagattgtgtcttatcctaacagactaatttttatggaagctgatgcggatagttgtttattcatggaagaaataatgtgttgattgcgttaatttgctaaactctggggatttagtagagagtaagacagctagttgttgccctcatgaaggttaagtgtgaaaagggctgcataattgcagggcgtggtgtatgtgttcatgtggcaatgatacctagccaggtgtgggaggactggaaaggcactctaaagaaagtggcaggctgggcgcggtggctcatgcctgtaatcccagcactttgggaagccgaggtgggcggatcacctgaggtcaggagttagagatcagcctggccaaaaatggtgaaaccctgtctctacttagaatacaaaaattagccgggtgtggtggtgtttgcctgtagtcccagctactcaggaggctaaggcaagagaactacttgaacccaggaggcaaaggttgcagtgagccgaggtcgtgccactgcactccagcctgagtgacagactcccatctcaaaaaaaaaaaaaaagaaagaacgtggcattagctgaaactggaagcatgccaccctggactctgggaggaaatggtcattttcctgtcacccagactactgcctcccagcctgactcttcagatccctcttgcctctcaaagtgttcatttgtttgttcattcattcatttattcttccaacaactgttggttgaataacaactgtgccaggcgtgtgctcgggatttgaaatacctaacttgaaccagctggacaagggtttctgtccttatggagcttacattttaatgggctagggaggtgcagagggtggacagtgcacatcataagtaagcagatgctatgccagaattctccagcctgcaaccagagctagcccttcatttccttgctctgaggctacagttcagtttctctcatgtggctgtgaggcccagccttcccctcgcctctctcttcaggtcccagacactgtttttcactacgcttctatttctaaggtgtcttttcagttaccacgcctgagaaagttttcaggaatctatttttggattagagatcccctgttgtcacatgccctctttaaaacttgtacataacatgcaccacataatcattccttagctgctgtgtggctgtatttaaggtttgtcttttccaccagcctgtaaattacctgttggccaagatgatgtctttcttgttccgtcccgtgtcttcagggcccagaattgggcctattgtaataaaagctggtttggtaaaaggggagagagttactggctgaggctggctgaactgagaaggctgtgcaaggctggggagcctgcctgggccttgggctgcagggtaagatgcaagatgaacaggggtggggctgagactcatgcttaggcggacaggatcaagtattgaaaccagcctagggagttcaaacttggttttgaggcaatgggatgtcatgaaaagcttaagtgattttggggactcctagtttgttttgataacatttaatattctcaaaatcattaataatttgataacttcaggcatggctgatttaatttttaaactatgaaaatatgaagtatgaaattatgattcttatggtaaaaaagttcaacgtgtacctaagagcatacaattttaatttcccttttcctacaacttttaatcctaccttttacatttatttatttatttattcttaaatatagacaaggtcttgcgatgttgcttaagtcagtacagaactcctgggctcaagtggtcttcctgcctgggcctcctgagtagctgggattataggcctgagttaccatgcccggctgtctgtcctacttttgagcagtaaattggtttctgtagctgtctaatgcttaaactttcctgtgcgttcaaatgtgtatttctgtcttaatgtaggtaaggtcatacgctatgtactccaacttgctacccccgcccccagtatatactttattttgcttatttttacagtgtaagagttactctcttaaagcttaattgtcatttgtcattgccttgtatagaaccaaggcatcttggactgtgtaccaaatcccataagatctggccagaacagggccacgccgtccatacctccttatcttgtgctttgctgccacttccttactgtgtttcagctttagctgcctgatattctttccctatgaaattgcttcctcatctaggatttttatatgtgtggttccctctgtctaatgttctttctccctgatctttccatggtagctagctgtttatgtttatgtgtgtgtgtgtatgcgtgtgtgtgtgtgtgtgtgtgtgtgtgtgtgtgtgtgtgtggttttagagacggagtctcactttatttcccaggcaggagtgcagtggcgccatcatggctcactgcagctctgacctcctgggctcatgcaatcctcctgcctcagcctcccaagtagctgggactacaggtcccaccaccacacccagtaatttttgtatttttttgtagagatagagatcttgccatgttgcccaggctagtctcaaactcctaccctcaagtgatcctcccatcttggcctcccaaagtgctgggattacaggtgtgagccactgtgcttggcctggctagatgtctttatccttaggtttaaaattttactccagaagggccctttctgagcagcctgtctgaaacaagttctccctagtattcttgcctgagtactctgtttctatgtaacatttattttagttatcaattgatttgtttattttctgtttctctcattagtttgtaataagctccatgaaggcagaagatgtatttcatgtagtgttgctgggcagatagttattgaattaatgtataagtggttgaataagaacatatagatcaactgcattctttttaaaggctaatatttcattttatggatgtaccagtcctttgttgaaggcttactaaattgtttttcagaatttttttcttattaaaacaccaccaacgaattcaaaataatgaatttctttgtatgtctctctgtgttcactcatgtgggtatatctgtaggatgacttcccaggagtaaaatttcagaacaaaagataacgtgtcctcaaacttttggtagatactgacaatttctttttaaaaagattatcccattttctatgacaccagtaatatgagaagtatttaactttgtcatcctggccattatcagattttaatttgctagaggaaaagtgagatctcattgttttaatttgtatttctgtaattaggagcaaggctgagcacagatattgtgcttctggaactgtttttctgtgagcttttaatttaatcttttgtgatgattgttggtcctttttttagttgattcagagtttgattaaagttttttaaacttatgatgttataggcaacctttacagtgtgatgtcacttagtgccattgaatttggagctatatagggctttttatctcttcaaaagtaattttgtagagcctgataataaaacttcatgttctcaaagaccatattggggctgagtgtataatatttagtagtttattattgaaacagtaatagagattttaatgtccagtgcataataggtcctcagtaaagtatttttggatgaatgagtgacaagtgaaaagttaatttttaaggcagcttgattttatttgaaagttcatttagaagaatctaattttcatagtaagaagacttagcatgctgttaagttgaaagataagcttgctttgtggcatgctatagaagtgttggatttgtggcagtggaatttttaatttgctgtgtcagatatagatatggctttatgtatccatacacacccagctataacatgtatattcaaataagtgacaaaatatgtctaatgaatttttgaattaccttttaaaacttgcctgttagttctctcaagtgatgaactttttacaatagcagtttattttctctcatcacgttggaaagaaatgttaaaagttttcttctaggtttattataatccagtcttcatcagccatcactcttcctgtattttgttcaagaggcactaattgttcgcatttggcaggtttaacacttcctgacagagaggctattaaggggaagtattctccaataactgtcactggctggaacaaagaaccttccaactcaatgtgtggaaaccactaacattcttaaatgacccttttcatggattttcatccctttaagctaaagtttggagaatgtagggtcagcgaaaacagcaacgtgtaataaagcagtaaaccttgattttggaaggcatagggtgggagatatagatttatctctgacttgaaaacaattgttatttggaaaatctcattagcagatgtgactgcttggagtaaaaaaaaaaaaaaacaacttaaaactgatgtcgctttcaggacccctttgaacttaacaagcacctatttgtggagcagactggctaatgaaaggaaattaaatttttctgacaacttcccctgccaacctccttattcaggggatgttattaggtactgaagaactttaaagaagatttttttttattagacataagtgaaccagttataaacatccccccccgcccccttctcggaggattctgacatggttgctctacattttaaacgtattagcttaaaagcttaaaaaacactgggcttcacttcagcattttagtcattttctaaaaattcagtcacacttaccagctgtggtttcaaaacaatattgtcagtctttgtggtagtttagtttgtgtcactgaattacacaaacacacacacacacacacacaccccacacatacccacacacacgaaggaggcttagatttcaacattatctttattgttatttggggaaatgattcagcagtgtcctgtgttggatgtgttaggtgagggttaatgatcagtgaaattacttagattcaagggaagtttttgtcttttcatcttcttagaggtagaagtggcattggttaatatttagcaataactaatccttaaatggataaacttttaccccttactgtttaggaaggtattttctttcttttgctttttggagttttttcctccagtagttggttcgttgaaattaaagtttttttttaatttatgtaacaagatacaattgtagagataaaatatgtacctgaaaaaaaaaaaaaagaaagaaacaatagaaaagaaaaggtaatgcagattaccaaaaggattttttggaacaattcgtaattcctgtaggtactggaaattaactttcatatttctgcaaaatcgatcaactactcccaaacaatagagaatcaactccccctgctgacagaatctaggaaaacatgacacataatattggacagaaacaagctggctgcggacaagctttaatgacctgatttatgattcagtattgattgtaaacatctaaattctgccattaaattccggcaactgcaccaaatcattggcaattctggtagtgcttcctgccagctcatttcaactgctttgagtttcttaatataataatgatgaggtagaatttacattccacttatggtattaattttacatttctctgaatgaaaagggttagaaggtagtaaaattgaacattaaatgaatcggaggagacagtagtgcaatatatgactgccctaaagacattgtgcaatgcctcatgggattaatgttgagtctcatttcctgcttttacaggatgcagaagaagctgtcagaattgcaagggaaattggtaagtccttaaattaactttggtaggatttctgtgtctttcagcagatacggttgagtcaacaggtaataagtaattcccatagagcaaataatactttaatagttttagattttgattacttgttgctctggaagaatgtatcagttgaattgccaaattctattattaaaggagactgtaaagagtaatttgaccttaactatacataactcttttgtaagatgagatcacaggctaattcaaagaaggaattgtcttaagaattctaaagattggatataagtttaatgtcaatttatatgtacatagttgaatgtggtttgttaaaattaagaacatttggattaaaatgaagataccatatgtgacatagttctttaagtttttgccttttgctaagatgttaggtatcaacttaatcttgttagatgggaaagataaaatagatgtgggaaattagaactgaatgatctaaattggaataaaaggtagactggaggagtttttaatggctgttttacatgtacttgtatttgggcagtgtttcccaactttttaatttcttttctttttcttttctttccttttttttttttaagatggagttttgctgtcattgcccaggctggagtgcaatggcacgatctccgctcactgcaacctctgccttccaggttcaagcgattctcctgcctcagcctccctagtagctgggattacaggtgcctgccatcacgcccagctaattttttgtatttttagtagagatggagtttcactatgttggccaggctggtctcgaactcctgacctcaggtgatccacccgcctcagcctcccaaagtgctgggattacaggcgtgagccaccgcccctggctcgcaactttttaattttaaaaatattcttggcggtcatgagaactatttttggtatctgctaattgagaaaatgtgtaagggcatgctattatatggattaacaatattgttaaataactttgcaggtttaataatcaaatcagtaattgtatacatttgacagaaatttgtacagatgagagaaattaggcaatgcttgtagggatcccagcgtcttctcagcattcctgtacgcctcagtccaagcatctcatcgtgccacacgaacatttctgtaggcctgttttctcactaagattatttagatctattttctgcctctagagagcatttgatttggcaaagctcatatagttgtgatatgtagaaatatcttattggtctggaagtgatcacttgtactagtaagcgtgttctttgcaaatgggacagtctaacttagcaggtctttagtgacctgaaaagcagtttggcttattgcacccttgtttgtagttggtactgtctaaattatttgggctttgcccatcattaagtgtgttttgttgtttgctttgcaaaaatctatcttattgatataggtcctggatttaagaccagaccatagaaaatcttattttatctgactacctcatctcttcattttttttttcagaatcattaacatttcaaaaagcctatcagtacttcataggaacatttgctcgactgctaaataaactggactatatagaactgattctgtggtttctttatggagaaaaatcaaaagtttctgttcatggtttgaaatcactggtattcctcattgcctaagaggcatataatatacctactggcttttgaggatagttttctaaaatagtttaattccatcctgtcagacatctttacatttaaaaagctctttttctagttctaggttagatattattatcaacctcattggatataataatactgttattattattattacagtatctacataaaggacaatatttagagaaatttagggaaataaagggattagaagaaaatttacagttacactgcagtgccacattttgaatggtgaattttggacttgcgagcattccctttgtgtaaatagcaggccgtggattgctttgcttcctttatgccttttcttccactttctttctttctttctttctttttttttttttttgagacagacttttcactcttgttgcccaggttggagtgcagtggtgcgatctctgctcactgcaacttctgcctcccgggttcaggtgattctcctgccttcacctcctgagtagctgggattgcaggcacacaccacaatgccagctaatttttttgtatttttagtagagacggggtttcaccatactggccaggctggtctcgaactcctgaccttaggtgatctgcccacctcagcctcccaaagtgccgggattacaggcataagccagtgcacctggccattttccactttcgttataacctgtcacctttaagataaccagctcatcatgatgggcctctgtctaactagttctcatcactttgctttcctccctcaatattttaatgctgtgctttacctccttttcattttttattttttcctactgaagttacctaatctaatctaagtcttttttctttgtacttgggcacatcctttatgactcctttctctttcctgtccttcttctaattcttccccaattactctctcttgcttgtgaaataaatgatagcaatcatggctattaagtataagagtactggtgttttgcttatactgaaagaaagggaaaccataaaatttgaggtaaaataaaccataaagaactagggtcatcagctcttacaaagcttttagaatttctctgaaaatctcttctgaatcacctcagaagcctcgcataaaatcttttccttgaagtgctactttctaaagtaaattaaattatgttttattaaagtctgttggctttctgtgttgtttgatatttcgtaagttttttactactgattttattgagatatatcacattttaactatgattatgattccatgtgaaaatgtgttcctagttctaaacaactgatttataatcaaacctttgaacctatccatttgtaagttgttgattgtccatgtgttatacctattcatagagttctctcttaattctttctgtgttatgtgatgaaaatgaagtttatcctgttttatgtgatttcctcctctctcatgtctttgcttttcttctggaaacattaatctatgctgccaaagtaggaaactcactgtattgagcattgatgaattaagtgccttttacataatggtaactccagtttatggagcatttcttcctaaggccaggcactttggaaatgttgtttctaatgctaattcttgggtttaatcatttttgtttacatttaaggaaactaatgattagaaatggtaagtaatttgctcaaggtcacagaactatcgagtggtggaccctggtttaaatttaggtttatttgactccaaagaccacagactttttattatactgtgtctaaaccaatgggattagaggatggcagctaaaatttgagcgactactttgtgtaaaatactgtaaggtactcaaatgtgttatacatggaattaaagaagcagacagtctcctatccttgatgaggtgagagacagttaagacttaatatgttacttgtatgtatttgttttttggactacctagtttctctcattcttgttcctgattttttactttgacctatctaagttgagagatacagagctattgatcctcagtttgtctttaacctcaatgatagacaacagtaatcagtgagcttgatttccattgaagtttgatctttttactgggccaaaggtccttaatacaatcaagtcaaaattgattcttgaaaggaaaataaattgtgaatctaaaacctgtcctttaacaacttccagattattcagattcttttcctttgcttgtctttctcacaatcacaaatcatgcccaatttaaataaaaacttttttttttgatcctcaggtctaccatactacaaacctacttctcccagaatttccaaatctcaataaatgtcacccctttcagtcaggccaaaactgagtctctcctggatgcctcttttcctcatcatcctgttgtaaatacatcaataggcattgtcagttcatcttatatacactgtcttcattactaccactctcctccaaactacttttgtcttttgcagggactgtggcaatagtttctttacttcatttcttaaacatttcacatagctgacagtgagatatttaaaatctttaaagaacaaggatatatttcatctcatcccagcccatttctgctttaaattctgtaatgactccattgaacttagataaaaatcacaattctttactctgactactatccctatgtaatttgacacctgcttttctctccagtcttattgtatactactcccttctctgcctcccatacttcagtcacattagcttacttgaacacagcaaatttcagggccttaggataagtttttttttttttttaatcttttgcggggtgaagggggatggcaggacctagcagactcttgctgatatcttcacaaaaatagctccttgcagtctttcatatcttagcctaagtatcatgtcttcaagagaagattctctaatactgccacccagtcattctctgtcttataactattttctaaatttctgcatagtattcatgatttgcagattttttttattcataaacttttctccaagtattttattttgaaaaatttcaatcatacggcattttgaaataattgttacggtttatactcgtatacccaacactaagatcccactattaacctttttctagatttgctttaccacttatctgttcatatactaatccattttatttttgttgcatttcagagtaaattgcacaaccagtatatgtcccattaaatacttcaacatgtgttattaattgaattcagtatttgtatacagttttgttattttgatgccaaatttgcacacaatataatgtgaacaaatcttaagtgtgtatttgtggattttgacatatgcatatatatatataacttagaatcccaccaaggtgctgaacatactatttccctggagatttccctcatgatccttccaagtcagttctcgcctaccccctggcctgcaggtaacttgttcagatttttatactaaagattagatttttaaaaattaagataaatttttaatactatacaattcagcctttcaaagtgcacaattcggtgattttttgtgtatttacaaggttgtgtaactgtaatcactatctaatttcagaagatcttcattactccccaaagaaactctgtactcattagtatgtacttcttattttctttccatctagtccctgacaaccattaatttactttgtgtcttgtggatttacttattctggggatatttcatataaataaatggaatcacaacatatgaacttttgtgtctggtttctttcacacagaatagtgtttttaaggttcatccatgttctaccgtttatccctttttacggttggataattttctattgtatgtacatgccacattttgtctgttttttatttttttgagatagggtctcgctcttttacccaggatagagtgcagtggtgtgatcccagctcactgcagctttaatctcctgggctctactaatcctcctgccttaccctcctgagtagctaggactacaggtgtgtgccactatgcctaatttttgtatttttttgtagtgggttttcaccatgttgcctcagttgatcttgaattcctgggctcaagtgatccacccacattggcctcccagagtgctgggattatagacatgagccactgcacctggccttatctatttattcatctattgatggacatttgggttgtttttacctcttggctattgtaaatggtactgctatgaacatttatgtccatgtatttgtttgtatacctgttttcaattattttgggtatattcttcgaagtgaaattgctgggttatatggtaattctatgtgtaacttttggagatactagcaaattattttccatggtggctgtcccattttacatttctaccaagaatatataagggtttcaatctcttcatatccttgccaacccttgttattttctttcttttataaggaaaactattgccatcctagtgtgtgtgtagaataatatcttattgtagcagagggaagaatagattaaaaaaagtgactcaactatatgctgtctataagaaactcactttagatgcagagacacaaataggttgaaagtgaaaggaaggaaaaagatatcccatgtaaatagtaaccaaaagagagctggggtggcatactaatgtcagacaagataaactttaagtccaaaactattctaagagacaaagaagggcattttatattgattaacaattacaaatgtatatgcaccaggaaacatggccctaaaatatttgagataaacattgacggaattgaagggagaaacagactaattctacaatagtagttggagactttaatagcacactataagtaatggatgcaacatctagagagatcagtaagggagggaatagaggacttgaacagcactatatactaattagaccttatggatatataatgaccattctacccaataacaatataaggcacatttttctcaagtaactattaaaagaggaaaggagtgatgattgagttaaaataattgttaaagaaaaagaaaatataataacaaacaggagcaatatctcataaagtgttgcccatgactcgcaatgttcccaagacttagtttgatatagaaatatttttccccgcatgtactgatttatattgatggattgctcttttcttaaaatagtataggattctctgcaatatataaattttatttttctttgcaaatgattgctttatattaatttgattactattttatagtaaaatttttgttgtggtggtggttgttttttgagacagagtctcattctgttgcccaggctggagggcagtggtgtgatctcagctcactgcaacctctgcctcctgggttcaagcgattcatctgccttagcccccacttagctgggactacaggcatgcaccaccacgcctggctaatttttgtatttttaatagatacaaggtttcaccatgttggccagactagtctgaaactcctgacctcaagtgctccccctgccttggcctcccaaagtgctgggattacaagtgtaagccaccacatctggctggttactattttgtagtaaaattgaccatgagttagttttctttgtatttctaatacttaatgcttgttacagagtatatattcagcaagtggttatttggtgaataaatcaaaatgaaatatgtatatatatgtatagaaatgaattaagcaatcacatatttaaagttcttttgtaatatttatagaccagaatttgactataattttctcccttttcccccttaatcttcaattttataatagagatacctggggaaaaaaaggaatattaagcaaaacatgataaactttcagcaaatagataattgaaacaaaatgatctaggattattcaaataaattcagtatatacttgttagtgactactagtcatcaattcttgtaggctgtccttgtgttcattaggctggactaatagaaatttataggaatctaagattcaaatgtatgaaagtcttttactgaaccttattgcctttacaccagcctgttcccatgacatcttatgttctttgaaagtctggctctcccatttgacttattttactattagtcttctgatgtagtgtgtctgccctgtctctgcgtagtgtgtgggggctatatggtagtcctttcttttctgccctggctgtttgcctttgcctattcttctcatcttccttttggcataatacaacatttttttaaaaagttacttttgttgcttatatacaaccaataattcatacttaagagggataaaaatatgtggctaagtcaggaatctttttattttgtctatttcatgcagcttagaaaaattttcacatgttatatatgactctggggttaaggttatatggaagaaacctttgcaaaaacattacaatttataccttcttcacaatcttacatcttgttaatttatttgccaatttcgtcttcaggagaagacatttaatatttaaggagattgaataacgcctaaggaaaagttatgttaaagaaaatggcattaaaataatctatgtgaaatccattaaataatgagatgtatattttgctgttttcctattattgaagtgatgtggtcatttgagattagaatgatattccctgggagacaggaacttgtgttctgtggctttttttcttctttcttttccaatgggtgcttatattttcttttattattccaacatgcacatttgggtttaagcataatttcacaagttctttttctgtcttttactgttaaatttgctgtttctgtctccctttatttctctcagtccttcatcttctttctcttgttttattgttagtcattcgtgaataccatttttttcctttttctattactctgttggaaaaggctgtgcataacattcaggcaggaatgtggaaacacattgtaatgtgaaaaaaacattgctttttttgtttggaaacttcctgtgtgtgaagcgttttgctctaatctgggcactgaaatgcactgatttccgatccctggagcagagttagggatctagtatttttatttgcctaagtagagagaaataggcaggcaaaatcagtttttcctttctctgccaaagaaatagtgtcataaaatagtgtcatgtattggtttgtttagtgtataatacatctggattatatttttgtaggtactgaatattgattcttatttaaatatgtttatatagttatttgtatatatgtgtatgacagactgaggaaaggctgtgtgtgtgtgtgtgtgtgtgtgtgtgtgtgtgtgcgcagtagtagagatgtggataaatcatagactccaacatatatatgtttactagttactggataattacagaccccaaatagtattgatgcaaatgtgcatcacctcagtctgaggtctgccaactcgaatgatactccaaaactaaactgataatgatgaaactaaatataactattttgtgatttaaagagagcaataaaatcagtggaaaattatgatcaaataaaaaatgagtaatgcattgatagtagagtgtatttccccaatttgtttgaatttaaactgtttccttgtttgtatctacagcaggaatttttcagtgttagtcacatggtgcatggcagccaaatttcccagtagattctgaactagattccttggaaaactctagtaatatgctaaatttaattggagtttgtggagttgtcattagttcaccagacctcgactataccacatttttacagcccctctcctgtcactttaaacaacacagatttagtttttcttcattctgtgtgttcaattctcattcgtcaggttgtagggtgagaaggaggcattttgttctatgctatccttattcagtggctaaggctgatggagtttccaccatctgcaatgtcatagattacagaggcaggacacagaaaagcctcagttttggtaatcatcaataagacattcttcatgacaaggtgtttactattatatctcattgtgtggctttgaaatttgcagattgtcaccaccatctcctaaatatttcttgaatttatctacttctctgcatttctgttgctattctctttgtttaaggtagtgtcatcccttgcctacatcactgtaacagcttttgaaatgtactcctcttatcatagcttgtaatcccttggaggtagactctggaagcttattgggggaaataattttgggaccaatacctgagggggaatgaaggaaactgagccaagggaaaagttgaattgattctctctcaacaaagccatcagctaataatttagagagctgtgaatatttgttggtcttttttagttgttccaagttcgggcaagaggattcagcctttatacacctgtatcaactatctagggggtgtgggctgcccctaggaaggggcatgaccttaggcagaaagccgaggacaagtcagcttttggttgacaatacttacaacagttggggcaatgtcctgaactagggatctgggcagaaaactgtacttaataactttgagatatatttttcatgattgttcatttctaagtaatttcagatttctgctatgattttgactcatatgttatttggtgatgtattttaattctttaattttttgagatagagtcttgctctgtcattgaggctggagtgcagtggtgtgatcacggctcactgtagcctcaacctcctaggctcaagcgatcctcccacctcagccactggagtagctgggactacaggcacatgccaccacttttggctaatttttgttgttgttgttgtttttgtattttttgtagagacagggttttgccatgttgcccaggctggtctcaaattcctgggctctactgatcctcctgctttggcctcccaaagtgctagaattacaagtgtgagccaccatgccaagcctagtgatatatttctaaataactgaaaaaaaaatagttttttattattattgatttctaacttaattgctttgtggtcagagagtatcatgtttttcatttaaaaatctttcagatttgatgaaaattgctttatggctaaggaataagtcactctgatacatattctgtatgttcctgaaaagagtgtatattctcaaattattatatgcaatgtcttatagaaaactcaagaggtcaaacctacctattgggatattcaaaacttctagtgagtttttttttttttttttaattaagacaatggagtctcactctgtcacccaggctagagtgcaatggtgcgatcttggctcaatgcaacctccgcctcccgggttcaagtgattctcctgtctcagcctcctgagtagctgggattacaggcacccaccaccatgcccgaccaagttttatagtttagtagagatggggtttcaccatgttggccaggctggtctcgaactcctgacctcgggtcatccgcccaccttggcctcccaaagtgctgagattacaggcataagccactgcgcccagcctgtgtgggttttttttttttttttttttgagacagagtctcactctgtcgcccagacgggagtacagtggcatgatctcggctcactgcaagctcccctcccaggttcacaccgttctcttgcctcagcctcccaagtagttgggactacaggtgcctgcctccacgcccggctaattttttgtattttcagtagagacgaggtttcaccatattagccaggatggtcttgatctcctgagctcatgatctgcccgcctctgcctcccaaagtgctgggattacaggtgtgagccaccgtgcccggccttttttttttttttttgagacaaagtctcgctctgtcacctaggctggagtgcattggcacaatctgggctcactgcaacctctgcctcccgggttcaagcaattctcctgcctcagcctcccgagtagctgtgactacaggtgcctgccaccacacctggctaatttttttgtatttttagtagagatgaggtttcaccatgttggccaggctggtctcggactcctaaccttaagtaatccgcccacctcggcctcccaaagtgctgggattataggcatgagtcaccacatccagcctttttgtgatgtttttggatatctgatggacctatatttgaaaaagtgattttccaatttttccttgctcgttaggttttgtccctgtttagataataggtgtattacagtgtatcgtgtttccttggctatcaaaacataatgaccaatttttgttttcaagtctaattatgatattaatattcctaaacaagcttatttttgttttatccttgtatcattctttatctttttcatctgccagtgaactgttgttttaggtgtgtctcttgtaagtgcacatctaaatttggactggatttttattttattgtttttctattcagcctgctggagcttgtcttttagctggagagtttagtccatttatatttattgtatttaaaattatattttgatttatttatataatctactttttgggggttttgtttgttccattctttggattctgttttctttcttggcttctttttgatgacgactttaaaaaaaatgtctcttgttcttattttatgtccccttcccattcctccctccactatgttggaaattttatactctatttctattgtttcagtgcttgctatagaaatttcaacttggagacattccttcaggtgtccttcatctttggcaacatttagtgttgtcagtgttttggattttagccattctaataggcacatagtagtatctcatagtttcagtttgcagttccctcatgacatataatattgagcatcttttcatgctattatttgctatctgtgtttcttttttattgagatgtctcttcaaatcttttgttaatttttcaattgggtggtttgtttcctggttgagttttaagagctctgtgtattttggatacaagttctttcttaggtatgggttttgtaaatattttctcccagtctagaacttatgtctttattctttttttttgagatggagtctcactcttgttgcccaggctggagtgcagtggcgcgagcttggctcactgcaacctccgcctcccgggttcaagtgatcctcctgcctcagcctcctgagtagctgggattatgggcacccgccaccacgcctggctaattttttttttttgtacttgtagtagagatggggttttgccatgttggccaggctggtctcgaacccctgacctcaggtgatctgcccacctcggcctcccaaagtgctgggattacaggcatcagccaccatgcccggctgtgtctttattcttttaagaatgttatttgggctgcagaaatttttattttaatgaagttaaatgtgccaatttttaatggtttgtgcttttggtgttatatgtaaaaactcattgctaaaccaaagtcacctagatgttcttctattttttctctagaaattttatagttctgcaatgtatatttaggtctgagatccattttgagttaatttttgtgaaaggtataaggattgtggcaagattaattttcttgcataatgaatatccagttattccagtaccctttgtttggaaagactatctgcatttaattgccattgcttctttgtcatagttcagttgactgtatttgtgtgggtctacttctgggctcttgagtaatttgtctgtcttagacaataccatactgtcttgatgtctgtagctttatagtaagtcttgaagttgggtattgttagtcttttgaatttgttctttttcttcaatattgtgatgcctattctgggtcttttcctttccatataaactttagaatcagtttgtggatatctacaaaataaattgctaggactttgattttaattgtgttcaacctatagatcacgttgaggaggattgatatcttaacaatattgaatcttcctatccatgtacattgattatctctacatttagattttcatccatttctttcgtcagagttttgtagttttcctcatagatacactgtatgtattttaagattcatgcctattttatttctttagtgctaatgtaaatgtcactattttaatttcaaattccagttgttcactgctggtatataggaatgtgataatcttttgtatattaatttgtattctgtaaccttactataattgcttatcagttccaagaattttgttgttattgctgatttttttggaattccttcatagacagtcatcttatccactagtgaagacagttctatttattcctttccagtctgtttactctttatttccttttcttaacatacttcataagctggaatctgcagtcagatgttgaataagagttgtaagaggggacattcttgtatttttcctgatttttgggagaaggcatccagtttcttgtcattaagtgtaatgttaactgtaggctttttgtgtatattctttatcaagtacaagaaatttctctttattcctagtttgctaaactcagtgattgttgatttttgttaaatgctttttctgcatctatttatatgatcataggatttttcttctttagcctgttaatgtgatggattacattaattgatttttggatgttgaatcagctttgcataccaggattaaatcccatttggtcatggtatataattctttttatatattattggattttttagtcattttaatatctaaaaacttaattttaaaatgtttgcttttttcttatttatctcatcatgtttatttttttctccaaatcattttacctgtttgtaatagctgtaacttataatagtatttgtaacaactgttttaagagtcttcatttctgggtttctttctgtcagctattttccttctgatatgaatcacattttgcatctttacctatctcttaattgttgattggattctagacattgtaaatgttacattgtgtgtttggattttgttacctttatttaaaaggtatagatgtttagtctggcaggtacattaattttgtttaggttaaggccttttaggctttaaaaaagttttcttagggcaagtctagcatagtcctttctcgtgttctgattaaacaagcttgtattatgctgtctctctacccgtcacacttcctgtcctttggttcataatttctatttcattatacgtctatggttttttcgtagtataatgtaaacccatgaaagatgtaggcaggagagagatataatagtatatataccttaagaaaatttcactgaccactatgtggcttggatgggggcaactgtagtagtggggagttctgctagtaggccagtacaagagtcctggactgctggtagtttgtgtaagtattatgattaagtattatgataactgagataaagaaaagtgaatagatttgatctttttaaataaagaatttataagagtttcatactatccagcagttgtgctcttacacatagatccaggaagctcatatacaaagttccagacaacaagtacaaaaatattcaaaggaccattgttatataaatagaacaggttacagtctgaatgttcattcacagtggaatggataatgctgcagtatgtttgtaggtgacatagattacagcagtaaaaataatgacttacagctgctcagattaactaatagatttacttagtaactcttactttgcatgttattctttaggcagtttcagccactgcagaaacaacaaagaagacaggcaaagatctttgtctttatgtttttttaatcattgtgcagtgaacaatgtagatattgactaaagcaagaatcattaaagttcatttttaataatgggtgaaaattgtttggatataggatcatcacagtttcaaagtatcaatctacagattatttgctaagaaaaaatggcatactttctgtgaggaaatttaatggatgccatcttaagtaatcaagctttatcagtttgggataaattgactttttattttacttttgatgcgatggaagaactcgaggatacaatatcaactatgttgtatttaagatttgttaaacatcttgaatttaatgagtgaataatcaggtatattcaaattgtggaatattctatcaaacaaccaccctgggttcttcagaaatatcatggtcatgaagaactccccccgccatcagcacaaaacaacaaacacaaacccacactttcccttctggggaggctgagggggttcaaaaggcaagtgaactactttacattagaggagcacaaagaaacgaaacaaagcaatgcgtactatctatgtaattctcatgagcaactttcatctggggatttccttcctttctgtcctagttctttctcggagtggggtgtcttttctcttctgaggtcctattacccatatcagggcctattctatccatctagaggactgttcaacttcctgaaatatcttttgttttctttttaccttggacctttccttgaggaaacaaaggccttgtagttaattataggtgttttgcaattggttatttaaagaagatccccattccccatcacatctccttgattcatgagagatttctgattagtaccgctggattaggaataagacattttctaagaaatacttttcttttcccttctttttatttttcctttcccattagtatattctatgaaattttaattcaagaaattgtaggtgagaaaaccacataagattctttattatacagcgtaccactgttgcatcaatagggtgtcattttatcagcttttaagttaccaggttgtgctaccatgtgtggcttgggttttgcttgaaaagtaaggttatttattgtgtcttgagtaggtaaatgtgacattatcagttggtcaaaaaagataattctttttaacttggaatccataactaaatggaaaatctcctaagctcctagaatcttccttcattcatccccttatcttccacatccaaactgtcgctaactctagtctttgtctttctctctatctctgttgctagctggactgctgcaaaggcttcctcatcagctccttgtttctacctttgccctttcaccattcattcattgcacagcagccaaagtgatcttttaaaatgctgtattaggtacttccctttcctgtatcacaccttccaacttgttccttctgtctggactcatcccccctcactgattttcagagtgctcgctctatcttgtcattaggttctcagtttaaatactagttttctcagagaagcattttcaaggagcagtaaccctgtcactctcagttacatttattccctccgtgttatagcagtcatcactatcttacattgtgtataagacatacatgcacttatttatttatattaatatgtgtatatacataaagaaatactgcagccttgacctcctgggcccaagctgtccccccagctcagcctcccaagtagccgggattagaggtgtgagccactccacccgactcagacatatatttagatgcatgtatgtttgtatatcattgtctgctagatagcagggagttttctgaatcgttggcctttgtagcctgcagagagccagataaggcttatagtgtatattcagtaaacattttttaaactgatgaatacaaatttgatagtagagttagaaagaaggctgcttgctttgtggtagaaagtaagacgcactggtagctgggaggtgagggacccagagaagatgtcctgtcctgcacttaaacctgcccttgaaaactgagtccagaaaagtagcaatggaaactttgtagtactttgctaacctaagtttctgtattttcttcgtatattttgtcatatagtattagtagatttcttttcggaagcattagtgcctcttttattgtgcagaagagaataaggagtggagactgtctctgtgttggaggttcagtgtcagtaggggagtcacttctgtgtctggggtgaggtaaggtagtagcagtaagcatcccatgagaggacctggaaggtgaggaaaaacttgggaagggcactagagcctgatttttttttttttttttttaaagcagtctcttctactaggactttcacctccttttacgagtagaatttgtattttgttatgctctgtgtattagtccattctcacactgctaataaatacatacctgagactgggtagtgtataaagaaaaagaggtttaatgggctcacagttacacatggctggggaggcctcacgatcatggtggacggtgaattaagagcaaagtcatgtcttaacatggcaccaggcaagaagagaatgagtgccagcaggggaaataccagacacttacgaaaccatcagatctcatgagaactcactcactatcacgaggacagtgtggggaaaaccgccctcatgattcagtcacctcccgccaggtccctcccacagcacatggggattattacatttcaagatgagatttgggtggggacacagagccaacgcttatcattctgtttcaaacatatgtcagctgaagaatacaaaattaaacaaatacagtatagacaagagtcaagcacagaagtaagtgctccagtggatgagaaaatgtgagagaacattagtggaaatttcatgtccagatgaggtgaggggtaacaagtaccatcaacttgatcatttctgatttttccaggaatgccaacttttgactaaatatttttttccttccacttcccatttacttatcttaattagagtggcagggacacaagaaagtagggatgagggactgaactgttggatattatttaacattatctgtgtggattattcttttccctcctcttcagatttctaagtattgtttctccatggtgtggtgacagcatatgtactgcctgaaatcgatttggcataagaagttgagtagaaaaccttactgttacattatttcagaatatagctcaatggttaaattaagagttagtatcagccaggttcagtggcttatgcctgtaatcccagcactttgggaggccaaagcgggaggattgcttaaggccaggagttccagaccaatgtgggcaatataatgagacccccatctttaaaaaaaaaaaaaagaaaattagctgggtgtgttggggtgcacctgttgtcccagttactgaggaggctgaggtgggagggttgcttgagtctaagaggtcaaggctgcagtgagccaagatcacactctgcactctagcctgggtgacagagcgagaccaaaaacaaaaaagctagtctaacttgcatcagtttcttccttcctcccaacatttttctgtttggcttgtgagattttggtcagggaatcttgccttcctgggttacatgtattcacaggtctaatgctgtgatgccagcagcactgggagaccacaatgccttattatatattgtcctattctctaatgacttcccaccttttctgagcatctgataattttttgttgataaattgttttatgtatcttgtttccccagcttgttccttgtgagcaagaatgatttccatgtcatattttgaaattcacaaatcactgtatagtccagggtccttagtaaatgactaaaatgcgattagtactggaaccagaaaaactgcaaatttcctaatcgtcagagggaactgaatgtagtggagatgtgggctgtctctcagctcttgtggcttcctgttacatggataaatggtttgtgatgatgcattgataaaatatttttttgagaggatgggggtaaggatctattaagttgttgtaaacagggttttgcaggtataccagtttcaaatttttagattgcgctttttcactcccgtaaaacaggctaattcttctctactgatttcattctgattattttatgcttgttattgtgaatgagacaaataccattcttgccattctcatgcaggattaaaactcgtgcataatctcttgcagaatcaagaatcaaagcatgcacaatcttctatgctttgtccccatctatgttttctattgtgttttcccctaccatcctgcagataactctgtacttcaactgaattgtttcagtcattccttaaacttgtcctataatctccacctctgttttccccactattcctgcctgaaatgttcaagtcctgctcattcttcatagcatcatttaaatagccctttcttttttttcttctttggaaacggagtcttgcgctggagtgcagtggcgtaatcttggctcactgcaatctccgcctcccaggttcaagcgattctcttgcctcagcctctgagtagctgggactacagacgcacaccaccacacccagctaagttttgtatttttagtagagacggagtttcaccatgttggccaggatggtcttaatctcctgacctcgtaattcgcccacctcagcctcccaaagtgctgggattacagacatgagccactgtgcccagcctaaatggcccttctgataatacacttttcttaattatttttctctctacctccctgtgatcctttctgttttgaattgccagtgatagaactatttgggtcctttgcttttctcttcttggatttgaaggctcccagtgtaagagcatgttctttatctgtcttctcagtgcactgagcattgtttcaaaaataccagcccatataaacatcatgaacagaaaaaaattttaattgaattaattataaaacgcttaggaagcaggtgccattttaactaagttgaagttaaagagtgatgttttgtggtttggggttcaaaaggtctatgacatttggccttctcttcccttttcctctaaggatcctatagcttgagttgagtgccagtagagcattacaggccaggaaggatcctgtaagggctcactgagctcttttttcttcagaaaagatcataaacaaatggtcccaaacataggagtatctctaccttgtttttagaaaacatctaaagaaggagacttgtacacttttcttgataaatcgttgtaaatgactcttgctgtcagaagttttactgtataataactaaatacttaatcatgtaactgatgacaattttatgagtttaaaactttagctggaagtgtgctttgttttgaccttactttgtattttcataacaccctgttaatgtacggaacagtggaatagcttctccattgataccagtgagccctggagcttctgctccagcccatagcatcgtagccaggtttggattttccccaataccatcatgtcacttcttgctaataaaagctgtaggggttgtctgtgactcttcagatgaaaataccttaagtacctgaaaatcaccatttttgaaaaaagggaatttgttatgcatgcaaacctcagttttggagatgtttcctggtgctattataagttgtttcttatatctttgattacttaatactgtacttctgtttttggaatccactgttaatttatgtgtgttttcttagcttttattactggggaaagtgttatgtttattggtacaagtacccttttttcttttaaaatggtcacactctcattttttaaatacatcattacactggtgttactttcctggtgttattttcctgactctaaagaaaggaacttttaaataaattaattattgttttctgcgttattgaacatgtggtcaattgtcatgttcatacatcccaatgatcaaagtctgaacttctgtctaattcttccctgctgttaggctaccctgtcatgatcaaggcctcagcaggtggtggtgggaaaggcatgcgcattgcttgggatgatgaagagaccaggtgagaggctgtccaaaatatacttttgatgaaaattgcagttaccagagttttattaaactgacaggtaaacagataccaaaagcataatggagtaattacagtaaccatctaatttttacacttttgaatgggaaaaagattgaaattatgtggaaaccttccttatttatattttgatgatgattatcttattatagaaagggttttactgttttaaacattaacaaaggattttctttttgtttttaccgtatatttttaaaaattacagtcaggattctattttctgggcataaattactaacatttggctatataattctaaatgtcatctaaagatttaaatcaactatatttaaaagcagttataatttcattgagacttaatgtattacctcaatatgtagttgctttcctttgctagtgcataaaagtagtgaattactttgataattttagagtgtgaaatatattctttttccttgagtttgaaattactgtgtcctttatatggaatgcgctcttattataatttagaatactttttatggcccaatctcagaagttacacaggtttccctccagtgaacacagcttctgctcaaattcaaggggaggggactgagtcttcacttcttcatgagagcgtgggcaagattcttagaagagcacgtggaatgggagatactgttgtggccatctttggaaaagacaatctgccacagcccgttttgtgggaaagaatggtatcataaagaagtcgaatacaacttaatggttttgcaagagatgtgtattttgtggacttcaatttttttctcattgtttttctgttttgcacagtacttacatagcaatttcactgaacgcttagcgcttatttttcattattcatcttaggatctcaggtttcttatcagtcatttctccagggctactgttagtaacttactcttttatggtgcggattactctttatagtttcttggaagtgaggtttgctgtgctgctgttgatttataaattttaatttacagcttaatattttgagaaatcactatatccattcatatattaggcatcattttgtaaataatttagccctttcttgccaagtaaatagcacattgattcaaaatatgtttataaaattaataaaaatacatgaataattttctacttaaaatattactctcttcagcttgataaataaaccatctcagaaaacttgttgagatcaacacaggcgtgcctattagatttaataatacaagctcctcattttaagaagttgctctatgtcccttatttatttgggaaagtcaaaactacctaaaaagggaaagaacagtactgcaaacatgcctatgcttgtcttttggagccactaaccgtgaacaccataccacaacttatccaccccttcttttcctctctccctctcgaggaagtaattggtttttacataatccacaaagatttcatttttcaggtacaaaggaaaatttggtagcttaattactttattcctttatcctaaggggtgtctttttcttgtaacatctttcctatgttttttggggggaagtagcatctatgacttgtcttggaatctgtaggacatctgaaagattttttttaaaaatgtaatggtttttttttttttttttttttttgagacagagtctctctctgtcgcccaggctggagtgaagtagcacgatcttggctcactgcaatatccgcctcctgggttcaagtgattctcctgcctcagcctcccgagtagctgggactacagctgcacgccaccacacccagctaatttttgtatttttagtagagacggggtttcaccatgttggccaggatggtctcgatctcttgacatcatgatctgcctgcctcggcctcccaaagtgctgggattacaggcgtgcaccactgcgcccaacctttattatatagtaaatttgggtgagaattatgaagattgttgaaggttcacttagatattttcatagtaatctctggctttcttttccctattcaagtttaaatgaagcgtatggcatgattgggaaactgattgtgtctatatttttgaatatccccactaagacttttggcattgtgagtgcaatttctgttttatttttgtattcctagcatctaaaatatatccaggcacaaagttcagtaaatacttattgaatgaatgtataattgaatgtcaccagtgatattcataatagagtttcccatgagttctaaaataggttgttggcgatgctttcaaacttgctgcttattttattttggtgactttgactttttacttgtggtgttctgggtttaaatgcaaaatgaaagatctcaatcattatagtggaggcaaactgtaaagtgctatattttttctttctgttattatatccaatctaataaaaagttgattatatggtatcgaaaactaattcattttgcttccagtttctttgaagtttgcagcctcctaagattcccctaaatcaacaatgtaatggaggactttattcccctaaatcaacaatgtgatggaggactgagaaaacctaataccttttctctgagacctctgagaaatgagttttttgcaatgttttgaaatttgtcttctagtcagttttacctgcagtgttgtacaaaaacaagcaaattagttgtgtgtgtgtgtgtgtgtttttttttttttttttgagatggagtctcgctctgttgtccaggctggagtgcagtggtgcgatctcggctcactgcaacctctgccttttgggttcaagcgattctcctgcctcagcctcccaagtagctgggactacaggcgcacactgccacgcctggctaattttttgtattttagtagagacagggtttcaccgtgttgcccaggctggtctctaactcctgagctcaggcaatccacccgcctcagcctcccaaagtgcttggattacaggtgtgagccactgcacttggccacaaattagttgtttccaatattactaggtggactgtaggattaaatgatattattttaaagttgtaataattaaaacgcatcttaagtgtaccaacctggattactatatgacaaggattatcattaaatttttctattagtagtctgtcatcgccaaaactagaagcagcttttgagatgaaaaaccatcctttaaaaaaaaaaaaaaggaagaacggtcagactaacaaaacaaatagagcaatagggctgacatcattaaagaaaacacaaaacaagcaaatcagatagttgttttttatattactagatggaccatttgcaacttaaaggactggaagaatttggtttcagtattgtacattaaatacagacatttagtcttcagattaagaaactttattaaatataaaaggaattaaagcacaaaaataagcaaattggatagttatttctaatattagtagatggaccatttgcctcttaaaggatcggaagaattggctttaatgttgtacattaaatacaggtatttaatcttcagattaagaaactttattaaatgtaaaggaattaaattttatatgctgattatatcaatggatagaaggcaatatatgctcaattacttttaggcaagcaagtttgggttttttttttaattgttttttcttttcttttttttttgagatggagtctcactgtcacccaggctgtagtgcagtgacataatttctgcccaccgtagcctctgcttcccaggttcaagcggttctcctgcttcagtctcctgagtagctgggactacaggcatgggccaccacaaccagctaatttttgtatttttagtactgatgggatttcatcatgttggccaggctggtctcgaacttctgacctcagggaagccactgtgcccacccaagtttgcgttttgaaaagattggtcaaatgagccctaaatatttgaataataggcatattttaatagtaatgatttaaattagtttgtaaacaaaatatataaagcaataattaggtccatatttttattttaaaaaactatacttttataattactatttttgatcaattttatagaagataaaattgtaatgatctgtgtgggtgtatgtgggaggcaactgcatttcaagatgtggatttaaaatattaagcagtgttcttaagaatcttcctgttggatgttcaatctcaatgagtgtatttgctgtagttccactccagtcatgcaggtgactagaccctttacatttttctttgcatcttctgacttctgaatcaaacagatgtttttttatatttttgctagtggaattaaggtatattatggttgaagaaatggaattaattttacttgctctgtatggtttattaaaatatcatatttaggctgggcactgtggctcacacctgtaatcccagcactttgggaggctgaggcaggtggatcaccttaggtcaggagttcaagaccatcctggccaacgtgttgaaaccctgtctctaccaaaaatataaaaattagccgggcgtggtggcacacacctgtattcccagctactcgggaggctgaggtggaagattcacttgaaacccggcaggcagaggttgcagtgagctgagatcctgccactgcactccagcctgggcgacagagtgagactctgtctcaaaaaaaaaaaaagtgatacttagcagttggtaaagtatcggcattcctgtttcaatggaaaatctaggatctgagaagttaaataactcatccatggtcacagagttagtgagtggaaaagtcacaggtcaaccaaaattaacttagttatttgtatattgagtaaaggtttttgcttttttcagaataagccaaaataaatatttaatcgattgtgttttcttttataatgatagctctatttgttttgttagtctgactcttcttctccttcttccccttccccttcccctccctctccccccctcctccttcttccttctttttttcacagggatggttttagattgtcatctcaagaagctgcttctagttttggcgatgatagactactaatagaaaaatttattgataatcctcgtcatatagaaatccaggttggtacatttaagatgctttttcattattattttaaaataatatcatttaatcctattggaattatcttttcttccatttagaatgattgtgagttgtgcctttagaatctgttgtactttccgttaaagtgctaggatgttggttgggattgggaatgatacaaaaatctacctccaaaaaatgcattcctaagatagccgaccaggctaatctccttccaagactggaccattatagggcattttttaaaaaagaaaagtgcctgacctggactcctgtgctacttcagtttaccaaatgtccgtgtagcttgctgtgacaggtgttctgctaggagcttgttgtatagagatctgtaaatcatttcttctattcagtttaagatattcatccttaaagtggttacgtaggggcatagattttggcaaaacaaaatgggttttctaaaataaaacggggaagaagacaagtctgttgaagttttcatttgcctgttgaaaatgccttcatgctaattttatacattatgactatgaattgatatgtaatagctaaaattgataaaaacaaatgtcaaattagaaataatgaattttaagtatttttttaaatcttaatttggtgtggagagggaaccagataaataaaaggttatttgctgaccttatattttctgacaggggcatgatacaaaaagtcctagattctgtcagtttattccttaagtttaatggtcactttcatagatattatttatgggtggaaaatcatcatttcaatcctcaaattttctaaagtgagaaaaaatatccaaacttatataatcagttggatgttttacaacattgaacacagtttctttctgaggctagcaggctttgttttttgcctttttaaaaagattttctaaattgatatatcacatataatatctgtatatcatatatacggtatctgtatatcatatatacagtatctgtatatcatatatatggtatctgtatatcgtatatatatatatggtatctgtatatcgtatatatatggtatctgtatgtcatagatacagtatctgtatgtcatagatacggtatctgtatgtcatatatacggtatctgtatgtcatatatacggtatctgtatgtcatatatacggtatctgtatatcgtatatatacggtatctgtatatcgtatatatacggtatctgtatatcgtatatatacggtatctgtatatcgtatatatacggtatctgtatatcgtatatatacggtatctgtatatcgtatatatatggtatctgtatatcgtatatatatggtatctgtatatcgtatatatgtgatatctgtatatcatatatgtgatatctgtatctcatatatatgtgatatctgtatatcatatatatgtgatatctgtatctcatatatatgtatatatatatacagtgaaatccataaatcttaagtgtgcaattgaagacaatttctatacacacacatctaattgtgtaacaaccatccaggtctagatagagaatgtcccatcacaccacttcctagtcagtccctacctgtggccgccaaaagtaactgctgttcctatctgatgtcagagattagttcttaaattgcataaatgaaatccagtgatatagtctgtcacgtcttctttttcacacatcatcatatctttgagattcttccctgaggctctgttgtcctttgcttctaagaattgctctgtgatctcccattatttgactcacctgcagtttatccatattgttgttgatggatctttgggtttttagtttctttatattagaaataaattgctgtgtctttttatgaacatatatacatctctaggatagactgaggagaggtattgttggattacatagtaaggttatttttagttttagtgggtactctggttgtgctaatgtatactcccaccagaaatacatgagagtttccattgatgccacccctgccaacgtgtgatattttcaatttttgaaaacatttaaccatattagtggacttacgatggtatgtctgtttaatttgcatttcctggatgagtaatgatgttaagcatctgtttataagtttattgaccatttgaatggcttattttgtgaagtgacttctcaaactttcatccttgccttcctttttcaaattagatttttaaaaattactggagtgtccgagttctgtatcaattttgtttatgagtcctttgtcagatgtatgtatagtgtatccttctcccttcatgcggcttgcctgttcactttgataataatgtctttcaaagaacagaagttctgaattatagtgaagtcaagtttaagtctactttgtgtaccctagttaggagtttttttgttttaggtatgatatttaagtctgttactctcctttacttattattattttgtttgtttgatgtgaggcagggtcagagtaatttttaaaattctgatatccactttttccagcatcatttattgcagtgaccttttgttgcatattaagtgagacttcgtcattgtcttaactattttgcttttataataaatctagaaacctgattctgtaagtgatctaaatgtattgtttttctgcagatagttttcattctctttaggttctttgaatttccgtgaaaagtttagacttcacctgtcaacctgttccccctacggacacctacgcctacacccacccactcccacctctacctccactcccacacaccccatctgatgggagatttgtatttgggtcgtattgaatctagagattattctggggagaattgacatcttaacaatgttgaattttctttcttccctctctccctccctccttcgctccctccctccttctttctgacagaattttactctctctcccaggctagaattctggatattttgtgaaggtagaccagattttctaatagatggatgttatgtacaagaaaaaaaaataaggtgattttagggttttggcctaagaaatgagaagaatggagtgggcttttactgagataggaaagactgtgagatgtgcttgtttttgagggaggaaatcaggttataaagttggataaatcaaggttgaaatgcccattagatatctaagtgtagatgttgagtagacagttggctatttaaatctgtaatttaagggagatatttagattgtccttcttgtaagatcgtaggggcagaattaattttgtccttcactgtattccccatctagcacttgttcacactactggaagaccacttaggtaggctgttttatctttaactagttgaatttcgtaacaggccatgaggtccttaagggtagagagtaggtcttactcatttgctgtccccagcaaccagaccattgtctttgacattactaatactcaataaatgtttgttattttgtgttaaataattacatacctagatcagctttttagtttattttatttagccatggcatacagcctgggtgatatttttaaacataagtgaaaatgcctcccagttaataggccacacagatgttctcatatctcatctatacttagaagggtttttaatttacttttctttagttttcacttatttatattaagtaatttatgcacatgataaagggtaattaataaaaagtaagcatcccttttactctattctaagtcctctagtttctgtccctaaatgcaggcaccgttactgtttcttggctattcctccatacatagtctaagaagtatatgtgtgtatgtcacctattatttttcacatgagccattatatactatgtcctttccacaatgaaactgcactggtagtgtgaatggcacctctctttgtggcataaaccagtatttctcaaccagggcactactggcatttcctgggttgggtctagggataccaacaggcttgcattatgtgacattgtctattataataaagctttttcaggaagcagtatagcttagagatttttctacattcagtacgtgtaaacctataaaatttttaaaaaactcatgatgcatttaaggattaacttcccttaaaagcagtatttatttataatgttttctgattacatggcttcctcatttatttaatggaataaataatcagcaaatcatttttgttgaatgcctagtaagtgcacagaatttttaaaaaatgaactgggagactatacagaatttagagaagaacaaactcttgattctgtatatgaatctgatattttatagttggaaatatttctgagaattcttggttattttggctttatttcttggagactgtctacttttactttcttgtcaactagaatttaaaaagaggttgagagttattttaatgatttcaaatatttttagatttacttcatgcagccacctttgagtcttagaaaattccagcttattggcattttattgctgttatgttttccttcattgcttggaatcattcttgagtttcagaaagggtttgttcctaaaaattaactttacagtcatatattaactatttattttacattttaccaattatagccatgatctttatttgatttttttcagaagccatatcaaatattaagattgatattatctgctatttataatgcacaaagaaacagaatgacttgttcagagaagttgcatagctgtttggaactaaaattagtgcctggtctttgggcttctaaaacagatcttacctctgtaaacctaatatatgtattcagaaatataaatcaacaccttaaatctgaaaatagattggtccgtttctgaaaatcagatgttctaggcaaaaactttaatgaagagctgcttttgagtttccagatttagctgaaaaagatacatgttaaatttgaatttcagattaacaatgattttttaaaatcactgttccatgtagtacttgggacatagctagaaaaaaattattcattgtttatctgaaatttaaatgtagctggatatcttgtattttatctggcaatctcagcttattttccattacaggttgaatgtatctcttaactgaaatgcttgggaccagaagtgtttcagatttcagatttttttgggttttggaatatttgcatttatacctgctggttgggtatccctaatctgaaaattcgaaatgctccagtgactgtttcctttgagcgtgatgtcaaaaaatttcagcttttggagcattttggatttcagattttctggttagagatgttcaatgggaaaaactattatgtttgtatattaactccagacctttagcagtttcctagaacaaaaataaaccacagtacagacatccatagatagataacagattacatattgggtggaaatgcatacaatgtcatttcccaatcaacagacatttaataatgttaacatcaagcagatgtttgtaataaagctgcggtggcactcctcagcaacattgacatccagtgtttatccccttcactaacactcagtgtccttcacaaaatttgtacaactgattctgatgttttactcgttgtatttgaaaggtgatatgaacactttttcctcaaatctttttgataaaaatgttttattgagctttggagtaataaatatagttttcctttgttaacatgaatcaaaataatgttttgagaggtatgtatatactatgaagtttgaatattaaaaaccaagagatgttgcatgcggaaaatattaaccatcatctactttgtgggtgtggttatatggtttttcaaatggtattgctctttcaggttctaggtgataaacatgggaatgctttatggcttaatgaaagagagtgctcaattcagagaagaaatcagaaggtggtggaggaagcaccaaggtaagtctcctaagaaacatttataaagcggctgcttttatgcatttcattcattcattcattcattcatcattcactgacgcatgcattcagagacagggtctcactctgttgcccaggcagtggtgcaatcacggctcactgcagcctccacctcccaggctcaagtgatcctcccaactcagcctcccacgtagccgggactacaggtgtgtgccaccatgcccagctaatttttgtgttttgtagagatggggttttgtcatgttgctcaggctggccttgaactcctggcatcaaaagattagcccacctcagcctcccgaagtgctgggattataggtgtgggccactgctcccagccacatttctttttttatttgtttgctttatcagctacaattgcactaatgttcatgtagactctgttactgcatatttttataattaagaatttgttacttgatttcctcagtgctttaatgtgtaaaagggagagaatacttgaaaaagaagtgggtttttattagaggagaaagttgggtagacagccaactgtgacttctgcaggcttctaggaagtatggaacctgatggtacttcacgggatttctgagatatatgccttctagactttcatgttggtgaagggttcataaagttggtcctgaatttatcctaccatgaaaggcttctggagtgtggttcttggaaattccttgaattatcagagccactttgggtacttctccagggcatctttcatgagtttggtgtatggggcctcatttctcatttgatgctaggttgctatttgtatatactctggtattctctttgttcttaaaaatcctcaggtgagtgttcctagtaatttttaattaccagacggtaagaagtatagcttattgtagctttaatcagcagagctagcatatcttgatataatgcctatatagtttctgaaaatagtaagtgagaatgtgagtatatttttaatcccggagtaatggtaaaaattcaactctattttagttacattggtttttaaaaatatggcatggtgttattagttttaaaacatggaccccaaatcctttgccatttttctctttgagcagtgaggggaaggatcattgttcccttttcttgattctgtgctctgtgaaggcttgacccgtagactacttagaagtgatgctgtgccagtttccagcccaggccttgggaaactgccagcttccgcttcctgttctcatgggatgcttgtgcttacacaccagccagtatgctgtgaagaactgtgtagcttacataagatgtggccatctagttctcaaggcccaggaacaggatgtaagaagggaggaagaagaaaagccaaagggaatcctcttcctgtgtctttaggaagatcctggaaggtgctgaagctaattacttggtgttgatctgaagttagacacttagctagggagacttgttagtatctttttcttaagaaaccatgtgctgagctagaactagtactgtagtactgtagtatggaggaaggggaaaaaggatacctgtggaacagtaagagtcttcaacacacatgtcttgcaattttctgtttccttgactgattatcaattccaattcaattaacactctgtttttagtaaaaacctactcaagtgttacctgggatagaaatctttcccagactgggaaccttgaatcataaaatgtgtttgttttttctctttgtctagaaatacaaacttttcataatgaataccttatctacttatttagagaaaaaaaggaaaatatacagcagtaggaatcaaaatgaaaaagctagaactcatcattaatactgacctgatatgtatttgtacactgtgaaatgttaaaataaatggaatgtgtagttttcagttcctggagtaagaatcggctgggcatggtggctcacacctgtaatcttagcactttgggaggctgaggtgggaggattgcttgagcctaagagtttgagaccagcctggacaacgtagtgggacctcatcttcacaaaaaagtaaaaaatcagctgactgtggtggcatatgcctatagttccagctacttgggaggctgaagtgggaggattgcttaaccccagaggtcgaggttgcagtgagccgacatcatgccaccagattccagcctgggtgacagagcaagaccctgttctcccccaccccccgaaaaataaaaataaaaaaaagaatctactaatgtgctttgagggcaatgctagctagggtcactcatatctctggatatctagcagggcttttgaaaagggcaagggcaagatcaaataggagaaagatagtttcacagagctgcactgagattctccagatgttatgctattaattgttagttggggttttttttagttgcattaattttgtcagccagttattgttgaaatgtcatctatgtctatacattaggttaatgcaaactatattatagataattcataacacttgaacccattgatttattgtaacttcaccaaaagggagacagtaggaagtacacttcccacctgtgaactcttccccctcccccaccccaatccaacttgaatatattcaaggctctgagtctaactagcaatctatatgaaatagaaatgtaatatgaatgttaaaagacaccgtggggttgcatgcagttgaaccaagaatgtgagaaataagacagtaaaatgaccagatccttggccagaaaatggggaaggggcattacagattaaaagagtcttaagatacaaaagccaatcaaatgcagttttggaccttatttggatcctgattcaaagaaatcagctgtataaagatatttatgagatagagaaatttgaataccaagtggatattaaatgcttttaaggagttcttgttttttgtgtagttgtgttacaaaagggtactttatctcatagaaacagacatgtatgtttttaaaagtgaaatgatacctaatttgggatttactttaaaaacaataaagggtgggcctggtagagaagtgggcaagtagcatagataaagccagagtggctatgtattaataattgctatatattggaggcagcttcatgcaagttttttatactattccataataaagcttttatagcatgtcatctcaatcctgctcatttgagaataattttaatccacaagtagaaaagtagttaatgttttgtttctcagagcctttctttcatagaagcaaaatctgtgaaaatgcaaagtggtttgatgatatttttttcagggtttgttgaagtcattttagcttaacttgcctgcttgaaggtgggtttggtatcttgaagccaaacgtgcaggatttagtggatgtattgctgattcttgttatttgtggcagttatgttctctaaagtcaccttgattactgaattagtgaacactgaataatttcccctaggggaaatacagggttaggttcctgcgagcctttgcttataacattttcctcagtggattaatacataattttgttttttgtgtatttctcatttaatatctgtggttgattcattaacagtgaactcacaatcctggccaacaagactataacacgtgcctgagtaaagcttatcccacacacattttctccagacagtacttcatggccttcttgcacatgggaaccccagacagcacctaaggacaatgcttgatgggccatttcacaccatgaaatgacacacacacacacacaaatgcaaaaaaagtgacactaaacagaccttgaaaaggatgcttgttatagtatgagcattgaaacgagaagggagagcatcaccttgttcagccttagcatactggagtctcaaatttttcacctctctgcacttgttcacaaaggaccatgaaagcgccttaagtattgattttggggttacaaataaatttcagcaagtaggcagatttgtaaatatggactacatgagcaatgaggattgattgtgtatgttagatactaataagttatttttctcccagtttttggctcgaagcaattctgaatatatatgttaaatattagaagttgaagagtagttatatattttgtgaatggattgaagttgcagagtaatgtgaaaagttcaaatgttttatacaaatctaaagttgacttatttgagcatgttatgcttaataatatagtcaacatatattataaaacatatataaagcacaatattttgaattcttaaattggtatagatgatctatatctgagtaaactttaagaaaatgtttatgtaatgcacacaaaagataacttgatttttgtccgaaatgtagacaaacatttttttgtatatgtagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggtaacaacaactgttatttattcctctccatgcctctgtactttacccttccttctccacccttttttgttttataaatgttaaaaaattaactccataaagtgttaaataaagatttagtttttatgcttgtgctaagacatctgttaggaatgacggatagtatccctctaaagttcaatgtctagacctctgctttgtcactgttaatactttatgttggaaataccactttgtttttttcttgaacctttctagatgaactgtatttgtcagtgtgtatgtgctgttaagaaaaattactctagatattacaaataggaagtgatacagtgattgcaaaatctttggaaggatggaggaaggaagggtacccagagtgaacttcggtggtgactcccactgctgtaccactcagccaggctcccagaggaaccggcacctctgccacagtgaggacgttgagaatcaagtggctgcccttggaactgttggctttgggggacataacttccttagttctaaccaaatctcaggaagcgactggcgttgtaaccggtggctttatttccttccttcttcccttttttctttcatttaaattgtgaactatacagaaacatacatagaacacaggtgaataattgaatgtattattataaagcaaaaatcaatgtaaacatcaactgggcctagaagtatttacaaaacagccagctctttttacactagcctcattttcttctccttctcaatgattctgattccccctccatcttccctagagctgtctcctatctgactgacttctcagaaccttcagttttcatatcattcttcctttgaattacgcatacctaagcagcattattacttttgtttgttttttaaaactatattaatgggatcgtatagtattcgttcttttgtgcctggcttcttttttcagcatggcatttgtgagatttgtgctatttcatggaactcctgtatgatacattttctaagaaaatgccactatttctttatctgttagatttctgtagatagtttatttccagttttatggaatttgtgttagtttgctaggactaccataacaaatgatcattaactatagcttaacacaacagaaatttgttctcgtacacttcaggaggccagagtctatcatgcaggttccagccgagtgggttccttcctggggggttggagggagaatccactccatgcctctctcctggttctggtgttgccgacagtccttggtgttccttggctttggcagcataactctaatccctgcctcagttgtcatattgccttctctctgtgcatctctgtgcccagggttcccgttttctgtagggacactagtcacattggattcaggacccttcccatttagtacggcctcatcatacgtgatttcctctgccaagatcctgttttcaagtaaggtcacagtcacaggttgtgagtggatgtgaattttgacacgacactcttcagtccaattcaccattcaaaaaacacatatggcctacagagataaatagattagtacttgcctaggactggggtgggtgagtggggggattatgggctgatggctaaggggtggaataggacaggagagactgaggaaggcatacttatgcctgaaaacagtgtcaactcttcttccgttaggcccttgggggagggggtggggggggagggggtgttgagtcactgcaggcatgagctgggtcgagcttaagccttcctgcagtggttttctcacgtgcaccaaggggccgcttgtgggatttctgcatgcctgcttcatcctgagcttgagggcttgcctctgaccctgtgcttcatgggagccgtgtcttcatgcctgtgcctctttcccagagggagactcctgtgggccctggttagccctaccatgggtgcaggagggctgttttctgttcgctgtgccgtggcggtagaccgtccttgtgtccttgaactttgaggtgagttcagtagtggccctgctgctccccagccgtggggaagctgatgttctgggctccaggtggatttctgcctctttcctgatggttatcttttgcgtgctatggctttcttcatgcttttactctcgacctacctgtttgaagacagttcacgtgtgcctctgtaagcagtgtataatttttcagcccagtttgatatgtttgtcttgtatcttgaccatttgctccttagaaagttgacagaaatgctggtatttttgagtttaaatttctaatttttaaaaatgttttcttcttgtccaatctctggcctttttcctttttttttctttcttttgcagtatttatcatttaattttttcctgtacaagtttgggggttataaatactgctgatcttttggtagaacctctacattacaacacacatccttaatttatcaaaaactgataacagtgtcttttcacctgagctgccagactgacaagggagcttagaacatttaaagtccgtttactgtctcctgacttgggtacaattatcccccgaggccatttctcttattattttagtcatcattcattccattcctcccacatatttacctttctttgtctttgtttctggtagtttcttttagaggtttacttgggacaatctctttttgttgacagccaatgactttatgttgccttgttcatgaaatgcgtttttactcttcttagacgtcttggctgtgggccgtggctcacccctgtaatcccagtgctttgggaggctgaggtgggaggatcccttgagcccaggagttcaagatcagtctgggtaacatagtgagaacttgtctgtaccaaaaaaaaaaaaaaaaaaaaaaaaaaaaaaattagaaatcttagtttggccagtatttttttcaatttattgaaaatattatttcactgtttctggtgagacttccccactcattctgcattctgcttatttggacataattgatttttccttttggtagcatttattaatttctgtttttgttagatttcctttaactttttgctgattcgtgtacatgtatacatggaattcattgaatattttgtctgtagattaatgtcttttaattttttttggaaattctccaccattattacttctggaacaatctcacatacacagatgaataaacctataactttcattttagacctccttaatatatctcttatgtttcttatgctctctttgatatttttcatcttttttggataatttcttctgtctttcttaccttcccttatgctgtatttaattaattaatcacccattgagttcctgatttcaattgtttatatttcagttctgaaatttctatttggttcttttaaaagtatgattcattggtttttatcttttcttgtctcctatttgaattttcaattttgacttttattttttgaacataattaacttatttgttttgtagtacatgtctgataatgttgacatgtgaagtcttatgactacttgtattaactgctttttatgctgtttcttggttctgctgttgagttcctgttgggccttgttattatactgtcatatacagttattttaaaaattgttattaatcaaaacctaagatgatggattctttcttatagagatttttcaaatttttttctgccacatgcctatggacagtagtatttgtgactacggcaatctaagctcaaagtgtaaggctccttgaactcctgaggggatacacagcccggttgcagttctagagaatggttggttttattccagttcagtcttatcttgaggttgcattcctttatggtgcccactaaaagtgggggtagtttatcaaggttctttgataaactgatactttggtggcctcttatcttcgtggttatgcttttgatttgttgatgccaccaaaagtatagcttatattcatagtccttttttcctggaatggcaaatgacgttagggcaaaaatggtgttgagtgttgggtttgcaaatctgtgttttcatcttggttttggctgatcccttcctatattcttaccctgtgatgtttttaagaagacctcccccatctcccattccccaccagttgttttctagtccccaataagcccaagttccaagctgagtggctttagaggtacattatgcctatagattaaataagtttgtgtcctgactctcaacaccccccaaaagcagtgagcgggcagtggaatgacagtctgtgcctcactgctatctcacttttcctttccaaatctcatgcatttgcacatccagaacctcatgcagtcacatggaaacctcagctgtaagggagtctgggaataggctttttaaccatctgtattctgcagtgtaagagtataccctagaaggagtttggagggaaagttcagtgccagcccaccattttcacatgaatataatcaccaaaattttaatctgtaagttatatgtaaaaagttaaaaacattgctgtattttcattgtaaagtataactgtcaaataatgtggctgattttccttaagtatggcaaaagtgatctatctagatgcattttgagactagtattgtaaatacttgtagcattttataggtagtagctcagtagttgttgcttaaaactcatacttcctttgaaatcacctttgtagcctatattttattttgtgactatctttagaagtgacagaattttgccttttgaaggttaatttgattttgattaaaatgtatctttataactaagtatgtctaattagattattagctgggaaatcatgtttttggttaaagtgaagactttattttgtcataatgagaaaaatagcttgtaatttgattctgaagacaatttgagacgactgcaaaatatttgtattctattctagaccaaagagatctgagattttttaattgaggtacttatcagtatttatggaattgacaaatgggcagtttgttattctgttcttgtgttatctttttttccatttgtttctggctcatttatctcaggttataagtttgttcaagtttgtaccatggttgtttctggtataaaacccgatagttgattttttttttttttttaaacagagtctcactctgtcaccaggctggggtgcagtggcgtgatctcggcctgcaaacctccgcctcccgggttcaggcaattctcctgccttagcctccagagtagttgggactataggtgcgtgccactacgcccagctaatttttgtatttttagtagagacagggtttcaccacgttgaccaggatggtctcagtttcttgaccttgtgatccacctgcctgggcctaccaaagtgctggtattacaggcgtgagcctccgtgcccatcctgtagttgatatttttatcgaataattctatgcagttggtcaagactatctaagtacctatgttttgtgtattggatagcttgctaggaaattatgttctataccctcaaaaaattataaaaatatttcaagaaaaaaaatcaaattcacaaagattttgtcatattaccagatctaatatgacaaaaattgtgaatcattaactcataatgatatgaatcagtgctatagaatgtcatgtccatgttcggcctgaaattgccccacttctcaccggtggtctgggccccacactgtgagaaaatatttcactaatacctgcgcttagcaaacgtcccaaggtctctgactgattagagctcttgttcacgaacagagctctgatagtacctaatgctgttaagcgtgctattttaatagcattctatgatatttaacatcatactttgagacatttgtctcccatgtagtgtttaatcatatttttctctcttgtggtttacttccagtgactgtgatcctgtcagttaccagaataagttaattttaattttttagaatgtatctgtgtgatagggggtatttgatgtggaggatataattaaatgggagcatgaacaaagaattttggacttcatatgtgttcagaaaactattcttacatattccaaagatttctttctgatattgtttaaacaatccaatttgtttttttttgagacggagtcttgctctgtcaccaggctggagtgtagtggcacgatcttggctcactgcagcctccacctcccagattcaaacaattctcctgcctcagcctccggagtagctgggactacaggcgcataccaccacgcctagctaatttttgtttttttagtagagatggggttttaccatgttggccaggatggtctcgatctcttgacctcatgatccacctgcatcgacctcccaaagtgctgggattacaggcatgagccaccgcgcctggcccaagtgttcttttaatagtagacattctctttcaaatttctttactaaccttaaattataatacttaaggcacattcaccaaattctttatctcccaagatatatgttatctctaattagtgtttcagtttgaactagagggctataattttctttgttctttttttattttctttgaaatttcctgattgaactttcactttttccagcttcagaactgtgttttgtttttgtttttgttttttttttttttggtaacagaaatgcatcttcactttctacattttcttaagagtgaaatttgaaataacaatacagtttctccataaagagatgcaacactaagaaagtcaccgcgtttggtgcattaatagttggttccgttgactggttttgttctcaatctggtcacagtttatgtaactgaattacctttgctatcttcacatatttttgctttattttttttaagtcactggttttctgttgcttaaagataaaatttaaatgcttttgcatcacaacacaagcttttttttttgtagccctgatttttcccccagagtcctgtttcttgccagtgccgatctctgtgtatgaattgcaagagactcctttctttttcctgaaggtgcctttcagtttgacttctttgtgccttgtatcatgccactcccattgcttggaatgttctctgttcacctctcacagtgaacactgagctatgtatctacctgcacacccacaccacacacacctgtctcccctctctgaccatacttctccctcatctcacctctctccacatttgaaagatggacagctagatggagaactactctacggacactaggattttgttaaaatgctattttattgaagtgtattctagtagtcccccttatccatagttttcctttccaaagtttcagctacacacagggtctacttcatttcaaatatattaaatggaaaactttagaaataaacaattcataagtgttagattgtgcactatcctgagtagtgtgatgaaatctcacaccatcctgctccatcctgcctggtacgtggatcctctctttgtctggcatctccatgctgtagacactccctctccatgagtcacttagaagctacctcactgcaatgagacatgatggtgccactgcactccagcctggacagagcgagaccctgtctctgaaaaacaaacaaacaaacaacaacaacaagaaaaaacagaaggaaaaaaaaatccgcctcggtgatcacatcgactgtatgatacctcagtgcttatgttcaagtcacctctactttatttcataatggccccagcatacaagagtagtgttgctggcaattcacatatgccagagagaagccataaagtgcttcctttaagtgaaaaggtgaaagttctagacttaataaggaaagaaaagagtcatgtgctgaggttgctaagctctgcggtaaggatgaatcttccgtcggtggcattgtgaagaaggaaaagaaatttgtgctacttttgctgtcaaaagtcaaacttcaaaagttatggccacagtgcatgataagtgcttaagatggaaaagacattaaatgtgtgtgtataagacatgaatagaaaagtgttctaattgacagcaatcatgttctatactatccacagtttcaggcatttgctggggacctaggaacatgtcccccaaggataaggggggactactatatatgcaatttgctgggataattttagtttcttattttgttgaatggtaatactcagaatttataatactttgtttaaaaaaatctagtggttcataagagtctacaatggaaaagttactctccataccacacttttatcacagccatttatttttcctctgttgaagcaacctttgttttttttaacatactaatttgggagtattccatgcctaatttaaagcattatctttttcattttaatgacttctaataacctgtcatagggatgtaacagtcatataatttcaccagatctctatcgataatttttccagtattttgctatcccaaataatgcaattatgagtgaccctttatatccactttgcacgtgcagaagtagaattgctgggaatatatgtgcttttataaattagttaagtattatcagtttacctcttaaatgagagcttgtttcttctctccctggccaaaagtgttttttgccttttgatctttgtgtgatagtgaaaaatggtatattgttttcattgtttatcatgaatttttctttatagattcatttatatttctgtgaattgactattagatcctttgccctttgggttttcttattgatgtgtaggtatttgcttattgttgggggaaattagccctttgtgatattgtcagaaaggaggggctttgtgaatattttcatagggctacagggcaggtgctttctgagcaaagaccctggcagttgtgagaggtgacagcgtgctggcagtcctcagagccctcgctcgctctcggcgcctcctctgcctgggctccaactttggcggcacttgaggagccttcagcccaccgctgcactgtgggagcccctttctgggctggccaaggccagagccggctctctcagcttgcagggaggtgtggagggagaggcgcaagctggaactggggctgcgctcggcacttgcgggccagctggagttccaggtgggcgtgggcttggcgggccccacactcagagcagccgggcaatgaggggcttagcacccgggccagcggctgtggaggttgtactgggtcccccagcagtgccagcccaccgtgctgcactatggcttggccccaatattttctctctgatggggaaaaatggccacctgagggaagtacaaattacaatactatcctgcagcttgaccttttctgtaagagggaaggcaaatggagtggaataccttatgtccaagctttcttttcattgagggagaatacacagctatgcaaagcttgcaatttacatcccacaggaggacctctcagctcacccccatatcctagcctccctatagctccccttcctatgaatgataatcctcctctaatctccccccgcccagaaggaaataagcaaagaaatctccaaaggaccacaaaaccctcctggctattggttatgtccccttcaagctgtagggggaggggaatttggcccaacccgggtacatgtccccttctccctctctgatttaaagcagatcaaggcagacctggggaagttttcagatgatcctgataggtacatagatgtcctacaaggtctagggcaaaccttcgacctcgcttggagagacgtcatgctactgtgagatcaaaccttggcctttaatgtaaagaatgcggctttagctgcagcccaagagtttggagatacctggtatcttagtcaagtaaatgatagaatgacagccgaagaaagggacaaattccctaccggtcagcaacccatccccagtatggatccccactgggaccttgactcagatcatggggactggagtcataaacatctgttgacctgtattctagaaggactaaggagaattagaaaaaaacccatgaattattcaatgatgtccgccataactcagggaaaggaagaaaatccttctgccttcctcgagcggctacgggaggccttaagaaaatatactcccctgtcacccgaatcacttgagggtcaattgattctaaaagataagtttattacccagtcagccacagatatcaggagaaagctcgaaaagcaatccagggccctgaacaaaatctagaggcattattaaacctggcaacctcggtgttctataatagggaccaagaggaacaggcccaaaaggaaaagcgagatcagagaaaggccgcagccttagtcatggccctcagacaaacaaaccttggtggttcagagaggacagaaaatggagcaggccaatcacctggtagggcttgttatcagtgtggtttactaggacacttttaaaaagattgtccaatgagaaacaggctgccgcctcgtccatgtccactatgccgaggcaatcactggaaggtgcactgccccagaggacgaagattccctgggtcagaagcccccaaccagatgatccaacaacaggactgagggtgcccggggcaagcgccagctcatgtcatcaccctcactgagcccccggtatgtttaactattgagggccaggaaattgacttcctcctggacactggcacggccttctcagtgttaatctcctgtcctggatgactgtcctcaaggtcccttaccatccgaggaatcctgggacagcctgtaaccaggtatttctcccacctcctcagttgtaattggaagactttgctcttttcacatgcctttcttgttgtgcctgaaagtcccacacctttattagggagggatatattagccaaggctggagctattatctacatgaatatgagaaacaagttacccatttgttgtcccctacttgaggagggaatcaaccctgaagtctgggcattggaaggacaatttggaagggcaaaaaatgcctgcccagtccaaatcaggttaaaagatcccaccacttttccttatcaaaggcaatatcccttaaggcctgaagctcataaaggattacagaatattgttaaacatttgaaagctcaaggcttagtgaggaaatgcagcagtccctgcaacaccccaattctaggagtacaaaaactgaacggtcagtggagactagtggaagatcttagactcatcaatgaggcagtaattccactatatccagttgtacccaacccctataccctgctctctcaagtaccagaggaagcagaatggttcacggttctggacctcaaggatgtcttcttctatatttccctgcactctgattcccagttcctctttgcctttgaggatcccacagaccacacatcccaacttaggtggacggtcttgcccaagggtttagggatagccctcatcggtttggtcaggccctagcccaagatctaggccacttctcaagtccaggcactctggtccttcaatatgtggatgatttacttttggctaccagttcagaagcctcgtgccagcaggctactctagatctcttgaactttctagctgatcaagggtacaaggtgtctaggtcgaaggccccagctttgcctacagcaggttaaatatctaggcctaatcttagccaaagggaccagggccctcatcaaggaacgaatacagcctatactggcttatccttgccctcagacattaaaacagttgtgggggttccttggaattactggctttggccgactatggatccccggatacagcgagatagccaggccactctgtacgctaatcaaggacacccagagggcaaatactctggtgggaatcagaggcagaaacagccttcaaaaccttaaagcaggccctagtacaagctccagctttaagccttcccacagtacaaagcttctctttatacgtcacagagagagccgggatagctcttggagtccttactcagactcgtgggacaaccccaccaccagtggcatacctaagtaaggaaattgatgtagtagcaaaaggctggcctcactgtttaagtgtagttgcagcagtggccgtcttagtgtcagagactatcaaaataatacaaggaaaggatctcactgtctggactactcatgatgtaaatggcatactaggtgccaaaggaagtttatggctatcagacagccacctacttagataccaggtgctcctccttgaaggacccatgtttcaaatacgcacgtgtgtggccctcaaccctgccacttttctcccagaggatggggaaccaattgaccatgactgccaacaaattatagtccagacttatgctgcccgagatgatctcgtagaagtccccttaactaatcctgaccttaacctatatactgatggaagttcatttgtggagaatgggatacgaagggcaggttacgccatagttagtgatgtaaccatacttgaaagcaagcctcttaccccagagaccagtgcccagttagtggaactagtgcatcaccctctcaccctccctctccccaccaccaaaagttgagaaggggcagatatgccagcaactcttctacaagctctaattttaatagtctgagctttcctttccagatgtgcatacccctctgcatgtgtgtgggggggaagcaggccattaactacgctgcctcatggggaagtggggtatgaggaacgggactaagatgttctgtgagtaaacaattgcactgatctatgattcagaaacctttttatttttaataaaattttctttttaattgtcagcaaggcaagttatttctatagaagggtgtgcccttacagatggagcaatggtgagcacacactcggacaagggaggggaaggggttcttatccctcacgcacgtggcccctgctgctgtgttgttcccctgttggctagggttagaccgcagaggctaaactaaatccaattggctaatttaaagagaatgacggggtgagtgctttggcgggagtcagggcagagcaggtagcaggtgatcggaatgagttagggtggagtaggtaactgaaaaaggttgctttacgaggaacttaagtttaaaagtagaaggcaacgaattgaacatattgacatattaattctttgaaacgaaatttagaactcatatctaacaacccctccccttgtatttccttacagctttcttttcaaacttttttttaatgtgtcttggcttagttgttttgcttgattttccaaaagaagaagcttctctggataaggtggaggatagttaagggaggagaaaccttttttttttttttaatgtcttggcaggattaacaaatactcgtatgaaaacataacagatatgatttgtaggtatttttccttatctattgcctttttaactttgtatgtgttttttcttcttgtatagaaagtttttatttgtatgcagtttaatttttaaatcttctctttgtgatttcaggagtgacatacttaggctttctgtgctctatgagcaatcaaactgttttctttcatgttttcatcaaatatttcatctttaatggtgaaatcttcacttcatttggaattcattttattttattttccaatggctacctgattgttccaacaattattgaataatcagtcttttctgtaataattcgaagtgctatctacattacatactgaaattgcagatgtatgcagacctattacttcactcttctttttttaatttttctgcttattcatctcctagcaccacactggtttaggtattatagctatatattatagtacagtatctagtagaactattcctttctcattacttttatttttcatatgaaaaattagcctatagattagcttattgtatttatatttaacagaagaaaaagaaattaaaatgacagaatctctggactattagataaatgtttataactttccacagatatattaattcctaaaatatgttctttttttcccttccagtgacatggaactaaaatatgttcttaataagaaaaatggttatgaaaaacatttatatttttgtcatcattttccttcatatttcaatctgaaagagtatattgtttctcttttacaaaagtaatggaaattggcatacttatatttaatcccgctgtctttacttcctaactcttcatgtttgctagttttattattagttctatgtgattgtagcatttcctttcttttctgtaggcatggctctcctggaggtttcatcttacttgtgtattttatcactttatggtcactgtcagcatcttaccatagcttcatgattagtgagttctttattttgatttgttttatataaagttagggggtttttttaatcaagaatttattttttagagatacctgtgggtagtgtatttgaattcttagatggattaaataaggttacccttatatttgaaattttaactcagatgcaaaccgtttgataccttcacaattgtaggactttaaacatctttctgtggtagaccttcagaattttatgagggagtatcaaaatttaagattatcgattgttttattcaattcctctatatatcttttctttttccctttaaaaattgaatctgtttgattaagaaagagatagacggagtttttatcataattttaaaaacgaactttatttgttagagcagttttgggtttatagaaaatctaagtacacagaattcccatatgcccctccctcatgccacaccatttctctacttaacatctcatattagtttggtgcatttgttacaactgatgagccgttatcgatgcattgtgggttttttgtttgtttgtttatttttagagagaggggtcttactccaccacccaggctggagtgcagtggtgagatcctagctcattgcagccttgaactcctgggctcaggcaatcctgccaccccagccgcccaggtagctgggactacaggcatgcatcaccacgcctggctaatttttgtattttttgtagagacgaggtttcaccatgttgcccaggctagtctctaactcttggggcctctgtctcctaaagtgctgggattatagccccgtgccagggcacccggcgatacattgtttttaactaaagtctgtagtttacactagggttgctctttgtgttacacattctatgagtttggacaagtgtatctaccattatggtatcataagaataggttcattgcctcagaaatctttgtatccaagacacctttgcatttctttccttctttccttgtttggttctttctgtctctcttctttcctttcctttttcccttcttttctttcccttcctccttccttcttttcctttttccctctgtgtgtctgtctcactttcttttcctcattgtaattttcacacatacagaagtacttcagaatagcaacagtagtagagtagagccctaggaatctgcaaccagcttcttatttacttcccagtgttgtttcacgtatgccttcttttcctcagttgttcctctcttggctggagtatcagacattatataaattcacatcatactgaagtatatgtctttaagttttccctacattcctaataatgcatatttttaaatatttatatacagtataatttgatgtatgtgggtttatgactcttgtacatgagttatgtggctattttcttgcctgaatgtttatcttgtttaaatgtttaatctgaaatcctactttgactcatgtcatactgtatctcctcctgttttgtctggtcctttattttaaagccttctttattagttgttttgtttttttagtttagaaaaaattatgtgtgtatgtgtatttgtatagatggggtctcaacatattgcccaggcttgtctagaactcttgggctcaagggatcctcctctcttggcctctgaaagtgctgggattataggagtaagctgctggcgcctagcctgaaaaaattttctaagaacctaatccaacattttcttttagtgtgaaaatttaattcttcccattttaaatacttgattttatttattttatcttatatttaaaaattttttttcttgttttccattttgtttttccttttctgtttgttgcttgaaataatggttaattatcccttttgtttcccattgataatttggaaatcctattgtcctttaaaattttatttatgtttatttttctattcagacagacgttttctctgtcatttgtaaagatgatgtaactagtttccttgactttccaacactgaagatttgctaagataatttaatacttctaagctatttttagtttatctcttcttttttagcttttttttagctcccatgtatacagcccagacacatctttcattatttgctatatcttcagctttcttttttgagatttctgccctagttcacttatttgtgtagcacattttttcatgaaatttcttcagtagaatgtgtggaatatatgctctgaaatgtcacatcctcaactatgtttctttagccctgaacgggggatactgttttgattgaatacaggattcttgattaggattgggtttcggttcttgtctttcaggagcatatgaatttcagctgtgttctagcttctagtattatgtctggtgtcattctgatttctttcccattgtagataatgtagtcttgctgtctgaaagtttgcccaattttttttatttctctctctctctttttttttcttgagacagggcctcatcctgtcacccaggctggagtgcagtggcatgaacctggttcactgcagccttgacctcctgtgctcaagcagtcctcctgcctcggcctcctgagtagctgggaccataggtgcatgctgccacgcctggctaatttttaaatttttttgtagagacgagatctcactttgttgcccagcctggtctcaaactccaggtcttaagtgatcctccagcttggcctcccaaagtgctgggattacaggcatgagccgttgtgtctggctctaattttcttttgatcattggaattcagggacttttttttccaaccaggatatgccttggtttgtgtttgtatacattaaccctgccttttagtccatgccctttttcagtgttcaggtttaagtattgcttcatttcagaggaagtttcttctgttatttaactatttccttccatcagcaattttctcctccttgtggaacttctagtttttgcaatttaggtctactggatatgtttctcttatgataactgtcattttatatttatgctgtgtctcttgacattatttctttattgatcttccaggttactaattcaggttgcaacagtggttatcctctcctataagtaactgactaaattgtgcaattgggaaatcacattattttagctcagaaattctaattgtgcgttacagttagccctccttacctactagttctgcatctgtggattcaattaactgtggcttaaaaatttaaaaataaaatgaaaatatcaattcaacaattaaaaaataccaataaaagcacaatatagtataacaacagtttacatagcatttacattgtattactataagtaatctagagatgatttaaagtatacggaaagggctgggtgttgtggctcatgcctgtaatcccagcacttttggaggctgaggcaggaggactgtttgagcccaggagatcagtgctgtgatgaaccatgatcatgccactgcactgaagctgggatgacagagcaagacccatttcttaaaaaaaagaaaagtgtacgggatgatatgcataggttacatgcaaataccatgttactttatatcggggacctgagcatctgtagagtttagtattcacaggggtcctgggaccaatcccctggggagatggaaggaggactcaggggatgtgtgtgcacatgcacatatgtgcattgctacttcttaagtttttaagtgcctttactgctttttgggcaaagttgtatttttctcctgtccttcagcagctctgtttcacttggtctgtgtaatcattattctgaatgttttttctttcttgtgctagtaatccccctgctgtggttttttgggggttatcagtactaagttctgcttcttgaaatattctaagtgacagcagcccttcagatggttgaagacatgaccatatctactccagaggcctggaagagcatatgtctcctagcattctcatctcaaggacagaattgagctaatttttattgactacttggattcctgggcaaagagaccacggacccatctggagcctttattgacttttcccctgaggtccatggctctttgcaagccagtctgtctccatgatgtgttcctttcacattcttccctagagttctctgaagctagtctccagttttcgttcagccacagagggagaagagcctgttcccagtttttggctctcatcttctccctagatcttggtgcttcccatgtcctcagctgcttagtaactctgggggagatagacagcatggagtttggagtggagaggtgggagccaggctggttccaggctgtttttgacagcttctcagagcaggaatagctaacctgggttatctggatctctcatgagctttagggaagtctgtgaaccctctgaagtcagatatatagttttttagtgagaaattcagtgagattcaaaattgtaaaatgtttcagaacaactgcagctgactaatggaggactcatttaatcattgtttttgttaattgcaaacatctactgttttcactcagagcaagtaaattctagttctcttccttcttagctgtgtgaccataagcaagttccttaacttctgtatgttttgatttcctcattagtaaaatgacattaattatagcatttgctgtataggattgtcagcattaaatgagtttatatagtttacaaattcaaaatagtacctggtttatactgagcacacattctttctgctaactgtgagtatcttatccataacatttgcatgctgtttattatatattggttgacatttttactcttactgttgtcattattattaacattattgctattactattgtcattaatataaagcctgtctgacatctgaaaagatggcaagccacatattaaataataactttctctcattcttttgtcagttaactgcaaaattattgttacatgtgaacaaacatatttgaaatattaaccacttttaaagagatctcctttctgttataagggtgtttgtgtaagaagagtctgggaggaaaaatggaaactgaaatcttccaaaaatgaagctgatagagaaaagtatttactacatggcttaggcctttgtgttaagattaatattaggaccctgaatacacctttccaaattcgtgtgtgtgtgtgtgtgtgtgtgtgtctgtttgtgtgtgtgtaattaataatttccagatgctaggtttttttttagatttaagtgttttggaaaagcatcctctgtatagtctacaaagtctataggagttagaaaattcccaaatagagaggaataaaatcttaataagtaagtaattaaaaccccaaacatggtcagtcagctgtccatatctttgagaacagacaggtaaactgtcccacttttgttagacttagtcagttgcttatgttgattggtacagtgcaggaggaatctacttttaccatggaaggaaaggtacagtacaattgttgaaattctgtgaaggctatacactctaatctcatcagggggaattctgcatcacagggaacctttatattccagaaagattttagaaatttttttgtaacttgattttgccctttgccatttgtttaaaaattaagaattattgcaacctaaattctggtttataacaattaactataattgaacaaataccatattctaatttcagactagttttggattaaaaaaaaatttctagacctgccagatgaaaatattttggtcttttatggaattggagtgtttgatagaaagaatgaggagaaattattgggaaaaggatttctaactaattgtaaaatttcattcttgtcagaaggggcattttggatgtgagcaaatgttgacctttttgattgtatttaaaatgatagaggccagggctctcaggctgtttagagtgagccagaattgggatgttttggcatgttttgttctgggaaactgaggatagaaggtaggatgtgttataccctcccttattatttactgaaccttagtagaaaatgaaggaaagaagtttttggtatacagatatgtatagataagcttttcaggcacttagatttggggttttgttttaaagcatattgtaaatgatattgctgtctgagttctggactctttttatctatgtttaactttttaaaactggtctttgtattagtttgctagggctgccataacaaagtatcatacactggggtggctgaaacaacaaaaatgtgttttctcaaagttctggaggctggaagtccaaaatccaggggccaacagggtcagtttcttttggaggcctttctcgttgcttgtgggtggccatccactccctgtgtcttcctgtggcctctcctctgtgccttgtgttgtctgggtcctgatcttctcttatgaggataccagtcatgctggattagggcccactctgatgatctcattttaacctgagcacttctttaaagaccatgtctccaaatacagtcacattctgaggtggtggggctaggacttcaacatacgaattttggggggtacacaattcagcccataatggtttccttatcatttcttcatgtgattattattcttggggtcaccaggggaaccctataatagaatctgttccgttttcgtggtcactcttttttttttccatgtatacatagcatataaaaattttaaacaacttactagaatatgactggttctaaaaatcctatctcccatccccccaaaatgaagacttgacaccggttagtctattctaaacattctgatttcagctccaaagtgaatttttaaggacaagttccagaaatgaattggcagtggtgatattaaatgcatatttagttttccaagatgagctggaaaactaaatttttagtttttagtgctgttggactatttaggaatagccagtactcactttgatgtatagttctgatgttattggcaaaaataaacaaatcaaaagcacaaaacaggcaactgacaatgtcatgtctctgaagagcacatctgtatataatcctacacaggtatacgcaccttcatccatctattctaagcacgaagaatgtatcagagaaaaggggagaaaaattggtttctaagccctgcagtccaactcttttttttgtttttttctgaggtagagtctcactctgtcacccaggctgtcactcttgaatataaccattgtttccaaggtgagtttataggagtgatgtgttggggcttatttcccaacatgcttttcatccttgagtgctgtggatcaaaatctaataaccttagatctttattttgaaatcctgtattctcaggaggtagagcttcagaattttagtaggtacatgctagattctgttccgtgaacagaaagagcagaatctttctgaacagacagagcagaaccaaaaataatggcattgaccatcctttcaggctggaatagcaacaaactacaaagacagaggcctattatgccaaacacttatgaaactgaattttatgtaatgggacagtttcctcatatttcagtgggtaatcatactaaactactttgctaagttgaatccaacaagttctgcttacaaaagatagctttcgaaaaaacaagtctttgtaatacctgtcagtttagacaggatatattgaataaaaatgtcacttaaaattttgttaatttaaaagaacattattttgataacaaaaaatttcagcattctctcaccacaccatatcttgagagcaatctcctatgccttctctattaaatgacagtgatgtattgaagaagtttgtgcatgtgtggaaggattttgtaaatttcaaagtgccacactgatgttggttatacttaggtatggtgggccttacacttttaggggcagtttctgctttgactaagcaactgggccactacttaccagctgccaaataattagagctgcagatatagcactgttgaaggaattttaatacttctcatcagcctcctcctcataatggccaagttaacacacactgcgtctttctgacttctttttacatgttgtgacttttccccttttcccttaaaactgattttcctcagttttaattttcatttcaagtcaactcaggtatataattaaaatttccttgaatcttgctcaccttcaggatgacttgcctgttattcagttactgatcctgaaagttttagaaattattaggtaaatatcacagtaaaatatttaaaagtttaggtcagaggaaacatatcgcacaaactatctgctattgtataactatttttatttaacatagtgggaggattctgacaagaatgttggtcaagtcagatgtctttatttttaataatgttttataatatgaaaaacaagtctttctagggacactatttttatttttattaacttttttattttttatttttttgaggcagggtctcactcccatttcccagactggagtgcagtggctccatcttgcctcactgcagcctcgacttcctgggttcaggtgattctcccacctcagcctcccaattagcgggactacaggcatgcgtcaccatgcctggctgatttttttgtattttttttttttttaaatagagacaaagttttgccatgttgtccagtctgctctcaaactcctgggctcaagatatccacctgggtttttctcccagagttctgggattataggggtgagccaccgtaccctgacgtatttttcttaactttaaattttgaaatgatttcagactcacagaaaagttgtaaaaatattacaggtaatttctgaatacacttcactcatatttaccacatttactttatctttctatctatatctgtatttactggaagcatttcagagtaagttgcaggcctagtggccctttactcctaaatatgtctgtacttcctaaaaacaagtaaattttcttatgtaactatagcaccataatcaaaatcaggatttggacattaacatattactgtcttccaatttagggactatattcaaatttccccagttgcctcattaatgccttttgtggtaaaagaaaaaaaaatctggttcagcatcctgcattgcatttagttgttgtatctctttattctctctcaatctggaataatccttagttttttggtcagttgtgatcttaacattttttaagagcataaaccatttattttataaaatgtcactcattttaggtttgcctcttttctcatgtactagattcagtctttgcattctgggcaggaatagaaatgacactgtccatctatgagcaccatgttggtagcacgaagtgcctctttatcccattattggtggtgttggctttgttaaggaggtatctctggcgtttctacactgtagactttctattttccttttgtccttaataaagtatcttatagggagatactttgagactctataaatagccagcatactttcactcactagctttagcatacttcctagtttgtatttagtgaggaataggctgaagatgacaatggcagtgtcagagtttattattataatttttagaatcatgaggtaggtaacaacacagtgccaaggagatttagttttccctaagcttattctgctaccgaaatgagatacattaagcactcagagatgaagcacaacctaatttacctcacagttgcatttgacaagcttggttatattttgggaaataaatttgaagcaacagatgagtaagagggagtggtaagaggtattagacacgatgctaatagtgacagcttggtggtgattaagaatacaaaactaaaaatagcaagtagatctataaaaagctagccgattgttaccatctagcgtaggtgtatggagctaaacatatttattctagtccatgagggtgattatggcatgagatgttataaggcacgattatgtcctataatatggcatttgataattttttgtacctgtttgaacaaaagattcatggtgagctagggatataaccaatacaaataaatttatcaacaactgttagactctgcagtgtggcactcccttgagaaatttgtctttgaggattcaggtattataacttggtagggcttactccttttttgtgagtgtgaatttttttttttttttttgggttcgggcttactcttgctcactaaatcccaagatttatatattcacatgctaatacgttaacaatgcaaaacagtgctgtctggtggatccctgatttgtgtgctttttagaaagagcacattgctgttgggtaggaaaaacatatgaagccaggttctcaaatatttgtgtggtaaggatggagtaacaataagggaattccattttgtattttgaatgtttttgaggcattgtttccaaaagtgtgttccatggacttggcaactcataaaggtactttgcaaaaggaggaggaagtgctgcgcaaggcccttctctaggagagtcacaggacatatgggcatcctaatgacaagagtctttcctaaacaatctgttgaactgagattaacccggtgtttcccaaatagaagtgacacagaaaccttttccccccacataatagccctcaaaacagatgcatattagcatcagacttctgtagttacatttttcttctaagtgggacaagatgaacttgttggtttaccagacaccaatttttgacttttttgtttttttatttttataaccttttgatcaagttaaccatcttttccctccctccctccctcccctccctccctccctccctcccctccctccctccctccctccctccctccctccctccctccctccttccttccttccttccttccttccttccttccttccttccttccttccttccttccttccttccttccgtccttccttccgtccttttgttcctttatataaccctgttctatcacttaagtattgagcttaacttgcagagagaaaccattgctaagcacttgggaatagggggatatttgtgattatttaagcaatgttgtgcttataagatttctggtaataacacagtctaaaggaaatgcttcatatcctgtggagtagctttggaatcctatgtatttagaaggatttctttcaaaaatgtttaaaattataagttttactttaaagaagttaatttcttttacctggaaaattgaagcaagttagactattttgtggacttatgcagtacttgtcaaaaggtaaatgttttttaaaatttctgttagtaaggattttacctttagcagcttgttattttagttatctgcttagttgcttctaatttgaattacttgtagctccctaatttagattgtaaaatgttatggctctgttatatgacttaagtttagaacacagtgggtccacttttggatcccattcaaagtggatctgatgtacttattttcctacacagttaaagatccctcttcaaaggtgaagcagagacacaataaatttggatcttgaaaccttcatagtaatatgctttttaaaagacatgtatacataattgtatagccattgcatatacttttatacatacatttctttcatatacattactgtcaggaagatcaggaagataatgtcatctctttagtgagataaattccaactccatcgtgaccacttaccatagatgtgactctgtatttgctgttcattcattcaatatgtatttatttgccttgtatatagtatgtacttatatgggcactggtcatagaaagaggaaactgaatggttcacttaacttttgaaattgtcttttcacctatcagggatgtgtgaatagtattgatgtaaagcacttggcacgtggtaggttcacctcttttttttttcctgagatggaatatcgctctgttgcccagactggagtacagtggtgcaatctcggctcactacagccttctcctgggttccagcaattctcatgcctcagcctcctgagtagctgggactacaggcatgtgccaccacacccggctaattgtttttatttttagtagagacagggtttcatcatgttgaccaggctggtctcaaactcctgacctgaagtgatttgcccgtcttggcctcccagagtgctgggattacaggcgtgaagcgccacacccatccaggttcacctcttgagtagagtgctgagatgctttctcacatgagattggtttctagtaataatagagggtttttttgctagttactttcttattgtatttatcttatagagtcttggttcttacaaaatcataatttgctttcaaaaatacatattttaaactacctaataagatctttatttagtgtcacatttacgaagggttgatgcttattttagtgatgatttgtcattaaaattatgtcaaaatgtcttaaaatgttgttgaaactgtaagcaaactcaacacgcacaaagctaattatgggtgccatctgtttatttttacaaagctttttttttaagactatggcattgtctgcttatgataagcttcaagattattataatgactaagtcctgtccttcaattagtgtagttgaagatgggaagataattcgtttgttcactgaccttttcctgtgtcagagtgtatgaaatatgacatgtcatgataaagaaactattgtgaagtgcatttagaagatacttaatttttatgagaaaaaaatgacatcaaagcagcagatgtggccaaagttttgtttaaattcttagaacttattcaaggttttagatgaacggtagacttttccagtgacttaagtggcttcattttaactcaaggttaagaatttctaagtgatcgaccaagtttatgttgacatgtatccctgtttgtgtacctatatgtcagcacatgtttttgtacatacatatctcatgtgttagtgcagaaggccaggtacatgcatgacagcatcagcccaagtagttatcagcaatctgctgagagagcagagcgatcgcactggctctgttttgcaattgtgcatgctaagcattacccaagtcagtgtggagggaaagcaacctgaaggatccatctgctcccttctgctacactgcctcgatgcaagattacactaatctggctgcttgtcaggacaggttagtgaaagcatgcaagtgggtgagacttagggtggactagtgctttggaaaatcataagctgcccctgtagatgccacgttaagtgcagcagaataggttgattatcggccacattgaagattgccgtgaaataaatatatagctttttggttaagaattagtttcaaaattaaaattcttaaatattgttggaccacagataaatcaaaattgagaaaaataatacagatagtttacaaatacttttaggccttagtttttcttatgatttgtgtattgtgtttattctttcattttattcccctagctcaagagttttttagtcaaatatgttcaaatgttacattcgattaacttcattttacccaaaaacttttgtgatttttcttgtttgtttctatttatttacccttttctacacctactgactggcagaccttggccttgcaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggtaaaatgaatggtgttgggaggaaggatggtggttatgtccagagtcatgagacctggtatagccaaacaatgaggtaaagttagggttttataatgttgccaactattggattacgtaatccataattaaatcagaaaaaaattagataattttgacctaattccagatagttttaaagaattgggcttagttaattgtcatgtatttgtagatggggaaatagctaccaatcctttaagaggcaacagagcattggttaaatactcttgagcttgaatggaccatggtttttgttttgtttgcattttctttgtttattttcaaacaacactaacaagaagtagcatttatttccatgggttttttaaaaaaatgcccaccttgggtacacattagttgttgatcagatatttacttaaaatttttcccaaccttttttttgtataattttctcctttattattacataaaaataacaatcaaaatttaaattgtaaagcttttagtaaaacatgtactcttaatttataattttaattttgggttttactcataaactctcagttcagtacttctaaatgctttttttcaaatgactaaaacaagaatgcaaggtaacatttgtactatttttacttttcgacatcaaaaatgtctgtcaagattaaaaataaatcagtgtctgtgtttaagaatactgagagctggtttgaaatatttttcaaggagttcaaaaatatgttttggcgtgactgtattgctcttgcttttttcatattttaagtagtattactttcattcttatgacactgaacctgtttattctgatgatctaagatatttacaaatgaagtgcatatctagtagcgtgcaaagttttttttttcaggtctttatttgaagaacccaaattctcaagttttaccatatgtgaactgttttgagaagtaagaaaaacaaatatctttagtataccacatttgttgttctaaacttgagtatgttttgatgtagggcctaggttattttattttttgcccaaggcattctaagaagttttataaaatgttggaattttaccaatttcaataaagtatgaacaaggtcaggctaaattctgcttacagttctgtttgatttttaagtacattctaagttgtctagcgtaaaagacaataatattctgaaatctgtgatttggtaaataccatatgttgaaaatagacctataaatggttcttcattgtgtaaatatttaaccttacttgtgctgatttatatttcaaagactgtgcttcctttcctttgaactttcaggacccctacaagtcttttggtttaccatctattgggagattgtctcagtaccaagaaccgttacatctacctggtgtaagtcattaagctgtaataccagctgaagggttaaaatcgtgatttatgtcatacttttatgttaaagcatgtcaacaccaaagggtgtaaattgaaggacaagtgaaattcatgggaatcatggtttttgtgttgaaaacaaatttttttcagtattttgtggtgttcaagaaagtcaggattcactggacaggggaagcctggggacatctgatgatataaatgatagcttacagtgttcccaattctttcgaaaattataataaaaaaggctgtgaatcctaagaatgagaaatgatgttttgtgttacaatttaatcttttcaataaatcgagtccaaccctgctatatagtcacttgtcaagaaattcaagcacaaaatcagctccttaattgaaatttaaggagattgaattaaggcaaacaaagtgtgcctcagtctattaaacctcatggactttaaagagtaataatatttatatcagttaaataaaagtgaccactgtccattttattccatagctcttctgtatttaatagctattttgaaaatagtttttgttgcagaaaaagagcaaggacataccctttttcttaatcaaggtaataagtgcatatatatatatatatatgacattatgttagctagtagatgacaaggctgtaccatctgtgaatattcaaattattcattttgattactggcatgaagatggtgaaagattacaggaagaattctaaatctgaagatattattggatatatgatttatttcactttttaaattgtttttgcccatgtgctttctaaagggacttgaccctttctgtgcttggagactccatgctgtgttcaaagccagaaggcagaaaaaaaattgtgaagatttaacaggcattatgtgacgttaaatagcacatgagaaaacaagtatcatagggacatatctaaacacttttttaatcaaacaaaagaagtattaaataagaattcataatgattactctagttgttagaagttttcaccatgttgtaatagctaacaggatgtcaaacattttgccctcgcaagtttttgcaatttgcaattttcaaacgtgagacctgttgaaagtacaagtgataatggacaaactataccccctacagtcttcatcccaccaaatctttcttcaattaatgctgcagcaggagttttatgtaataacatttgcagttgtgagccatccatagaaagaaaaaacaattaaaatgccttaaatgttctgcttactgctgttatttgcttgtgtgaatgttgcatgtcagctaaatggaccaaggagtagataaagtgattgggtgcaggagagtgcacactaagctttgtctatcattattgctgggagcaatcaaattgatgtcagcaggacagtagatgcgttgacagctgtaattatgtatctccatggtgatcacttttggcctgtcatggaggcccatgagtcccctcccttggaagcatttaatcagattgggctgtcacttgtcaggtagacatggcgggctgggagttgtgcttagggggagaggtgaattgagaatgaagggtgggagatgtctgatagtttcacagagtccactgtggtactgaagacagaaattttaattatgctagaggtttctgagcagtggtttgagaatctcgtacagaggtgcttgggtgttttgttgtggttgttattgtttgtttttcttccttgtcttattaaaactagagcagtcagtttaccttagaaaacaatttttggctcttaccttttttggtcacaagaatgcatacttaagagttaacttatggtttgtacttttcacatgcttcattaagcctgagatttattaatatggcagaggtgaagatttccttttttatttttgatcatcatgttttgtaaatttgttattttcagaccacagttttgttctgctcagaaatttggttctgatttcatttgaattttttcttaaagtttttagtgcaaatttgtatagcctttcattgaaggaatggagacttgatctgacttcagattggttgttaagaaataaaaatatagctgattattacttggaaaaagcagcataaatagtaaattataaagcagagttttcatactgtggtacagtttttaattgggaatactgatttgcttatacaaagatacgtgtttatatatatcttgattttatcgtatgtattttaaagttaagatgacataacttctgtgatcataatattagtaaataacaaagacagttatatttaattaagatctgtaggtaacaccttataggatgatattattcaaggcaactgaagttttaagtaaggaactgtagaagaacataataaatattctttattgtctatgttattttatttgtgggttgaacatctaagttcttcctagctttgtagcagtttatgtagcaaatgataggatgtagttaaagtcagaagttttagaacttgtatcagtctcgtttgtaaacacagcattagcaagcatgctgtggttttaaagatgacatagtggtcaaattagctctttcactttttagtactaaaattaagaaaatgaaaactcacagatatattttctgttatgtaacccgtttactagttgccattttggggctctttaatgtggggaaaaggtagattgtgattttattgcttttaaagctgctccattaatttttttctagtttttgtcaacactgtgaatttcatagaacatcagtttatgtcctgaaatatgttttcagaaaatagaaagccaagtatatttcgtaagtgtgctgaatgatttttgtttataattaagatttttgtatatgaatgtgaatacgaatacagatatctatatttttgtttgtgcttgcaaatacagaaataaaagcccttcaggtatgttatagtgttccttttacaaccttacaaagagaataatagtagtgtgaattttaagaaaatgaaactatcgcttgtcttctgatgtcaccgtataataaagccatcattataccctcatgtggatatcctagacaagaggttctacatgtggtcccttgataattgcctaaattaaaatattaaaggcctaacagccgctgtgttgacctttttctgccttgctgcagacagatgagctgctgtttattaggaaggcttcttcccacaggtggaaggctacgtgagcttccgctcttctcttcccacccctttacaatgttgggcatcaaagtcctgctgttccagcagctttgattcagttcctccatcctcaagacccctaggatgtgcctgacagtctgaagtattttgattagcttttaaatacttcagattccaaaacttctttctaataatttaataaatgttctgtcctcagtaactgctcatttttaaagttttgcatggctaacctccgtgccttgctgctggtatcaaactgggaaatgaaaacaagaatcagtgatgtactaactcactcgttggctggttaacagcaatcagcctcttcaaaagaatattttgaacttgtgctatccccctaccccccaccccaagaaaatcacaaaatcagaactctaattggggctttacaaagcaaagccataggaaaagctgtgtaaacatgaaagcctcaggggagcaacagtaacagaaaaatagtgttttacagttgagagggtgaggcagaaaaggaaagtgttacagacatgaaaggcccaggcccacattcctatggagctgaggaccaggcttgacgaggggcctcactggtgggctcagaagggtctggcagggagtgcagttagcaagggcatcgtccatgccatgcttcagctggaagacaccatcagagagccacagcatcctggcatagtgatgtaggaagtcttcattttttattttttatttttgctgttttttagtttcgtcattcagtggcagaacaaaaaatgtgttgcattacatattaacggatcaagattttagattgttttcctattttccagaagttgaaatgttatttgagattgaaattctctatccattttctccatggaaatgaaattggtggttacaaaaaaatatctacacaatatgaattacttttctttttttctttttttctcccaggtccgagtggacagtggcatccaaccaggaagtgatattagcatttattatgatcctatgatttcaaaagttagtttaatttctcaatggattatttgatttcttcgaaaaatcaatgatatttaaagagtctgaaactgggcctttatctgaatcataagctataattaaacaactaattatgcactgatgtaaatgtgaaagcagagcaggttttttctcttgagagaaaattcagcgttatgttagtttgtagtactcctcctccccaactaaatcatgccacaccatcacacacatgcatgaacaataataataataaacatctaaccagtggtgccagcctaactcattgccatgagaaggaattaaggttttttttggccattggcagaaattacctgagatggaagtatgaatgaatggcaagagttgggctgataggcagtgtttgttagagtactttttgatcttttctcttcagtttttacaaattaccaattatttaagtagatgtgatgtaagagtataagatttgttttgcccacctgtctttttgaagtttgactttccagaataaatgaattgaatttttggatctttaaacccttaaaaccgtataaagtgtaaaatgctgtaataattaagattgtggattttatttttattttattattatttttttgagatggagtctcgctctgtccgccagcctggagtgcagtggcacgatcttggctcactgcaacctccgcctcccaggttcaagcgattctcctgcctcagcctcctgagtagctgggtggctcgtgccaccaagcccagctaattttttttgtttttagtagagatggggtttcaccttgttagccaggatggtctccatctcctgacctcgtgatccgcccgcctcggcctcccaaagttctgggattacaggcgtgagccacaatggccggccagattgtggattttattttgaaaattctgtgttctctgaaatgatacatctgtattgaggaatgatttgtttttcaagccttgtttctcaagatggcttttccccaagtgtcctttttaatgttatagttgcagtaaacaaacacttttttatctgtctttcttcagttagggttttagtgcttttttttgggatagggtctccctttttcacccaggctggagtgcagtatcatgatcttggctcagtgcagccttgacctcccaggctcaagcgatccacctgccttagccacccaagtagctgggactacaggtgtgtactaccatgcagggctatttttttatatcttttgtagaaatggggcttcctcatgttacccaggctgatctcgaatacctgagctcaagcaatccacccgcctcggcctctcaaagtgctgggattacaaacgtgagccaccgtggttggcctaagttattagtagtattaaaataaaatttaggtcttttgtttattagagaaccaccatttaatttaaaaataaaactatgtaaaaatattatacgttgatttttaaatattccatttttagatgaatgtttttctcttcagaaaaatggcctacaaattaattttcaaatttgcttgatattgaagagctagtaaaacctactaaaataatcacaatctatagattggctaatataactgccagaaaaatctttaatgaatagttaaggtcttatttcattgccaaattatagagatacatataagtaggcactaaatcatgtagaatagtaagacttttctgtttttttgatttctgaaaaagtaccatttgcttctgtgtatattatatgtaaaactgcaaatgatttctaagatagtcgtcttctttctttatacttttatttttgaaactttactttttttgttagttatgaaagtgttaagggctggacgcagtggctcatatctgtaatcccagcactttgggaggctgaggtaggtggatcacctaaggtcaggagtgtgagaccagccaggccaacatggcaaaaccctgtctctactaaaaatacaaaaaaattagctgggcgtggtgacacacgcctgaaatcccagcttctcgagaggctgaggcgagaggatcgcttgaacctgtgaggcggaggttgcagtgagctgagattgcgccactgccctccagcctgggcaatagagcgagactccatctcaaaaataaaaaataaaaagaaaggaaagtgttagctattcagggtatcaaacttggaaaccacagaaaaatagggaaaaaatgtcttatctaatcctcaccactacccttggtgttcaaatcctatctcatatattcacgtttagctgtatctccttttaaattttttctgtacttacttttgttacgtttttgtttttgtaaaatcactctttactatgataatgaaatgtaggagaagagtctgaaatagcttgattctaatatttatatacttaaaaaatcataattgacatgtattgaaaactgaactatcataaaatttcgagatatatttagaaatctgttatgaaatattttaatttttactaaaatgaatcatttaacatagttctaaatatatatatatattgggttttttgtttgcttgtttttagctaatcacatatggctctgatagaactgaggcactgaagagaatggcagatgcactggataactatgttattcgaggtaaaaacaaagatttgcactcgttggttattgtatatggtgtccagttccagagaacagcctgggggtttaccaatgagaatatggcacagcacatttgctcactatgtgcttaaagagaaataagaaaaactcaaatccatcaaaccaccataccaagtatagccgtttccactgttttaagcaaatgcatattttctctatatgcctaacatatatattactctatataaccagtacacattggttacacaggccttcaggagggcgtcttttttcttacagaagtaatattgctgtggagaggtctttagtgcgtatttgggacacacgttcagtttatgtgagtttatctatgtttatctatatatgcgagtttagatagacataaataagttacttgggaagattattcctggaagacattaaagtatttgtaagcacattctatggggattttctccctttttatctctgcatttttattgtggtaattgaaatactagattttggttaatttaatttttactctaatgtgcttgagcagtaaatccatgaatttgagagtctgaataagaatattttgtcaaaactcatttctgttaaactgtgatataatacgacataggggcatggcatctgggcagtttgtcaaaatattagattagttttggtcccaactagaagttatttatctactccatctggcttctgaaaggagtactcttttgtatttacatgaataccatttcatgttttatacttaaatgaacattttcccactaatttgcttactctatatatgtatatataggttcaccagttactacagtttttaagtgactaaaatacaaagtaggcttgccattattctcctaactttatatgtgtcacatataaaaaataaattttgttgtataggtagatttttccaggcttagtctgaaattttgcctttgaattactgtgatgtagtagacagaaaccagacaaagctaggttcatagcccctgtcctgacgccatttaataattatgtgatttttggccaagcacggtggctcacacccgtaatcctagcactttgggaggctgaggcgggtggattgtgaggtcaggagttcaagaccagctgggcaaagatggtgaaacccagtctctactaaaaatacaaaaattagtcaggcgtggtggtgggcgtctgtaatccccgctacttgggaggctgaggcagaaaattgcttgaacccgggaggcttagtttgcagtgagccgagatcacgccactgcatgccagcctaggtgacagagtgagagtccgtctcaatgaaaaaaaaaatttttttttaaataaataattacgtgatttttgtcaaatgactttgtctctctgaatctcatactccacatttgaaaaatggagtgatagtctctgccttataaattactggtgaggattaactgaggttaagtatataaagggcttggcaccacactggcttatgttgttcaataactttagttgtcatcctttcttcctctttcctcacacttaataaaaccatatatttaagaatcaaggccaggcgtggtggctcacgcctgtaatcccagcactttgggaggctgaggagggcagatcacttgaggtcaggagctcaagaccagcctggccaacttggcagaaccccgtctctagtaaaaatacaaaaattagccaggcgtggtggtgggtgcccatagtcccagctactcaggaggctgaggcaggagaatcgcttgaacccaggaggtggaggttgcagtgagatgagatcgcgccatcacactccagcctgggtgacagtgtaagactctgtctccaaaaaaataaaaataaaagccatgtgttataaatcacattatcaatccattagtcatatgaaatttactaaatcatagataaacaatattgaaagaccgttttatgtaatttctaatactgtgtgcggaggttatatgctttcattgcaccctgttcaaatacttctccagagaatttaccgtcactgtaaaattaaagtattaattgtgtaattaactgtgaaatgttgggttatcctataagattattaggcacatgaggacactgatgatctttatcttgtttgtatgcatattgctggtgcttagcagtgtctgacacatgctagatgattaataaatgtttgttggatgaatgaatgagtgagcaagtgatactatccctgatttcaaggagttactaatatacttggtgtgaaaacatatgaaaagataagtataatattaatatagctttgtaggtgccccaataggggattgaaaaagggtagtgggagtttaaggaagaggctagcatatctttcttttctcgcctctcttggtcctttgaaagtaactagtactgctttaggactcatagtgtctctgtgtctctgtcgagagtacctcactttgttctgctttcaaatgatcctcagagtggcaggatttttaaaaagactggtaatgtcctgtgtaggtgaaataaaggggatgggcacgctcaagcgtctttgcagtatcacttgttatagtattttgggaaaataatctggtgttagatgttaaaataaaagtgcataccctctgacccagctattcatcttttgtgaatctttcctatagagttaaaaaactgaattatgagcatgttcaccatgacatttacaacaacattgtttgtagtagccaaaatgctgaccaaccacagtgtccgctaaatggatgaatgactgaataaattacaatgcattattactataaaatactatgcagctgtgacttaaagacctgtttgtatgaatcgttaaagtagaaaagcaatttgtagtcatgtgtagtacattctcatatcacttgaaccatcttctcatcctaaaatattttaaattgtgttggatgagcacagagaaaggtgtggacatctacatatcacaataatttttttaagctcaaaggatttatgagagaggggtttttcttgacacatttctcttagactttttaattttaggtattttcaaatctatagaaaagatgaatgaatagtactgtgcatgcctgtgtactcttcacctagattattatttaataaacttttttttgatatttgctttctctatttctccctttctttgccttttcctcttcctttctcacccttcctctttcctttcctccctccattctcttctctgtttttctcctgatccatttgaaagaaggttgcaaacatcatggcgcatcactcctgaatactttaccaggcttcttaaggggaagaccatgttcctgtaactggatttttcttgcctgctgcacagatagagtctatttattgagacagcgttattgcaatagagaaagagtttaataaacacagggctggctaaatgggagactgaagttttattactcaaataaatttctcccaaaatttggaggctagggtttttaaagaataatttggtgggcagggggccagggagtgaggaatgctgactggttggtttggggatgaaattataggtgcttgaggcagggtcttcttgctaccttcagttactgggtaagatcacagaactagttgagccagtttgctggtctggctgcatgactcctgagccttaatttctaatgttagttttacaaatgcagtctgttccccagacaaggagggggtttgttttgggaaggggctgttttcattgttttacagttaaagtataaattaaattcctcttatagttagcatggcctacacccaggaatgaacaggggcagcttggaggttaaaagcaagataaagttggttaggtcggatttttctcagtgtcataatttttgcagtggccatttcattcctgcaaaaaagcacaataccatcattacacccaaggaaaattgacagcaacctaacagtttcatctcatgtattgtccatatttaagcttgtccctcggagtctttttttattgttttttaatcccatctgtggcccaaagttacacagtgtctttgattatgtctctttattatcttgccgtctttcatatttcatttcattaattttcaggagagtccacggtagttgatttgtagaatgtggcacattctagatagaaagtgttaacgttggttcactaaaggcacttgtgaagtgattccaagaatgagggttgtaggtgataatttgcactatcactcacagaactcgcagaaactctttgcttactattatcagtttattataaagggtacagcttgagagtaacccagtggaggagatgcacagggcaaggtgttaggaaggggtgcagagcatccatgccctctccaggtgcaccaccctccatcacttccgtgtgttcagcaacccacaagtcctctgatccttgtccttgggtttttatgaaggcctgactaggtaggcatgattgatcctatcaatctgccattagtgattaagtcattcttcagtccctctcccctttggagggtgggggtggggctgaaagttccaaccccttaatcacatggttggatcctctggccacctgctcccatcctctaagagtcatctcattagcataaactcaggtatgattgaaaggagcttgttatgaataacagaagacattcctctctcaacagtcatttctatgatattcttgccaaaaatgtacaacctgagtataatcatgaggaaacatcagacaaaccaaattgaaagacagtctacaaaataaatggcttcttctcttcaaacatgtcaaggtcaggaaacacaaagaagagttgagcaacttatgtagatcaaaggaaactaaagacacatgacaactaaatgcaatgtgtgatcctggtttagatcctggaccagaagaaaaatgtttttcttttgtagtaagggtcataagtgggacaattggtgagatttgaataaggtctggagatgaggtgatagcaatgttagcagtgttaggcttgtctgattttgatccttgtactgtgattatagaagagatataccttgcttttaggagatgtacactgacatatttagaagtaaaatgacatcttgtctgcaacttaccttcatatgtttaagaaggaaaattatgtatctgtgtataaatagaaaaaattagtgacaaagcaaataaatgtgataagatgttatcatttgtagaacctccatatatagtaattctgcttactatttttttgaaatttttttaaattttgaattttgaaattatttcaaaataattttgaatttttttattttgaaataatttcaaaatttaaaaaatttaaaatttaatttcaaaataaaaagttaaaaaaatagggaagagcaagaacccccactctccactaatatttaaagaataaaagcagagatgcatttgggattttgaacttacatattactcatctggctaattctgaaggataggcaggtttaaaaacttgctttatgaaaggcagaaaagggaagacaatctactgtcttgtttggtaactgcttaattattcaaatatgaatatttttttcctgtgctgattgtgaacttttgttaagatagagaaactttgaagcaaaaatgtaattcggttaaaatgaatttcaaaatcctcatgaaataagagtgcttttggcctctgtttgatcctggcagcatgtctagctgatgtctgggcagtgttttggaaccagcaggcagtcaggggaaggccactcctaggggcctcttctctgtggcctggtggtgatttcccatacagatgggacctggtgaactctgccagaggtcatccttgactcccagtccacacctcccagtcataatttttatgagtatgtgattaataatatccttgaagttgtaaactaactctcaaagaatacctctactgtccccataccatttaaacaaggatctgttcaaatagtgttgtctttcctgggatgtgaaaagaaagaaactaaatgcaaaatggtaactttcaaatctgtatgatactgtttagtgcttcagtgattcttcccatctagctgatcttttgagctcttaggtataaaatacttttctgattattaccctcttttggctttaggattaattaatggacagtagtttcgggaacagttagtcgaggcatagatgtttgttgtctgccatgagccattatctcaccatattggccttaggaaagaaaaagagataacgatttagttttgcatagtcatatataatattttatttagaaaacattaaagagaaaatggttttgtgttttaattttgtttttaaaatatcatttagtgagataaaagtctgtgtttttatgctgtatttactattcaagtagaaagatttttaaaattccatgcttcatttacgtgcttgatggctctgttctttgatatccaaaatgtaaattaatatttgctttcaattcctttgagttagatttttctaaaattaacacctatttttcagctttggatatagaggacaaatacaacatatgatttatcctgtgaaactgcaagcatgttaactttctgaatattatcagtcacaaattttgggcatcagaaaataatctctttttttgttcaaattgtcattaactatttctgaaaactatattgtattttactgatgacagagtttggttccacctattttaacattggccacacagggagctaaaaaatttataccagcagtaggctataaacatgaaagccagtaaagttaaatatgaaatattaaatatatatgttaatagtattctttttttttttggagatggagtctcactctgtcacccaggctggagtgtagtggcatgatctcggctcattgcagcctctgcctcccaggttcaagcaattctcctgcctcagcctcctgagtagctgggactacaggggtgcgccaccacacctagctaatttttgtatttttagtagagacggggtttcaccatgttggtcaggctggtctcaactcctgacctcaggtgacccgcctgcctcggcctcccaaaatgaacaatactatttctgtttaaccagggcagggaagttcaaaaatcctgagactgcctgctaacttacttactgttttgcaaaaacacttgtaaattgaaatattctgaattatttatttgtacataagatcaatatttttggtaaaataaattgttgatgtaccttggtctaatacctttcatcccttccagtccctcccttagagtcttattttttccagaactttatttatttattgtaatatatgagcgatttgcatattgctggttttatttcacgtttctctgtctcaccctgttttggattccttcacatatgggagatgttcccccataagtaggaacgtctgttttctgatgtataccatcgaatctgcctgcttttctgaaccttaatcattcagacatcatctcacaggcatctcaaatttaacttgtccatgaatctgctattttcctctcaacctgtttcttctctgcaaatggcaacttctctcatgttgcagagccagaactttgggtgttgtgctcatctccccattctttgtaattgtggttgttgttttgagacagggtctcactctgtcacttaggctggagtgcagtgatgggcccagggctcattgcagtcttaacctccagggttcagctgatcctcccacctcaacctccctggtagctgggactacaggcacaagccagcacacccagctaattttttgtatttattgtagagatgggattttgccatgttgcctagactggtcttgaactcctgacctcaagtgacccacccacctcggtttcccaaaatgttgcaataacaggcatgagccactgcacctggccctcatctccccattcttgccatcagtccctgcctgcctcctgaatatccgtcaagtccagctgcttctcccatctgtattgtcagtgtcctagctgtggaccccagccttgccatttttcagcatatctccgcaattgtcccctaaggaatttttccatcttccctcttgcccttcctcagtcccttttccgtatagcagcctaagtgattctggattgcataaatctagtcatacctgccctgcttcccattctagttgctctcatgggaatgtggaatctgtgcatggcctatcacacgctgaatgcctattggccttttcactgcacccagcaccgttctctcctttgctcatactcagaccatggtgttttcctttcattcctctccataggaatacctggtggtaatcatttgctttttgcaacagtgaaatctctctctgtctctgtctctctctctcttttaattatactttaagttctaacaacgtgcaggtttgttacgtaggtattcatgtgccatgttggtgtgctgcacccattaactcgtcatttacattaggtatatctcctaatgctatccctcccccctccccccaccccatgacaggccctggtgtgtgatgttccccttcctgtgtccaagtgttctcattgttcagttcccacctatgagtgagaacatgcggtgtttggttttttgtccttgggatagtttactgagaatgatggtttccagcttcatccatgtccctacaaaggacatgaactcatcattttttacggctgcatagtattccatggtgtatatgtgccacattttcttaatccagtctatcattgatggacatttgggttggttccaagtctttgctattgtgaatagtgctgcaataaacataacgtgtgcatgtgtctttatagcagcatgatttataatcctttgggtatatatacccagtaatgagatggctgagtcaaatggtatttctagttctagatccttgaagaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttggtttgcatttctctgatggccagtgatgatgagcattttttcatttgtctgttggctgcataaatgtcttcttttgagaagtgtctgttcatgtccttcgcccactttttgatggggttgtttgtttttttcttgtaaatttgtttgagttctttgtagattctggatattagccctttgtcaggtgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgtctatgtcctgaatggtattgcctaggttttcttctagggtttttatggttttaggcctaacatataagtctttaatccatcttgaatgaatttttgtataaggtgtaaggaagggatccagtttcagctttctgcatatggctagccagttttcccagcaccatttattaaatagggaatcctttccccatttcttgtttttgtcaggtttgtcaaagatcagatagttgtagatgtgtggtgttatttctgagggctctgttctgttccattggtccatatgtctgttttggtaccagtaccatgctgctttggttactgtagccttgtagtatagtttgaagtcaggtagcatgatgcctccaggtttgttcttttggcttaggattgtcttggcaatgtgggctcttttttggttccatatgaactttaaagatccaattctgtgaagaaagtcattggtagcttgatggggatggcattgaatctataaattaccttgggcagtatggccattttcacgatattagttcttcctatccatgagcatggaatgttcttccatttgtttgtgtcttttattttgttgagcagtgttttgtagttctgtttgaagagatccttcacatcccttgtaagttggattcctaggtattttattctctttgaagcaattgtgaatgggagttgactcatgatttggctctctgtttgtctgttattggtgtataagaatgcttgtgatttttgcacattgattttgtatcctgagactgctgaaattgcttatcagcttaaggagattttgggctgagatgatagggttttctagatatacaatcatgtcatctgcaaacagggacaatttgacttcctcttttcctaattgaataccctttatttctttctcctgcctgattgccctggccagaacttccaacactatgttgaataggagtggtgagagaggccatccctgtcttgtgccagttttcaaagggaatgcttccagtttttgcccattcagtatgatattggctgtgggtttgtcataaatagctcttattattttgagatacgtcccatcaataccaaatttattgagagtttttagcctgaagggctgttgaattttgtcaaaggccttttctgcatctattgagataatcatgtggtttttgtctttggttctgtttatatgctggattacatttattgatttgcatatgttgaaccagccttgcatcccagggatgaagcccacttgatcatggtggataagctttttgatgtgctgctggatttggtttgccagtattttattgaggatttttgcatcgatgttcatgaggaatattttagggcctctctgtattgcctaggctggagtgcagtggcacaattatagctcactgcagccttgaattcctggattcaagtgatctccctgcctctgactcctgagtagctgggactacagatgtgccaccctacgcggctaatttttaaattttttgtagagatagggtctttgttgtccaggctggtcacaaactcctggcctcaagcagtcctcctccctcagcctcccaaagggctgggattacaggtgtgagctaaattcctccctaatgttaccatagccttagctacttatctttgggtccttctcatctttctgttttccttcccagccaggaaaatctgtgtaagtctcaaatactttcctcttcccggaacaccaaagctgtcatttcctatgcaggtgaacctttctggcaagtgatacctcttttctttttcaaaagcactctagtttgtctctttgtgaaacatgatcaagggattaatttcccatgttttatttagcctgatctctttcaaggagctttttacatttttgcctacctaattgatctttctaagcatcctagcatattgccttcagttgcttttcactttcatctaaacaaaagcaacgccacattttttcaatgatttcttaggtatattgatgtcattagaaatttcatctgccttctactatgtttctcattaaaaaaacttattaaagccctctgaaacatagttattatgtatgggccaagtaaatcattacccacagaacaagcatgaaatagctgtgtagatctcatgggcatgcgctatagaagatctgtgtgtgtgtgtgtgtgtgtgtgtgtgtgtgtgtgtgtgtgtgtacataaagcaatctataatatatatatatgtatatagtgaagaatatgatcgattctgatatatataactttttccatggaatttttgtgtagctaaaggaatagcattaatttgaatttgtgaatgttttctaaacgtcttgaggcagttttgataaattgagaattggcctttataaaatttagatacatagcatctcttgagtcaggaacagaaatgctcaggattttccatatggttgtggatatggtctagtataaaaggatgcataggaaaatgcctgggagggtatacatgttaagctgttatcattggctagcttagagatggaaagtcatattgaaaaggtgtgccctgctcgctcaaacacatgcactagggtacagggtaacctgctgtaacaaagatttctaaatacagtgggataaataagagagacgtttatttacctctcatgtaactgtctggtccatgctgctaggaggcaagtcagcctcatgaggtcattcaaagatacacacacccatcctgatgtgccactccgtttgaattgccaaagctgagtttctgccatgtcaggaaacccacagtaagacgagaagaaaggaagctcaagcaagcaatgagagagtcggaagttgcgtacatcactttagcttaccttcctttgtctaggaattagtttgtcatgcctacctacaagctagatgggaaagtggagtctgtgtctgggtgtcttttgctcagctaaaattctattactatggaaaaatgaaaagcaggttttaggagaaactagcagtctgtcacaataaactgtgtcttaaaaattgtttatatataattatatatatgtaactattgtgatatataatgtgctaatcattaggtaaactattcagtctctctggattgcaattttcttttttttaattttttttttttcttttagagatagggtctctctctgtcacccagatttgggtacagtgatgcagccgtagctcactacaacttcgaactcctgggctcaagtgatcttcctgcctcagcctcccaagtacctgggactataggcacatgccaccattcccagctaattttctgtttttattttttgtagagacagggtcttgctacattgcccaggctgatcttgaactcctggtctcaagtcatctcccaccttgacttcccaaagtgctggaattaaaggtgtgagccactgcacccagcacaattttctcatttgtaaggtcccatttttctctgtagtttacttattctataactagttgcgcagtttcccaagagcaggtaccatattgtgtgctctcattttccttcccatgatatctaatggctgcatgagtaatagtgtagaatacatgttgatgcatatagataggtttgctcagattaaagggctagatagtaaatgttttagactttgtgggacacaaggtttctgttacaactgcttgactctgctgttacaacatgaaaacagtcatatgtaagcaaaccaggctggctgtgttctaataaaactttttttacaaaaataggtaggaggctagatttggccttcaggccatattttgccaaccattgtcttgtaggaaagttacactttccaaatagatacaggtgtaaactcagatttcaggagctccattctttttttttttgttgtttttttgagacagagtctcactctgtcacccaggctggagtacaatggtgcggtctcggctcactacaaccttcacctcccggcttcaagcgggaggcctcagcctcaagagtagctgggattacaggcgcctgccaccacgcctggctaattattgtatttttagtagagacggggtttcaccatgttggccaggctggtctcgaattgctgaccttgtgatcctcctgcctcggcctcccaaagtgctgggattacaggtgtgagccactgtgcctggccaggagctccattcttaacagaaaacagaactagaagttaggtaggtcagtgctgaagcttaggatgcaggaaaacttctgtctgatgttttattaattacattttgtctcatgctctttgtatattcccatataacaggatagtaatgttcttttttgagagcccagcattgcattaagcattatatcatttatacctgataacaatcatgcataataggttctattattgttaatttacaaatgaggaaactaaagctttgagaggttaactaacttacctaaggtaagggatagacctggtatttgaacttgactatctgattctttgcttactttatggttattgttgcaaaagtggggattctgtgagacttgaatagtaaaatcagaatcatacttcgtaggtttcttatgcagcatgatggtacagattagaaccatacaagagtggactaaagtaataggaaggaatgaacaaacctctgtttactttgacttcagctgtcatgctgcagtcacctgctcttcttgtggaagcctgatgtaatttctgccttccctggatgtaacatgcttcctcccacttgctttcattcctgtgtaacatctttgtaatctggatgaccaagattagatacttcattcttcacaaaaccttcctgcatcctagaactctcccaatactattagtatcctcttgtggcagttacctattttgatattacagttgacctttgaacaacactggtttgaactgtgcaggtccatttatcttggattttttttcaataaatatatcctaaaattatttgaagatttgtgacaatttgaaaaagctttcagacaaactctatagcctcgaagtaccaaagaaagaaaaaggtatgtcatgaatacataaaatatatagagatactagtctgtttcatcatttgctattataaaatttacacaaatctattataaaagttaacatttatcaaaacttacacaaacagagaccatacctggtgccattcaaagcagagagaaatgtacacaaacagtaaagacgcagcatgaaatcataaccacattaagattcactgtagtacatactgtactactgtatagtttcatagccacctactgttgctattgcagtgagttcaagtgttgcgagtatctgcttaaaacaccatgtgatgctgatcaccgctgtgtgatcagttctctctccagtaaattgcatatggcagtaaaaagtcattgcttatggttctggaatatttttcatcatgtttagtgcaaaccataaactttgaataacaggacagaatccatacaaagtgctactagtaatgctggaggtcctcccaagaagcagagaaaagtcatgacattacgagaaaaagttgaattacttgataatatatggtagattgaggtctgcagatgtagtttcctgtcatttcaagataaatgaatcccatgtaaggaccattgtaaaaaaaaataaaatgaaatttatgaagcatttgctgcagctacaccagcaggtgtgaaaatcttgcacttttttgtgaaacacctttcatttcatattgaagatgcagcttttatgtgggtacaggattactataagaaaggcattcccatagactcgaatatgactgtctatgggaaaagtgaagttgttatatgacaacttaaagcaaaaggaaggtggaaggatataaagctggagaatgtattgccaaccaaggatggtttgataattttagaaagagatttggctttaaaatgtgaagacaaaatgtgaaggggaagctgtttctgccaactaagaggcagcattaagacaccattaagaaaatcattgaagagaaaggatatctgctgaacaggtttttaatgcagacgcaagtgccttattctgagggggaaaaaaaagccacaaggaacatttcttagtagggaaaagaagcaagcatgaggagttaagacagggaggaataggctaactctgtctgttgttctgtgcaaatgcaatcaggtttatgatctgcacttatctgtgaagctgctcatctcctagccttgaaggaaaatgataagcaccggctgccagtcttctggttgtacaacaagaaggcttggacaatgagaaccctttttctggattgactccattgatgctttgtccctaaagtctggaagtactttgccagtaaggggctgtcttctaaagttcttttgatatggacagagccccagccacccagaacacatgtgtttaacatcgaaggtgtcgaagtggcctgcttctccccaaacccaacaagtctaattcagtctctagctcagagtactgtaaggtcctttcaggctcattatacacagagctgtatggaaacgatcgttgacactgtggaagagaaaaagtctggaaagattacaccactgaagatgcattgttgtcatataaaaagctgtgaaagccatcaagcccaaaatttgtgctggagaaaactttgtctggatgttgtgcatgacttcacaggatttatgaaagaggcaaccaaggaaatcatgaaagagattgtggatttgacataaaaggtggagtgggggttgaagggttttaaggtacggatcttagaggaatccaagagcggatagacaccacacccgaggaattaacagaggatgacttgatgtagataaatgcttctgaattggtgccagaggatgaagaagaagacatagaagaagcagtgccagaaaacaggatcacatcagacaatgcggcagaaggattctgattattcaagactgctattgacttattttacgacatggacccttctgtgatactggcagtaaaactaaaacagtggaagaaggattgaaatcatatagaaacatttttagagaaatgaaaaagcaaaaaaggcagacaaaaattacaaagtatattcataaagttatacagagtgtgccgcctctcctgcctccccttccacctcctccacctctcctgcctctgcaacccctgagacagcaagaccagcccctcctcttcctccttctcctcagtctactcaacctgaagaggaggaggaagactgttatgatgatccacttccacttgatgaatagtaaatgtattttctcttatgatttgcttcataacattttctttagctttattgcaagactgcagtatttaatatatataatatataaaacttgtaattgactatgttttcagcaagggtttcagtcaacagtatgttattagtatttacttttttgtagcatcaaaagttatatatggatttctgtctgtgcaggaggcacccctaatcctcatgttattcagtcatcacctgtgctttgaaattgtcattgtgtactaggctcaatttttttctactagattacatgcatctttaaaaaaatgacttattgaggtatacttgacataataaatttctgatatttaaagtattcaatttcatgagttttgacatacgtatacacctgtgaaaccattaccacagccatggtgttgaacacttctttcacctctggaagtttccttatggtctttgacatttaccctccctctacccctttcccagtgtaaccacatgatctgctttctgtcactgtaggctcgtttgcatgtcctaaaattttatattaatggaattatacattattatgcattatttttggtcttgcttttttaactcagcataattatttttaggtttatccttgttatttaatgtgttattgactctgtgtgtgtatgtggaatagaattccattgtatggacaagcccagttttgttaattcatttgcctcttaatggagatttaaattgtttccaggttttgattatagtaaataaagctgctattaacctttgtatgtaagtctttgtatagacatatgtttttatttaacttgacttaatacgtaggagtgagttgtctgaatcagtgaatatatgtttaacttttccagaaactgccaaactgttccaaagtgtgtgtatcattttatattgccaccacagtgtgacaattcttgttccatatcctgactagcacttgctattatctgtcttttcactttggccatgtaaatcggtatattgacggcatctcattgtgtttctttaacaataatgatgttgaacaatttttcctatgcttagtggacattttgactgtgtttttttacttggtgtgttttttgtcttataattgtgttgtaagtgttctttatatgttggtagatacaactcccttgttcaatatatgtattgtgggccagacacggtggcttatgcctataatcctagtactttgggaggccaaggtgggtggatcacttgagcccaggagttcgagaccagcctgggcaacagcaaaaacgtgtctctacaaaaaatataaaaattagctgggtggccgggtgcagtggctcacgcctgtaatcctagcacttcgggaggccgaggcgggcagatcacgaggtcaggagatcgagaccaacctggccaacatgatgaaaccccgtctctagtaaaaatacaaaaattagctgggtgtggtggcgtgttcctgtaatcccagctacttaggagactgaggcaggagaatcgcttgaacctaggagacagaggttgcagtgagccgaggttgcaccactgcactctgacctgggcgatagagtgagaccctgtctcaaaaaatatataataataataataataataataataataataatgatgataataataatatattttatgtgaatatcttctctcaggctgtagtttgttattttattttcttagttgcctcttttgaggagcagacttaaattttgatgaagtacagtttgtcaatatttttatagttcatggtttctatgtactaagaatccgttgcctaccttaaggtaacagattttttcctccatattttctactgtagttatgaaaataggtttgtgattcatttggagttaattttttgtctatgttgttaggtgttagcgttgaggttaattttttttttttttttttttttgagatgttgtctagctccgtcgctgaggtgggagtgcagtggtgtgatcttggctcactgcaacctccacctcccaggttcaagcgattctcctgcctcagcctcccaagtagcggggattacaggtgcctgccaccacgcccagctaatttttgtatttttagtagagatggggtttcactgtgttggccaggctggtctcgaactccttacctcatgatctgcctgcctcggcctcccaaagtgctggaattacaagtgtgagccaccgcgcctggacttttttttttttttttttggtccaaatggttagctgtttgttctagtaccatttattgaaacgacatttattaggttggtgtaaacataattgcggtttttgcattgctgaaatttgctgtttgatattggaatacattcttaaataaatatggttatgttatacatcattttaatgtacatttctcgctttgtttttttgctaatgacttactactggctgtttaatttatatttagagtatggaaatgatgttagacaaaaagcaaatctgagcaattttcttatttgagtttaaaatgggatgtaaagcagcagagacaacttgcaacatcagcagcgcgtttggcccaggaactgctaatgaacgtaccgtgcagtgatggttcaagaagttttgcaaaggagatgagaaccttgaggatgaggagcttagtggccggccttcagaagttgataacaaccaattgagagcagtcatcgaagctgatccttttaaagctacatgagaagttgctgaagaactcagcgtcaaccattctacagtcgtttggcatttgaagcaaattggaaggatgaaaaagctccatgagtgggtgcctcatgagctgactgaaaataaaaaatattatcattttgaagtgttgtcttttcctgttctacaagacaatgaaccatttcttggattgtgatgtgtgatgaaaagtggattttatatgacaaccagcgatgatcagctcaatggctggaccaagaagaagctccaaagcacttcccaaagccaaacttgcaccaaaaaaaggtcatggtcactgtttagtggtctgttgctggtctgatccactacaggtttctgaatcctggtgaaaccattacatctgagaagtatgctcagcaaatcgatgggatacaccaaaaactgcaatgcttgcagctggcgttggtcaacgagaaatgtccaatttttctccataacaacacccaactgcacgtcacataaccaatgcttaaaatttgaatgagttgggctatgaagttttgcctcatccggcatattcacctgacctctcgccaaccaaccaccacttcaagcatctcaacaactttttgcggggaaaacacttccacaaccagcaggatgcaaaaaatgctctccaagagttcgtcaaatcccgaagcatggatttttatgctacaggaataaacaaacttatttctcattgagaaaaaggagctgatgtaatggtccctattttgattaataaagatgtgtttgagcctagttttaatgatttaaaattcacggcccaaaaccacaattacttttgcaccaccctaatacagcccgttgacttgacttggcaataccaagcttcttaaatttatatttagtgttttattgataccacaagttcagatattttttgttgttaatagaattcaaggaaataagtaatcttgaatggtttctgctaggtcatagaacagtgatgataaatttctccagattatcagaattcaatttttcactgattcattgttcttcaatttgatatcattttacttttaggtgttacacataatattgcattacttcgagaggtgataatcaactcacgctttgtaaaaggagacatcagcactaaatttctctccgatgtgtatcctgatggcttcaaaggtttgtatgcattaaaatattttagtgttttaaagttgttatttttatactttattgtaatacataatttcactctattttgaaattaaggccttttggcttatattatacttcatttttagaacatgcaagactgtttacattcatgattttgagtatttatggatgactcatgagtgtgataatctgcagtcttgtggagtgcagaattcaaccatgtgaattgttctatgagtccagtgttttggagcaaaacatgtagatagatcattagcctacctgacttcctggtttctgaaaatcaaatcagatttgtattttctactgaggtgagtatataaggaactcttctaaagtgatttttaagagatatattaatgaaaatagcactgaaaatttcagaaaaccagattctggtcctattaatgaaaatctaggaagatgatgattttattctgaaaaatgaagttttcaataaagtaatgagtggaatgtgaaatttaacacagcaaagttatcagcaagcatttccaggtagtagaaaaattgctcatcaaatgggagatagagaaaaccctttagtgagcattcaaaacatagttaacataagatattgagagataaacaagatttagactgagacttaatagaaatgttactcaggtgaaagcctctacctacatttttaatgagctagtgaggtatgaaggttagatagtctgtcccatatttcaagtgttctttgtatccattaaagtgttttaatgtaaaatgactcacattcatattaggagctatatatagattcaggtcaagttgatgtcgttgagttgttgggtgcatttataaagcagttttcagttcagaatttacaatacagagttttcataagactcaacagagataactgatttgaatattgttttaaaactttagtgttatagagttttatcattagtattaaggcaaatgaagaatggctctaagttgggatcttaaaacaaaaactaatgatttattaggttgtttttcataaacttttgaatttttaaaaatacaaaataaaatacaactaggatagtagttttatacttttgtgactattcttttaatatttgttggtttaatgaggctaagaaccccttacgtcattgcttttcattttatccctagcacaaaacatagtaggtactaagtatttgttgaattaatgaaaaaaaaaaaatcttagccataatattgatgagaaaggattactttggatttttttttttttttttttttttgagacagagttttgctcttttgcccaggctggagtgtagtggcacagtcttggcttactgcaactctgccttccggtttcaagcgattctcctgccgcagcgtcccaagtagttgggattacaggcatgtgccactacccccagctaatttttatatttttagtagaaacggggtttcaccatgttggccaggcttgaactcgaactcttgacctcgtgatctgcccgcctcggcctcccaaagcgctgggattacaggcgtgagctaccgtacctggccgctactttggatatttttaatcatttatacatgtatccagataaccagttcattctattttgatcctaacatttagtttcttgtccttcctaaaattttaattaaaagttgtagtacgttttgaagtggacttaggacttccatgtttttatgtctgcctggcaattcagtgatggtgataagataggaaacagtgggcagaaggagaaaacagggaaaaactacagagaacctttagaacaaacattatatgcatgtatgggtatttatatatatatacacacacacaaatacacatttatatataagtttgtctatatgtatgtatggtgaagtatcccagagaagaagaaaatggggcatttaaattttctaatcagagttgattagtatgtgctggacgtttagcaacaatagagaatatcccaaattctgtagagaagggatccccttcaaactcagaaatgtacttaaacctagatattgcagttttctgtgatgcatataatatattacatttctttttttgtaaggaattaacagcttggacaccacaattttgttttttatgcttagaccaatttttaaaattggcatacattgcttttagcaattatttagttgcagccttcattttacatgtgaggaaactagagctcagagatatcagtaaagctaaatgaccagtaagataataatgccaggaattgaacctaggcttattcaactcctatttgagtagtctttgagttatgctggggttcaaattcataaatcacaaatgttttcaatcagggtatgctacatgttgttatattgcctctaaatactttagaaacacactcctatatttgccattcttaatgtctccctcttgttttattttcttattttcatatcagttcattcttctttgagtggttactgtctgtcattcttcttcagattgctgtattttccccctaaatcaggtcttagatattttaaactgtatcgtcttttgactgtttgatatatgtgcccaagagactgaaggaagtggtaactacagttaatccaggatcctctccatatgtttggggccaggtcattttgcccctttggggtttcccatctgcttcccatctgttcagctatcctaggcactattcacaggcaagcacctatttttatgactgcattaaaattttctattgtatatgtttattatcccacatttatttgtatgtagactaagccagttttactagagattcttagagttaaactttgaaatgattgcttctaaaattaaaaaataggatacatgagaaattattcttgtcatctctttagatgtggatgttgaaaagcggtttcccttgattctgaaaaataaatggaacatgaggaagaagatattttaagaactataatttcatttggcctataatgaacattttgggcttatttctctgataccttcctatacttcaaccccaagccccatcgaaagaaattgtcagaattatctcattcttttaagaagttacagatcttctggtaaaaatttcactcaacacaaaaagtatataattaattatacttctcttttttccactgaatttagtcaagtatatctacactttaaaaaatactactatgatatttggactgaattcaatcattaaagtcattcaacaaataattgatataggctctagaagaaaatcaaagatgggtatattttacctgctcttagtgagctgacatcatgagagaaataataatgtaaagtacccactatactacaggacaggataaagtaagtgcctggtaaagatgtaagcaaagtatcttgacagaagagaaacaaaacaaaacaacaacaacaacaaaacaccggaaacccagttccatttgagggaataaagaaaggctttaaggatgaggtagcatttagactattggaatacctctccggggactctctccatgggagctgggctgcacttgtgagagccatgtgtgcacatctttataagccatcctctttgaagttggtagtttgtaatcagccatgaagaaagtatttactgtaaagaaattggttgtaccctgcggcttttctccttcccccacaccccagttgtttgttaagcatttaccagcaaaccactgcctaactctttggcctgcatattgagcagagtccctgatgtaaaaaggaaaagaattactcatctagggaggaagacctagaagactcactaaggacaggtggtgctcagttttagagctgctgttgtaggaggcagatgactgtgcttactgaaaaatgggaagaacacttaaaaatactgaattagaggagaaagacttaatgaactaaaaaactgtgatttttctaaataaaacaattcagcagtcaatgtggaaggtaggatggtcactactaagatccaaattagtgactcaaaggaataaatggaagtatctcaaaatatgcagcaaaaaggtaaagagaatgaaatcatgtggaaaatgatgagagatatggagggaagatccaaaagattttacacataagtgcatactaggagtttcatgaaaagaaaaatggaaatgaaggataactttgaaagaaataatagagatttttttctcactgttcttaagaaagccttaggtattcttggaaagactcactgagattcagactggattaatttaaaaagtaactccactaggcatataaaaaacaaatacttttttaaatcttctaaaagaaaagaaagaagatgcaaggaatgtacagtgagattatgttcatactctataaactggaagttagaaatcttagaatagtgtctgctacataggaaagaatttgactcaagagtactatacccagctaagatatcgtcatcaatataaacaaatttgttttcagttaaataaggattcagaactattttaccatatatactccttttgaggaaattgctaaagaaagtactttaaccagtttttaggtaagatgatagcttaaaaatatacatatttttccccctacccccaaatccactaacttgagttttttaaagacacaagcccactaggaagaagaaaggaaatagcatttggtaaaatgaacagctgaaagatgattcttaactgacttagtaacctaagaaagttgaatcctaagctgacaatgagagaaactgagaagtagctcattaccactgcagaacccttcagaagtctcaataattattagctccagataccctgggaaattcctaaaggtagcactactgacctaaaatatctgtaaaattttctccatatcacttccctcactcttcagagtaaggcgactctctttccctcatcctggtgtaagctttcagattcttctctgcagaggataaaaaccaggggacaccaggcacagttggacaaaggatcgagggaacatggacataataaatgtggtgacactctctgccccagctttgttcctcagttggttcccaggggactggcaggcagactggtactcacagacatgaaagtagacgatccttgaaaaatctaaccccctggtgagatgacctaaagattccccaacaaaacagtccagccagattaccctacagacaaagctgccagtggtcaacaaagccatagcccacgaagagagaacgggcctggattagaatcaggacctctatctgcattatttaatacaacactgtggccgggcacggtggctcatgcctgtaatcccagcactctgggaggccgagtggggcggatcgcctgaagtcaggagtttgagaccagcctgactaatgtggagaaaccccgtctctactaaaaatacaaaattagccgggcatggtggcatgtgcatgtaatcccagctattcaggaggctgaggcaggagaatcacttgaacccaggaggtaaaggttgtggtgagccgagatggtgccactgccctccagcctgggcagcaagagcaaaactctgtctcaagaaacaaaaacaaacaaacacacacccaaaaaacagaaaacactacatgtaatgggaaccagcgcgtagctgttaaaaataaatggtagacctaaaaccactcgggaaatacacaggtcaggcttcttgaaaactgcatcatgccaatgagggtggccagtagcatgagggtcatagtggcatgtcacaaagcttgtaggtgctgttacatggttttgaactccagtaattagtggcttaatgaacaaggagaggagataataaacattgtttaggggttgggacttttgcatgaaattatccccccaaaagtttaagaaggtaagagttagttgtgaggaggaaggtttttcttctttcagtcacaaatacttatagagcctgttgggtaaaagattgtgctctaggctctgggaatacagaggtaaaactgtcaaaaagcctaaggcttttagaaccaagagttgcagctttttccagccatgtcttcactgaagagcccactgtgcccagcctcgttgacttcgcagtagaggctctaagcttgaatgttgtgaacgttccaaggctgggtttaagaaagccttagaactccatctagacctgtaacaagtacaagtgacttgctcctctgaagagtgcttgaggctgcatgtgtcctgcatgtgaggctggagctctcagtccttctgcctcctcaccacctgtattccacatgcacccagcagcacctctcagtcttctctgtcggggttgggggagagggtaaaccaagtgtcagattacagcactcttggtttacgttcacactcgctaaaaggggtaggaagaattggagagcttttaaaatacttaccgcgcccccaagttttaggtgtgtaggattcatcagtaaacagaaaaaggagctgccctcatgggacttacattccagcaggttagcaggcagcatgcattcccagctcccctcatggcagccaggcagggtttacacattagaagctgctcagaaaagggaatgaggtacattcaccttagcttactagcccagaatgcagtgtcagtgtgtctgactcaacaccaagctggtctaccacccccagagggcaaacagtggagaccgttcaaagggagctcaaggtcagagccagggaagacatgccttacttagtatcaggccgcaggggaacttgcagaagtcaagtccactctggcctgtgatcaggagtagcattatgctaaaatcgttgtaagaataggtcagttatgatcagacttcttatacagagcctgttggaactgagtaccccccttttgaagtggaatatcagtaaaatgcttgaagttgatgtgcatcatatcagtttgcctgggagatgtgatgaatgatggtccattttatttgggagacctctctcaatattgcctgagtccatgcactaatagttggttagaccagatgaaatactgattgagcatcttgcagtgaatgggttcccctaatgcattgcctcctcccttgctgatggtatatacggtgcatatgtgtctaaagaactgacttgtaaaggactttgattgtgaaccaccatgagaaatacattttacatcctgacatagtatgcacatataaacacacacaacattttcatgtaaaatactgtgtttaaagtgctatgataatttgtcttcctgcacatgacacattaaactggcttcatgaactactaaacagtttctttacacagtttgataaatatcagtccagaacagttgtattcaaagtgagatctgctgactggcagcatcggcatcaccctggagcttgttagaaatgcagattattaccccttgccctcataccttctaccagtcagtctgctggtgaagtgcacacagcatctttaatccaggtgattctgatgtttggtgaagtttgagaagcactggttctttttacactccagagagcttttgtgattatatatattgatatttaccacattataaattaaaactgaggaacttgaaaatatttattcattcattctgaaagtaatggtaataaatccattacgtgttgacatgcatgagagcagtgatgtcatcacacaatatgtgtcccttggatctgggaacctctgcagtatactcttgagaaaatgagagttaaaaaagcaaatatattttagtagtactatgaaaatcatttgaccttgcaaggactcctggggactcccagttgttggcaggtcatgctatgagaactgttcttctcaactgtatgttttgacaagactgagagcaaatttttgtaatacttcttatatagagtaattatgtaatcatatgggatgttttcatcactgcttaggtgtcaggggaaaatgaggaactttccaatgcccataagagtatggtttattaggctgttgtgaggatctagtatggaattcccagaaccagttggtagatcccatatttgtattatgttttatgtaatgtctaggtttgtctcaaaagagggtggattacctgtgctctccctgcccttcagggagcagatagattacttccctgtggaaaattgtgctgtagatattggaagtatttgtatcttaattttgaatatttttagtcttatttgtattttgagtgattttttagacataatgtttaaattacttcatttcttccaaataagtttaggcaactagtttttttctttttttgaattgtacatttgtttcttggtatctgtgggtgattggttctaggaccctttcaggtacaaaaatccacagaagctcaattccccagtgtcgtatttacatataacttagacatatcctccctgcactttaaatcatctctaggttacttataatgcgtagtacaatgtaaatgctgtgtaaatcattgttatactgcattgctttgaggaaaatgacaagaaaaaaaagcctgtacatgttcagtacagacaacaatacattttttttctcaaatattttcaacctgcagttgtttgaatccatggagggtcgactgtaaaagtagcaccttatggctgacgagccagcattcaagttgctcatactgtcccatttaatactctactatctatatgtagtactctggtaaataaatagttttagatttgtggtgaagttacagagctgtcaaaggatgtgttaacctatagaccctggagtatttgaatcctaccttgactcacaaccttcttgaagaattacgcaaattcttcaatcagtcactcaccccaggcctttgcggccagccgactatcccaggtccagctgtgtaatggtaggaagatactgtgagtgagaggaggagagagattggttggttgattgggattcatgcagagaagcagaagaatcacggcgtgatattctttggatcttcgcaccagaaagcatggcctcatctgtgtccttgaccagccgctctccttttctccagggacaggggcttcttgcacgctatcctcacttccctcagcagggaagctgggctgggaaaggacagagagaagcagatgtgaggagcttatgcttttcctggagatctctgtgtggatggttttttctttttaattgtctttgttctgtgcatctgttgaatatcttctttcccaaattaaacttctttcccaatataaacttcccgtgagcaggattttgttgtcttatttgaatggtcttgcttcctcaatgtccgcacaccccagtgcctagtacaatcctagctgcataatagatgccctataaaatacttgtttgaatgactagtaattctataggagagaagcacagatgttaaaataaatgattgattgattgattggttgattgatttccctcaggacacatgctaaccaagagtgagaagaaccagttattggcaatagcatcatcattgtttgtggcattccagttaagagcacaacattttcaagaaaattcaaggtatggtagatcatttaaaacagaataaatgagcagaacaatattgataatccagtctacataggaaatactaataaaagatgtggctgatctcagttctagagatcttatgggtctttggagaagtataataaagtcacactgtataaatatgatattgcttacattttgtttaaacaagtttttttaagttcagaaaggataaaaggatcttggcccttttaatttggacataagaagatagtctgaaatccgatgggaaatccattcgagtagtttgtgtttatgatttctgttttatttacttatcttgaaaaacgtttggagaagtatatttaaatgtaggaatgaatctgggcagttaaaaaaatatatatcagaaactagtgaacacacaagaaggaattaacaccaggttgagttagtcatttgtgagacacaagtgtgccttttagcttcctagtgacccaggtaaaaggagaacatgctttatatcagggtaagtagaaacaaaacctcaatgccattggtgcttctagagagaggattgtttattatgaatgtgtgtttacttgctggagcaatccctttaaaggaatcatgctgttgataaattgttacttcagtttcttttcctttttactttttcacaagaggaagaacaaagtttaaaaaaaagaaaaaaaaagatggaaggtgatgaactagctttgaaaagcacaaatcagaaactgaaattacttctgaagaattaggtagaggagaaactaaattggatttaggctgtatcttagtggctaatgtggttttattcaggaaatctcagtgtagttggtactcttcacttgttctctttacctagaaagaataggaagcttacagtgtatctttttaaaagttatgatttggtagctaccagggagagatgagaagatatagaatatcagtaaatgactgaatgactggacggaggaggaaaatggtcaatagaaccgtgaatctgcttgtgcatctgtttaatatcttctttcccaaattaaacttctttcccaatataaacttcctgtgagcaggattttgttgtcttatttgaatggtctttgctcccccgatgtctgtacacctcagtgcttgttgtttggttgtttcccccccacatagttgtgcggtctagtatgggaggcactagccatgtatggcaattaagattaaagtgaatggaagaatccttttcaaagttaccggaaacgtggctacatttcaactgttccatagccacgcgtggttagcagctcctgcactgggcaactctaagaggctttccaccacagcaggtgtgtttccatcaagttctgttggacagcatttgtctggagggatatgtgtgtaggagagaatgttgcttttgttttaaaacctgaatttcatattttttattcttttgataaatgcagtattcagatcctaattcctttaccttcagatgttatttggaccttgattatttcagaagttctgagtgtagctaaatatgactggtttgatttttaagaaatgtatgcaagttattttcagagagtgctgccttactgtgtggaagaatctgaaaagggcttaaaaagatggagaataaaaattacctgtaatcccataattattcaataattacttttaatgttttggtagaacccttcaaagtatatatatatatatatatatatatgtatttatgtgtgtgtatatatatgtatttttatatacatacatgtagcatttatactttgcataattagagtcataaacctgggaatatggtttgaattacttgtgcaagataaacagcagtatattgaacacccatgcacacattatctagcttcaatgactgtaaaaaatctatcttccttgtttcatttttacctctacccactccacactttccccatttgttaattttttaaggtaaaatatacaaacacacatatacacttcttacctgtacagtttttgtttttgttttttgagacagagtcttgctctgtcgcccaggctggagtgcagtggtgcgatctcggctcactgcagccttcatctcccgggttcaagcgattctcctgcctcagcctcctgagtagttgggactacaggcatacactaccacatctggctaatttttttttgtattttcagtagagatggggtttcaccatgttggccaggctggtcttgaactcctgacctcaggtgatccacccacctgggcctcccaaagtgctgggattataggcatgagccaccgcgcccagccttacctgtacagttttaacaaagggatgcttgtgtgtaactcagacgactctatctttacatcgtctcttccagtgcactccctgcctccttttgcttgtggtgctacctgcggtgtgatttcttcagattgcttttttggtaaactttttttttttcttttctttttagagagatgaagtcttgcttttgtcgcccaggctgaagtgtagtggcacagtcataactccctgcagccttgaattcctgggctacagcgaccctcctgcctcagtgtccctggtagccaggattacaggaacataccaccacgcctggctaatttctgtattgtttgtaaagatggggtttcaccatgttgtccaggctagtctcgaactcctgggctcaagtgatccagtccaccagccttggcctcccaaagtgctggaattatagacctgagctgggcgaaaccttgtgtctgctaagtacaaaaattagcgggggcgtggtggcgggtgcctgtaatcccagctactagggaggctgaggcaggagaattgcttcaacccaggaggcggaggttgcagtgagccaagaatgcgccactgcactccagcctgggtgaaagagtgtgactccgtctcaaacaaacaaacaaataagctaaacaatctaataaaaaacgggcagtaggtttgacttagactttttatcagagaagataaatgaatggcacataagttcatgataagatgctcagcatcatcggtcagtggagaaacaaaatcacaaatctataccactacacacccactagaataatatgcatcaagtaatgagtgggtaaataaaaagtggcatatccatactatgagcttattcagcagtaacaaagaataaacagctacattcactaatgtgtgtaaatctcagaaataacatgtgaagagacagaaaccagataaagaagactatgtaatgtatgacttcatttatttgaaatttctagggaaggcaaaaagtataaagaacaaaagaaagatcagtggttgtctgggtctgggtatgggagcaagattgactgcacatgagttttattgttctaaaactggattggggtgatgggtgtacaactgtatgaatgtattacaatctcacttgatcttagccaaaaggccgagaagtgatataaatgtattacaatctcatcagactatacaattaagatgtatagatgttattggccaggtgcagtggctcatgcctgtagtcccacactttgggaggccaaggcggactgatcacatgaggccaggagttcgcgaccaacctggccaacatggcgaaaccctgtctgtactaaaaatacaaaaattagccaggcttggtggcgcatgcctgtagtcccatctactcaggaggctgaggcacgagaattgcttgagcctgggaggcataggttgcagtgagccgagatcacgccactgcactccagcccgggtaacagagcgagaccctgtctcaaagtaataaaaagtaaaatgtatagatgttatacaagtaaattatatcttaatgcaacttaaaaaactgtaaatgtggtaccaacaaagggcttgaaagaggtgggaagtattatgagaagtgttaagatgatggaagatacatgtaaaaataaattgtattcgaaacttgagtagaagcagatattaaggagtcaggttactgacttggaagacctggtggatggtggtaataacaaaagtgcaagagcagctttgaaaagaaaatatgagaagttccatttaggcagttgagtttgagatccttgacaggcataattgtagctcctaaagacttagcaatatgatatattcctatccctttgactgtttcttctttaataataatatatatgcccctttgagcccattaggaaatacttggggcatgcttttgtactcattagttccatgatttttttgtaataatcaaatgcacacagttttagacttcaacggtgttccttaatgtgtgctccatagagcgctagtttgggggagtattaaaatgcattacttaagaaaatgtttctgtgtttaaataaacgtggaaaatcccttgttaagttagaaacctcttagagactgtcatacaggcacacctcatttcattgtcctttgctttattgcacttctcagatattgcattttttacggattgaaggtttatggcaaccctgcattgagcaagtctttttgtgctgtttttccaacagcatgtgttcactgtctctgtgtcacattttggtaattctcattacatttcagacttcatcattattatcatatctgttttggtgatctgggattagtgacctttgatgttcccattgtaattgttttggggtgccacaaaccatgcacgtgtaaggtggtgaacttaattgacaaatgtgtgtgttctgattcactgacctggccattcccagtgtctctcactctccttgggtctccctattccctgagataaagtaatattgaagttagactaattaataacaaagcagtggcctctaagtgttcaagtgaaaggaataagtagcacatctttcactgtaaatcaaagggtagaaatgattaagcttagtggagaaggtatattcaaagccgaggcaggctaggcctcttgtgccaaatggttagccaagttgtgaatgcaaaggaaaagttcttgaaggaaattaaaagtgctattccagtgaacacacaaatgataagaaagtgaaacagccttattgctgatatggagaaagttttataggtctggatagaagatcaaaccagccacaacattcacttaagtgaaagcctaatctagagcaaggccctaactctcttcaattctgtgaagggtgagagaggtgaggaagctgcggaagaaaagcttaaagctatcagagcttagttcatgagatttaaggaaagaagctgtctccataacataaaagtggaggggaagctgcaagtgctgatgtagaagcttgcagcaagttatccagaagatctcactagcatcatcgatgaaggtggctacactgaacagcagattttcaatgtagataagacagccttctattgaaagaagatgccatctcatactttcatagctagaggggaaaagtcaatacctggcttcagagcttcaaagaaccagctgactctcttggtaggggctaatgcaactgatgacttgaagtagaagccagtgctcatttaccatttcataaaccctagggtctttaagaattatactaaatctattctccctgtgctctagaaatggaacaacaaagcctggatgacaaaatgtacatttacagcatcatttactgattattttgactccactgttgagacctacttctcaaaaaaaaaaaaatttttttttcaaatgattgctgctcattgacagtgcacctggtcacccaagagctctgatggagaagcacaaggagattaatgttgttttcacgcctgctaacacaacgttcattctgtagctcatggatcagggagtcattttgattttcaagtcttattatttaagaaatacatttcacaaggcgatagctgccataaatagtgattcctatgatggatctggacaaagcaaattgaaaactttctgggaaggattcaccattctagatccccttaagaacatttgtgcttcaatgggcaaaataaaagatcaacattaacaggagtttggaagaactggctttgaggtgttcaagatgtcattgaaggaaatagctacagttggggtggaaatagcaagaaaactagaagtggaacctgaagatgtgactcagttgctgcaatctcgtgatagaacttgaatggatgagagttgcttcttatggatgagcaaagaaattttgcttaaaaagcaaagtttttaagatggactctgcttctggtgaagatgctgtgaacattgttgaaaaggattttagaatattacattaacttagttgataaagcagcggcaagttttgagaggattgactctaattttgaaagaagttctactgtgggaaaaatggtatcaaacagcatcacatgctacagggaaacctttcatgagaggaagaatcaattggtttagcaaactttattgttgtcttattttaagaaactgccgcagcctccccagccttcagcatccatcagcctgatcagtcagcagctaccctctatcagcaaaaagattatgactcactaaaggctcagatgagggttagcatttttttagtaataaagtttttttttttggagatggagtctcgctctgtcgcccaggctggagggcagtggtgtgatcttggttcactgcaacctccgcctcctgtgttcaagcagttctcctgcctcagcctcccaagtagctgggactacaggcacatgccaccacaccccactaatttttttgtattttttagtagagacggggtttcaccgtgttagccaggatggtcacgatctcctgaccttgtgatccgcctgcctcggccatccaaagtgctgggtttacaggtgttagccaccacgccagcctaaactactttttaattaaggtttgtacattgtttttaagagctatcgcacacttaatagactacaacacagtgtaaacgtaacttttatacacattggaaaagtaacaaattcatgtgacttgctttattgaaatacttgcttcattgcagtggtctggaactgatctcacagtatctccaaggtattcctatatactaaaatgcattctgaaactcttaagagcaggatatagttggactcttacctacactctttttttcttgtgaaaacctttttcctaaaagctctttgaaaaattaatattccaatgaatgcttttgggaaacacagagtatgttatattgtgatttgtagtgttttagatagtttaaacacaacattccttagagattgttgaaatatttagggcaattgctttataaagtggaggttaagaagcaatctttatagtctttgctaatttctagctaaaattgtaaatgtgataattgctacattaaaaaatttaagtatcttattttttaactcattatcttttagaagttagaaacaaaatatgtatttatgaaatatgtagactgcaagttcacttatccagataattgcacatttattttctatacaacaagcaattgttcatttttggtgagtttattttctgttgaaaaaaaggtactatcacttatttagtattatcagtttattgtaaaattgctacaccctataacagtgtagagctgtaacatttagtaaatatagtgttcttcttcaggaagcataatcttgtgtagctaagtgaagctatgtttctggcttgcttactgaggaggtccttgacacctacatcatgaaagctgatgtacggtgtttgaaccttcacattttggctttagagtcatgttttcacaatcggcttgggaatggattctaagagtcaccctccaggtgtggctctgtattgctttgtcatgggtgtgtccgtgaaatgtttttccttccaaaccagtagcccacagcccttcctttgtgttgcttgttttggctgctgatcttattttcccaatttctctatgggcttcactctttcatcatttatgacttggaaaaacacattaataatacatacccctagtatttggatagtaaaacaatagtggttcattttagaaaaaaagaaaagttaatgtcagaaacaatagccattttttgggggatgactataaaatgaatttgatgagctcaatctttttctgacttaccatgaaggcttctttttaataattattcttaaacacttatattgacagaaatgaatcattaaaagctagttatattaaacaaccactttttttaaaagctaaaatgattttgttgacattgtagtttgatataataatttgtttcactaactggtaatgattggaagaaaaaatagtaaaggtaacattttaatcatttttagtaatctttatttttgctcaaaatgtctgttttttcttggatctggattcagctttcttgagaatcagcttttactttccgttttttttcctttctttctttctttctttctttctttctttctttctttctttctttctttctttctttcttccttccttccttccttccttccttcctttctttcttttctctctctttttctctttctctcttcctcccttcctccctttcctttctttcttttctttctttccttccttccttccttcctttcttttcttttcttttcttttctttcttttctttcttttctttctttctttcctcagtcttgctctctcatccgggctggagtacagtggtgtgatcttggctcactacagcctctgcccgctgggctcaagcagttctcctgcctcagcctcccaagtagctgggattacaggcatgcaccgccaggcccggctaatttttgtattttttgtttgtttgtttgttttgagacggagttttgctcttgttgcccaggctggagtgcgatggcgcaatctcagctcaccgcaacctccacctcccaggttcaagcagttctcctgcctcagcctcccaagtagctgggattacaggcgtgcaccaccatgcctggctaattttttttgtagttttagcagagactgggtttctccatgttggtcaggctggtctcgaactcctgacctcagataatccacccacctcggcctcccaaagtgctgggattacaggcgtgagccaccgtgcctggcctaatttttgtatttttcgtagagactgggttttgccctgctggccaggctggtctcaaaatcccaacctcaggtcatccacctgctttggcctcccaaagtgctgggattacaggcatgagccaccacgcccggccactttctggtttctactttatcctcataatttccctcttggtatttgagcaggggttaaagactcagaaaaagaaacaacttcactatggcctataatattaatggaaatacttcagcctgaaaggttaaaataaagcactccctttggtggaggatgactttggctgcatggaatcagtgtactttgtgctcaggcttaggagaacatatcaagtatcacggctggctacacagcctggtgtcagtttaactctttcagccacagtagcataacgggaaattacttcctcttgggttctttgtatgtgcagtcattgtgtctgcatttgtattgtattatctttcctcatctggcttcctgataaaatggagaatcgattttttagtgatttctgcctagcagagacaattatctgtttatttttctttgcctttcctggtttcagatatagaatttattcacctgttattaaattttcaattagatgataaaagtttaaggtttttgaaatatgatcttaaccactgaaagatgagtggggtgagaaacatagaaaaaagtaaccgtgtgaaaataattcccaaggaaaagccggtattgttgaacgggtacatactggctcttttactaagatgtcttctgaattaaaagagcatgtgaaattataacacatttatacgtcaatgaaaataaaacaacttatcataactcgtttcatactctcagataagccacttcactgtgacaatgaaggtgacgtgatacctaactatacaataaaaaaaaatagcactttaagtatatatttacaaacgtatgtatacactctttgtgtttggaaatagctacgttcatttgagcaaataaatcccctaaaagcaacaagatgggagaaaacattaactcaatcattatcacttaagcttgccttactttttactgtctctgttatgatattttcagttacttaatatgactgtgttgaagatggtttagaaatctatgtgagattaagtacaagatactaagtggataagaaagcacatttacatatttttgcttactattacattgtaaaatatttttattttgatcctactataagagctgagggaaaggcagaatagcctgattattgctggagaatttctctgttccctaccatgattccagaagctcttgcacacttcatcagtattattgtaattctttggctgcaggatatttggcagctgttgcaccccactggcaaatcctattcatacttctttcccattcaccattgccattggagaattgatttctctctcctctactctaacctttcccaattcattttggattgttcaatgtgaaacattttaatttcatatcatacagctattcagcttacaatcccttttttaacctgtcaccagggtaacagcatagcatgctttctttaggcaatcaagtttttatttcacatgcttaatgttgcattaaatgtttgcattttgtttaacccccttaaatagtttgaactctggatatgttttatagggtaatgaaatccttgatttttgaattgaaactaaatcaacaccatcagtgcatttataataaaatgtcaaaagattaatttccataatacaaagattattattaaaaacgcaagttagctgatctgtgtaaggcaattttctgtaggtaatggaggaatatttgtatatattatatttgtgttcagccttgttccaaaaaaagatttaaaagtggtttagagattgtcagtgagataagtaaaaaacttaaaaaaggaatagatttggtgcaaatgggaaaatatatcttttgaacccattatttgatttttcagtataatgcttttttctctgttcgtatatatgaagatttgattacttgatttttcagtataatgcttttttctctgtttgtatatatgaagatgtgattacttgatttttcagtataatgcttttttctatatttgtatatatgaagaccataatgatttatgcatgtggagatgggtgaagtaacgagatgtactagaatgagattagacatcttttctaggagaccagtgtgggcattgtgtgctttaatatctcttcatcagtttactttagaactaccttttccttaaaataagtaatttaataataatagattagtgaagataaaaatgcatatgtttagatattgattatttgacttgaattggatagacctcagtttccctttacagaactacctagtcatcttttcagccttatccccaataatatgttcaatgaaatttgttctgtgaataaatcctgtgatatttggaaaatactaagaaatgtgtaagacaaggtagagcagagactagcaaaccatgttgcttggaagcatggttcaaattgtaatgcccggggtaaccactaagaaaataactttaaaaaatagtattagtaaaagaaaagtcaagggaattaaaataagacaatagaaaacgttgatttaaaacaagacaataataaaggaatagagggagaaaaaagatatgacatatagaaagtaaaaagcaaaatggtagatgtaaatcctacctgatgggtaattaattatattaaatgcagatggcttaagcctatcaagagcagatactgacagaatagatttaaaaatatgatcaaaccatatgctttacaagagacacactttagagttaaaggcataaataggtcaattgtaaaaggatggaaaaaagtatcagacagacattgtattcgtaatattattatcagtattttattactaataatgctgatgtcaaacaaaatagccttttttttttttttttgagatagggtcttgctctatcacccagtctggagtgcagtggcatcacaggtcactgcaagtttgaactcctgggctcaggtgattctcctgcctcagcctcctgagtagctggtactagagtgcatgccctaacatttggctatatatatatttttaaatagagatgaggtcttgctatgttacccaggcaagtctcgaactcctgggctcaagtgatcctcccacctcagcctcctgaagtgctgggattataggcatgagtcaacacacccagcctttttttgtattttttttttcttccagagacagggtcttgctctgtcacccaggctagaatacagtggtgtgattatagctcattgctgcctctaattcctgagctcatgtgatccttctgccttagcctcccaaggaactaggactacagatgtactccaccatgcccagctaatttttaaaaatctctttagaggtaggtttttcctatattgcccaggctggtcttgaactcctgacctcaaatgcctggactcaagtaatccttacgcctcagccttccaagtagctgggattacaggcatgagctgccaagacaaaatattgttcaagacaaaattattgctagagacagaggggtattttataatgataaaagggtcaatccatcagaaagctataacaagtataaacatatatgtacctaataacacaattcccaaatatgtgaagcaaaactgagacaaagagagaaataggcaattccacaatacatcactttgaaaaatggatagaacaactagagagaatatcagcaaggaagtaaaagtgtcggacagccctatagaccaaatagatctaacagacatctctagaataatctctccaacaacagcagaatatacctgtctcaagtgcacgtataacattctccaggctagaccatatttaccataccatatactaggccataaaacaagcctcagtaaatttactagaattgaaatcatccaaagtatgtttctgacaaattaaatgaaattagaaagcaacaaggaaaatttgggaagttcatacatatgtggaattaagcaatgtactaccaaataaccaatagatttacaaaattacagaggaaactagaaaatattttgtggttaatataaacatcacaacatctaaaaacgtgtgggctgcacataagcagtgcttagagggaaatgagagctgtaagcacatgtattaaaaaaagaagaggccaggcaaagtggcttacatttgtaatcctagcactttgggaggctgagacgagcagattgtttgagcccactagttcgagaccagcctgggcaacatggtgaaaccctatctctataaaaaatacaagaatatgctgcgcatggtggcacgtgcctatagtccttgctacttgggaggctgaggttggggaattgtttgagcccgggaggcggaagttgcagtgagccaagatcgtactactgtactcctgcctgggtggcaaagtgagaccctatctcaaaataaaagaagaaataaagctgggtgtgggtttggtggctaacgcctgtaatcccaattctttgggagattgagactggaggatcacttcagcctagaagtttgagaccccatctctacaaataataataataataataataataataataataataataataataaaataattcgctgggtgtggtggcacacacttgtaatcccagctactaagaaggctgaggtgggaggatcggttgagcccaggaagtcagggctgtagcagtgagccaagatcatgccactgcactccagcctggctgacagagtgagaccctgttgaaagaaagaaggagagagagagagagagaaagaaagggagaaagaaagaaagagagggggcggtgggaggagggagggagggagggagggaaggaaggcagtcaggcaggcagggaagggagggagggagggagagaaggaaaggaaggatcaattaccttatcttccacttcaggaaacatggaaaaatagagcaaacaaaagcagagggaataaaatactgaaaactagagtacaaataaatgaaatagatactagaaagcaatagaggaaatcaataaaagcaaaatgtgtttgttggaaagatcacagaaatgacaaacctgtagataggctgaccaaaagaaaaaaaactgaaattgtaaaatcatgaataatagggggtatgcctactgaccttacagaaattaaaatggtcataagggaatattgtgaacaattgtttaccaataaacaagataacttagataaaatggagaaattcatagaaagatacagactgccaacactttctcaagagaaagtaggaaatccgaatagacttatcataagtaaagagatggaactaatcgttgcaaaacttcttagaaagaactcaggaccagatgacttcattggttaaaaaagttaaaggaaaattacttaatactaatcctcacaaactcttccaaaatcccaatttacaagaccaatatcatcatgattccaaaaccagataaagtcattgcaagacaaaaactaaaggctgatatccttcttaagtattaatgcaaaaattcccaaccaaatagtggcaaactgaatccaagaatatatacagtgatatacatcataaccaaatgaggtttctcctagagatacaaagttggtttaacatacaaaagtcaatcgatgtgatacatcatattaatagaataagagaaaaaaaccacaggattatctcaaatgcaaaaaaaaaatctgacaaaatccaacagcttttcattatgaaaaacactcagcctactcggaatagaaggcaacttcctcagactgatgaggagcatgtgtaataaacccacacctgaaaataagggcatctagattggagagaagtcaacttacctctttttgcagatgacatgattttagatgtagaaaatcttgaggaattgacaaacaaatctgttagaactaatgagtcctggaaggatacaggatacaagaatgatatgcaaatatcaatttttgtttttatacagtggcattgtacaagccaaaaatgaaattaacaaaacaactctatatagcaccaaaaaatatacaatacttaaatgtaaattttaaacaagaaatgcaatacttgaacactgaaaactataaaatgttgttgaaataaagatgacctaaatgaaaaacaccctatgttttgaatcagaagacctaatattgatcaccaaactgatctacagattcagcacaatccttactagaatcccagctgcattatttttggaaaaatagacatctgattccaaaattcatatgaaaatgcttttgcattgtaaaagaggaatgaagttcagaggctcctacttcccgatttcaaaacactacaaagctacaataatcaagacaaagtggtactggcgtaagcatagacatgttgatcaatggaatagaatcgagactccagaaataaattgttatatttacagtcaattgagttcagtaaggataggaagaaaattgaatgagttaagattaatcttttcagtaaattctgcttgggcaattggatatgcacatgtaaaagaatgaagttggtctccttcctcacaccatacataaaaatgaactttaagaatcatagacctaaatgtaacagtgcatacaacaaaattcttagagaaaaacataggagttaatctttgttacgtttggttaggtaataatttcttacataagatgtcaaaagtacacgcagcaaaagaaaaattagataaattggacttcagaatttaaaacttgtgctttaaaggacatgatgaagaaagtgaaaagacatccctcaaaatgggagacaatatttgcaaatcatatatatttaatagtcttttgtctagtatagggaattcttacaacttaataataggacaaatgatccagttaaaagataggcaaaggacatgaataaaaatttttcaaaaaagatatagaaatggccaataagcccataaaagatgctctgtatcattagttgataggaaaatgtaagtcataaccacaatgagataccacttcacacccatgaagtggtgaagatgtggaaacatgggaaccattacatgttcctggtgggaatttatgactacagtgatatgaacttgggaataatttgacagattcttaaaatattagacgattaccacatgacctagctattccacttcctggtatatacccaagggaaatgaaaccatgtgtgcacagaaatgttgtatacaaatgtttatagtggcatttttcataatagccagtggaaacaaccctaatgtccttcaaatgatgaatgagtatataatagtaaataaaatgtgatacgttcatagaatggattatttttcagcaataaaaataaatgagctattgatattttctgcaacatggatgaattttgcaaaaatgctagatgaaataattcagtcaaagtagatcacaaattttcccagaataagcaaagctatagaaatcgaaagtacataacagttgcttagggctgaggaggggaatgtagagtaactgctctcgtatctaatgtttcccttatgaggcaatgaaaacgttttaaagttgcttgtggggatggttgcataactctgtgactatactaaaaaccattaacttgtacacttcagatgggttaaatgtatgatatgtgaatttcatctcaaactgtttaaatgtatatagtctgttacacattttatatttaagaatttgttttcctaatggtataatagatgttcaaattttaggaattaaatgaggcatttcttccttctagtttgatggagtctttgagaatatttcttttcaaattgtaaaatatgtttctatgtctgctctcaatttagtgcaagagtagctcttgggggtagcaatatcaagtgttcctgggctaccacctggaaggtggaagtagtagatgtatgtgaacccgcgttcttccatcttttctttcctcttctgccttgaaatgcaagtgacataaaattaaaacaacacggaaaagtttcagttcctacaatggcagtgtagtgtattttcaatgaattcctttccagataaataattataaactctggacaaaatataaagcacaactatttgaaggctgtcgatgtacaaccaaatacgacccctaaaagaagaaaactacaccagtgagatgcacatttatgtggcttttcctctgaaagcagtcactattgcatgcattaaggcatggctgtaactcagttattggttttaggtctcagagaatgatgttcagtgttgtcagaactgctggaaattaagcagggatatcatggcagaaagggagcaacagagtgaagagttccatatgtgaattcaggttctctcaaattgttggttgaccctggaaatgtgcgtaacaaagaccccagggatcccagaagatcccagaactgctggaatgctgaatgaactgagctaaaatttcagttgcctaccatggttatgataatgttggaatctgaatctcatcaatttgaggtacttgtaaacaccttgagctttccattaaaaccctggaaggaccatgccttgggagaaaagactgtttctggaataaatggtttggactttttatttattgagagcaaaaccaaatagttcctagtacaacataaaagtgagcctccacaacttcaggactggtaactagcaatgtaactgcctgctgtaataaaaatcagtacttttcagagggagataacatgatgagtgaagtctgacaacatctccacaatacagtttacttggcatgcaatctaagaataaagacaactataatccagaggaaaagcagtcaacagaaatcaaccgtgagattactaaaatgtttgtttcatgggcaagagctttaaagtagctattaaaatcattttcaagtattaaagatgaaaatgagggaaaaatgggaactatcagcatagaaatggaaattaaaacacactactaagtggaaattccatatctaaaatgtcctatatctgcaatggataatttgctggataggctgaaaagcatactggtgatggcagaagaaggaataggtaaccttgaagatagaagaatagagattatgcaatctgaaaaaagagaaagaaaaatgtgtttaaaaaattgaagagacacaaaaggacaaaggaaacttttggaggtaaaacatgtttattaccttgattgtggtgataatgtaatgaccgtatgcatatgtccaaactaatcaacttgtgtgcattaaacatgctgttttttaaaatgtcaaatacacctcactaaaggtgtttagccgaggtgggcagatcacctgaggtcaggagtttgagaccagcctggccaacatggtgaaaccctgtctctactaaaaatacaaaaaattagccaggtgtggtggtgcacgcctgtaatcccagctactagggaggctgaggcaggagaatcacttgaacctgggagctggaggagcttgcagtgagctgagatcgtgccactgcactccagcctgggcaacagagcaagactcctcaaaaaaaaaaaaaaagaaaaagaaaagaaaaaagctgtttaaaaaaaaatggaagacagcctcggtgacttgtgggcactataagttatcaggaagcatgtattaggaaggacaaaaagaaaggcaagagagtgaagaaacttcagaaaaaatatttaatgttgtcttcttaagattgggaacaagacaaagttgtctgtttttatcgtgtttatacagtattatcctggagatcctagccagtgcagttggaaagaaaagaataaaaggcatagaaatcagaaaggaagaagtaaagtcatttctatttacagaggtcataattgtttgcatagaaagccttataagaatctataaaacaattgctggaactaacaaatttagcaagattacaggataaaaaggcaatcaaatgcaagttgtatttgaataaactagcaacaatgggaaagtgaaaattaaagttccacttaacatagcataaaaataggcaaagcagacaccgtcactagttagagtatgaaggcatgcaagaaataacggagcctaatgattgcaaaggaagctttccacaccttaattggttacctaagaaaactctaaggagtctgccatacaatgaataaaactaaggcaaaaataggcataaagttaacaaaagagattcatgactaccacactttatgaaataaattaaaaatcagaagaagtaagagttatatcctgctcatggactggaagagaaaatattaagatgtcacttctctctacagtaatacagattcaatgcaggcccgatagtaattctattgggattgtatctcagggaggatgtggaagaaattggcacattgattttgaaatttctatggaaatgcaaagggacttgtattagtccattttcaccctgctgataaagacatacctgagactggacagtttacaaaagaaagaggtttaattgaacttacagttccacatggctgaggaggcctcagaatcatggacgaggaggggcaagtcacatcttaagtggatggcagcaggcaaaaagagttttgtgcagggaaaccccccccttttttttttctttaaccatcagatctcgtgagactccttcactatcatgagaacagcataggaaagacctgcccccatattcagtcacctcttactgcatccctcccataacacgtgggaattcaagatgagatttaggtggggacacagccaaaccatatcagacctagaatagctaataggaacaaagttgcagtacttggtctacaaattttcctgaaatgggctcacccctgtctcctaccacacaggaaagttagagatgcatcatagacagatctacatgtaaaacatctaaaacatgtgagtatatcttctgaaactttgtatgtaggcaaaaaacttcttagcaaggacacaaagcactaaacataaaaggaaaaattagtgagttagattttgttaatattaaaaacttccattaaaactgtaaaaagataccactacatacctattagaatgtctaaaatccagaacaccgaacaccacgtgctgctgaggatgtggagcgacaggagctctcatgcattgctggtgggagtgcaaaatggtaagccactttagaagacagtttggcagtttcttacacagcataaccttaccatataatcaaggagttgtgctccttggtatttaccaaaatgagctggaaacataggcacacactaaaacctgcacgtgaatgcttacagcagttttattcataattgccaaaactgagaagcaatgtccttcagtaggcgagtggataaactggtatgtccgtacaatggaatattatttagcaataaaaagaaatgagctactaaggcatgaaaagacagtggaaacaaatacatattggtatggggaaaaagctaatctgaaaaggcagcattctgtatgattccagcgctaagtgacattctgaaaaaggcaaacctatggagatggtagagatcagtgattgccaagcattcgggggagggaggggaaataaataggtggaacaggggacttgtaggcagtgaagctactctgtatcatactgtaattctggacacatttcattagatatttgtcaaaacccacagaatgtataacacagtgaaccttaatgtatggacttcagttaacagtaacattgatattggcttatcaattgtaacaaatacaccatacaaatgcaagatgttcataatagaggaattcatgtgggggaggatgtatgggaaattgaaattctgttgagtttttgtcaacctaaaactgctttaaaaaataatgtctttttttttttttttaaatctgctgaaggaaagacattgttaagaaaattcataagcaaaccacagaagagaatacttgcaatacataaatctgacaaaggccttgtatccaaaataaagaactttcacaaatcaataaaaataaggccaatgacctaataaaaatgggcaaaaacttgaatataaatggccactgagcaccataaggtcctcagcattactagtcatgggggaaatatacatgaaactatgataagatgcggtttcccagcctctagcctggctagaattagaaagactgacaatgccaaatggtggcaaggatgtagagtaactcattgcagtggaaacatggaaatgttgtaatcttttggaaaacaatttagcaactcatataaaattaaacctacatttagcctacgacctctactccctagattttttaccccccaagaaatgaagacatacctctttaaggggggaaaaagcaatcaagtacaaagaatatctacagtggctttgtttataacagccccaaactggaaaccaccaaaaatgtccatccacagaaggatgaacttattttggtgtgttggtacagtaaaatacttctcagcaagaaaaaaaggatgaactattcaacaacatggatggatgcacctcaaaaacattatattggtcaaaaaagccacagttttttttggagtctgttcttgtgaagctcagaacaggcaagcataatctctggttgactgttagtggcaggcagagccaagcgactggaagggtgaatgacagaacttaagatcttggaatttgactgtatgttagttgtatgcgagtaaaatttaaaaaaaaataacagttgctgaaacaaaagagagggatttcagatatttctgcacccaattatggtaacaataataactaatttagcatttatgtgccaaacactactctaagcattttacaccttttatctcatgtaagcagcatatgggttaggcattcttattatctttgtcttgctgatgaggaaactgaggcacaaggaggctaagtaagttgtggatggaggtcacacagcttttgtaggtctgcacttggtcagtgagacatggggtctgctggggtgacagctgtgccacagtgcctttcctggctaatcatgcccagtgtctaaattgagaaccttaagcccttatcggtggaagaaggaaagggagtatgcataatatttaaatatatgagattatgagtaacattacgtattctatcctagattcagatgtcatttgtgtaattatttgtaatgctaataacaccaaacttgggggtgttccctgtttctcagcatgattatgtgatacagactcttccacacagtctcatgtatttgaacatacacattttcaattgcatgtaggcagaattctaatcctcctctatgccaattcctagctttgaagaggttctctgaaaatgctgcttttatctttcttctgcagtgatgaactttaatgttggagtgttgtaagttctcacataataaggctcagatttttgtttggtttggcagtagacttctgtttaaaattcctttaatctgttcattctatgctttttatattcattttaataactgatggctctgtaaagaattttttttgaatttattgcactagttaaaaaactactaaaacttgtacttaactattcctccatctcaacgttctaaaagtgagttttccagtgaattgctgaatttttatcttccctgggagttgttcctccccttccccaaccctggggaaataagaaacaattcatatactagatctaaagtttcattaaaattgcttatgccctgtctcaggcattttaagtgggccatctgtctaaacatctctctctccttttttttttctgatcatttcctcgacttattcatgagccatgggagggctcctttgtagtctccatgtagctggttctgtctacccccactgaatacatctatgtgcttgcataacatatcttttcaccgtgctggaaattctctgaacttggttcagatgaatggcccactttctgaaggcctttttcttcctgcaaagatttgtatgcagaaactgacctcagtggccatggaatgcagcatattattctcgatcattttacagcccacccactgtgaaagttatgatgaagcatttcttaatgattccttgaccattagcattgttttaactcagtattttacttctaaagaggtgatggcacaacaaaaaccagcttttttgagtgtctgataattatggtttaaaatgcttataatcctttctaactgaagatgctgagagtttttatgtttatacagtcttcttttagcaaatgacttgtaatagcaaagtatttactcaaaagcacccttttgagtaaaatattccagtaagttaaatgtattagtattaatagtgactatcagctgacagttcttcaccatcaaatataaaaaatttagttatgtcgagcatattcatcctggctggctgatgataaagtggacagacctgggttagagctattattttatttgctttgtgagtcactgtttatgtgagttcttttttactggggtttttggtttttgtttgtttgttgaagaaataacttaattggtatcagctttgcaggtgactaataagttgcacagattaaatttttggtcagatgacagcatctttcactagaaatgtacttcgttaaaggaaactgtatcattactatggtgagttgaagttctaagaccttttccttattgtcagagagttgttcataaaaatcttctttgagactattttgaatttaatggatctgtgtaattcttttctaaacatttagcacataattgtaggtaattgttactatcataaatctgtctgtgctggttaaattaataagaatgtttcaaagtaagtattataaatgtattttcagtgattttgcagaaatagagcatgcattctttcaggtttgtattttttaaaatttatagcttatttctattgcagagcatatttatatctgccagttaactggcatatatgcccaacccatccattttatttaaaaacccaaacaaaactagtttcaaacttatgtcaagccagaaggaatctttgcaaattttgtttgtagaagagtgaacttacaaatagatttcacagtttcgactctgttttggtatttagaggtcttgcacagtgaagcctttttcctatatcctgttaacatatcaccctgaaagaaattgttagaaaaaggctgggtactgtgactcacacctgtaatcccatactttgggaggacaaagcaggaggatcccttgaggccaggaattcaagaccagtctgggcgtcatagcgagatccaccccatctcttaaaaaaaaagccagacctggtggtggcgcacacctgtaatcccagccactcaggaggctgatgcagaaggatcatttgagcccaggagttccagactgcagtgagctatgattgggccactgcactccagccattgtgacacagtgagatcatgtttcttaaaagaaaaggaaaaaattgttagaaaagtgccactgcaggagttaagtttgtagaagaagcagtagcttcctatcacttgcctaactctgatacacttttacaggtgtagaaatattggttcaaacagattgaataagttctcaggtacattgctagtagaacaggctgagatttagacctggatgttttaactcgaaaccctgtactctttccataaggcccctcctgggacaaattataatatatatgaaacagatgtgaatcaaaataaaacaatggaaaaataaatagtacttaggttttggagagtggcaactgtatctcatcaccatctataaggtccctttctgtgggaaaatgggttctgggttggaacaggatgtcaggatcagcaatgttccaatgcctctggaagcagagacttgttacgtgatagaagaaattctcaatccctactccatcaggctgctacagtttgaaaaatattacagcatatgacatagattaaatggaagaaagatctcttgagtttatgctataattaaggaacaatttgtgagggaggcaatattttccttgaaggatctgttagtgtgagaagcagagagatgagatgagaatccaaagtttctataaagaaagaggtttcagttataggggaaagtaagaatataggccgagagccgggacaactactcataataaaagctatagcatgtatacacctaatttaatcaacacctccctatcaatgcagatattgttacaatcttttatacatacataaggaaactgagacagacagtttgctccgggttttgtgtcagcttctgtgactcatcaaggcctgagttcaaaaccactgtcttgctctctgcctcatggtagcttggtttaagagtctgtcctaaccaaatagacaaatcagagaataagcagaaataaaattgaatgcaaaaggtgggttcttacttttaaggcattgaatggtagttaggttaataaagatgtaacttggtgtggggtagaaaacgatcaaatgatcatgagcaagatagtgacataattcttgaggaaagcacagattcaagaaagccaagttgcacggtcatctagatgtgaggctgtttctgcaatcacaatacccctgtgaaattggagtattgaccccattcgaagtgagcaaaatgaagtcttagtgagatgataggcgtagtccagggacacccagggagtatccaggagcttggggcacacagtcctgtcacacctgtgctcttgctctcctgggcaagtcagcctccccttctacacgtgcttggtgcatagtagacactcctcacagtcttttctacttatccctcatctctttgtctccatcctgtgccaggagctggagatacaaaaataaggaatgattttggtcttttaggagcccacaggacactgggagacaaacatataaacaaataaatgccctgtagaataaaggtgctaagaaaaaaaagaggaatactggcacagaagccctttcttcccttcttcctttctgctcagacctccttttctttccctctcctcctcccctccccactgtgtgttgtctccctcaactcccctgcacccccattcattcatactcttctgtgtgaggctctatcccctgaaacagttcttttcacactgccagaaagaatcgtcaaggcctgtgtgtacagtgtgcattattgttgatgcattttttttttacttttatttttacttccatggtatttaaaacatatccttatcttcagaataatgcagatcaagaagtggtaggtcaaatacaaatatgtatttaaattaataatattaatcagatattgaatctagaggtgattggattagaagcatagtttttgtgactctgatttttttaatgctgaatacacagagacttcttttgaaaatttggtgggtttaaatgaaaacataacttggaacattttttcagaactgtggtttaagctggagcccagatactacaaaatgctgatgtttagtacttggtaaatattacttcacaagtataaatatgcaatacctaaattaggttaattctgaaatcattaaattttgttactttaaaaagtcgtgggaaacatttatattctaaaaacacttttgtctttggctgcttgatacggattttctgaaccatgtaatactgataatatgcaagaaaagacccgtatgataagactaacattgttcatagatatggagtcctttctggggggttttaggtgatggggaaaaccagggctagaaaagaaataatgtgtaagtttccaagatgaggactgtgttttatttctctgtggtgccccacaatttagagccaagtgcttagtgtttgttgaactcataagtcatttagggttttgtgtgtgtgtgtgtgtgtgaatgtgctttattttagcaaaatttagatgttgtcctattatataataacataataagtgggtatctgagtaatgtttaaattcgttttttaaatttcgtgaatttttagtaataacattataaaataagtatagttttttttttgtttttttttttttgcaaaaaataattatatcggccaggcgcggtggctcatgcctgtaatcccagcactttgggaagccgaggcgggtggatcatgaggtcaggagttcaagaccagcctgaccaaaatagtgaaaccccatctctactaaaaatactaaaaattagccgcgtgtggtggtgggcgcctgtaatcccagcctctcgggaggctgaggcagaagaatcacttgaacccaggaggcagaggttgcagtgagccgaaatcgcaccattgcactccagcccgggcgacagtgcaagattccgtctcaaaaataataataataattaaaaaaaattatatcctagctaatgtactaagatatttctcttctaattgacatcatgaagaaacattctataagtagaataatgtagagaggttcattgtttaatacatttttagtctcatcaccagtaaagaacaaaatgattctctaggccacatcatgctaactcagtaattcattttatgtctctgaagtttaaggcatggcatacttacttatttcattgtaatttttttttaaaaaaaccattttgaatagtaaccaaatattgaaaaaaactaatactgcttcaggcagatgaatttgtgaatgactgtaacaattaggcaattcaaattcatagatacatgatgattcttagagtaggtgtttaaaatgttcgcaaatacattcaatggcagttttagcctgtgcattttatatcaaagggaaattagtttattgagaaataataatataaaattattaactctttttcttttcattctacttcagaatgcctgttattaaaccagacatagccaactgggagctctcagtaaaattgcatgataaagttcataccgtagtagcatcaaacaatgggtcagtgttctcggtgagttttctttctttattttcttggtaatcttgatgttatctatgaatatttaaagccatttttaacctgttcagtgactctcgtcttttgaatttgtagtacctctatgtatttttcatcttctttaggaagctgaatggaaatggaaatttttgttctcttatgcttattaggaaatacatttctagatttagccacatcctaaactcactttctgatacttgattcatttttcttttatgctgtgagaagtaatacttttgcctttgttacagagaagagcattttgaattacagttccaaatgtatgatagtggtggtaggtaaccatccttttaaaacaaataatctgaagcctcacataacattatctttaaatctcatgctgcaagacactcttgaggctaaatttaccttgtggtgacactctttttgttttgaagaacttaaaccccttggatatagggtccaagatagaactgccacagttggaattctagtctatagtgaacaagattacagtaagatttcagtgtttatactgtagtatgagtgatatgtttaaaactgtgatccgagtgtgccagaaaaataccattaagagttgctgttttaagtcgtatgccttcgtgttttcagcctgaactcaaggaggttgctattaatatatagttagtataatgaatattctgtttatctacatttctcttcttacggctaaattgcattgaaatgtcattttgttttggggaaacaagtgaatttttatcagaatattgaaataggatatgaacatcaaaacaatataatttcacacaaataagacctggtgtggcttgagaggggtacggcagtttcttgatctcagtgagaaaatatcacaagttgaagattcatgagaattcattcattccacaaataattgttgcatgcctactgtgcaccagatcagttccaagctgttgccctggagaagctgacattcttgtgtggtgtcagactcacagatcaatgatgtcagtccatgaactaagggtagtctccttggttttctttaaatgttgtgattcactgtatacgccaaaattgctgaaacgttagatactgaaagatacttcactcagctctcttaaaatgaaagctatgatggagttaaacagctgtctcatgagatcttgtgtgactctctacattccacctattgacatggtcatttcagaaaaacagctttgtaagtgcacatttaaccagagatcaggttgagtagcaaattataggaattgaatagtaaagagtatcaatattacaatgtagcatttttttttctgggggaagattaactttacaaaaatgtagagtttagcataattttcagttctatattgagtcaccactgaagccttactgtaatctgatattctgatacaatgttcttttaagtagtgccttaccttaataaagaaaactgtctagattacttttcagagctgttacttctttttttttttttttttttttttttgagacagagtcttgctctgtcgcccagaggctggagtgcagtggcatgatctcggctcactgcagcctcttcctcccaggttcaagtgatttctcctgcctcagcctcccgagtagctgggactacaggtgcatgccaccacacccaactaatttttgtatttttagtagagatggggtttcaccatgttggccaggctggtctcgaacacctgagctcaagtgatcctcctgtctcagcctcccaaagtgctgggatcacaggcgagcgttgcttctttatgtttgttttagattccatgttgaaaagtagagacctctggcctgactgcatacgtggtatctttcaaatttttttctgtagaattatctccagcttcactttttagcttatgaggaaaacagggctgtttttaaaacacatcaaaattagtgcattaaaaacttccctggaaaatatccaccttagtatataatatcagaaatgatttcctatatttattggcttagctactgtcagagcatcaatagcccaatgaaaggcatgtgcacatgatagtgtagccctttttcctaggcatatttaaatttagctactttcatttgacatcagtattatgaaaggaggcaggttgaacagcgtggcgaagtaaaggctcattggtagaaatatttcaatagtatggcactattgtctgcttttagggtcatagacgggagaactgtgattgttaacttagtttcccagatcacccactgtcacatcaagaaaaaaattagcctacaggtgacaagccaggtctgggttaatgactctggagatagtgcaggcaaaggctttactgagcacacagtaaagctttaggtgccctacatttccagagttcttctgtttaatttttaggagtttaaattataagatatttctaataaggaaagtacagcagatgttgcagattttccatacaggtctcctatttaaaaagaaaaatatatagattaaactaagtcctttctttacatcatcctgttccactttctcccaagtggtggcagctaacctgatgatgctgtgtgtcctttctgtatgtgttgttaagacttttggtacagatgtatacaccacaataatggtaaaaaggaaagttgcaacaatatacatacttaatggcaccatttatgtaaattttaggcaaagcaatttcatttacaatagaatgaaaaggactaaaatacttaggaatatatttgaccaaggaggcgaaaggcttacacactgaaaactataaaatgttgctgaaagagcttaaaaaagacacaaatatatggaagggtatcttgtgtcagggactagaagacttaatatggttaaaatatcagtacctctcagctacttggaaggctgagacagtaggttcacttgagcccaggagtttgtgcccagcctgggcaacacagcaagactccatctctggtgaacaaaagaaaaatgaaagaaggaaatgtcagtactacctgaagtgatctacagatacaacgccatccctatcagaacccccaaatacattttgttgcagatatagacaaatttattctgaaattcatgcaatttcaagggggtcccaaatagtcaaaacaatcctgaaatagaagaagaaagttgaaagccttatacctcctcatctcaaaacttattacaaaaccacagttttcaaaacagtgtggtactgcacatatatagaccaatggactaggatagagagcccataagtaaacccttgtatgtatggtcaaatggcttttgacaagagtttctaaaatattcagtggagaaaagacagccttttcaacatgaataaatttgggtccttttcttactctgtatacaaaactaaccaaaatggatcaaagacctaaatgtaagagctaatgctataaaattcttagaagaaaacacaggggaaggctgcgcacagtggctcatgcctgtaatctcagcactttgggaggccaaggcaggtggatcacttgagctcaggagttcaagagcagcctgggcaacatggtgaaaccccatctctactaaaaatacaaacattagctgggcttggtggtgcatggcacacacctgtaatcccagctactcaggatgctgaggcaggagaagctcttcaactcagtgggcaaaggttgcagtaagctgagatcgtgccactgcactccattctaggtgacagagtgagaccctgtctcaaaaacaaaacaaaacaaaacaaaacaaaaaaaccagtagataacataggggaaaagcttcaaggtattggatttggcaatggtttcttagacatgacaccaaaagcacaggcacaaaagataaattggactatgtgagagttaaacacttctatatatgaaaggagaatattttcccagaattttcatccctcctttaaaattttccattctaaacactataaatatataaatgtttcatgcaaatattttctcccattctgtgggttgccttcttactctgtttttttcccaaagtaaccactctgtcagagtacaatcaacagagtgagaaggcaacccacagaacgggagaaaatatttacaaatcacatagatgataagagtttgtttgtttgtttgttttttgagacagtctcgctctgtcacccaggctaaagtgcagtggcacaatcttggctcactgtagcctctgcctcccaggttcaagtgattcttctgcctcagcctcccaagtagctgggattacaggtgcatgccaccacacttggctaatttttttttgtatttttagtagagatggtgtttcaccatgttggccaggctggtctcgaactcctgacttcaggtgatccacccacttcggcctcccaaagtgctgggattacgggtgtgagtcaccacgcccagccctcccgataagagtttaatatctggaatatataaagaaatttttcaactcaataacaaaaaacaattaaaaatgggcaaaggactttcatagacacctctccaaagaagatatacgcatggccaataagcacatgacaagatgctcaatatcactaatcattagagaaatccaaatcaaacctgcagtgagatactacctcccacccgttagaatggctagtatcaaataaacagaaaataagtaccggtgagggtgtggagaagctggaacccttgtgcacagttggtaggaatataaaatgatgtggttactttggaaaaaacagtatgatggtccctcaaaaacttaaaagtagaattacatagtaaccttagaaagttggtaattctgatatgtgctatataacacagatgaatcttgaggacattatgctaggttataagccaggcgcaaaaggacaaatactgtacgattccacttatatgaggtacctggagtagtcagactgatagagacagaaactagattggtggttgccaggggcagagaggaaggggaatgaggagttattgcttcaagaatacaaagtttcactttttaagatgaaaggttttctggaggtagatggtggtgatggtagcaggaaaatgcaaatgtatttaataccactgaactgtacatttaaaaatggttaagatggtaaattttatacgcgttttaccacaagtaaaacatacacaaaacaaatcagtatttataatgaaaaacttaaaaggagggttgtggccaggtgcagtggctcacacctgtaatcccagcactttgggatgctgaggtgggtggatcacctgaggtcaggagttcgagaccagcctggccaacatagtgaaaccccgtctctactaaaaatacaaaaattagccaagtgtggtagcacgcgcctgtaatcccagctacttgagaggctgaggcaggagaatcacttgaacacaggagatggaggttgcagtgagctgagatcacgccactgcactctagcctgggtgacagagtgagactctctctcaaaaataaataaataaataaataaaataaaaaaggaggtatgaaaattctgggaaatgaatgcatggtaaaaatgaaagttaagtgaagtgttaatcgtaggagaagtgaagtattttatgtattttaggtctttattctgatttctgaatacagctgtctgaatgaatgacagaattaattaatagtataaaacctgctagacacaaagtagaaatattattcagcttgtcatggtgataagccgaaaagtacccaataacaaactgatttttattataattattttcatgattcccttctggattcccaggatgttttccatttctgtcttgctcaatataacacaaaactggtcaaaatagtttttggccaggtacagtggtgcgcacctatagtccatccactcaggagaaaataagtttatgatgaattaaaatattaacacagttaatatcttaaagatggtgaaaaactaaattcatattgaatgtgattcacttgaaagaaagagttgaaagaagagtgtcagagtagtcctaatgtataagaaaattagttagaaatttggccttcctagcgatggaaaaaggagcactatacatgcactttttgaaaaattttgcctgatgtttcatgtttactactaataaactagaaagcaattgtatatgatcctgtatattgaattgttacagtgggccaatgatagaaaattttgtaaggacctaagggtttttcgtgtctctgtctccttcagttcggctctgatcttagttatttcttgtcttctgctaggttttgaatttgtttgctcttgcttctctagttcttttaattgtgatgttagggtgtcgattttagatctttcctcctttctcctgtgggcatttagtgctataaatttccctttaaacactactttagctgtatcccagagattctggtacattgtgtctttgttctcattggtttcaaagaacttatttatttgtgccttaattttgttatttacccagtagtcattcaggagcaggttgttcagtttccatgtagttgtgcggtttcgaatgagtttcttaatcctgagttctaatttgattgcattgtggtctgagagactgtttgttacgatttccattcttttgcatttgctgaggagtgttttacttccaattaggtggtcaatttttgaataagttccatgtggtgctgagaagaatgtatattctgttgatttggggtgtagagttctgtagatgtctgttaggtctgcttggtccagagttgagttcaagtcctgaatatccttgttaattttctgtctcattgatctaatattgacagtggggttgttaaaatctcccactattattgtatgggagtctaagtctctttttaggtctctaagaacttgctttatgaatctgtgtgctcctgtattgggttcatatatatttaggatagttagcccttcttgttgcattgatccctttactaccaggcctgccttacaagagctcctgaaggaagcactaaatatggaaaggaaaaaccagtaccagccactgcaaaaacataccaaattgtaaagtccatcaacactatgaagaaactgcatcaactaatgggcaaaataaccagctagcattataatgacaggatcaaattcacacataacaatattaaccttaaatgtaaacgggctaaatgccccaattaaaagacacagactggcaaattggatagagtgaagagccaacagtgtgctgtattcaggagacccatctcacatgcaaagacacacataggctaaaaataaagggatggaggaagatgcactggtttttcctcatctttatggatttatctaccttttgtctttgatgttggtgaccttcggatggggtttttgtgtggacctcctttttattgatgttgatgctgatgctgttcctttctgtttgttagttttccttctaacagtcaggcccctctgctgtaggtctgctggagtttgctggaggtccactccagatcctgtttgactgggtatcactagcagaggctgcagaacagcaaagattgctgcctgttccttcctctgaaagcttcgtcccagaggggcacctgccagatgccagctggagctctcctgtgtgatgtgtctgtcaatccctgcgggggggtgtctcccagtcaggaggcattggggtaagggacccacttgaggaggcagtctgtccgttaacagagctggagtgctgtgctaggagatctgctgctctcttcagagccagcaggcaggaacgcttaagtctgctgaagctgcgcccacagctgccccttcccccaggtactctgtcccagggagataggagttttatctagaagcccctgagtggggctgctgcctttctttcagagatgccttgcctagagaggaggaatctagagagacagtctggcgacagcggctttaccaagctgccatggctttgtttattctctgaggggaaaaccacctactcaagcctcaataatggtggatgaccctccctgccaggttgacttcagactgctgtgctggcagtgagaatttcaagccagtggatcttagcttgctgggctccgtggggctgggatccgctgagcaagaccacttggctccttggcttcagccccgtttccaggggagtgaatggttctgtttcgctggtgttccaggcaccactggggtatgaaaaaaaactcctgcagctagcttggtgtctgcccaaacagccgcccagttttgtgcttgaaacccagggccctggtggtgtaggcttccaagggaatcttctggtctgcggggttgtgaagaccgtgggaaacgcttagtatctgggctgaatagcactgcccctccctcatggcacagtccttcacggcttcccttggctaggggagggagttccctgaccccttgtgctgcccgggtgaggcaatgccccaccatgctttagcttgccctttgtgggctgcacccactgtctaaccagtcccagtgagatgagccgggtacctcagttggaaatgcagaaatcacccaccttctgtgctgatctcgcggggagctacagaccggagctgttcctgtttggccatcttgccagccacttgagaaaaatgtctttttactgtttttgacttaaagctgttttatgtgataacagtatagctactcctgcttatttttggtttccatttggatggaacaattttttccatccctttactttcagactatttgtgtctttaagggtgaagtgtgtttcttgcaggcagcatatatttgggtcatatgtttattcagtcagccagcctccatctttttattttattttattttatttttttgagacagagtctcgctctgtcacccaggctggagtgcagtggcgtgatctaagctcactgcaagctctacctcccaggttcacgccattctcctgcctcagcctctcgagtagctgggactacaggcgcctgccaccacgcccggctaattttttatatttttagtagagacagggtttcaccgtgttagccaggatggtctcgatctcctgaccttgtgatccacccgcctcagcctcccaaagtgttgggattacaggggtgagccactgcacctggccaccagcttccatcttttaagtggagcatttaatccatttacattcagggttattattgatatatgaggttttgttcctgtcatatcattaattgctttctgtttgttttatatgttccttgttccttcctattttatattgtttatctttgtggttggtgttttccttcagtggcaacattagagtcttttctgttcctcatttgtgtgtttgccttaccagtaggttttatacttgcacgtgttttcatgatggtgtatattgtccttttgcttccaggtttaggactcccttgaacatttcttatagggcggatatggtggtaatgcattccactggtcaaattcggcgtttgcttgtctgggaaagactttatttctccttcattaatgaaggatattattactgggtatagtaccactgagtggcagtgtttttctttcagccctttgaaaatacgattccattctctcctggtatgtgtggtttctgctaagatgtcgactgttagtctgatgggacttcctttatagatgactagatacttttctcttacagtttttaaaactctgtatttggctttagatagtttgactataatgtatcatggaagagatactgttttgcattgaatctggttgaggatttctggaccttctgtatctggatgtctgtatctctcactagacttggggagttttcagttattatgtccttaaatagagtttcaaatcctttcattatttctttgccttttgggatactgataatcttgatttttggttactttattgtgtcccatatatcatgaaagctttctttatgttttaaaattactgaaaaatttttttgtgtgactgcattatttcaaaagacttctcttcatgctttgagattctttcttctgcttgatctagtctgttgaagcttttgaatgcattttgcatttcattcagtgaattcttcattccagaatgtgtctgattcttttttatgatacccatctttttggtaaatttctcatttatatccttaattgtctttctgatttttttgtgttgtttttcagatcactcttgtgtctcactattattagtatcaaaatttttagttatttttctggaatgtgaatttcttttggatgggatctgttgctgcagacttattgtattcctttggaggtatcatattcccttgctttttcatgtttcctgtgtccttacgttgatatttgaacatgtagggtaatattcgcttcttccaattttagaatttgttttcataggggaagactttttcctgaagatgtatccatgctgttggttgggtaggaccctttggctttgattctgggtgcatgtggtagtcactgtatagtgtagtcactgtatgatttctttggctgtaaacagtatcggtggtatctgtgatttctttagtggcttagggtactgttattagtagaggctgtaatgaggttttctggggacaaggatgccacatgggccactctttgggcctaatggtggtagtggtgggctgagtatgtctgtccttgggccccggggttgcatgtgctgacactgatgttagtgggtccaggtgagtaaatttaacaaaagaagtataaaacttgtattgtgaaacaaaccattgaaaaaagaaattaaggaaaatccaaataaatggaaagtttctaatatttgtgaattgaaaaacttaagatggcactgcttgcctgtattagtctgttctcacgctgctaatgaagacatatccaagactgggtagtttataaatgaaacagctttaatgaactcacagttccatatggctggggaggcctcataatcatggcagaagatgaaggaagagcagagggacatcttacatgcagcaggcaggagagcgctcttgcaggggaactcccctttataaaaccatcagacctcctgagacttattcactatcacaggaaccacacggggaagacccacccccgtgattcaatttcctcccactgggtccttcccacacatgtgggaattatgggagctacaattcaagatgcaatttgggtggggacacacccaaatcatgtaattcccaaattagtctaaagatgcaacacaattcctgccgaagtccaagctgtatttttatcagaaattgacaagctgatcctaaaatttggaaaatatggaaacttaagggacccagaatagccaaagtaatctaaacacacacacacacacacacagacacacacgaaaaaacaaaaaaacacgccagtcacattggctcagacctgtaatcccagcactttgggaggccaaggcaggaggatgacttgagcccaagagttcgagaccagcctgagaaatatagtgaggcccccatctctacaaaaaagttttttttagctgatggtggtagcatgtgcctctagtcccagctacctagaaggctggggttggaggatagcttaagcccaggaggtggaggttgcagtgagctctgatcacaccactgcactccagcctgggatacagagcaaaactctgtctcaaaaccaaccaaacaaacaaacccacaaaaatccagaattggataaatcatatttccatctttcagaagttactacaaacagccttgtaatcaaatacagtgtagtacttgcaaaatgattgtcatataaatcaacagaatagaattgagaatccagaaataagcccaaaaatatatggtcaattgatctttgacaaaggtgccaaaataattcaatggtaaaaagaataatctcttcaacaaatggtgtcgaaacacctgggttcacatgtaaaggaatgaagtagaaaccctacctcatattgattagtatacaaaaattaatccaaaatggattgaagacctaaatataagaggcaaaacatctttaaaaatagatgaattgttcaacatcaagattaaaatgtttgcttcaaaggacactaacaggaaattgaagacaaaccagagaatgggaaaaaatatttgcaaatgaaattttcagtaaagcacttgtgtttaaaatacataaagaacacttacaacttaacaataaaaaacagcccactctaaaaataggcaaaagatctgaatagacgtttctccaaagaatatatgcaattgccggtaagcacatatagagatgttctgcatcataaggcatggagggatccagatgcaaatcaaaaccacagtgagattgtcctttgtacccactacatagctctactttaaaaagtcaggtaataacaagtgttggtaggccaggtgcggtggctcacgcctgtaatcccagcactttgggaggctgaggcaggtggatcacgaggtcaggagatggagactgtcttggctaacacagtgaaaccccgtctctactaaaaatacaaaaacaaaattagctggggcatggtgatgggcgcctgtagtcccagctccttgggaggctgaggcaggagaatggcatgaacccgggaggtggagcttgcagtgagccgagatcgccacactgcactccagcctgggcgatagagcgagactccgtctcaaaaaaaaaaaaaaaaaagtgttggcaaagaggtggagaaattgaaaccttcaaatgctattggtgggaacgtaaaagggtgcagctgctttggaaaacaggatggcatttcctcaaatggttaaatatctgggttattcagaaccttggctctgttgtatcaggagtatttaatcttgaatatttatataagtatttatgtatttctttattactatggtgaatatatcttacctttcaaataatattgaagcaagttatttccctgacccctttgcgggaccgctttgccacggggtgcctcctttaatcagcctatagctctcaactccttgtgggagggagcacacgagcgaaggaggcgggaactgtagtgcaggagcactggaactgaccagccgttttggcgccagtgggatcaaactccactcatttgcacctgttgccttccacacctcgtaggagggagtgcacaggtgagtgggtgcaggaaccagagcaagtgcttttgggcgccagcaggagcgaactctgtgcaggccccatggcagcatccaggaggggtgcctgtgactcccaaagccccagagggcatgttacagtgctcttttagctctgctctccacaggcggcttaagtgttaacagctcagttggcctgctgctgccctccaccagcgagggcaaagggccagcgtaacaaccttttgtatccacacacatggctcctgaactcttgtctggtgtccaggaaaaatgaggtcacacgaactaattgaaggatggtaaatgcaggaatgattttattgccgatgaaagtggctctcagtgggaagagaggggagctgaaaaggggacagaggaggggtaggtgatcttcccctgaagtccggctggattttctccggttactccatcaagctgtccctctgaagtcaagtcccttctctccaacattcagctgcttctcctctctgctgattgagtctggggtctttataggcacaggatgaggtggggtggggccatgggtagtttaggaaaaggcaacatttgagctggaaaacagggagagaagttctcactttgggccacggtctcaggcttttcagcttgagggtggaacttcaccagggacccacacctgtctgcctagaatttctctgcctcctgtctctatcattgtatcaatatcaaacaatagttgttggcctacatgtcagtaatttaaagatgaattaaatggttatatatgataacatttatcagagacctttagaaacattcatattctttggtctactatttttacttctagaacatattccaagcaagcaatgaaaaatcgctaattcaacatataatattttgtcagggaaaaaataaattaaaggcagttgggcttggagatatccatgtaaacaatctgtacttataagggaaggcagagttggaagtaattaaaataatgtaataaatgcattaatagaggtgtcatcaaccagttaaatctatgagaaagaaagaaaggcactcaactgcttgggggaagggaaggatctgggggaagatgaaagaagttcctcttgggggagatgactgatgagtcacagcttagaacatattttttagtatatataagccagaacttgcctcaaaattattgtataaataaatgaggaaaaacattagaatgtggtagcatgggggagagcacctcagtcccccaagtagctgagactacaggggcatgctaccatgtctggctaatttttatattttttgtagtgacagggttttcgccatgttgcctaggctggtcttgaactcctgggttcaagccatctgcccaccttggcctctcaaagtgctgggattacaggcatgagccaccgtgcccagcctgtgatttcaagttttatccaagcaatattttttgagagcaatataagatttgagactgggtgcgtggctcacgcctgtaatcccagcacattgagaggctaaggcgggaggatcacttgagcccaggaggtctagaccagccctggcaacaaaaaaaattttatatgattagccggtcatggtgatacacgcctgtagcctcagctactcaggaggcccaagggggaagatgctttgagcctgggagattgaggctgcagtgagccatgattgcaccactgcactctagcctgggtgagagtgaaatcctggaccccgtgtcgaaaaaaaaaaataaagatttgagataggtaagcttttgtgtacaagagagtttgtgctacattttgttttctttataatgtttgttttggttgatgcaaaattgtttcatcttagatgcttgaggtggaaggagggaattgttttgtagtattcatataattgaaattaccaccctatatttttctcctcaaagaaagaatatggtgatgaactaagaatagaaaataataactacatatggatgcataataagaaataattatatacgcattgtttgacgttttccttctctgctataactcaccctttttcctttgttctaccaccatatgttttgttctggatttcttgactaagaaaacattccaccatagtttattttaatatttaaagagcactttgaaagtttgatttttttttttttttttgagacagagctcactctgttgcccaggcaggagtgcagaggcacaatcttggctcactgcaacttccacctcccaagttcaagttattctcatggctcagcttcccgagtagctgggattacaggcacgtgccaccacgcctggttaatttttgtagtttaagtagagacggggtttcaccctgttggccaggctgatctcgaactcctcacctcaggtgatctgcccgcttcagcctcccaaagttttgggattacaggcgtgaaccactgtgcctggccaaaaattcaattttaagtaaatctgtttaaatgtttttgtgtaacgttttcataaaaatgaaaaattcgatgaacttagaatatgccaagaatcttctgcacaaaataataactttgtgttctcaaatagtaatataaagaatctgtaatgtatcttcattaagaatttatacatgcattttacatcataatctcttttattctatgaatagagcataatactaaattatgaagttactggaatttttataggaacatgataagaatcatgtggttcttttaaagagttaattttggaacatcttttgttcaaaaaatagaacattattatatgtattcttttgcctctattgtcagtttttaggataggcttttaatcttgaacatgaaaaggacatcagtaaacaaggtgagttaactattacatttatgcctattataggcttttagtttaaaaattacctatggcttaaatacagagaaggcagacagaaaaagaacctttttttccctgagcattttaaagagaatactacagtaccattaggggtttataataaaggactataattctatttagaaaactgacttacagtacatgacaaatgatagaaaattgaggtaagttttttgaagtcatattttatatttattttttatttttcattaatttgtcttttgccagaattaaatgttatgatcattaaactacttctcttcttaggtaattttttcacttagtctttctacccctctacctttaaaaagtatactgaacaaagcagcaaaagatattctctttgaggaaaataccttattttctgtgaatagttttttaaaattaaaacataatgcataaacatagaaattcttttacattggcaagaactttttccttgataaaattatttttccatttgaaaaattattaggataataagtcaagataatgcttaaaaatgtaaaaattttctgcaaagaatgtaaaactgtcgtaagtgaagccaacaggtaagccaaaaaaccagagagaaaatttgcagttcattttagtcacaaaataagggatgcccttcatatatgcagaactcttacaaatcaatatgaaaatgaacaaaagccctggtaaaaaaatattcagagacagtttacagcaaaggacatgtggctcctgcacatatgataaaaagtgctaaaagccacacacacattcaagtgaaaatcatgatgagatacgattttccatgcacattttggcaaaaatgaaaaatgtgttaattccgttttgttttgattttatttatttattttttttgagaccaggtcttgctctgttgcccaggccggagtgcagtggcatgatcacggctgactgcaacgtcggcctcctaggctccagtgatcctcccacctcaggctcctgaatagctgaatagtcagcatgcccagctcctttttgtattttttatagagacagggtttcaccatgttgcccaggctggtctcgaactcctgggctgaaacaatccacctgccttggccttccaaagtgctgcaattataggcatgagccactgcacctggcctcttcctaagattgtagaaacgtaagctctcaaacgctggtgggagtataaatggatataacaacctccatggagagcaatttgacaaaatgaatttatactgtgtgttatgtccacctgtaggagatgtgcaagaatagtcatgttagtattatttcttagagcagaagactggaaagaactagcaaaaggtagtgaaaaggtagctcactccaaaagttttgcttagggttccagagttcatagtaatttcatttgtcctaaaacatcacaggactattttaaagaatactatgtttctccctgctattggtttaaggaagaatgtctaaaagtaacttactgtaccagtgtaacatggtatcaaactgcctgtcagactggaatagttaaataaatatgatacattcataacattgaaatactgtgcagcctttaaaaagttgagagtgtcttctatgtgctgctttctttttttttaagacggaatctcgctctgtagcccaggttggggtgctggggtgcagtggcgcgatctcagctcactgcaagctctgcctcccaggttcacaccattctcctgcctcagcctcctgagtagctgggactacagatgcctgccaccatgcctggctaattttttgtatttttagtacagacgtggtttcactgtgttagccaggatggtctccatctcctgacgtcgtgatccacccgcctcggcttcccaaggtgctgggattacaggcgtgagccaccgcgcccagccctgtgtgctgctttatcaagtgacagaggcaaacgacattcattggcataaaaaagaatgtgtgtgtttgtgcttgtgatatccacagaatatctttggaaggagccacaagaaactgggacccatggttgcctgtgagttggggagctggagggctgactccataacaagtgagaaggatacatctcttagatcatatctttttagtattttttgaattttgaaccctacatgtgtattacctattttttttaaaaaacatttcaaaattgtgcagtggaagggtctgtaagatggagcagtgttgaaataatggagccttaattacctttcaagaaacttctgcagtgacttggccatccggggaagcaatcagaaaagcagctggctcattaaatggagagtgctggtcccacaggtgtaagtacacaaaacgcaatcactgaaattctttggctagcacttccaactcggagacagttgctggagatcacttaataggctctggttacaggttgatctaatctgaattaagaaattggaaaaagcaaagaaagagcagtaacataggtcagagtaaggaagctgagtccgaacagttcctccacagcctcctgtttccccttctgtaggtgtatgaactacccagagagattactgtgaatgtagaatagttggagagatgtgtttcccaatagcaaaaggcagtgtaaaggtagttcactccaaaagttttgcttagggttccagagctcatagtaatttcactcgtcctaagacatcacaaggctattttagagaacagtatgtttttccttactcttggttcaagcaagaacatccaaaagtaacctgatgtaccaatgtgactccttatcccaagctaaagaatatcctttcaaggcaaattcatccaaatcagcttgacatctgatgggagggggttggataaacaaggttgtagagaaatcaagtctgaagagtaaccttgcacagcttgatctgtttactttttaaatgcaggtttgttcagtgggtatcgcactctacttttgaaacataggactaaattttcacaaaaatgtgaagatcctgcccgtgtactctggaaaattgcttgtctaattgggtgcacagctgcacctgtaccctcttgaatgactcagtcatggtgtgctcaagggccaagtaacttgttatggtgctaagtgaagaacaaaaatatataaaattcagttactttggcaatgaaaaacactgaatggtattggttgttatattacagttggcaaatactgtaattaagacttcaagtgatttttagtattagccctggattcactttctgaagaattttatttagaataaaactttcagcgttgataccagatagtcacctttagttcagttcagtttcataaatctttataaaatatttatagtagtcaaggagcctattacgggtgctagtcaggtttctgcaacaacaaaaagtaaattaaagttggctgggtacagtggctcacgcctataagcccaacagtttaagaggctgaggcaggaggatcgcttgagcctgggagttggagaccagcctgggcaacatagtgagaccctgtctctacaaaaaaaaattagccaggcatggtggcacatgtctgtggtcccagctactcagggggctaaggtgggaggatcaagtgagcctgggaggtcaaggctgcagtgagctgtgatcgtgccactgcactttagcctgggcaacagagtgagaccccatctcaaaacaaacaaacaaaaaatgtaaaactcacaaatttaaaaaagttttaagaccaggcgcaatggctcacgcctgtaatcccagcactttgggaggccgaggtgggcagatcacctgagatcaggagttggagaccaatctggccaacatggtgaaacccagtctctactaaagatgcaaaaattagccaggtgtggtggtggtcacctgtagtcccagctacttgggaggctgaggcggagaatcgtttgaacctgggaggtagaagttgcagtgagccaagattgcaacattggactccagcctgggtgacaagagtgaaactccgtcttaaaaaataaaaataattaaaaagttttaaaattcactttggtatgatattttgacccctcaaagttgtttataaatagaatgaacagtggagccatctgttaaaatgccttggctgagtgactcagctagtagatgaattttgacatatttatagcaccatgcattgatcattttagttgtaatataacagctgtttattgagtaccttttatgacataggtcctggagaaccagtggtaatcaaaagagatgatacatctgacttctcacagtgtcatctgttgagggggacaaggatgaaagctgtgtcagtgaaggaggaaaattgagtggtaacagggagggcaggtgctgtggtgagcatgtatgtagcggaggccccgaactgaacacggaggtggttaggggaggcttaggaaggaaatactggccaggctgagacctacacaggaggtttgggggagggtaggggaaggagtcagagtttgaaggcctacataaaaagtagatacagctataaagaacgagatcatgtcctttttagggacatggatggagctggaagtcattatccttaggaaactaatgcaggaacagaaaaccaaatgccgcatgttcacatttataagtgggagctaaataacaagaacacatggacacaagggaacaacacactggcgcctaccaaagggtggagggagaagatcaggaaaaataatggatactaggcttaatacctaggtgatgaaataatctgtacaagaaaccctcatgacacaagtgtacctatgtaacaaacctgcacatgtatccctgaatgtaaaatagaagttaaagaaaagaaaaacacacacacaccaaaaaaaagcagaaagagaactaagaaagttaattgtgtctgaagcaagagagaagttgtgtatgactgcagcacagaaagcttgaagtgtgggacctggtggcaggcagggagggggaaacgagtggtgagatgggaggggcaggccccaggggaagcagctgggacccggccatgtgaaagtgccagccctgaacctggtctggatgtgtgtggagtgcagtggagagccacagaaggcttgcctgcagggagtcggacagagttgcctgtttgggagatcactctgccttcatgatggagaataggtttggagaggcaagactggaggaagagggcctgctagaagcagtcatgcaggtgggcgctgtgagcctcagctgcaagtattttggagaaaaaatggatcaacatggaagagatttaagatgtagaattaaccgtgcatttattgagcagtaataatattagctaatatatattgcatatttaatatgtgtcaagcactgttctaagtgatccacatgcaatatgttatttaacaacaattgtagtcaacatgtacaatctactttcatttctattccaatcctataaagcataagtactattattagtcctatttttaagtataaggaaattgaagcatagagaggttacgtctagagaaataggaagacaattttagacataattttgaagggatctgtgagatacacaagtggagatgtttcctgggtcattgcatgtgaggttctgtggcccaggagagagtttgggggagattcggtctccagtagtataaatggcagttgaacacgggttgaattgaggagaaagtagaaaagggaagaggaccaagaaagatgaaaccttgaggtatgctaaagatttaaaggatgggcagaggaagaagaatcagcaaaggatactgaagaggagcattgaaagagactgtgtcagaaaacccaagaagttgtgttgtttcagaatttaaaggaagaggctgttttaagaagatgaggtcattgatgccagtgaatgtaagaagtcatgttaaaacaaaaaaaacaactaaggctgagatttatccattggatttagtgaaaataattgagaacaatttcagtgttgtaatggggccagaaatgaaattgtggtgagttcagacattgagatatgcggacaagtggagtgaatgactcttctaaaggcatggtcgttaagagtgggccatggtgttgaggggattgactttttaaaggtttaataaattcttaagtgctgataacaggtgccagaagaagggaatttttgatgattaaagaataaggagaaaaagaagaactaggagaagggcctctgtgcttttttttttttgaaatggagtcttgctctgtcacccaggctggagtgcagtggcacgatcttggctcactgcaacctccacctcccgagttcaagtgaatctcctgcctcagcctcccaagtagctgggactacaggcgcacgccaccacgcccagctaatttttgtatttttagtagagacggagtttcaccatgttggccaggatagtcttgatttcttgaccttatgaaccaccacacccagcctctgttccatttttatatgaaaggacaaaggagcgggtggagatgaagggagagttggtgacttattcacctgtgatggctgctgtgggggaagaggtgaggtgagactgggaggagttgattatggcattagaaattggaagtacgtggaatgttgttgaggctgggagcaagaattgacttaaacacaacagaagggctaggctaaccaagcttccatttgaagtcgtggagcaggagttgatggggtatcaatccatgtggtcagatagtgcaaggcagctctgcatgtccaggaggccaggacacagggaggctaggcggagaggtgccagtgagggaggtggagataggcagatcctgaagggcctttaaactatgggtttcgattttattgtgacattattcattatctagccagcttttataggagcagtttataaagtatgttctagggaatactattgatcaacacgtttttcaaaagtctaaattgtgttcaaattggtgtcttgtgagaattaatagaatacatatttagatcactttcataaataaatacattaacatcatattttcagtaagctcatatttgatatctaatcaaattcttttagtcatgaatttgaatgagaggttttttgggttattgttactgtttgttttgtcttctgtgtttttatatttggaagcagaattagcttttggtctcttaagtgaccccttagtcacttaagatggtgttcatttccatcattgtgcttatcatgcacttgagttctcgtgtttatttctttgtccacttgtttaatttcagcctcttcacactaaaataggagctttgtaaaggcaaggacctagtcttgttcactgtcacacttcttgtacttctcaggaaatattcattgggggcagggtagaggagttggggaaggaaggaaggaaggaagagagagaacagtgaagcgggaaggaaggagttccaaaaactgcttccctagtggtcatggaaactctttaataaattagaatgttgtctccaaaaaatacaggcagatatgcgttgacaattgcctttcatacaccttaacaaactagttacataatgggatatcaaaattcagtcaatgtgtttgctagtttaatttgttgtgattaaagaaaacaatgattttatttataaatttagcacctaggaaatgtgatttcaaatatcaaagcataggcattttttactctttttaaaattgaagggtcaacaaaatctgccttattcttcacagttttttctctgtcagtaatgtagcagtgtgttaatttccagaaatttaatctcttctataaaatttcctgtgacctgaaaacttttgaattggagttaatttaccaaactgtcatggaatgcctgaaatttccttggggcagaggaggtagcagagaggtggtaagttaccatgtttccattgtgtgaataactgataagtgggattccaaacagaatccatgtagcgttttaatgaattcacatttggagaaaaaagtcacagactttcaaaacttacaggaatttggctgtcctagggcaactcctcacttaacagcaagaggggatgagaaggttgagtgactcacccagggaagtgactcacccagggaaggtcaagtgactcacccaaggttacttggtaagtaaagagagaagccagaagcctggggcctcctgacggctcctgcttctctttttactaaggtcttctgccatgggaagaaactctgaatgttagcaaccatctggatggtgttagttgtatgtctctctatgtatgttgaaaagaaaatgttgaagaattgaatttctcctgcttatgggttgtgtcacatttaatagcgttctttaagaaaaaaacacgattgctcaatatgattatatgagctcaccataaccaatgacaggcagaaaatcctgggaggatagacactaacaccacattatcctgttgggataatatcccaaattctgaatataactttcttttaccactttaaaggccaaaaaatggctgttaaatggagtatttttgtcaaaccaagtttttaaagttttcagcagctgcttctgctggcttttattaactactgaagagtctttttttttttttttttttgagatggagtcacgctctgtcacccaggctggattgcaatggcgtgatctcagcccactgcaacctctgcctcccgggttcaagcgattctcctgcctcagcctccctagtagctgggtttacaggcgcccgccaccgtgcctggctaatttttgtatttttagaagagatgcggtttcaccatgttggtcaggctggtcttgaactcttgatctcatgatctgtacacctcgggctcccaaagtgttgggattacaggcatgagttaccggaccctgcctactcaagagtcttaattgaacatcaaaatcctggttttgtttataaggaaaaaaagttaatggtgcaactaggactaattctttgattaattttttaaccacttctacttagcaagtatatgaaacacattaaagactgatgcatctgttttgtttttgttttgagatcaggtagaagatctacaaaactagttggaggctggaaagaaatttcagatagtgatacatagaaatgttctgccttaactctgaatttttagtcatgaaatagtgcaaactcttaacattacttttgtggagctttgtagtccataaaaataacattgttgtagagcctctgtatgcgtcagctgtgactgagtgttttgatgtcttagcaaaaggcagaggagtgctttcctttgaaatgtgtgaggcggtttgagatgcagcttctcagatggatttaattagtccttcgtagaactggatgtccgtttgttgcaactgaattctcatttcattcatccataactagaaacacctcgcttcaaacgggtttcttcaaagaaagaggggtttagggttctatgttgtactgctttttgatgttggtttccctttaactgagaagaccttatgtttatacaactgttattattaagaaaacacagctttcttcagcgaggttccttttgcatcagcgctggttcttggtggcagtcagaggtctgtggaatggatctctgtcagactatcacagcagctgtgtgtttgcagattttgcttatgagaggcatgaactgaaaataggcgtaaacttgagtaattccctaaacccaaaatataagatagaaaccagtaactgaatctggtaacagggtagttgtttgtttcagaagcttatattaaccacaaaaacaaagtgaatcaactaacaagggttaccatgacccaaatagtaattgcattttgattcactttgcctacagtgcacaggtcaggtctgcttctcaataaatatgttgaaagaatgaaatatatccttcatagtaaaattatgttttttaaaaaatatgtcctactactaatattttttaaattatccctaaaccttcacatttcattagaatagctacttcaatttactctgaaaaaactgctttcttgtctttccagtttgtgtgtccagggtctgacgtgctccatcatcaaggcagcttttatcttctgtgtccgtgattctaattacatttcagggggttgtgatctctcccagaatcccgttcatgcattgtgtttaggatgaaatgcttgagggggtttggggctgtacactcatgggcacaggtttgcatatctaaaactttctttgctctaacatcctgatttgtataaaaatcctaaaagcaaatttcagacttctaattattctttgcctttaaggaaagacaaaattaatttagactgttcaagcttaaaattatcccaaagccacagatcacactgaaaacacatagtaatatagcccacaaattattttggtgtcttgtttccatattccatccaagagtctgtagaatctgtaggcttatatttctgtcttgtttcttagccataactgatcttttccatcttattcaccagactcagcactgcgtaactgtggcaatttctgaaactcagtggcaagggatataccaccattgaagagattaaaaataatcaacaaaggctttaaaaagtttaaaaaatgtatttggagcaataatagcaataggtcagaaaaagttttcacggaaagggccaatatacaattaggtttccatctctgtattcttgattgtgtgttttatgtcttgtgactatcttgtggagttcctaattttaaaagaattatgggtgtggctcaggaatattttattacatttgtgtaaattaaataattttttaaaattatggatgtgatttaaatattcttttagtggttctgcctttggtacagtgttccatgattttgtaatgtttttatttgttgaaaaagctctaaaaatcttggtagaaatatagaatctcagaaggcagaacatttggtaattatcttttatatcaatttgcaagacaacttgttagggagccctatttctagtagttgaagttaataagtaacaaatcacagcaatcacgttttttatcatgcagagtgggcagtcttataaaaaagaaacgtcagtctttttggatatagggacacaagcaatcatagttttcctctgttatctttagtttgtaaaaatcaacctatctaccatcagcatttacccacaaggtttagtttggagttacctaaggggatggtagagaaacaataatttaacgttatgctgaaaacaatagtctctgaagatagagaaacctctgtcacttaccagttgtgtaaagttggaaaagttacttagcctccctgaaccactgcagcagtggtgtttacctgaatgttggcatagaggaaaaccaagggtcacgaggcaggtggacttgagtttaaataccaatcctgaacctgctggctgtggaatccagcagaagttagttatcttttcttagccttagttttccttatctgtagaatagggatagtattctccagggtttttgtaaaaattaaatgagattttatataaaggctctagtacagtggctgatgtaataagcaccccagaaatgatttctcttccctctaaaacacggatattttgctttttaaaagaagctaaagtagcttttactttgcaagcagttcttttccattgtatgaaaaattcttggaaagttttaaaaataagacaaaagggagccacagtggcccaggcctgtggtcctggcacataagcagccgaggctaggcgttcgaggttagcctgggcaatatagaaacctcttatctatataataaaaataagacaaaaaataaaatgtgccaacatatattagcaaggtttgtcagtactgattaatatttttacattctaatattctttgttagaattgtatttattttatgaagccccttttgaatctacagcagactacctgggaagtagttatagaggtcatcatcgtgtcttggtgattcactttgggaaattttgttgagtgaggctggtgaacctagaaagctgcttcttctgcctccccatttctgtccccaaggccctgctgtggttcaaaagcccatataaacctgcagtttccctttcttccacgatagggcgcgcacctacactgttagggtatggggccgactggctcctgccctgtgggaggtttgatccttgtccatttagaggcccttccttattcatggacactctactgagtgtctgttgcaaactccctggtataaaccccagacgtcatggatttaccacactaattattagagtggccattatttgcaataaaatagtgacccttgccactgtgttttcctaccaaataaacttactgacaagtatctgcattggctgggtcgaggtgtcatcaaatcagcctaggtttggatgtgctgttttgctagctgtagacccttgagcaattatgtaacttctctgagtgtcagatttgtcatctataaaatgtggttagtaacgtctccattgtaggatcgttcctaggattctgtgagtgtgatgtatattaaaatacctgattgatattagggcctcagtcatgttcctttctttgctttagactcatttctctgaaaaagtaatacgatgtttatagttggggaaaaaaacccaaagagcgttcataatctggatattaccactattgaaatttctattttgattcagtgttttttttgaaggtattcttatttttaagagagggaattataaaatatgccattttctaactcagtgtttaaaccttaaaaaaagagacatttcttgaaatgttaaacctatggctttgagcatggctgtgtgtggctgtatttgctcttggccatatttattgtggcagcgtggtaatgggtttatgcttgttttatcgcttgtggtttttataaaataaaaactgtgtttggctgtgtgactgtcgttcagaacaagattaaggaaactagatggagattaaacatagcacaatcttctgttgtaaataaccatagacaaacttgtgagcagctaccaaattccccagttggacaaaaagtgcttctttttagctttgaaaacctagtgatgatgatttgagaactggcataagtctctttaatcattcaggttcagcgtgattagaagaagagttgttttaaatgtttttgtgattagatttgaaacaaagcttagaaggatttatgattttgtttacaaccagctacgaaaaacaccaaggaaatgtgaaagctggtagtaattggtgagcttgctgggagtggatgttgtttccagtagtgtaacttaacaaagattgaaggaagctccgtgccattttatttcataccactggtttaggtgcattaattgatattttaaccaaaattttaatctaaatcaagtcttttaggttcaacctattccactgggttttaaatgatcatatatgcataccacagcacatctcacattgagaacgttacctcagtgggaaggttgtttcattcttggttgagtatagcattccagcttgtaattaagctgcaatacaaaaaatatacgcacttgctagaaggatattcttgctagcattctgtatgtatcatttgcttattcaagcatataaaacttcaacaagaggaggtaattttgcttagatctcttgatttgaattgttccgctatttggcactgggtggaaaagggaaaaaaatcatattgaaagcattgttctgttaatgaagttgcttgtccttttttgtgccaaatttggcaggtaaaattaccatttattctacttgctagagctggagaatagactgttgaggaaaagtagcaatttaagtaatgacactagatagaatgtgctacattatatacatctcccatacttttagatattgacatgcaatttttatttctctttagtaatgcactttgtctttaaccactacattacttcccgtaagctccatcaactacatgcaatttgcttcagttgtgaaatttaaaaatttactattaattataataaagtgaagcattttgattcaagaagaaattaaagattgctgtattttgttctggatatttcagaagtattgtattctttttaattctgaatatttaacataaaaaagatgaaatagacgcattggttaatttgaagaaatacaatcaaatttgaggtattcatggttttttccatgttaaatatgctttgcctatttatatttgccttaatttttgttttgtagagtataaaagagaaactttaaactcgtatacaaaaatgggaaaatatctaaaaatatgactaggtagttttaaaaattactcacgtattcaaatgaaatgcataagtttagcatttgctaaatttgagatattttatttcatattatttgtaaatatatttttgtttggcgtgaatttgtaattcactaagtttcttgtagattaaatttttcttagttgtaaaacttcaggcttaaaaaaagtattattattgttacaatttacactataatggctaaacttgcccctcctccttaaaagaaatataaactaatttgcaaaaatatattttttgaaaagccaattggtgaatttgtagacttgtaaatgttaattcaggaacagagttgagtattgctggaccttctaaccatcactcatttctttctgcccactaaactaactggtaggcaggtgcagatgttacaaaatctagcatcgcaattgacactaattggcatagttgttggcagtcttatcagaaagcaaagggctgaatggttgaatgggtttagagaacttgaatggtaataagcatttttatatgcatcttgaattacttttgtgacccagactaacaggaacactttattctgacctcattcttcaatgaatagaaattgtagaaagcataatatgcagtgtatgtgatgactgattgtttttcaggtaaccttttacagctatctgctctgttgcctacttcctccccccactacctcccttcccagtgctcagagaaaccaaagtactgtaaatgtgtggaataaaaaggagataacaatcattaatgaatattgaattaatttatttgagtggtttgttgccaaaagcttgaggatgtcataagagttaggctaaacttaagaaaaagtattcattgaatttatggatgaaacaaaaggacgactgggacttgcttcttaatagtcttggagcaggtgggtgaatcagtggggatatggataaaacaggattggctttgagtggataagttttgaacttgggtgatggatatatagaggtttattaaaccattctttctgtttctatatatgtttgcaattttccagaacagaaaggttgtttgtttagtatgcggggtgacttcaccctctgctgttgtcaggttttttcaatacctgccagttcctttccaggatctgccttttctcccccagttccttttatcaaaaagtacccatctaaagtgagaactacatcacctgacaagctgttctgtgcgcttatgtataaatgagttattttctaggcagtgtggattttaataggagttttctaaagacactgccttaattaaaggaatggctcttgggttgggaattatagtgttggggtgggtctttgtgtctatatgtgactatatgtagaccactcttcacacttacagaagtgttaggtgataattttaggtgtaatatgatgattgatcttagttctttttagttctttttttttttttttttgagagttttgctcttttgcccagtctggagtgaagtggcgtgatctcagctcactgcaacctccacccactgggttcaagcgattcttctgcctcagccccctgagtagctgggattgtaggtgcccgccaccatgcttggctaatttgtgtatttttagtagagacggggtttcaccatgttggccaggatggtttcgaactcctgatctcaggtgatccacctaccttggactcccaaagtgttaggattacaggcgtgagccaccggcatggcctcatcttagttctctatgttagaggtaatgatgtctttttcttctgtagaaagactttccaaaaagaaagtgcttttctttaggactttttagaatatgttcaaaatactgatctttgactaaggagaggaagagaaaccaagatcatatttcagactattgtttcttttcccatggttttggcttatcccgagaattgacttgacgtgttcccttttttatttcaaagtagcattgcttgaaatattttagattttttatagctttctaaggaattaaactctaaaaacactttaactgtttttttgttgttgttgcttgtttgtttgtttgttttgatacagagtctcactctgttgcccaggctagagtgaagtggcgtgatcttgactcaccacaacctctgcctcctgggttcaagcgattctcctgcttcagcctcccgagtagctgggactacaggcgtgcaccaccatgcctggctaatttttgtatttttagtagagatggggtttcactatgttggtcaggctgctttcgaactcgtgaccttgtgatccacccaccttggcctcccaaagtgctggaattacaggcgtgagccaccgtgcccagccaactgtttttttgtgttttttttatttttttttaattgtatcttgggaggccttcatgagtgaatgtagcttgctcattattttttgtaccattcccagtcattttctactcattcctttccttactagttttcagtttggccatgttctgtgtacaatttctggtaagtgctaccaaaaccaatatatattagacatgctgtttttcaagactcctgaaaaagtgccaatcttattctcctttcagtttgggagcacagtttcacaaataatagaatagtcttactttgtttgcagaattagaaggatttatctaacaacttgaatagataattttttttttgtagacgtgaaagtgaaaccttagtattgggatagaattttaagtagcattttaaatttgtttcaaaatcttttcttattgcctgcctttcattaaatgagctatggtaagtatgctggggtgtatacgtgtgcgtggtgatgagatgtttacctctgtgtggatcccttgtagattttgtattgtaaaagtgcataatagagtcctttatatagctggaataactgtaatctgctattgtaagcatatatggatttttaaatacaaccattataatactttataggacattacaactgaaaatattttgacttaaaagttgctttattagtcttacaaaagctatgttgaagagttttttgttttttgttttttgttttttttttaaagaaccatgttgtcagtggtcaacaatcaaatgtaaaaaacacttagctggaaaacatccattaagataatgaaagtgagccacgatgcttgtgtcagtttttatattttagtttaaaacatagttttttagcaatcctataattataaatataagttagattttctctctaatttaattagataatttttattttaatacaatagatacttatcaaggatctgtcgttcttcaagatcagggcactgtgctgagttcttcatgagggccatgaaggaataatgcccaccctcacgaacttccagcctagtttggaggtgttgagattaatacagtaatgattgtaatataaggcttactctgataagtacattgagatataaagtgttacagagattcagagcaaggaaagacccagccctatttagcagtgggcaaggggtggtatgggtgggtggtattggtaggggcaggggggatgaggcagaaaatcaagagcaaactgaacaaaatgaatagaataggtgtcaggtcatggaagatggatggtagaattctgttaggctgaattggctagtccaaatttaaaaaatagtaggactaaagtttaggatatagtgcctgtgcacatttgctgaatgtaagagaaagtgggaagaaaaattgaaatgatagttagattgtgaccattagtacagaagacccagaggaccatgtggagaacttaattttttttttttttttaattaagcaaccagaagccaagaaggattttgaactgagaaaacttgtaagacacagtaaagccacatttgtaactggtctatcgaagtgaatacaactgtagcaggttggagatggggctttgggaaggttttcttgtttgatgggattgtcagtagtaaaagaaatgggaaggaaaagagttcacattcagcttagaagttgagaacaaaatttggggagatagatgagagagatgtcaggtaatagttgggggttgggaagggccaaacaaacaacactcagttattggcatgtgtgttaggccgtttctcacactgctgtaaagacatacctgagactgagtaatttataagaaaagaggttttagttggcacatggttctgcaggctgtgtaggaagcatagcagcatctgcttctggggaggtctcagggagcttccaatcacggtggaaggccaaagaggagcaggtgcatcacatggtgagaaccacagtgagcgggggtggggatgtgccacacacttttaaatgaccagatttcactaaggagatggcccaagtcattcatgaggaatccacccccattgttgcaggactttttcttggtttagctaaggatggggttctttgtcccatggccatgaaaattcaggcccacagacaatttgaatggtgagtaagacagggttttattgggtgaaaaggaaaaaaaacgggggaacagggactcttcaaggccagagtcctgctacagtgcttcctgcctgcagcttgaatgtttggttccacacaggaagaggaggggccaggttcctccctgctgcaaacactgcgaacttcctgaggccccaccccagtgcgcagctggttggaatttttccaagaaccccctccctcccacctggctgtctcattctcccctctaaagaagtacatctaactgccattagaatacggataaggacaaagaccgatcttaactgcttcctgctgacaggggatgctgttttggggaaacagcagtcagagatccctcaaaggcctatctaagcgttcccggcagaaggggccgttgtcagagtctccagttgcatgaccatttggagtttgatggcctgaaggcaagaacagacaaaccgggttgttagaaaacatgtatcaaaaggaaaccagaggacgggtaaagatagctaaaaaattaggccttttaccagtttgcacagggagaaggaggccaaaagcccgactggtcaggaaaacttcacacttttgctggcatgttgggcttctgggttcccttcccctgagcccagtcctaagccaacccgtttaaggtttgggaaattaactctttccagcttggaggatgcatctgaggtgagtgtatcatagtatagagacacaattacctatttgcaaagagagaactgaggaggagaaagaagaaaagaaggcgttttttttcaaaggagtcctgggggtcccggatgcattcaaaaggcgtacaaactgaagatgaatggctacctatctagaaagaggggagcaggtgtccctggttcccttctcttcctagcagatactcagggttagtgagggagagaagagagagcatcctctttcctttcttctatccttgcatccctgaatcccagcaaccttggtaggtgctgccatggctgtcaaatcaacttgcaccggtgaagcagggggcctagggggtgagaatcatccactcttacccacgtaacgccctatctcccctgctgtcagtagctttgaattctgtatgccatggatactaatgtggcctttatccatgaaacaggaagccttggggttggcttaatcagcaggaatcagccactctcacctgtgctgtgccttttaaccttggtgttgtcatctgcctctggatcccttacatccagttttctttctagggctttgacccgaagcttggaattgagtcgggaacacaaatgtgtctcgaggggagttgtgtggactccttaccataagtggaatactaaggtgaaactgtggaactgagtcctcctccaacaagggagaggaaagcatgtcttgtgacacacccagataactggtgactgtagttatgcttgctaggatttgggtgcatggtgcttggctttggttcactcccttggtcttactttacccaaaggaaacctcggagtgatgggcatcctatttattcccatcccctggcaggatttacaggataattgctcagaactagaatattgatccagacttttacattacccatccctcttgttctttctgagctgcagccagagattgctggttggtttacaggaacaagcagggttagtctaaaatgtaggtgaaaacttaaaaacaactagtgagtttagaatttaatgacaaatgtatgataagttttggaacataatttctctccagtcctcatttttgttaaacaaaaaaaaattatgataggactgagtggtttgcaaagtagactttagtcttattctttgcctgaatatttgcataaaatgcaacaagaataattatttctacataggccttttggattggctttgatggatgtctattccacaaggaatctcagataagaccttttaagccgagcccagccatggctttctatcctcaaatacttgcgagttgggtggtcctctccttttaaggtcccaagctaaacttggagctcctggacctgttaggaagtgacattcttttttttttttttttttttgagatggagtcttgctctgttgccaggcaggagtgcagtaaatctcggcttactgcaacctccaactcctgggttcaagtgattctcctgcctcagcctcccgagtagctggaattaaaggtgtgcgccaccatgcccagctaatttttgtacttttagtagagacaagatttcaccatgttggccaggatggtctcgatctcttgacctcgtgatccacccgcctcggcctcccaaagtgctgggattacaggcatgagccactgcgccccaccagaaagtgacattacttactgaccacaggtcagtaaccctttacagggactgcgtagacaggggtatgaggccattttccccactgggctcttactggctctgcaagtcaagattcactcctttcacagtgaaagccttggtaaaataaccactttctccaattgtgtcctgttgcaaaagaaaaatggattcttactacactgatgcaaacaactattttgtcataagttaagaacactcacagatagtttccaaattctagaggaagcaggaagagagaaacaaacatgctccaaaccttcatcacagtagtgtataccttacttaattattaaagtccgtaaacagttcaaaattggccgggtgcggccgctcacgcctgtaatcccagcactttgggaggccaaggtgggcagatcacctgaggtcaggagttcgagaccagcctgaccaacacggagaaaccccatctctactaaaaatacaaaattagctgggtgtggtggcacatgcctataatcccagctactcaggaggctgaggtaggagaatcgcttgaaccgggaaggtggaggttgcagtgagctgagatcatgccattgcactccagcctggctgggcaacaagagtgaaactgtctccccacccaaaaaaagagaaaaatagttcaaaataagtttccttgactctgaaaaactaaacaaggatcagcaatattccaagcaaaagtcaaaaaggttgcttcaggtttctgagttcactccattaagttctcttgttttgcttgatatttgtgaacacttcagctctttatgagtcttgtactttttcctttattttaatgttacaatcttcaaagttattagaagcctgtatttgagaggacctgttaaaattctatagcttattataaaccatcttttgaaaaggattaaaacaagacaacaattgctgtgaatagctaaatatccagggtagttacagttagaaacacaactgacaaagaagttcggttatctccatggtttacaataacttaacataacaaccttaattatgattaatagcatatacttggacattagaattttagaaatcccatacaatttgggaacacatattagcattattcacaaaaatataacctaaagaagattgaacatcattttggcaatcccatgtaaactaaacatgttaaataatcctgtttacctctctttctggacattccaggggccctctggactatccgaaaagccagttgtcaggaaagacaattttgaaactgaagtttgattttgagaaggccgttaaacgttcaaggtttaaatactttgtgttataaaatagaattccagattaccataaattatttattttgccaaagtaatgactcagaagttttaaataagtaaaaaccttttatagccctttacgaattttgccaaagagcagattagcgccttacaaaaaccttgttgtgtttttatttcaatgctcaatctacagaaaaaccatattataccttttggaatttagtcaatatgttcacatagagaacctcttctgcaagattcatttccacaattcttccaccacttgtttgaaccttcagctttttcctaatttaaaactgtcctttaacctagacaaaaatttatatttccatgcctccttgtaaccttttgctaaaaaacacattttactgttcttacataccttgcatgtaaatctatttccagtagtcttaattacatgttataatagtaactcctagcaatttttaacttttttaaaacttggggctgggcatggtggttcatgcctgtaattccagcactttgggaggctgaggtgggtggattacctgaggtcaggaggtcaagaccagcctgaccaacatggtgagaccctgtctctactaaaaatacaaaaaattatctgggcatggtggcgggcgcctgttatcccagctactgtggaggctgaggcaggagaatttcttgaacccaggaggcaaagcttgcagtgagctaagattgcacgactgcactccagcctgggtgacagagtgagactccgtcttaaacaaacaaacaaacttgataagttgttttaattgtttaattgtgtgctaagtgctgccaaggtttgccttcttaattaagagcatggttatatgtccccagcccttaccagttgtgaagccagcaagtcaaatagttcttaaaactcaaaaagcagcttgtaacctcaaaatacttagcaaactttgtatctgacctgcattgtttagtccacctatttacattttgacaacatctgctctttaccaataatccttaaggctgtttttgtttctcaatgattaaagtcacgtgaactgaaaggtatcacagtttttatcttccctttaaaaaatattagatccaagtgcttgtctttgtttaggccaaattaattagagctctttttacagataccacacacagtatatacacagacaggcaaaagaaaacccagtcactgggtggggccctttaagagacagggctaggaagacatgcagatatggaaccagagagggctcatcccctaaggcaggattgctaaacaaagccttgccactggagttagaagccatgccctcaggatgtaaaacaagatggaagcctgatttcacaaccaacaccttgcagagaatacaaacagtgatagttccggggtgggggtctggcctagtaaagtgttttctaaaagagaaaaaacttaaaagttaactgttgacagggtaaagtaggaaaaaaacaacaacaaaacaacagcaggttaaaaaatgcctaggaaagaaccttttattctcatgcaagtggttctttcaccgaggagagaagcttaagcttaattactgtccgatggagttgaaacccttggctggggaaggggaaggctccagtggctcgtggcagaaaatgccagccagccaccccgggtgcccttggaccatgtgtccaagcctcagcagtggaggagggaggtagggagctgctgctctctggtccctcccaaaaaaggaagaaaagggctatggaaaggtcgggttggttctcaacccctgggagcagcaggcggtgggggcacagtttcctccaccctcagaaatctcaggataaaaaggcttaggagccacagtgaaaggttttgagtccccatttcactcactgcttcttgagccccacattgggcgccaaaaatggttcctggacttttccttagttcggctaaagatgaggttctttgtcccatggccagaagaattcaggcttgcagtttgaatgggagtaaggcagggttttatagggtgaaaagggaaaaaaagggggaacagggactcagcgaggccagagttcctgctagagtgcttctcacccacagcttaaattcctacttccacataggaagaggaggggccaaacggtgcagatggtgaggacttcctgaggctccaccccagtgcacaggccagttggagtttttccaggggccccttcccgcctggctatctcaccatgatcggaacacctcccactggtccctacctccagcagtggagattacagttcaacatgagatttgaacagggacaactgtccaaactatatcagtgtgtcttttagagttggccatttttgtcacccccactcgtttatttatttttttgagatggagtctcattctgtcgcccaggatggagtgcaatgacatgatctcagctcactgcaacctctgcctcctaggttcaagcaactgaacctgttgagtagctgttgggattacaggcatgccaccatgcccagctaatttttgtatttttagtagagacggggtttcaccatgttggtcaggctggtcttgaactcctgacctcaagtgatccacccacctcagcctcccaaagtgctgggattacaggcgtgagcaaccatgcccagcctgtcacccgtacttgtgatatgattcaacaaacccgtttctatggccaaattggtttgctaattaatgtactatatggactgggattctttggtacaaaacgtgactgtccaaatagcctgactaattatctattttccttaattttttgccagggaaattttttttgtttttgttgttgttttgttttgttttgtttttttgagacggagtctcgctctgtccccaggctggagtgcattggcatgatctgagctcactgcaacctccacctcctgggttcaagcaattctcctgccttagccctctgagtagctgcgactacaggtacatgccgtgatgcccagctaatttttgtatttttattagagacagggtttcactgtgttggccaggatagtcttgatcacttgacctcgtgatccacctgccttggcctcccaaagtgctgggattacaggcttgagccaccacgcccagcctgccaggaaaattgtaaagtctacacacagtggagctactagtgtagtgagcaccatgtgcagttcttgcggacctctccttgcacaccactgtttttattctgaagtattttatagcacgtattgcagtcctgtaaattgatgctattttttttaaagtttgttgaattgcagtatcctaaattcccaaacccatgtccactgacaacctagcacactcttttttttccccaagagaaactcgtttcttattaaattttgcattagtgtcaaatcggttgactgttttttttgttaaagcactgtcatatttttttctataatatatactctttgacctactgtgaaatatatttaaagtagaagatttatgtgtatgtcagacaaattgtgaaagaaaatagtagcaaacttgttagttagccagataatgtgaggcagtttctcactgtctgtctttgaagggagttgcaaatatagaataggggaaagttaaaataaatcctacattgttgaaatgtttggaatcagaggtatcaatgtgaagtcattttttttttaatcagtagacacagaaacagatttagatgtatttgcttagggcttaactttacaaacttggcagaaaccatcttaaccagtaataaagtaaccttactggtaatgggacaggtgtgcctcttgattttttttttttttttttgagacatggtcttgctctgttgcccaggctggagtgcagtggcacgatcttgactcactgttacctctgcctcccaggttcaagtgattctcatgcctcagcctcccaagtagctgggattgcaggtgtccaagccatgctaattttttgtatttttaatagagacagggttttgctatgttgaccaggctgtgcctcctgatttgatgctgaaaaaagcacaacattacttctgtggtattccagataaaaatacattaatcaagaggaaacattttcccaaattaactggtctatgccctgcaagtctggaaagtgtcttagtcaatttggactgctataataaatataccgtagaatgggtggcttaaacaacagtcatttattcctccagttctgtaggctgataagtccaaaatcaaggtgctggcagatccggtgtttggtaaggacccacttcctggtttgcagatggccatctttcttgctgtgttcattcatggctgagagcagagggagaggaagcagctcttgtgtctcttcttataagggcactgatgccatcaggagggctccacccccaccacctcattacctcccaaaggtcctgtctcctcatactgtcatattgagagttaggcttttatcatatgaattttgaggggacacaaccattcagtccatagcacaaggaaaatcatgaaggacaagcaaagttaaggaactattcaggttgagagagacaccaaagagacatgaaaactaaatgtatgaacctaaattagatcttagacataccataaaggacattattagggctattagaatttgaatagagtttgtggattagttggtaatattgggttaatagtaaattcctgttttgttgactgcactgtgctgtcgacaaaatgttagtgacagcaaaatgttgttgatagcacagtgcagtcaacaacatcaggaagttactattactccagtattgccatctagttcacagactctgttcacattcactaaggagagggtccttgtacttgggaataaatgcggaagtattaaagggtaatgggacatcataaaatgtattctttactgctcagaaatgttagcagctagggaatctgggtgaagggtgtaagggaactccgtgtactattgctataacttttatgtatatctgaaattgttttacaagaaacaaacaagatacaaagaaatacctccccaggatgtttattagaacaatagaggctaactataccatttttctatttcttattaggtgcaataaaaggacactggtaactgtaaatttaacagttaaaagtaaggtcatggcggtggcttacagctgatagtgccctgtatactctgtacaagtgcatgctttattatgatcaacctaatggatagttagttttgtttttttttaaaccagggtcttccttgagatgtaatgggcacagagtaaacggctgattgttagcttattctgtggatgtatgtgatgagtgggtctggggcatcagtttctatatctcacctttacctatcaaagaaattggacaaaccatgatagcaaacaaatgaaaagaaaaaggagttttattgttcatgcttacaaaagaatcctgttaatcaatttgtaatccaccaattattttgggaataaaattgtagcaaataaatttaagatagaaacataaaactattaaacatgttatttgtattataatgtaaaatataattaatattttagtatgtacatattaggaataatgtcactggtggccccagaggctaaaaaacagaatgcaaacctgctggaaaatccttggtagataggagcatagaaaacagaatatcaaatgcatttattgttggccaggagacatggactactaggggaaattctgagtgtctaaggatagtactagaatgctaaacagtcacagataataatataaagtaggtaggattaacaagaaacagcacatcacagtcacaatgtgtgggaattaggcaaaggaaatacgtagccatttttatggacgtcttatagtccacttagacaatagatgtattctgtggtggtaaaccaccagcttaggtaatgggatttattggaggacatcagtggtagcaaaatacatatgaaaagcaaaagcatactaataggaatctgatgaaattaagagaataaataatggaggagatattagtgaagaacaagaaaaattgaagaacagtaaaagtaggcatgcttggaaaaggagaaaaatagatctctaataatcatttttggggaggagtatagagcgtcactaagttgaactaccaccaacagccagcattcattgagggcttattatgtactaggtgctgttctaagggcttgacttcattcctcacaaccactccttgaatatgcattttacatatgagaaaatggacacatgaacaattaggttacttgtggaactgaggttcaaacacaagcattgcgaccattcacggcaatactgcatagaaacacaggattccaccataatcaggtaggggagcgaaaggcagtttcaattgttctttatgtaaagaactcatctacctggagttattcattaagctgatataatttacagtgtgatctgcagagaatgaccttatcacaccaatccaaaagaaactactactataattaaactgtgggcaaaataatgtaggatatttttgtagaccgtaaaactgaaattaaagttgttactgatcaattaatgaggtgataattaaacagaaactagccaacctgactgattgtagaccaatacctaaaatttgtttttgcaattcacatcctttgagatatatttaattacatttataacacatggatatttaatataatcttttgtgacagattgacagatcttcactatcattatgtgtaattcctcttgatgtttttgtcattattacatatatatttgggagagaaataaaaggctgtttccaaggtgatggtgataaagagcaaacttataaaaatggttgcctccttttgtttgtataaaacaaccatctcatttccctctgggaggtcactagaggtatgatagctctgttttgaaataatattttagtaaataggaaagcagggtaaagaaagcctcccctttttgtgttatgttaaggtttaaaactgtgttacagtttatactaaaacattaagaatcaattattataagagcattaaattgtttgagttttgtcatgctttgcctagaaatcagcactgaagcgagtgacttagcaacgttattagatctattaaataattggaaatttatgtgcttattgtcagcatcttggctttttagaattttaaagtatgtttgtgcttcacatctctagttgcagtttatgtagaatttagtgaactataataacgttggatggtggtaatgtcacagtgtaattaactgcatagcatacaaagttctttgttaatggggaatgggatatacatcatctatttgatatataagttaataatcatactttttgttagcagtagttaaatgataagaactaaaaagaagcaataaacatctccatctctaaaacagtcttgcaaatatgcagtgagcatctactgtatacaagcactatatcttcatatttagattacatttgctattttgcttttcacatgtgaacttaagtgaaatactctaaggagtattgcaaggtaattgcccctataaattacataatttatatggctctttaacttttttagatgtaaaatgggaggaggagagcgttgagttggagtgtattatttctaggattctttctagcccacaagtcgaatcagaaaacagtggctcatgcctgtaatctcagcactttggaaggctcaggtgagaggattgcttgaggccaggagatcgagaccagcctgggcacatagtgagaccacacctctacaaaaaaaaaaaaaaaaaattagccaggcatgatggcaaacatctgtaaccccagctactcaacccgctgatgtgggcaaattgcttgagcccagggggttgaggctgcagtgagctggatcccaccactgctttccagcctgggtgacagagtgagaccctgtctccaaaacaaaacaaagcaatcagaaatgtacagatctttttccacagtttgtgcagaacagtcacttctaagatatactatgaaagtctattacaggagcaggaactagttattcctttctgagaattagatataacttgaccaacaaatcggttttttatccttcatatcatcttcagaagtagaagcaagatatatgatcaaagtctttttaaaaatagcagaataccggggtttttattttatattttcactctgcacaatgctaatctccttaacatttgatgacaaagaaaaaacttggaatttgtgtatgacaaaaagaatgacttatgaggtgaatcgaaaacactttttacagcctctgtcttcctaaagtttattgtttttggaaatagttttttggcaaatattttgttttgtaagttttacatttctaaagttgaataaaattaaatgtttagcaggtgcttgttgtaatagaagctataatattttaactatgtcatgaggtatctctgaggaagtgtttcttttttgttttttaatggtaaaggatgtcagtaatatctctcaaatgtcaaattaatttagggtgtgtactttctttttccctatgatgacgtagataggaaaatcgaatgttccaaacaactcatggaaaatgttccacttcagcgttatttgtaccacaaatgcagtgaaatgcttttaatggaatccagagtgataggtggattatgacatgtggggagatgccttcttgaaataggacataaatcatggttttttttttttttctgagacggagtctcgctctgtcgcccaggctggagtgcagtggcatgatctcagctcactgcaacctccacctcccaggttcaagcagttctcagcctcttgagtagctgggattacaggtgcccacgaccatgcccatctaatttttatatttttagtagagagaaagtttcaccatgttggccaggctagtctcgaactgttgacctcaagtactccgcccgcctcggcctcccaaaattctgggattagaggcgtgagccaccgtgcccagccaaatcatgtttttgaacttgttttaaatatctgtgtgtgtgtgtgtgtgtgtgtgtatgtatttttttttttatggagtcttgctctgttgcccagggtagagtgcaatggcacgatctcagctcactgcaacctccacctgccgggttccagtgacctcagccgcctgagtaactgggattacagacactcgccaccacgcccaactaatttttgtatttttagtagagacggggtttcaccatcttggccaggctggtctcaaactcctggccccataatctacccgccttggccttccaaagtgctgggattacaggtgcgtgagccaccgcgcccgaccagtattatgtatattctttttgtttgtttgttttttgagatggagttttgctcttgttgtccaggctgcagtgcaatggcgcgatctcggctcactgcaacctctgcctcccaggttcaagcaattctcctgcttcagcctcccgagtagctgggattacaggcatgtgccaccacgcctggctaattttgtatttttagtagagacggggtttctccattttgggcaggctagtctcgaactcccaacctcaggtgatccccccgccttggcctcccaaagtgctgggattacaggcgtgagccaccgtgcccggcctgtcatgtgtattctaattataaataattttcaaccaaactgatatgtttggttaagctggggaaagttttcagaaaatagagtacactgagatgaatttcatgaactgtacccaccaaagccttgtcctggttaattcaaatttataatgccaatagtttaaattagcatttagcctttaagtgacggtggaatggtgaggcatatgatgtttttataccaaacactccgtgctccatgtcttttttggagtttacacttttcaaaaacaggcggcacttccatgtgtttatttccccttcatctctgtttagtgaatgattggtttcatctttacaaagattattctggctgtagtggggagaaccagttggagatatggaagatgtatgtggggaggccagagtatcgtggcagtctgcctgagagatgcagtggccggggtttggtctaagatgttattggtggagacggagagaatttgcggtatttgagagccactccagcctccattatttctaattctatgtcctctacccttctctgtcatctctccactgcctcccagccccttccactgtgccccctgtattgcccactttcagaccaacagccttttgtatcagccttttctggaatgttccactaattacttaccctaactaaaaccttagggtagttttgttctcataccacacgcacctccaagacaggaggtgggattactttcctccttgtgtcattcaggacgactgctccgctctttcttgtaagccctttcttttttgaaatcacatcatcagtcttcactacctcatcttcctcttggcaaccttcagctccccttccctgtatccctctccctgcacgtgaagaccagcagccagttcctggtctgtctgtctgtctccatacaatcattattccctgtattttctctccatccacagacaccactcctgtttttacatcctttatccaatccctggcctggcattatagtcactcactcatgaatacccttaactgctcactccttcattcttccatcagtctcaaacttagaggaactctgcctccaccttccctatgcctgcgcatgagcaccttaccatggctggtgaacgtcccataccaagggcacagttaacatgcgtctgctggtcagggccagctgagcatcctacactgggcagaagggttgctgtttctctgataacttctcctcccttatcctcagtgattccttcctgtcttcaccactgtattcacatgtcccacgctcctgctgcagctgacactacttctgaatgtccctcttctctataccaccagggctctagatctgatcaccatgacttttagttttatttcctctaattcattgtccaagctatagcctgcatgatctttcaaaaatggacagtgtggctcacacctgtaatcgcagcactttgggaggccgaggtgggcagagatcaggagttcgagaccagcctggccaacatggtgaaaccccgtctctactaaaaatacaaaatattagccgggcatggtggtgtacacctgtaatcccaactactcgggaggctgaggtgggagaatcattggaacccaggcagtggaggttgtagtgagccaagatcatgccatcgtacttcagcctgggcaagagagtgagactccacctcaaaaaaaaaaaagaaaaaagaagaaaaaaaaggacagcagacaatggcactctgcaggtggaactgcttcatgtttcccactcctgtccctgttcttcaagagccggcctccccttctctctgctccatccacatgggtttcaaagaagcttagctctttctcaccccagggtttttttctttctttttttttttaaatatgatattccttctagaatattcccacacacccatcactagcatacttaattcctactcacccttccagtctttgctcaagatcacctcctcagagaggtccttcttcctgctgacaagtaaagaataatgagaattcagaagaggctatagaaattggctgggtgtgatggctcacgcctgtaatcccagcactttgggaggccgaggtgggtggatcacttgaggtcagaagttcgagaccagcctggccaacatggtgaaaccccatctctactaaaaatacaaaaattagccaggtgtggtggtgggcgcctgtaatcccagctacttgggaggctgaggtaggagaattgcgtgaacctgggaggcggaggctgcagtgggccaagattgtaccactgtactctagcctgggcaacagagcgagactttgtctcaaaaaaaaaaaaaagaaaagaaaagaaattgctgaagatttgtgatttttcacaatacagttttagtagtcagattatagaaggttatggggaaaggtgtatggtaagaaaatagctgcagagaacttgttttagaacctgtcagagaaaggaagagacacagttagggagctatggagtcgtgcatgtgtttgaaagcagaggcgagacgccagtgtagactgaaagctggagaacagcgaagttaaaaggattaactaagaagcagagagggcatgagatgggagtgaaggaaagagcatggctggttaggcgagaaaataaggacttgggcctatggcttcgattttggtaaagagaagaagtcatctgctgagagtagggggcagggttataattaatgtaagtttggtgcacttgagtccttggtcaatttcagggcaaattatataatctttgtttacattagcatggctgctaaacacctctagcgttgtgtctttggatagtttatgaaatacagagttttttgcataatttaaactactccagtgttttcacagtgctaagacattttgataatattgtctgccttgaaaggagcagattttacttgtgcctcaggatattatgtcatttatcacttcacttttggcttatttttctttttatccccacactgaatttgatttaatttgttagcttttattgtcaattaaaggcaaaatgtcaaaaagttctaacctcaaacagaggtatgtgagcaaaacactcactttataatattggaaatagccatattagaaattaaatgtctgaggtcagatatggtggctcacgtctgtaatctcagcactttgggagaccaaggtgggaggactgcttgagcccaggaattcgggaccagccctggcaacacagtgagaacctgtctctccaaaataaattaataaatatataaatctggaggtggtagctcgtgcctgtagtcccagctacacgggaggctgaggtgggaggattacttgagcctgggaggtcaaggctcagtgagccatgatcatgccactgcactccagcctgggtgatggagtgatgccctatctcaaaaaaacaaagacattaaccatctaaatacatctgaaataaaagggctttgtaaccacagaattatagatgtagcagagatatttgaccttgttagttcaggtctctttcagatgaggaagagagattatctgaaacacattgtaaaatttggtgttgtagttgaagtctgtaaatctacaaccagagaaatagaaattagtatccacctgttaactcaaatgcagtttaaaaaaaacagctacgatttattgtgtgcctactagtgaaaggtctgaagtggttgttgattgcatattgtaatgacagagaaaatgagcacacttcacttgaaaaaaaaactttagagtggatgtagtggctcatgcctgtaatcccagtactttgggaggccgtggcgggccaatcatctgaggtcaggagtttgcaaccagcctggccaacatggtgaaacaccgtctctactaacaatgcaaaaattagccgggcctggtggcaggcgcctgtaattccagctactcaggaggctgagacaggagaatcgcttgaacccgggaggtggacggaggttgcagtgagctgagattgcgagactgtgctgcagcctggtccacagagtgaggcttaaaaaaaaaaaaaattaatgtactgtatgtatatatggtacaaagttcaaaaagtccaaatggatttgtggggaaaaacaagcctccctttcatacctgttcctcagctattctgtcgctcttaagcatttgtccagagatactctttgcatttaaaaacacacatgtatagttatttttttcttaaaaaatgatagcacactgtatacactattctgtattttcttgaaaatggtttcaaatcaatatgtatagagatgactcatttttttaaagaaggggcactaagtttttacattctacagaatatgtatttatttgatatactttaaggaaatctttgctgggtgtaaaattgggggacaacatttccttttttttttagtacttagactatattgctgtgtggtcttctgtatctgtgttgcttttgagaaattagactgacctgagtttttttcctttcttgtacatgatttcttattttttattttttttgagatggagtcccgctctgtcgtgcaggctggagtgtggtggcgcgatctcagctcactgcaacctctgcctcccaggttcaagcgattctcctgcctcagcctcccgagtagctgggactacaggcacccactaccatgcccggctaatttttgtctttttagttgagacgaggtttcaccatgttggtcaggctggtctcaatctcctgaccttaggtgatccgcccgcctcggcctcccaaagtgctgggattacaggcgtgagccactgcacccaacccatgattttttatttctaacttaatacctccatactttctttttattctcttcttttctttcttttccttttctcttctcttttcttttctttctttctttctttctttctttctttctttctttctttctttcttttctttctttctttctttttttttttttttttgacagcattttgctctgtcgtccagcctggagtgcagtggcaaaatcatggttcagtgtagcttggaaggcctgggctcaagcaatctcccctgcctcagactcctgagtagctgagactacgggcactggccatcatgcctggctaagtaaaaaaaattttttttgtagagatggggtctcactttgttgcccaggctggtttcaaactcctggcttcaagcagtcctcctgcctgggcctcccaaagtgctgggcttacaggcgtgagccaccatgcctggccataattctttctctagccttaaagttctataaacataatcaatccacaaattccaggttttacttattttgacaagttttatcctgttatgtatctttgaatgtacatttgttctttttgctttgtgagcctctttggacagttacatattctttctaacccccttcctcctccatatctgttgtcttctcagtaaattggttttatattgttagtcttatctatttcattttatatgatttcttcagtccttatctttcttttagtcacatttattctatttttggttgcttcttaatgtggcttttatctcaataatgttatttttctctccattttttttctgagttctatcagcttgactttcatttccttctgttgttgtataatctcttctttgaacctttgtttttcttctttgagctctttttttatttttatttttttaagaggggtcacgtttcctatggttgcctttgagactttggagaactatttatctgaactcttcctgtgtttctttgagtagttcttgtgttatatgctactaatttacctttttctctgagttttttttttttttccaaattgtatgcagacatcgagtattggttgttttctgagtgttgtttatgttgaaataggccgggagggtaggtgaagcaggctacagccttttttttggacatgttacttagtcatttctcaccaaatctgttatttagtttgaaagggtaggctggttcttcgtgtcggagtctatcacgaaatgccacctccactccacatctgccccttcagtgacccttgactgaagggttgcatgtacacagtggatctggcatggtaacaaggattcttcggttcagccagcccacctttctctggtattaacccgtggttcaaagagacattctctacttctcctttggcctatacttccatctagattccctccttggatgctagcatcattagaatcactgtacctcttattcgggattatgtatctgtgtattgctagaagcctgagaaggcctgtgatggctttccacacatcccttgccccgcttatactggcagataggtttcagtttatgatttggagtcatgatagcttccttgtttcagttgtgtagggaagttgcaaatttctactcatgactcattgtgtagatgatgaaatgtagtgtattttctatcacctatcatctttgtcagaggccctctacctttagtagtggatggtgggaagaaaaatttgtgagtaaacaggatcttggcctctgttggtttaaacagtctctttggggtaatgtgtttcagttttcttctatccccagcttctgctgaggtgaggtctgggagcagtgagagaggcctttgggaatgatgcttagatctgcctcgcggcgctggcatggggagaacgtagactcacacgcagtcttcctgaggctttgctacgagggcctgggtgggtaaccactgagtaacatctctcgctgttgaggctttgaaagccttgaggaggcttctcctgtccttagacctactacagtcggcccatgggctctgcatctgtggatccaaccaactgcagatatttgggggagcggggaggaaaagatttggatctgtactgaataggtactgccttttttccccccatctttattccctaaacaatagaggataacaactatttagatagcatttacattgtattaggtattataattcaaaggtattataggtaatctagagatgattcaatatatggaagaatgtgcctgggttagatgcaaatactacaccattttatatcagggacttggagcatccccggattttggtatctgcagggcggggcgggggtggtgctcctggaacccgcctcccatggattccaaggatcacctgtatttgcctgcagtcatcatggagttccccatactgtgtggtcttcatcctgacccagaccttcactggtcagaacttcaggattcctatcacgatgtacttgggttatttgcccagcccctccctccagccatgctgcgctgttgctgccacgccatattcagaatgccacaaaactgagccctgggcttcactgcaagcctgcagcctcccctacactgtgtcccagaagcagacctcttgcctggatatttttagggcaccttatacttgtcagaatgttttcagcaatctttgtccactgccacccccgccctatccccaagggtccagcagaagaggaaatagtgaagtctctgataatctgattttaatgagtatcttttaagagaaataagtgatagtgggggaattgttagggatcatatatcatagttctgctgcaggtttatctggaaacttgagcaagattaagtatcaccttgttaggttgtctaccatataataataatgtcatctgtaagcctctcatattaaagagttagggaataagcatcagtgagtgaaaggaagaaaaccaatagttctttcattttaaattagctatgatttttaaatttccattacttttatatttatttggaaattattttttttcttttacgagtatccctgttttgaaagattatgggtctttttttgcatattcatgaaggatgactggatgaaatcagtcatttatgattgacagaaatatgacagaactttgcaaagtttgaatggacttttgatattcaacaccaaagaattttgtctaattaaagcttctgtttaattaagataacaatgcatagtccttcattaaaattaacacagaaaaagttcttccttggtccttggagaggatattatatgcaagccctgttgtgtgggttgcaagatgtcactggaatttatatgcattacttgtctaattgcagtaaatgtagcatgtccagataggtttcgagttagaaggctgtttgttacttacggaaatcacttgaagcctcagtacccggaggcagctgttcacaggtccttcacctctccccagagatgactgggaagacgctgttgttggaccctgtctttcttggctggagcagtaaacatgacaggttgtttgggagccatctgtttaaaatggctgctgctttgtatgcagcaatgaacttgagatcagttttctgtctttcttcatggtaatggtcttatttggtgtcacaacaggtggaagttgatgggtcgaaactaaatgtgaccagcacgtggaacctggcttcgcccttattgtctgtcagcgttgatggcactcagaggactgtccaggtgagtgttgtaaggatttccttagagggcctcctcaagtccagaatccttgtcagcacctgtgtggctaatacttagagctataggagggaaaagctgtattttattcaccttatactttttacagtcgaaaactttttcttttcttattttagaggatcttaagttttaacctgagcatttaatgttttcttttttcagacaatccaagaaggttcatgtattgtactttgttgtaaacaaggaattctgcaggcttttctaaaaatgctagattagctgtttttttttttcctctgtgggtttttagttgtaaaatacaacttactttgttacctttcttttctgtgcagttgaaattacgtagtgttaggctagtaaaacttgtgttattcaggttgactttccacagctcactgatgtcctttaaaaatttagtaatcttaacttattaatctttcttttcgcctcaatataaaatgtcctgccttgaggagatgccttggaacccagagtcgatagaacattttttgtaacctgtgacttccattttaaagtagaaagttatgaaaagagattctgccaaaattcttcaccttacctcatatttgaggtttagcgttttaggaaaaaaaaaaaaatcatggaacatgtggctatcacaggctaataaaaatctagccccacccatagcattaaatgctcattctttgttcttttttatgaaaatcatcttaacttgattttacacaggaaactggttttaaaaaccttgagaaatcaggataatcacagattaagactacttactccatacctgattcttatctacctctatgagagaccgggatagtggacatcagaatccacaaaaactatgtgatgactgaactgatttctaagtcagtttcaattgatatattatctctatggttccaagtaaccttgaactcttggtaataagccctatattttgactttggttttgtgacttgtcccagtatattttttctcatttttttaattttctaactcctgtcttttctcatattttataacttaactcatattatataactttatataatattatatcagtataaattatgagttgaaatagtttaagactcttgaaaaaaatatcactacataatttcacattacttagatccatgtattattatgtctttaaaaactgtggtgtctgggcacggtggctcacgcctgtaatcccagcactttgggaggccaaggcaggcggatcacctgaggtgaagcgttccagaccagcctggccaaagacagtgaaaccctgtctccactacaaatacaaaaattagccgggtgtggtggcgggcgcctgtattcctagctacttgggaggccagggcaggagaatcacttgaatctgggaagcagaggttgcagtgagccaggatcacgccattgcactgcagcctgggcaacagaacaagactctgtctccaaaacaaacaaacaaaacaaacaaacaaaaaactgtggttttgttatactggtttatgttcgatagactgtacagtgcatcgaatatgttatggctcaagtgtttgtcagagggacatagtgttaactctcagtagtcagaagaaagaggtacaaactcctattatgcaaattttttgtattgtgttactttcatcatccttttcagtgagtgcgcagatagttgtcttgatggcacttttacatgtagaatttatagctagattaatagggatacatatgtagaataatcaaaaatattttccctagtgtagggatcatgttcggtaaatccctttttaatcctgtaagtactttgctactaaaagaattaatgtgtctgaaataagtgaccccttaaagagagatcccttgactcttaggaagaggtcgttgcatcaagttaagtactctctaattggaaggaaataaactcagagaggtaaatggtgtactaggaaaaacagtcgtttacctaaaaaaaaaaaaaaggtaaggagagtttttccttgtgaaaggggatggattttatttactttctgtaggcattagcattatatcgactctttccaaaaatgtaatgtggcccctatgaagataataacaattgtagtaataataaataacacacagtgcttactgtgttatcaggtgtagttttaagcatagtacagatatgaacttctttgatcttcacaattgtatgaagtaggtgctatttatagttttataaatgagacaactgaggctcagagaaaagtaagtgacttactcaaggtcaccagctagtaagaggtaaagccatgattttttttttttctttttaaatgagacaggatctcgctctgtcacctaggctagagtgcaatggcacaatctgggttcaccgcagctttgacctcccaggctccagcgatcctcccacctgagccccccaggtagctgggactacaggtgtgcctgccaccacacccagctaattttgtttattttgtagagatgaggcctcactatgttgcccaggctggtttggaactcctgggctcaagcaaccctgcctcctccccgaccccccctaccccccacccccacccccaccccccccacaccctcagcctagatccatgatttaaatccgagcagtcttgctgtaggtaggatccttgccatcaagcattgcaggatgctgaggcaagctatgtaacttcctgggcatcacaaagctaggaagaagcagagcaaaaacttggtccgtggcagtcatgtgtgctttcccccactatgctatagtactttgcgatttttcctatcacattcttcttcaaattataattacctgtcattcatgctttaaaccagagatgcttaaactttaatatgcttcagaatcaactagaagccttgtggaaactcaagttgttggacccacccatagcttactctgatttagcaggtctgggctaggtctgcatttctggcaagcccccaggtaatgctgctggtctgggccacatttggacaccctctgctttaaacctttgtagtcagagaatgagctgaggagtggtgtgccccagcaaggtgggtaggaaccgagtcacatgagccttattaaggacataggagaggctctactttatccctaggtcagtagggacccgtggaagagctttcagtaaggaagtgatgattgaacagaattgtagcttacgaggtttttttggtttttggctgctttgtggagagtggcttgaagaagcatgaggtgaagattggaggcaaagagagaagtcagcagatgttagggattcggaggtaagaagtctcagcagctgtggggatgagggcactgtgtgcagaagggatctgcaagcgtgacaggagaaagaactggtggctttacagtcatctgctgatttctcttctgaccactgttagcatgggcaaacctccaaattctattcctgactcccccttttctctctctgcttgcttcctgggctgcattgctccaagagttccagcttaacacctccaagcagatagctacgaaatgcaattataagtgtttgtgtgtctctttgcaattgtttattctgagaaataagggatgaatattaccaaaggcatttttcaagtgattttacagtaatcacttgaaattgattactgtagtaattgattactatagtaactgtaggtactttaaagtaataactacaattcttttttctctggatttttgagcatacatataaactttatattcttaaatagtattaaatattactatttatcattaacttgtatcattaaattttattattaaacctcatttaatataaaataatatgtattattattattttgagacacagcctccctctgttgcccaggctggagtgcagtggtacgatcttggctcactgcaacctctgtctttcgggttcaagcgattctcttgcctcagcctctggagtagctgggattacagacacgcactaccatgcctcgctaatttttgtatttttagtagagatgaggtttcgccatgttggccaggctggtctcgaactcctgacctcaggtcatccacctgcctcagcctcctaaagtgctgggattacaggtgtgagccatcacacccagccaaaaatatttattatatctatataaaagctaaagaatgacccaatgaaaacctgtttacccactatctagattaaaaaaaagaaaacaggctggtcactgtggctcacgcctgtaatcctagcctttgggaggccgaagcaggcagatcacctgaggttcggagttcgagaccagcctgaccaacgtggagaaaccccgtctctactaaaaatacaaaattagccaggcatggtggcgcatgcctgtaatcccagctactcaggaggctgaggcaggagaatcccttgaacccgggttgtggtgagctgagatcgcgccattgcactccagcctgggcaacaagagtgaaactccgtctcaaaaacaaacaaacaaacaaaaaaccaaaacattatcagtgctatttgtatcattcttccttgattaaatcctcctttccagtgtccctgaagaacaccattatgagttttaaattgatcactaccttgcttttctttagggatatttatgaatacaccaacactgtgagcagtatcttgttgagctgctcttgtttttgaaccttgtaattgcccccatcctctctgtgttcctccaggagttgtcttctccccaccagcatgatgtttgtgagcctggcccatgttgctgcctatagctgcagtttatctacttccatacatcatattaatattaccaccaattacttattctcctctaaatagacatctgtgttattttccttattttgttgtcacagtgatgcttgtatgaacaccctacttcctgtttcctcttgacataggaggttctccaggtcatgtgccggtataacagccatgctgtggggcctgtgctttctcattcctgcatggcaaggccaggtgggtttctctgtgtggctgtaccagcttatgtgcccatcagtagtgaagatgatagtcacaatgagaacaatgaactaaccttattctgtacttattatgcccggcactgactgttctaagcactttgtatgtatgaatgcccccaaaaacccaataaagtacgtactagtgttatccctcattttgtatttgggaaaacagaagcttgtagaggctaaattgctttcccatctggtagtaaatgggagtgccagaatttgaaccaaggaatctgtgcccttaacattttttttcacatcctggtgaacccttggccttcccagactacttaggtttttcctgactggtgggtttagatggcatctcattatggttttaatgtatacttccctgattagtatgacaatgaacattgaaaatatatatttattggctctcttgttttctcttctgtaaaatatctgctcatgacttttgcccactttttaaattggattatctttttcttattgactcataaaagttcttcctgcgttatggctcctttttgtcgtatgtgttgataaagtagcttctgtttttattgttttaagttatccaagttaagttttaaggcaagatttaatgtcagaattttcaatattttcctttatggtttgtgtgttttgcgtttgtgtagataatcttgttctactcctaagctcacaaagatacctatattttcttttaaacctttttaaattgtgcttttcaaagttaactacttaatcctcatgggattgatttttgtacacggtatgagtggctcacgcctgtaatcccagcactttgagaggccgaggtgggtggatcacgaggtcaggagatcgagaccatcctggctaacacagtgaaaccccatctccactaaaaatacaaaaaattagctgggtgtggtggcgggcgcctgtagtcccagctgcgtgggaggctgaggcaggagaatggtgtgaacccaggaggcagaacttgcagtgagctgagatcgcgccactgcactccagcctgggtgacagagtgagactccatctcaaaaaaaataataataataaataaaataaaatacagataccaggccgggtgtggtggcttaagcctgtaatcccagcactttgggaggccgaggcgggtggatcacctgaggtaaggcgtttgataccagaccagtctgacctgtaacatggtgaaaccctgtctttactgaaaatacaaaatattaaccggggatggtggtgcacacctgcagtcccagctgctcaagaggctggacccctgcactccagcctgggcaacaaagcaagactccatctcaaaaataaataaataaataaataaataaacaaacaaacagataactcgttatgccagcacaatttaatgatagtcgtgcttctcttcccttactaccttgccaccacctcacctttccaaccccgaaattctttaaaagcggtttctgtgattctcaattaattgtaaataaaaagatgatttttcgcttaatacgatcctcagtatatttgcttctgtgagctctcagtcagttgcactcttttattttttgttaatcttctggaaacccttagccaagggcatcagatgatatttgagatacaccttagaaaaacgtgtttgtgaatcaacaggcaaattgggaagtattcatttagggaagtaatgagagctaaacatggaaaaataggttggaggaccagatagtgaatgagagcctgaagaatctatgcttttcagtcagcagtggagatattacaactttttgcagagtacagtaacgtccatcaaaatgccattgtagaatattaatgtgtcctcataatagaggaggggttaagggattgaagggtgaagtggagatggagttcatttagaagacaatcctattactgccttcatcctccactagggtgcaagcagtgtagagaaaaagggggttgagtttgagagaaacctatgtttccatgcatagaaaccactttctgtttctatgaatttgactactgtgggtatgggtaccgcctataaatgaaatggtatagtatttgtcttttgtgactggcttatttcacttagcatactgtcttcaaggttcatccaggttatagcatgtgacaggatgtctttcctttttatggctgaataatattccattgtgtgaatatactacatgttgtttatccattcctctgtcaacggacatttgggttgtttctaccttttggctgctgtgaattatgcttccatgagcatgggtgtacaaatatctgtttgagtaccccattcttttgggcatatgcccagaagtggaattgctggatcacgtggtaattgtatgtttaattttttgaggaacctccatagttgctgcaccattttacattcccattagcagtgcacaataatttcagtttcgtgccatctttgttaacacttgttattttctgttttgttttgttttttaataatagccatcctattgggggtgaagtggtatctcattgtggagcaggacttatctagatagtaactgaagaaaaagcattccgaatacttctaggatgtgtccttcctatattggtattactctgtaaccagttcactgcacaagtggcacttttttcagtccaagtagaagcaagtttcttagagctgtttttttttttaaaccctttatttcaacttctttccttcccatatataaaaccacataccattctaacagtctgtaatgttgctaccaggtaataaacaagccatactgtatttgggagaggagggtgtgtttcaaagtctagttcattgtaatatcaaaactggtaaaacctctcctctctaaactcagtttgacctcacactgagaaacctttactagtgcagaggagaatgttgctttcttcttgcttgctttatattgtaggggcaaaagggtgtgatcccactcctccccatcataagggtgtccatggcagacactcctataacaaaagacaggttaacaagagaaaagtataactgatttatttaatcaaagttttatgtgacatgagagtcttcagaacagagatccaaagatacaaggaaagctgtccattttaatgcttaggtttaatgaagaatgggcagccgtgtaaaactgatgggacaaagaatgtaagtgaatgctagtaggctgagaggaacccagcaaggcctatgttcagatcttcctggcctctcttgtactatttcttcctcccaggtatgggacaagacccatctgggatgacggtcttatgacctgctactgttgtagagaagggtaggccagagaatttctttatgagcagctcttagaaaggcagggaggggttagagtcctctttctggtttcatagttgtctttgcgggagaggaattctgatgtctgtgactcatctcaggagagaatgaggggtgagagacaggaaggcagaaggtcagagatcttagttctgaggttacttctgaggccttctctttggggtatcattttctgagcctcaacaatacccttttctacttcagagctgctatattgggtctctcagaatttgcagtatggggtaaagatgagaagagcatggcaggaagaaccaggttttctggggcagaggcaacctggcattcactctcttggggcatggcagatgtccaaagctggccggtagccctgggatactttcatgtggatttgggggaacttctcacctgcagaacacttaatgcctcctgtcttttccagttgcctttggtctcctgagcaactactgtgttgactctgaatgttctcactgggcatggtccctcataatgaccccgcctgcttttctcctgcacaatccacgtctggccacaggaaatagtaataagtccttgcctcaccaaaccaacaaagtacaagcttctcttcttggtctgtctctaagaattcgcatgaataagtgattctcatgaagtcgctttcacgtagcttaagcagagttcagccttaaattctaagcttaagaattcgacctcctcaaattaattttcctcttttattcttttaaggtgggagatggacagtcactggtcccacagcttcctagcacattctaccaggtagccttggctagcatctgacttaaagatgtatgggtacttggcgtctacttctttttgttgctgaacccctgtgattccatgaaaagtagtgcgttcatctgttcttatattgctataaagaaaaacctgagactgcataatttatcaagaaaacgggtttaaatggctcatggttctgccagctgtacaggaagtatggtgccagcatctgctcagcttctggggagggaggcctcagggagctttcagtcatggtggaggcaaagcaggaggaggagcatcacagggcaagagcaggaatgagggtgagagagaacggggaggtgccccactcttttaaacaaccaagatctacctctgtgatccaaacacctcccaccaggccccacctgccatgtcgagaatcacatttcagcaagagatttggagcggacacatccaaaccatattaaggagcatttaacttctttatctgattagatgagtaagtagttgggaaggcaacttacctttgcttcaggaattagctcccgattcatccagtccgatcacgtgtattcatgttcctggttttcattggtaaacttcataagtttaatattacccattaaattcctttaaaagtaagttgtattttggtgtatactgtcactggtagagggtcatgattgcaagttatccaggttcttggcgttttgaacaaagaattggacaacatgtccagcaaagcaaacaatgaagcaacaacagaacaaaaacagggatttattgaaaacaaaagtataggcggccaggtgtggtggctcatgcctgtaatcccagcactttgggaggccgaggcaggtggatcacctaaggtcaggagtttgaaaccagtctggccaacatcgtgaaaccccgtctctactaaaaatacaaaattagcctagtgtggtggtgcatgcctgtaatcccatctacttgggaggcaaagacaggagaattgcttgaacccaggaggtggaggttgcagtgagctgagatcgagccattgcactccagcttaggcaacaagagcgaaactctgtctcaaataaaaaaaaaaagagagagagagaaagaaaatgaaactgtactccacagtgtgggagcgagcctgagcagtggctcaagggcccggataccgaatcttcttggttccaaatacctgctagaagttttccattgattactttatactcacctcatgtaaatgaagttgcagcctataaggttgcagaaagcagccaaccagaggctgaagtgaagttacaaaggtcacactcctgtgcaaacatgttgcaaagttatactcttatgcaaatgaagacttggctggcaatcagtctgattggttttggacagcaaccattcagagactggagtgaagttacaaagttgcaaagactggacccacagtcaatctgattttctgatttgttattggatgggaaattgactgtccgatttcccatctgccacacagaaaaggtgggtggtttgcaaagggagtagcccctggtccttttattacttaggtgtggaaagctaggattttcctttcaatttagttctaggaagttggcgtgaaacagccttgggttccctgcctccagaccctattctcctgcctcagtgctatcattagaataataaatttcataggttattaacctcttttaattgatctaaatcacctgtttccttttggatttgacttttaattcccactgccctgctgacttctcggcgcatataaatgctcaataattggatgaataggtgtgggtgggtgaatgggtaagtggacagtcatcttacattatagaatgttttgctgattctttttagttcctgacctcccaacatttgcgaaatccatactccattagtgtggctggtggacctctcttgatacagaataaccatggtttctgtgagagcaaaaagaaacaagagggctcccaaggacttgcccacagaggcgctttgctcaccaagcatggttctttcctgttggcctctgtttgctctgggtagcacctcggctgttttaggcccacagtatcacctattgacaagtgtagatagctattgatagtatcaataggtgtaggaaagggtctgcctcctgctattcctggttttctctttctcaaaggcttgtgcatgccctaggctttctcactgtccgttgctgggtgaggtcatatcagctcttactcccacagaaccacccgcacctgctttaagtacgctgcctttctgacttcaagaaaatcatactctcggaaaaagtctaatcattgtggataactttgaatatggagctagtgatatattacctaagggaggaggaaatcacatattttgaaatgataaagaaccaggggcataaacattgagaactcttgaaaataattaaaagttctcttcagaattttaaagtctttttctattaatttctctaataatttagccaacttttcttcaaatatcatcatttaaggaaaatgaaataactattttatatttatttgtttatttgtttttttttttaccagtgtttctgttttcattgccgaagtagtcagttggtaatgacgtttattaaatagccttatctaatagaaggctaacacaagccatatttaaaatttctttgttttaattaattagctctttgttttgttttgtgtttgagacggagtccgttgcccaggctggagttcagtggcacaatctcagttcactgcaacctccgcctcccagactcaagcaattcttctgccccagcctcccaagtagctgggactacaggcacctgccaccatgcccagctaattttttgtatttttagtagagagggggttttaccatgttggccaggctggtcttgaactcccgacttcaagttatctgcccgcctcagcctcccaaagtgctgcaattacaggtgtgagccattgttcccaactgtcatttaaaatttcttagtagtcatattaaaaaagatgaaacaagtggaattaattttactaatacattttatttaaaccagtgtacctgtggagacaaaagtgattccatcttaattgctaatgcaccatgttgttttttttttcttgaaggcaaaccttgttgttttaatgtaatttattttttattttactttttttttaatgatagggtcttgctctgttgcccaggctagagtgcagtggtgcagtatggctcactgcagcctcaacctcccagactcaactgatcctcctgcctctgccttctgagtaggtgggactgcaggcctgtgccaccacatgcaattaattttgttgattttttgtagagatgagggcacactatgttgcccagaactcctggactccagtgatcatcccgcctctgcttcccaaagtgctgggattataggcctgagccaccactcccagcaaagccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttctgtctgtaagttcccccaagaaaacaccctttaccaacaaattgagtttctttgccttattctttggtttcttggctccctccgcatttgggggctgctttgcatttatggccctttcacagaataataccccaaatgttgtcatttcaacatgaaagacttttaaaaattactaatgtgataccagaaacaacatagacattggcattaatacaacagtatcttaaacaatggaacggtcagagtggaatgtagtcctaccaaaacaatggagttgggtttaacagaaaattacactgcttcagttttaaaattaacattaaatacaattgaaaatttaactcctcagtcacaccagtcatatttcaagttctcagtagctacgtgtagctagtggttactgggttagaccactcacaggcaaaattttttgtaaaccagagagtgtttacagatagagaaaactctacataatggtttttaaagtattcccccttaatgtcaaccacagttttggtttttatctcttaaaatttggaatagatgagttgaatttatttttaaacagaagatgaatttatcatctagctgacaaactttttaaatttcccattagaagatttaaaaaattacaaccatttttaaaacgtggaatgatttcctgcctgtggcatataattaaagtgatgaaacaaacagaagattcgctgtgtcctggccatggtgagctcactctctgttttcctcacaaaccccagaacctttgtagtgtggaacctgctggatgaatagaagttttttattttattttatttttttactatgtctatattcctgtgaagtaatttttttgaccttgaaagaagttcttcaattttgctgttctctatttcttacagtgtagtttgtgtaccgggatttaatgtattgtttgtcgttagcgttttacatactagattttcatcgtgcatagtcacgttgtttgaacatttgcaagcagagccgactaactgctgttggcctgtttctttgtatggcgtgatttcttctatccacctgctcacagcaggttgccttcaggcctgaggagtagctaaatacttttgaaaatatcttgagatcctgctaaggtctaacaatttctgcatttgtgtgatgtgaagctattcatgctgtacctttgaagacttttttctttctatttctcatattcttgctcaaatattttcaaaagaagataaatttattataaataacagtgcagagctgattgtagcaccactgcattctatattgaataggtctttgatattcagctaagtggaactaattttctatgttaaagcagacaaatttggaatagtgtcacatgaatctcatgttatttactgaagaataccagattaaatggattagttgtgaaatgactagagtattaaattatatatatatatatatatatatatatatatatatatatatatatatatatataaaacgtgataacttaaaatgcccagtgggcctatgtaatataaaatattacacaagcacatgaatatgatggacgagatgttattctgtttgcagattgtgaaactatctgtagtatatatacaaatggttgtccacacagaatttgaatcaattttaaaattgtaaccttaaatttcagttttgaagaaaataaattgttgattttcatatctacttgagaggaagttaaaaatgttattttcttttcagttttttttagattaaaatagctcccacaccctccaagaataaactttagttttaatcctaataactgtttatagatagtaaaattaatattttaattagaaaaataaagcggcatacatttttgcctgtactttgctggtacacaaatgaattgggaagtaattgtcttatgttttcagtcctaaagtgttttacaggttttaaaaatgttccccccacccccatctgtttgaagtcattattattttgtactttacacatgtgatttctctagaatcattgcatgtgacatgacactctcaggatatataggatatataaatatataacttagaataagtagaggttggtatttttcgaatgaagtaggaaatgaaagagtaattattaaccatatcctttttacattcctgacatatcaatacagctacacatcttagaaacaagctcaccagtagaacagaaataactctgttgactctgctttaaaatatttcaaggcagtttaacagctgggatgtatttacagctatggtataaagtattaattttgatgcaaggctacctgcttttgtaatgtagtcctagaagcttagcagttttctgggttttataatttggagttgcttttaaaatttaaccgaatgggaaaatgtctttctgaacttccccttcccacacccccacacatacaagcttttctcctcttctgttaactagaaaattatattttcgttgctgcctgaggaagagaattttgagtagtataaacactgattgtagtaaatgtggaaaataatacaaacagctgcactgcagaccgataagacaaatcccacagtaatggcctttaaaacatattaccaagttggaaatcagtgaggggaaaaagaaaactattactatttcttcctcttactgttcagtgacattatttttaaaggtgaaattacctctggttttattatcctaggaaggtatttttggaacatttgatttattgttttgcaaatgtttttgcctttgtgtgaataactttgctaattttgtatgaatttgattctaacaaatgttgaagtcattttgttaacaaaatcttctaaagtattttttaaagaaataaaaaggaatatattatgtaaacattggagcagactatcaaaataagaaaaggagaacatttttatctggctttggagtgccatttaaaataggaaaagggatgaaatatttgcagaaaatattttaataagcgtggatatgtttcatcaaatacaagtcttaatttttatgaagaattttgctattagcatatcaagtggtcagttcatatttgttttggcatgcattagactcatgataggcattgaatactttgttttttgtggattctaaaactgaattatcttaatcctaggctctaggaaaagtatatcttactgctagggaagattgaaataaattccagttctgagtgaaattttatttctgtttttctttacatcaatcttttctttttccttttttcttttttttttttttttatttttgagacagagtcttgctctgtcactcaggctgtagtgcaatggcatgatctcagctcactgcaacctccgcctcccaggtttaagcgattctcctgccttagcctcctgagtggctgggattacaggcgcgtgccaccatgcccggccaatttttgtatttttagtagaggcaggatttcaccatgttggccaggctggcctcaaactcctgggctcaagtgatccgccttccttgacctcccaaagtgttgggattacaggcgtgagccaccacgcctggcctgtccttccttccttccttcctttacaaactgtgggagagtggtgaaaaaaaggtgacagtcattatatatgtaattgtgacctgctttaaattgaatgcaatgttaaggacagcttattggtacttatacctatggtcacacattcattgatacagtttgtttttaatgtgaaaatttgtttccattttacataatacaaaattacttctatttgcctgggaatgaatctaacctttgtagtgtcagccaaaggaatgataatattgttttagtgtctcctacatagaagggaacgcccagtatggcctaggcagtgttctagactctgcagatagaacaaggaacaagacttaccttccagcagggggaagtagatactaaacatgtaaatacctaaataaggtgattttagtactaagaagttggatgaagactatgaaattgatagaaagtcactagagaaggcagctttagcaaggatggctaggaagtcctctctgaatagctaacactgagctgagacctacgaagaggagggggcaaacgtgcagaagtctgggggaaggaagtcccaggtagcagaaggggcaaagcagaggctctgaaacgggacaagcttgttttgtgtgaaggccagttggggagagtggaacgaggaagacagaaccagatcatctaggggccaaagaactgttttgttttgtgttgtttctttctattcatgttgtggagcgtttggagggtttgggtaggagagtgatgtgatgtgattttttaaatcattgcaggccttggggtagagacagagaaatcattgatttgaccattgcagacctcaggtgagaggtactggtggcttagaccaggaggcaccgtctgtttctatggggctcacaacttgagtggttattacatttttaaatagttgggggaaaaaattaaagaagaatgtttcatccagcctgggcaacatagtgagaccttgtctctacaaataatttttttaaaaattggctgggtacaatggtgcatgcctgtgggtccagctgcttgggaggttgaggtgggagaatcgctggagtccaggcagttgctgtggagagctgtgaccatgccactgcactccagcctgggtgacagcatgagacactgtcaaaaaaaaaaaaaatcaataatgtttcatgacccatgagaagtatgatgtcacattcagatcttattgatgataagcagttaactagaacatagccacattcattcatttttgtctgccatgtatagctgcttttgcagtttttgtcgtatgaagctgaatgcacagactttcttgccacgcagcagttcagtgggttattgtgatttttttttttttaatctcaggaccaagattaaagttttttgtgcagagttgcaggtagccaaattactttttgtattcctgtgccttagattcctcatctgtagagcaaaattgagatcgtctttcaggtctgtttgctctccacatcctaaggtcctaggtctgaatcagacttagttcttctgttgtggctgcttagcacatcaggctcctaactgaatgattgtagtggtgttttactcggtctcctagcctcgtccttccccattctatgtatcttcagcatgacctcagaccaccgtctttctaaaacatgagcatgtcacactccagttcttaactgtaagaactttgtcaggtatgagctctctttgtacaagatctgacctgggtttataattccttcctggtttcctttcttgccacttccaccttcatccaaccctatttctggccacgctgaactgcttaacattccctaaacttgccatgccatcgtgccatcccttaatctgaaatttttgttaactgtctcatcagcccacaatttttttttttttttttgagacggtgtctcgctctgtctcccaggctgaagtgcagtggtggtgcaatcttggctcactgcaacctccacctcccaggttcaagtgattctcctgcctcagcctcttgagtagctcggattacaggtgccaccaccacgcccggctaatttttatatttttagaagagacgggatttcaccatgttggccaggctggttttgaacaacctttttttttttttttttttttttttttttgagacggagtctcgccctgtcacccaggctggagtgcagtgatgcaatcttggctcactgcaagctctgcctcccgggttcacgccattctcctgcctcagcctcccgagtagctgggactacaggtgcccgccaccatgcccagctaatttttgtatttttagtagagatggagtttcaccatgttagccaggatggtctcaatctcctgacctggtgatccgcccaccttggcctcccaaagtgctgggattacaggcgtgagccactgcacccggtggttttgaacttctgacctcaagcaatctgcccgcctcggtctcccaaagtgctgggattataggtgtgagccaccgttcccagctgtttttcagttttcttttggaaaattcctgctcatttttaaaatttgtaattggtttttaattgataaattaaagttgcatatatttgtcatcctgtcttagtagtgtcttttgtgttgctacaaaggaatacccgagactggataatttataaagagaaaaagtttatttggctcgtgattctgatgtctggaaaagttgaggattaggcatctgatgaggacctcaggctgcttttattcatggtagaaggcaaaggggagctggtgtgtgtggaggtcacagagtgagagagaagggagggaggtgccaggctcttttaaacaaccagctttctcaggaactaagagcttgaactcgccctcaaagagggcattaatctattcatgagggatccttcccaatgatccacacacccccattatgccccacctccaacactggggatcacatttcaacatgaggtttggaggagataaactttcaaactttcacacatgtacaacatgttttgaagtacacacttcaaacagtggatacactgtggaatggctacattgagctaattaacatatatgtattacctcatatacttattctgtatgtgaggtacacttaaatatactcagaaaatttcaagaatatattaataatacgtcgtcattaactgtggtttctatattgtataatagctttctcgtacctatttctcctttataactgaaattttgtgggttttgattaatatttcctcaacaccccctccccaaccaccattctattttctactctatgagtttgacgtttccagattcttcatgtaagtgaggtcatatggtatgtctttctgtatgtacctggcttattttacttaatgtaatgtcttccgggttcatccatgttgttgcaaatggtaggattttcttttttaagtctaaataatattccattttgcatattataccacattctctgtatccgttggtccatggatggacacttaggctgattccctgtcttggccatcatgaatagtgctgcaagaaacatggggatgccagtatctccttgacataactgatttctttcctttggatatatatgcagtagtgggattgttggatcatatggtagttctatttttaatgttttgagaaacctccgtactgttttccataatggctgaatcttgttcatgttttttttctttcttttcttttctttgtttttttgaaacagagtcacgctgtggtgcccaggctggagtgctttggcacagtcggctcactgcaacctccaactcccaggttcaagtgattctcctgcctcaggctcctgagtagctgggactgcaggcacctgccaccacgcccggctactttttatatttttagtagagccaccgtgttgggcaggctggtctcaaactcctgacctcaaatgatccacccaccttagcctcccaaagtgctgggattacaggcatgagccaccgcaccctgcccctgtttgtttttaaatatccagctttaatgtctgtcttaacctatctaatgtcttccttattaacctttctgctcatttagtcggtctgtcctcttatcccataatactttgtacattttgtactatgcatttatcgtattgaattatacttatttttccaataattctgctgtcttttccttagtctcttggaaggtgggtcttaattcagccagcagtgcccaacacagttgagaggtagatggatgattagatggatgaccaacgtagaaatgccagtgtcaaaacctaggaatcaaccctccgttcttaactgagtctccctaagacacaggaaaggagtctattttattccattttgttttctgtctttttttgcctttattaagttcaacatgtgtgtataaaagaataggaaaaacagataagtgaaaacgagagtcaactaatatttttgcctagaaataagttttatgtgcactaattctagaatttttctgtaacataattttttacaaggcttattctgaacatattgttttgttcttcttgcccttagaaataaactgtaagcgtttttcatatcttgaaactttttaaatggcaggctggatatataccacaatttacttagctagtgtctttccccgtcatttacatttcttgccattgttcagttctataaactacactgtgatatttgttcagctttatttttctgcctatccttacattttttcctcaggataaattcttagaagtaaaatgggttggctgggcgcagtggctcacacctgtaatcccagcgctttgggaggttgagggagcgggttatgaggtcaggagttcgagaccagcctggccaacatggcaaaaccccatctctactaaaaatacaaaaaattagccgggcatggtgggagatgcctatagtcccagctacttgggaggctgaggccggagaatcgcttgaacccaggaggcagaggttgcagtgagccgagattgtgccactgcactccagcctgggtaacagagtgaaactttgtctcaaaaaaaaagatgtgaaatgggttggttgggcatggtggctcatacctgtaatcccagcacttttgggagctgaggccaggagttcgagaccagcctggccaacatggtgaaaccccgtctctactaaaaatacaaaaattaggcagatgtggtggcaggtgcctgtaatcccagctactcaggaagctgaggcaggagaaacacttgaacctgggaggcagaggttgctgtgagccgagatggtgccattgcgctccagcctgggtgacaagaatgaaactctgtctcaaaaaaaaaaaaagaaagaagtgacatgggtcaaaatgctcccatactgattttttttctactctataccacactgccttaagtatgctatctagattaccattgtgtcaatttacttggcaatatttgcaggtaggggaaaacattttgcattaaaccactgtctttcttattgatctaacctccctccgtcaaggaaccgaggactcagcttgatttctagaggttcactctgggttctattacttctgtgatcatagagatcagagttggtaaacctccacttctgtaaaaaggaatgaaattaggatacatctgtatcgtaatgctcatggcatgtagttgagtgaaagccactaatactctacatctgggaacttaaaaaaatgatgctggcttagttagaactgctttatttgtgtgtgtagtctttgaagtcactgagccctctctgattagccagaagaggaagaattctgaggaatacgttaggattaagtagagcaagttttttttgtttttgtttttgttttttgagacggagtctcactgtcatccaggctggagtgcagtggcaggatcttggcccaccacaacctcacctccgcctcctgggtccaagcaattcttctgccttggcctcccgagtagctgggactacaggtgtgcaccaccacgcctggctaatttttgtatttttagtaaagacggggtttcaccatattggccaggctggtcttgaattcctcacctcgtgatccgcctgcctcaacctcccagagtgctggaattacaggcatgagccaccgcgcctggcccaacagaccagttttgtaggtgagaattatctcacagtgtagtcagcttccagtgtactacttattcacccatttttagtagcagtagtagttacttttaactaaaattttaatagtcatagtatttacttttaattaaaattcaaacaagatatatgcaagtgatatatttgctgtaaacaaattttatttataaataaatgaataataaagaggttatttctttcactactctctggacatagaattgcattgttgttttaaacaaatgctaattcattttctataactattttattgagatataattcacacaccatacaattcacccatttaaagttacagtttagtggtttgtagtcaattcacaggggtgttccaccaccaccacagtcaattttagaccatgtttatacccttgagaaaccccacaccaattagcagtcatctccatgtcctcccagacctcctcttggaggcatctaccaatctaccttccatctccatggattttactattctggacatctcttattaagtggaatcatataatgcatgatccttggtgaccaacttctattgtagcatgtatcactacttcattcctttttatggccaaataatattccactgtatggctatactatattttgtttacccatccatcagttgatggacatttgggttttttggctatcgtgaacattacatacaagctgtgcagatatgagttcattttatatctcttgtttgttttttagtgtctttctcgagaagcaggtggaaacatgagcattcagtttcttggtacagtggtaagtatgaaatcattctttattctcttaatttacagagaaaaaatgttcaactagttgtagctcatgtgtttgaacttggcttcattactgctagatatttaaattacctctacttttttgcctttacaaatgatattctagggaacaacttcatatatttcactttattttagtgtttggaattattatcttttttgagacagagtctcactgtgttgcccatgctggagtataggggcacaatctcagctcactgcaacctctgcctcccgggttcaagcgattctcgtgcctcagccacccaaatagctgggattacaggtgcctgccaccaagctcggctaatttttgtgtgtttttttctaaagatgaggtttcaccatgttggccaggctggcctcaaactcctggcctcaagtgatccatccacctcggcttcccaaagtgcgggattacatgtgtgagccatgtccggcctggaattattttcaaatgtggataagatatttttaaacatgtatgatatattttctcccaaatagaatcaaagtcataaatagttttatggcttattatacatgttgcccattattttatgtccctttagaacaccacccatcatatattagaacacaactttgcattgtcacctagtgtgagttgtaattttcaagattagtaaacttgatctgctgaagagtttcaatttattattactattttacttataagtttataattagtattagttactataattttcaaactaatttgtttaaaaaggtaccttatttggcttggtgcggcagctcacgcctgtaatcccagcactttgggaggctgaggcaggtggattccaaggtcaggagtttgagaccagcctgaccaacatggtgaaaccctgtctctgctaaaaatacaaaaattagccgggttgtggtggtgggcgcctataatcccagctactcaggaggctgagggaggctgaggcaggagaatcgcctgaactgaggaggtggaggttgcagtgagccacgattgtgccactgccctctagcttgtgtgacagagcgagaccccgtctcaaaaaaaaaaaaagtaccttattttaattttcatttttctgtttattgctattgtatttgaatatttctccatgtattcattcaccagatatcatttctaatctgtgaaatgtctgttcatgtcctttgggtacctcattcaggatatggattcatattgggcatttcagataactctggagtttattaagaatatcagaggtattctgcaagaatatcaagaggtatttcaggcgagagagcttgcgtgaaaaagggttttgcagccattgagataggaaggatgttaataaaatgtgtgtttactgaatgctttatcgattatagagatgtatatataatttatgtatataaagtatatgtataggtacttggtcaatgtaacctaaattttaagtattggaactaagttttgtgattattcttgtttttctgattagtaaggtaatacatgcttattgtaaaacatttgaaatacaattcaaatgtatgtcataatatgttgcattagtcaagattctccagagaaatggaatcaacaagatgtgtgcgtatgtgtagagagaaagagaaagatagatctaaggaattggctcaagcaattgtggaggcttggcaagactaaaatctgcagggtagatgagcaggctggagacccaggggagcgttgcagttcaagtccaaagacagtccactggctgaagccctccttgcttggggaggtctgtctttttctcttaaggcctttaacgggttggatgaggcccacccactgtggagggtgatctgctaaactctaagtctactgatttcagtgttcgtctcatctaaaaatatcttcgatgatacatctcagtgtttgacctaacatctgggtaccatggcctcgtcaggttgacacataaaattaaccatcacagaagtatatatcctatccctagaggtttttaagttattagcaatagataattcttccagaaaattatgcatcttttcatgcaataatagatcttggacacctttctgtgtcagtccgtaagatggacctcagtcgccttaagggccacacagagctgcattacgtggatggagaggactgctttcactcctcagtgttcgtgctgggaagtccactcatgctgtctctgctacttagcatctctactgggtttctaatcggtttctcaacttcatgtatcggaaactgagctcgaaaagtttctccctcagtttttcctctctctgaaaatggcaacttgaactaatccttgattactttctctcctcttcctctctctcctcttcccctcctctcctctctcctctctctctctctctctctctcttctctccttcctctccctctctgtcctcttcctctcctctctgtcctcttcctctcctctctgtcctcttcctctcctctctctcctcttcctctcctctctctcctctctctcctcttcctctcctctctctcctcttcctctcctctctctcctcttcctctcctctctcctctccctctctctcctctccctctctctcctctccctctctctcctctccctctctctcctctccctctctctcttttctccctctctctctcctctccctctctccctcctctccctctctcctttcctcctcttcctctctcctcttcctcctctccctctctcctcttcctcctcttcctcctcttcctttctctctctcctcttcttcctctccctctctctcctcttcttcctctccctctctccttctcttttttctttctcctctttctcgctcctctttttcttctctctctctccttttctcttttccccatctgtctctccctgtctccctctcccctgtctctgtctctgtgtccccacgccccccactcctggccctgcctttagccatctcttgtttggaggatggcagtagctggcgtccacctcactgccatgctactccctagtccatcactaatagagcaggaaaaggagtcctttgaaaacatcccttggttggccttgttgctcttcttcagacctgctgggcacatgccttagggtctctgcccttgtttttcttctactaagaacatctgcccctacatgtctgctcaggggtttcctcactttcttccggtctttactcagtaggctccttctgaaggaaggcttccctggtcacgccgcttacagttctggtcactctttccaacatcttattccccctcgcccactttatttatttatttttttcattagcagttaccactgcttgacatactgcaattttccttttttgatgtatttgttgtctatcttcctcacctggaagtgataagctccttgagtgcagggtgatttgtctgttctgctcagcgtgctctgcccagtgccctgaacaaggcctggcttggaggaggtattcagtcagggttgggcaaatgaatgactgaaattggccaatgtaggacctgagtgttagacttgaaaagaaaactaaagaaaggaaatacaggcctggctcggtggctcgtgcctataaactcagccctttgggaggctgaggtaggaggatcacttgagcccaggagttcaagaccagccagggaaacaaagggagaccccatccttacaaaaaattagctgggtgtggtggtgcatgtctgtggtcccagctacccaggaacatcacttgagcccagggaggtcgaggctacagcgagccgtgatcacaccactgcactccagcctgggtgagagtgagaccctgtaccctgtctcaaagaaaaaagcaaatatgaaaacaaatggaggccgggcatggtggctcacacctgtaatcccagcgctttgggaggctgaggtgggaggatcacctgggtcaggagttcaagactagcctggccaacatggtgaaaccctgtttctactaaaaatacaaaaattagccaggcatggtggcaggagcctgcgatcccagctactacaggaggctgaggcaggagaatcgcttgaaccttggaggtggaggttgtagtgagctgacattgcaaccactacactctagtttaaaaaaaaaaaaagaagaagaagaaacaaatggagaaaaagaaagtgcagggagctttttgggactgtggagctgaactaagctgtcttccatggataaggaaactgtatcttagaaaaggtcacttgacttccccaaggtttcacgtctggctggtgtgtagagcactaaagggtatacagatttcctggctctcagttcagggcctgttccatcagcaggtgcccttcaatttcactcccttttatccacttcaggcacccaaaacatgctagcataaaaaaacacaagaaacaaaaacacaccacatgtacacacccctacttaaatggacaacaaaagtcaccggaaaaaagggaaaaaaagaatgtctttttgatttgttttgttttgtttttgtttttggagacagagtctcactcagttgcccaggctggagtgcagtggcgcgatctcgatatccgctcactgcaagctccgcctcctgggttcaggccattctcctgcctcagcctcctgagtagctgggactactggtgccggccactacacccggctaatttttttgtatttttagtagaggcagggtttcactgtgttagccaggatggtctcgatctcctgacctcatcatgatccacccgcctcagcttcccaaagtgctgggattacaggcgtgagccaccgcacctggccaaaaaaaaaaagaatttcatgtagctgacactttcctctgcccctaataaatcatagattccttgccaatgagttctaaaggggctgtgtccactctgtttatacagtttatacctagcaggaatgtcagtttcaggtacaatttctagagtaatttctaattactgtaaaattcacagtacagcatagcagtttggatggccaatgtgctttgttttactgaatttttctgtgtgtgttattagcaatagtagatcagtctgaaagggggaaagaaatagtttgaagatagtagtggtcctgttacaacaaatacagattgattcctagctagcatatgttgcttcagtcaaagatgtctaaagcaagtatagtttccaagacacacaggtcaggaatagcagcatgtcccatggcaaaggtgatgctttccaggtatagatttgtctttgtgagaatccttgtagaattttctatataagtttgtttttgtcaatattgataaacatgatcttcaatgttcaaaggagagttcaattttagactaagagaagtacttctgttgtgtaaataaggttcaaaaataaggttactgttcaacttagagaaaatacaaacttaaaaataattcatttcattttttattcactctgaacttttaaaaaaagctggtttgtgattttcattttcagtaaaacaaatctcattactttaaaaaaaatgcttgtattagatattatatatatgaaatattatactttacattcttataaaacatttataaagaatgatgatacaacagatttgcatacctaagtgtaagacttgaacaaaagactaaagacaggaaatacaggcctggcttggtgactcatgcctataaagccagcactttgggaggctgaggtgggaggatcaaatacatcaaaaaagtaaaatatgtagtatgtcaagcagtggtaactgctaatgaaaaaaagtaaataaagtgggcaaagggtggaataaaatgttggaaagagtgaccagaattgtaagtggtgtgaccagggaagccttccttgagaaggaggctactagcctgaagagtttttaaaaacgtaaccattagtttggaaggtctctgtgttactcccattctgtcactcattctctccctgcacaaggaactaacatcttcccgacttgtatctattattctttgcttttctttataattttcccacatttatatccctaagtgatatacatttttgttttacgcgtttttaaacttgatatacatagaattatattctggaatcatctgtgacttggtgattttgctttgtgtttgtgagactcgtatgttgcatggaggtataattcatttatgctcagcaatgcaggatgctgtggtgttgataaactagcctgctactcatggataattgggtagtttccagtgttttgtgctgtaattctcactactacccgaagcattttggtacgtgggtatatgtgtactgatggcacatatgcaatcgtttctttcttttttttttgagacagagtctccctctgtcacccaggctggtgtgcagtagtgcagtcttggctcactccaacctccacctcctgggttcaagcaattcttctgtctcagcctcccaagtagctgggactacaggtgcatgccaccacactcagctactttttctatttttagtagagatggggtttcactgtgttggccaggctggtctcaaactcctgacctcaaatgatccacccacctcagcctcccaaagtgctgggattacagatgtgagccaccatgcccggccatatgcaatagtttctttagggttttgtgcattgagtatgcagtgaatgagttcactttgttccacatcttcacttggatcttcttaatttttgccagtgtgaatagtgccctcattgttgtttcaatttgctttatcctgatattaatgaagtagaacatcttttcttatttattggctatttctcttcatcagccatttggtttccacctctgagaagtacctcttatagctttttgtgtgtttctctatgacatgggactgcaaaaatacatgaatttagtatgtgaatgatacaaattaagtatatgtcatttggcttttcaataaggcaagagggttaggtgtggacttttatgactcattcttgtagggcccaggcctttggggcttagcgggtgttctcccggtgtgcggagacgagagattgtaataaataaagacacaagacaaagagataaagagaaagcagctgggcctgggggaccactgccatcaagatgcggagaccggtagtggccccgaacggctgggcgcgctgagtacaagaccagggggcagggtaaggagggtgaatcttctaagtgattgacaaggtgaagcaagtcacgtgatcgtagaacaggggggcccttccctcttaggtagccgaagctgagagagagaaggcagcatacgtcagcgttttcttctatgcacttataagaaagatcaaagactttaagacttttactatttcttctaccgctatctactacgagcttcaaagaggaaccaggagttacgggaggaacatgaaagtggacaaggagcgtgaccgttgaagcacagcatcacagggaggggtttaggactccagatgactgcgggcagactgggataatatccagcctcccacaagaagctggtggagcagagtgttccctgactcctccaaggaaaagagactccgtttcgcggtctgctaagtaatgggtgtcttcgcagacactggcattaccgcttgaccaaggtgccctcatgcgggcgtgacagagggctcacctcttgccttctaggtcacttctcacaatgtcccttcagcacctgaccctatgcccgccggttattcctaggttatattagtaatgcaacaaagagtaatattaaaagctaatgattcataatgtttataatgattgataatgtccatgatcatctctatatctaatttgtattatgactattcttattctaactattttctttaatatactgaaacagtttgtgccttcagtctcttgcctcggcacctagataatctttcacgcacacgttctgactatgagctatgaatggaagtgactgtcaatgactctgaaggttctgagatttatgctacttgctggctgacaaatcagcctgcgacatttcatagatgctgatagaaaacatgagactccaggatcagagatgaaggacagtttattacagcagcagcagtggtcaggataccattgtctttgtaccatttccctgaacccagattcctctagggcaatgcaaagagacatgatacctgcacacataatgggttgcattataggagaggagctctgagtttagagaacctgagtctttttatactgtgcagtaatcgcacctgccctttgatctggagggagacactctaccaaggccatttactgtacaagcatctttgaaaaggtagttcagagcaaagaacaatcagtgtcttgctcacaagaagtggaaaaatgcaagagacctgggggtgaattgtctcctggtagtgatgtgtgtcacttttggtcagagatagctaagagcaagtgtgagccctctagtccctgccatgccccccttggaggttgtgtgtgacgctgatgctcctgtcagcatgagttccttctgaagagtggcagtgagcactgctacttgcaagctgtagtagactgggatctcagtgttgacttattgctaatgcgtagcccagcttatcctgatacatagtctgggaacatgaaggaccaccttctgtttatagaaccccatgtctgcttatagatttcagattttatagagattcattaggtttattctgtctactttcagtcctttcgcttataaactttcaatccaagcataaggtctttttcctgttacgctgtttgaactttgtttaaaaattgtggccaagcatggtggctcatgcctgtaatcccagctactcaggaggattgcttgagcccaggagttcaagaccagcctgggcaacagtgggaccccatctctacacacacacacacacacacacacacacacacacacacacacacacacacagtgggaccccatctctacacacacacacacacacacacacacgcacatatacacacagtgggaccccatctctgcgcgcacacacacacacacatacacacacacacacacacacacacacacacacacacacacacacactagcggagtatggtgacgcccacctatagacccaggtactcagaaggctaaggagtaaagatggcttgagcccaagagttcaaggctatagtgaggtatgattactccacttcactccagcctggggaacagagtgagaccccacctcaaaaaaatcaaaaaagcgaagatttaaaaattaaaataagattgttagccagttttttgtttaatgaaggaaaagttttccaaattaacagaatgggacattcagataaaatttgtgcctttatgacccaggaggatggcctgggtgtacatacaagtactcaggacaccacattctcacctttggtatctatccgttttattactctgccactcccaaacagtaatacataggattccgtgttagtttcctagggctgatgcaacagattagcacaaaccgggtggcttaaaataacagaaatgtgttccttcacagttctgggagccaggaatctaaaatcaaggtgtgggcagggttggcgcctccctagaggctcttagggagggtctgttctgtgcctctctcctggcttctagtagctcctggcagtccttgccttccttggcttgtggctatgtaattccagggtcttctgctgctgtcacatggccttcttccctatgactgtgtgtgttcattcacataaatccagcaccaccagtcatcagatttaaggctcaccctaatccagtgaaacctcatttaactcattatgtctgcaaagaccctatttccaaataaggtcacattctgaggttctgagtagatatgaattttgggatgacactattcaacccagtatgctatatagatctgaaagcctacttgacacacatgtaaagctaaaaagtgactgaggcaacttacctgaaaatatattttacaaacagagcattacttcttaggtctcatttgagtactaccatttatttccctagtattttcatacatcacctgtatgactgcagttcgtaccccatactcaaaaatgcaggaacactgatgatggctatgcctaattttcagaagacaaaagtgagcatagaaaggttaaaataactatcctatggtaataactggtagaaacaggatgcaaaaccagccctcaccaactttgaagtcaggctgttgaacatcagaggaccttgagaacaaattgcttgactgtggaatccagggagctctctgcagtaactgctaagtacaactgctcaggctgccataatgaaacaccattgaccgggtggcttaaacaacagatgtttatttctcacagttctagagcctgggaagtctaagtaaggtgccagcagattcagttcctggtgagggccctcttcctaggctgcaggcaaatgcctattctcccgtagcagagagagagtgcaaactctgatcttccttcctgttaagggcgctaatcccatcatggggccccaccctcatgacctcctctaatgaactctgaaaggctgcgtctccaaatactgtcacattgagggttaggcattcagcatatgaatttggacgttcagtccctaacatacatttggttggtaagctgcagatcccagaatttttccaggatatctgtgcccatttcaaattgcaaattgtctgggttttgtttgttttgtttgcatgttttggtgaagctgtgagtctgtgtacatcagatagtgtaagctcacaaagaaatcgaagagagctggtgttttacttaaccagaattccttacttgaactgtgcttcacaataagaataaatattttgttattaaagaatgcagaagttaccattttattgcaaatttttattataattaggttttaaagtactataataaggcaaacatatctcagtgagactgactttttttcccttataaaaacaatgtttgtatgaaagagaaaataagcttagactccattgaacagcttcttcatggctgcagtattggcattcacccaaggactcttgagaaacgatcaaattttcagtatctttgaagcttagccagagatctaatgaaaccaaatgatgctaaagttcttaaagctaatttaaatctcaaattatacattttaaattaagtttttattgataataaatatactttatttcatattacccttgaaagcttgagtgataatattagtagaataaacatgttttacaaagatttaccattaagaatgctattaatatgacccttgatacaccagcacaattagatttcaaagtaagcacttatgaagtaacagcgattaatgacaaccatcgaaaacaattttgaactccatcagtttaactcaggagggtaaacttaatatgataattcatctagttgaattgtatcagcttagcaggaaggtatgtaaatatgtgacccttacctagcttctaaatggatgctgtgctgatagatttatcagttccattaaagaactttggggaactttggagtttcagcaattgttcccttggaggctgaaaacccaacctgatctcatactgggaccattctggtctgcatatttccataatttgcctttgctactaatatgacagcaagacacaaataactgtttctaataatatcagatggagttgtggaggacagcattttaatgtagtaaaagacctccccgtggggttgttattgctactatagaacagcagctacacagttgcaactgtagtctcttaattgattcgtttaattagcaagagctgaagcttgggctgtatcttgtcatctgatatcataggactcgaaatttgcatcattcatatttatagatatgtaaacatcatcaaaaaggtcttctgcttctgaaaattcacttacagatatcaaattttaatagagcagactcccatttgtttgaaatttaactaattaaaaaatgaaaagaattaagtttgttactgtttttctttatctgtactcttgagaaataagtgatgtcatacatttttggttgtggatcatctcctaaacataaacttccagagaacttcttcagtcttccgtatctcataattccataagcagtccctcaactgacatgtctgacttaagttgatctctcctctctgtcccatccctttctctgtgtcagtgtgatttcaggaatgacatgatggcttactggggtttcttgcacacgtgtgctgtaactttccacctgtccctgcctgcctttgcagctgctccaagtcctgctagggtaggctgtctgcttgtgctgtggtttggtgggtcatctggctgagttggctcttggcagttacctgcctacccaagctgcattggtccccactttctctggaggggaaaagagaaacggatagaaagtatctggcatagaaaccagagcctttctagtctgtttaccctcaactccacagggcttcctccctgctcggtcacactctttgtattcctgacccttttctagtccaacaataggaagcaggtggcggtcacagagcagacactttgtggaggggtgatgaagttttctgatgttcagatatattttacagtgctaagaaaatctatagcattccttcctgcatttgcccctaaatatacaaaatttcaggcaaaatatgggtagaataagattttatgaaatggaatataaatgtagtcttaatcttgaacattgtttctgtggtaatgtgtgttctgtgtgccatgtaaccaagctaagaatgaacttttggaatataactacgtttttattcttttgaaattggcatgctctatataatataaaagtttggttattagtattgcagtgtgatgcattctgaacaaaaatttaaaagaaatcattgcctgcctgctatactatgtgctaggaagtgggttagttgaacatgacttggtccctacccttaagtagcacactggctggtgaagacagacaaactgataccatgcaaacatggtatcagtgctgagatgggtaatgcataggcttatatagtagcagagcgaattgtagatctgttagctttattatttgtttcttttattgataaacagtacagtccatagggcgtaggtctctggttaagaatttgcattttatttgtcaagtacacctcaataaacacagggaaaagaagaactgtatttcatatcttattagacattactttttgaaaatgagcacaaaacctagcatttaatggtagtcatgagagtcagtcagtcatcttacactggtgacagacactgaattctggcaattcaaaggaaacaaatatccctgcagtcattgggcccattgtcacctaaggatagagaaatgtaaatgactgattaccgtgataagaacgctaacagaggtgtatacgaagtagagggattctggggctgaggtgaagaaagtggagaaattgtgaacagtttttcagtgtttatagctcatgctgtgactttaaggatgaattgagtttgcaggagaaggcatttcagatagagggaacagtgagcctggagatagcaggttgtagaaactgcactctgtactgatgatggagaaagaggacggaatgaaattaataaaggcgcagaggtattaagatgtcccaagtgtttaaggaagagcagattggcttatgagggtgatgggcagggcaacaaagatccctttggaagatgaaattagtctgttgggggcaagatgacacaagaccattccaaggaggttgggtggcattccctagattctgaggttcattgaaggagttgaaagaagaatcataatctcatcagaggtggttggttttattggtgtggtttttttttttttttttttttttgacaacttatgggagtaggcaaagaaagaagagggtacatttgagagccacttctttagaatccagtgtacaattctatgtattgggcagaattgaagataattctgagatttctagaggtgataactgatgcagttagggaggaaaaacaggaagaagagaagaattgtaccagagaaaaggtggactctattaaaaagatggatttaaccaatttaagtttgaaatgccaagagacatctatgatataagggaaatttctggtctggagagcaagaagaagattaagagtgagcacgtaagttgatgccccagcagaggtgaggtcctaagccatgcagtagatgaacctgccaaagggacaatggcaaagcagaggccaggcccagaatggagctccaggaaatgcccacagctaaggtggaggcttgtcctctctaatggagtcacttacaaaatgatgacatgtttattattgaaatcatttatatatactattagaagccagttcattgtaacctcagttatgatttcacagtatcctagggtatcactaagttatttcaaagtatctcaggatctgttgccacctgccaaagatcttcaaagtaaaattaatatttataaataatgccttacgcgtgtatggtgctttagggctttagaatgattctacatatgtcagcttacttgattccattcaattgctaagatgaataagccatagcacaccttagagtgagtggtaaaaattagacatggaatacttcttgcagtgttttccatttaaaatatttgagattacaagttatgtgttcacaggaaattaccacgaaccactgccagattgctagtgaacaggatcgggcaggggtgggggaggaataagtagagtttgtcttcctgcatttgaatcgcagatcacctgtctcttagctttgtgaatttgaacaggttgcctaacctccctggtcctcaattttttcatcaacagaatagatattatctgcttttatggagatggcaagggctgaaaaagaaaacgtttgtaaaatgcctgaaaatagcaggcacttggcaaagaatagctcggtttttattgtagctccccactctccctttgcttcattttccctttcatttgtcttgcttggagacatgctatcatctgaagtgatagtctccaccgagtcttcaatttggtgcttggcctacagaaaaatccagagggaaaatattgttcccttttatttgaaaaaccaaatttgtgttaatcccctggttatgaccccttaacatagttaatgttttgtaagtgaatatggaatagaaagcacatacttaaatgtgtaccttgtggtggcagggtgcttaaaaacatctgtttccttgaagaatcttgcgaatcaccaacaccaaacttgaccagggaagaatttggtgccttgtgtttaaactgtgctgcttaaaatatattcagatggaaagaatggcaaaaccattctgatataggacattttatgacagtgcctatgagatgttctttcttctactggcctcacttttaaagggatatcattttaggtaggctgtttcagggcactgtcatatgttactgtggactatcgatctcttgtacctatgaattatttgattgtcactctttaatttatagtgagaaggaagtgggaatggcagctcttctcttatagaagaaaaatctgagtcagtggttctcaagttttatcatgcctgaggatgaccaggaaatcctggtgaaaatacagattcccagatctgttcctagaaaagctgaccccccatgtctgatgtcgaaatcggcttaaaatgcaccaggactagaatttgcaatatattttgaacattaatgtagaattactatctagtttggaaagtcaataccaaaagacacatgatattcctggccccatgagccaagcttaggagcagtgttctggatccttttcagaatgagaagataggacaaacatttgattatttgtgctaattaacatgtactttcataatacatacttttttaaaatcagggagtgacatgataggatctaaagtataattaggtccatagtgtcatcaactgtatcttttaagtttacttatcatctgtataattctttagattcagtctgagttatttcaagtcttatagacagtgataatttttatttttgccctagagcagggcagtgttatctgtttgggcagtattaacattttggacaattctctgttgtgggagactgccctatgcgtaataggatgtttagcagcatccttggcgtccaccaactagatgtcagaacatgtctccagatataacaactaaaattgtctccaaatattgccaaatggctgcacacagcttggttggggagagactccagaacagatgtgaaacttagtggctggaagcttacaaagtacacatgtcatgacctacttgaataccttatgcgaagaaaataaactttacccgtcctgatactggatttgctttaggaacatgtttagcgaatagctgtttggaagtgtgtaaggggtactttttctttatcttcctcatattggatcatgaaccaggtctaccatggacagccattcatggaatttagggcaaagtctagtttgtgtgattgcattgtgttcatttgggttctttttaccatttgagtagatgtactgttactgcttaccaaagacacattttgggtatacagtgcgtgtgcagctcaataccttattctagaagctgctgctcttcattttgtcttcagttttgtaaaagccccgtaatcctgctggtgagacatattagagtgtgataagcatcacttcacagtgacatctgtgaagttcttctgttctttttgcagctactatttaattgtttggctatttaatattttgtggcgcttccccccttgtgcaaggaagtatatggcaggatgcctgacaagacacgtaggaagccacacagtagtcagcatctcaagtgtgtgttcctgagaaatagccttcccaagccggcatatgttttgtatggtgtaaattctcaagattgtgaggggaacagctaaggtaattcctaaggtatccgtgttaattacctaaggtaattaccaagcatcagggaacatagcaacactgcaaagtcaaagtaccctcgtttgaaatagaatctctacctgatttaggggttagggaaagaattagtggataggttctaacaattacccttctgaggtcacgagtttgagaccagcctggccaacatggtgaaaccccatctctactaaaaatacaaaaattagctgggtgtggtggtttgtgcctgtagttccagctacttgggaggctgaggcaggagaattgcatgaacccaggaggcgggggttgcagtgagctgagattgcgccactgcactccagcctgggcgatagagggacagtccgtctcaaaaaacaaaacaaaacaaaacaaacacagttacctttacagttcaccatggccaaaagattgtaccactcctttcctgtctcagccactttttgagtgactgtaaagtaggttggccgggggacgatcgttgcttgctgagtgcctgtaggtacctagcaccgtatgtttgtcattctcattgaagtctcccctttgagatcaccagtagaatccccatgtttcagatgcagtaacacggacaggaagtaagggatttgctcagagtggtttatatcagaagagcagctgtaggaccaaacccagatctagtaacaaatgtggcttccttcacatgagcatctgggtggttgggagttagttattcctgactgttgggtggagagcaatttgatgggacaaaaccagttcttctgtgttgaggcttagacaccagccacttaacgggccagacagctgaggtccggatttctctgcttcctgagccagttactcttgtatagcgggggaggagtgggcacattctttttttgagatggagtcttgctctgttgcccaggctggagtgcagtggcacagtctcccctcactgcaagctctgcctcccgggttcaagctattcttctgcccagcctcttgagtagctgggactacaggtgcccgccaccattccagactaattttttgtatttttagtagacacggggtttcaccctgttagccaggatcgtcttgatctcctgacctcatgatccacccgccttggcctcccaaagtgctgggattacaggcgtgagccaccgcgcctggcatcaagtttgattgtgagagtgcagcaattcagtcacatgtccaagctccactcctagttcttttgctgttttccctacatctgcagttacttcttgaacccctcaaagtcacccatgagggttagaatccagttcttcaaactcttgttcatgttgataatttggcctcttcccatgtgaattcaacacaaatgttcttaatagcatctagagtggtgaagaaggttttcaatttactttgcccagatccatcagaggaaacactgtggcagctgtagtcttccaaatgtatttctgaaataataagacttaaaagctgaaacgactgcttgatccatgggctgcggaatggatgtcgtgttagcaggcacaaaaaccacattcatctccttgtatatctccgtcagagctcccaggtaacaaggtgcattgtcaatgagtagtaatatttttaaggaaatatttttttctgagcagtaggtctccacagcaggttttaaatattcagtaaaccatgccctaaacagatgtgctgtcatccaggctttgtttttgcgtcctagagtacaggtagggtagacttagcatcattcctaagggccctgggattttcagaatggtaagtgagcactggcttcaactaaaagtcagcagttgcattagcccttagcaagagagttggcctgtcctttgaagccagaggtttacttctcctctctagttgtgaaagttagatgacatcttcttccaacagaaggctgttttgtctacactgaaaatctgtagtttagtgtggccaccttcatcggtgatcttaactagaccttctgcgtgacttactgcagcttcttcatcagcacttggtactttgccttgcacttttatattatggagatagtttctttaaacctcatgaatcaacttctgctagcttcacacttttcttttgcagcttcctcgcctctctcatcctgtgtagaattgaagagagctagggccttgctctggagtaggctttggcttaagtgaatgttgtggctggtttgattgtctatggagaccactaaaacttaggctgggcacagtggttcacacctataatcccagcactttgggaggccgagaggggcggatcacttgaggtcaggagttcgagaccagcctggccaacatggtgaaactccatctctactaaaaatacaaaaattgagctgcaacaatagaaagatggtggagcaagaacaaagaaacaatccctttgactgggcgcggtggttcatgcctgtaatctcagcactttgggaggctgaggcgggtggatcacctgaggtcgggagttcgagagcagcctgaccaacatggagaaaccccgtctctactaaaaatacaaaactagccggacgtggtggcacattcctgtaatcccagctactagggaggctgaggcaggagaatcgcttgaacccaggagacggaggttgtggtgagcaaagattgcgccattgcactccagcctgggcaacaagagtgaaactccgtctcaaaaaaaaaaaaaaaagaatccctttggttccagaaaatctcctgaaaaagaggaaggcttattaagccttcagagctacccaggcaaagcaggtacttttggcaaagaggaacaaaggaaaggaaaagggctcaggtttaagggactggaatcctacatgattcctggcggcagaaacatgacaaggtgggtctcagacgactagaagtgaaacctcatgctttggaattgccagataaacattccttggcctttcttgtacgtatcaaaaggattgatggtgtggccgggcacggtggctcatgcttctaatatcagcactttgggaggccgaggcgggcggatcacaaggtgaagagttcaagaccagcctggccaacacagtgaaaccccatctctactaaaaatacagtattagctgggcgtggtggcaggcgcctgtagtctcagctactcactcgggaggttgaggcaggagaatcgcttgaaacccggaggctgaggttgcagtaagccgagatctcaccactgcactccagcctgggcgacagagttaggctctgtctcaaaaaaaaacaaacaaaacaaaacaaaacaaaaaaagtttgatggcgtgtgagtttactggtgcagaaaaccattgcaagattttgcctaaagaaagtttttagtggtgtctttgtaaaagtcaccccctgctgcatgtaatgggatcttatgtgacctggggatttccaaatctgaattttctctgggaactgattttgaaacgtggtcaaggtcaagaataagaccatccctctgacagacaacacagtggttgcggagcacctggggaagtatttccaggagacttcatggttcttgcgtcgtttccacctctcagtggcccatcatgctaccaaaaatagagtgggcttcctcgagatgggcacacctggctatcggggtgaacacgtcaatcagctcatccgccagctgaactagacccaggtgccaaactgcagtacatttttatcagtgaagtggaagcgtgtgttttgggtttttttggggaatttttatcaagtatcttcagagaagattatttcctgcttaatcttcaaaaactggaaaggaagggtcaaagaaaagacagtagcttatgtttatggcgggcacctctcatcacagtcattcccaaggaaaaattccagagttttctacattggcagctgcctcgtctaaatcaacacattccatgtgcatcttctatccttgggtttaatgttgctaaatgagtaactctagcatttgtacaagaccccctaagactctggcagcagtcgaccaagcccagggacataattgaatctggagattcctgaggccttgttttgaaaaagacttgaaatacacataggaagaaaggcccaaaaataaatgttcacttgtctctgcaaaaaaataaaaataaaaaataaaattaaattaaaaaataaaaatatgaaaactagctgggcatggtggcttacgcttgtagtcccagccactctactcgggaggctgaggcgggagaatcgcttgaacccgggaggcggaggttgcagtgagccaaggtcacaacactgcactccagcctgggcgacagagtgagactctgtctcaaaaaataaaaataaaaaaacttttcatatcagcaacaaggctatttcactttcctatcatccatgtgttcactggagcagcacttttaattttcttcaagacatttttcctttgcatttacaacttgagtaactgcacaagagacctagcttttggcctgtttcagctttccacatgctttctcagtaagcttaatcatttctagcttttgatttaaagtgagagacatgtgactcttcctttcacttgaacacttagaggccactgtagggttattaattggcttaatttcaatactgttgtgtcttggggaatagggaggcccaaggagagggagagagatgggggattggccagatagtggagcagtcagaacacacacaacgtttattatagtttaccatcgtacatgggcacagtttgtggttccccaaaacaatttcaatggtaacatcaaagatcagcgatgacagatcaccacaacagataacgacgaaaatgggtttcctaataatgcagaggtttgaaatactgcaagaattaccaaaatgagacacacagatgtgaagtaagcacatgctgttggaaaaaatggtggcaatagataaagggttgccacaaacctttaaattgtaaaaagtgcattatccttgaaacacaatagagtgaagcctaataaaatgaggtaggcctggattttttggatacttgatagtatctaagtttcttctcaaacacagcaaacatttcacagttcaaatttgcccatcggtagagttttctctgtggatcttctctgttaatgccacatctgtctagagtaaaagttcaattcaatattgtgctatcaacttagcaacttgttgaagatgaactaacataagtacatgctgtgtgtgtgttctgtgtgcagacacaacacaggtgagctttccgtaagcctggatcttcccaatggcggtgcttctcgtgtgcaggccaactagggagaaggggacactggggcccacccggagctctgtgggccttgtctcttgtgacaaggatattttgctccttagctcagcagagtccaggttcttgtctcaggactgggaagaagtaggcaggcggacacttggagagtgagtggagtagaatgcactaagggaaaggaaaacttaaaggaagggtcttgaaagcagattgtggttctcccttcacagtggaatacaagggcttttatatacctgctgatggggctgcgttccctatttctgtaagcgcgaattcctggcggctccacccgtccttccaatgcagacgtgggcccttagtctgagccactctacattgatttatttcccttactgcgcatgtgttaagggacagaacttttccaccgcaagcatgtttgggcaaggtccctgggcacgacgaccttggtgggtcagaggttctccggggaccctcccctgtctaccggggagagttctctgcttcctgcctccatctactccccagtctgcagtctggccctcggtggtcctgcagatctggtgttgattttgcagggtgtttggaaaggtacctgcgtattttcatttatggaagtgactgagtgccgacgaggagaggttaatgcccttgagaggagaatttattacttcatcacctaagagaagggggcacacccctccatgcagggcacaggggaaccaccagtgtgggtcaggaggcagaaaggagccagagaaaagtgtgggtgggaaccttagtggggcttcctcgggaaaggcagtgcgtggctggtttgaataatgatggtgggctttggggtggtctctatttgcctggtatctggccctgggatgttttaaggcagggaaaatactggcttggtgtgtgttagagaaaatgggcagctggcttacttccaagttctttactaaattgaggaattagctggtcttgggagaggcagtgtctttctgggtctgtaagtccctggaaaatgttaaagtatcataagataaaaaaaaaaaaaatttaaacctgattaatacactgtgaacctagaagtaaccagattttaggaaactgacctatagtgagcaaactcacagggattgatagctaagccagaatatgcatttattagcttgaggggaggaatgtttcttccagtgaccaaatctttaagtctgccctccagaatattgactaaatattctgccatctagaatggaataattaggaaactcattagtcaccttaatttcaaactagtttggtttatgtggtaatcagagcaaacggtgacgtggtgtacctgtgccgcgcagggacttggtgaattaatctcttctcccagaacgccccacaagggccaccgccgtgccttcccttttctttgcctctgcgctgctgttatcttcccacagaaaggccccctgcagtcgattaggcttcagctacctaaacaataggcacagacccaaacgatgtcaaactacagttttctcctgcccttagggtggcactcaggccactttgattggaattttgagtgtccccaaactctggttgtactctttcacagatgggcaattacagtactgctctgtggagttttaccagtatagctctcagaaattcctaagaattttctatttcttaggttacactctctatagtacatacactcagacagaaaaatatatttcacgaagagagccttgaaaaatctcatctctagtcccagtgatgccttaaactggttgtgtgaccttcgtaaacctcagttttctttgttgtaaaatgaaaggtcggggtcggtgacctctagagtctatcccacccctagcctgctccgagagtgattgcatttggcacaatatgcagtttgcttcgcagcagtagcaaaatgacacatgcaacttattatcatcattgtctatcttttgatttccttgagttttccagtctcattaggggagacatctctggcttatcgcacaatgacatcgtgtcttgtaacttaatttctggggacaacacattgtgctgccacaggcacagtgctaataatcaaggttgtctgttctgcttactgtgacttttttgtggtttctggagaaaaaatgcagatgcttttcaattattctaagggaattttgatgaaccccctgggtagagttccctgtgccacctgccatgagaagtgagttttatcgaacagaaggtagggaattgaattgctcatatttgttttctttctggtacctatagtattatttcaagctcaagcattttaataaatatttaataaatacctgtctaaaataggccaaaactgtcataaactaaacctcttttcttcttcaattttaaatgcaaatgagttaatttgacttttagtggaatttccaagataaaggcccatgtttttcctttatgtatccgaaagttatttttgatggtatagtgaacgtcctgcttactacacattttatgtattagcctttggaagcaaattccttaagtttattgcaacgttgctgcttttgttgccattcttataattttatgtatttactgtttctctctctctctctctctctctctctctgtctctgtctctgtctctgtctctctctcatattgagacaggatctcactctgtggcccaggctggagtgcagtggtacagtcatggctcactgcagcctcgacctcctgggctcaagtgatgctcccacctcagcttcccaggtagctgggactacaggaatgcgccaccatgcctggttaattttttaggtattttttgtagagaagggattttaccacgttgcccaggctggtctcgaactcctagtctcaagcgatcctcccaccttggcctcccaaagtgctaggtgtgagccactgtgcctggccgtatatgtccattttgcaggccagaattctttgactgtttgatttacagagaattttcaaatatctgcctctaaggacttttgtagcaattttattgagatacaattaacgtataattcacccacttaaaatgtaggatccagtgggttttgtttcttgtttttgttgtttcttttgttaagagataagcagcaaatacatttttagtataattatgtttcattcaatatttgggacatatgctaacacttgttattattagcattattattagcattattattcaagctgaggtctcattctgttgcccaggctggagtgcagtggcttggtcacagctcattgcagccttgaactcttgggctcaagtggtcctcctgcttcagcctcccaagtaagtgggattataggtgcaagccacagcacccagcgattcactggtttttagactgtccacagagctgtgctgccatcactgtaatattttaaaacattttcatcaccccaaaaagaagccccctacccattagcattcactcctcaccccttccacccctcccgcctgtggtagccactgatctactttctgtctgtgtatagcttattctggacatttcttaggaaaggaatcatacagtatgtcgtcttttgtggctttcacttacatactggtatccacattgtagcacatgccagtacatcattcctgtgtatgggcaaataacatcccattgtatggatataccttaacattttatttacctgtcagttggtgggtgttggttcctgtcttttcggctactgtgaataatgctgttatgaacattcatgtacgagtttttggggcgacaaggttttaatttttcttgggtgtatacctagaagtggaatttccaggtggtgtagtaactctatgtttaactttatgaggaattctcacactgttttccaaagtggctgcaccattttaccctcccaccagcaatgggagcgatccagttcttcccacatcctcactgacactcgttattgtcttttttattatggtcatcatagtggctatgaagacaggcttgtttttaaatattctctatgtagtattctgctttcttccctagaaatcataattaatgcagaagtagcccaaattgtgtatgttaatttgttttatttttttaaaacaaacttgaccccccaaaagcaacaaagcacatacatttcagttaatatatattttctaggacgttattgtctcttctcaaatgagatgatttcgatatgaagcacagagttcctttcattttcctatgctcattctctctctttttaatggtatcacatactgtgcaggaaggtcattatataaggagaggaaaaaagaataatcagcatagaagagaaaattaatgctgtttgtgtaatttttaataggaatgttgtaaaattttgagatttaaaccaactactaatattttttatacattactgggcagtttcctcttgttgcctgtgaactgatactttgccttggaaactcagatagtaaaaatatttgtcaaagcttcaaataccagtgttttaattccttagtcatttagatattaatcctgttctggagaccacctacatgtgtttgtaagggatgtgataactgacactgtatttaattagcactaatattgtgaaaaaagcaaaacatattaagtatctttccaagtcactagtttgaaattagcagaagtgaggaagagaaagtcctgtccaccccccacccttagtttgcatacccatggaagtttgtgatccatttactcattcatttatccaagtatttgataggtacatattttgtggtggacaacattccaggtattgtggaaatggaccaatttcaataggacagaaatctgaatcacaaataagcatccagtggcaaccagctggtgtacacactgcacctaaatacaaattcataggtatcaaaatcaccttcatgtgtcacacagtcacctttcttagttcctcatagcaaaactgggggactctgaggtcagtccccagagtacctggttgaggggtggggcagggcagttgaataagggagtagaatgaatgaaaactttagactctgaagctcgtcactttattctgccatattttagttttgtggtattaaatctctacagaaattaattatcttgcttcctttcttgaattccttttcaaatgttatagttactacttcagtaattctatcccatctgtttatatacaaaaggtaatttaccgggtaatgaccgagggcacctgctttaaagtcaagtgcatactaatttactggctatttgcttggcctcatttacgctctctcggcacagtttctgggtctgtaaaatgagagtgattgtaccatctacctcattggcgacagtgagaattaaatgagttggtgcatgcataacacttagtacagttcctggcacaatgttaccactcaataactagcagtgtggaaatatttcacacctaagagtaaagttttatttacctttaggagacaggatcctgggaactttctggttgccatagctgcttcctcaaggcaactaagttagatgtggagtttctaattcctgttggaaattcagtgaataagaaaatactactgaaagttatactattttctgcatgttaatgatttgatattatacagctttaagttctcagtgctcattcgggtagtgcaggtgagagacggcggctttaggggcaaggcagtgaccctgtggatgatgggaagagagttgttaagaaataattgtttaaatcatccagagagtactgtagcaaggattgttcctaaaaagaactgtggtaatccttgttgaatagcaagtttggacagtatacggtagggaaatctcaggaatactataaacaaataaaatgatggggtgagccctatgaagcgtgtgttctcctgtgggcagtggcagagttacccttcacccctgagtcctgatttctcagcctcttcatgtgactgtctccttggctcctgggaaagaaagaagcctctaccttccctggattgaatgcagcccttcttgtcccgtctgcagagcatgaggaacagctggccacctgcacctgacaaggcctgtggccgcgggcagtacccagccctgcgctgacggccgctccaggttgttgctggatgtggcgagctcgagctaatcgggccttttaggcttttgtttcttagcaaatgatcagctgtgaactgcccttggcctaacttggccttgttagctcagaagcccgcaattcattgcattttaccctgaagaggaatggtaggtctgaggacatatttatttttctgtggattttttttccccttgatccaggaaattgtctgtcttcaacaacctagtcttgtctcctccagagaaaagttttgaatcctctgaggagcggtctgtcgccattgtggcctgtggtcagtgggtcagaccagagccctgacaactgtctcccttcctgggcccaagtggacaccagaggagtttggggctctgggatcagcctgctctggcgagtgtcctttccctcccactctggaactgtagcttctcagccctcttcttgatgctgggcgggtgcctgggaggccccaccccttccctgggtacctggggaggtccccgactgagaggtgggaagacctgtgtcccctcccccagcacactctcagcctctgacttagttctcataggaggaggcaacagcttccaggagctgctgctgttaccctcgacgccatgatgaggaggaaattgcctggtcaggagggctcgcctgcctcttcacagccaggcgtactgtagcggcctcaggagcggtcaccctgggagtgactcctcacctcctaagcagccctggggcatgaacactcgtcctggaaatcctgctaggctggcttaagggagttgcttctagcatgcctttctggataagcctagtagaattgctttttctactataaaaaggaaagaatggggctcctcatattatagtaacagaattcttggtactagaactggtaagccaagagaaatggaagctgaccaacttttctctctgcacagggttcagagggatagaaacacacaatttgactctgcatgcaccagaaccttctcactcagggtaagggacagccacagtttctgggacgttacctaaaaacacaataatcccacttattctctgacagataatcatcagtcatagccccactactcacttttattaaagaaatagctgggcccttttaggtaaagccctttatatactgggaaaaaaggtcatgttatccattcctcaaatcccaggtaaactcctgctggttactcaaaaataaaaaccaaaatgaaagcccattcatcacagggatgcctaatcttgtaatgagggaatcactgagtgtggcacagggaagactcctgagagattctgatggggtacaagtgtgctgaccaacgtcctagatacagtgggcccttgaacaatatgggggctagggatatcaaccctgtgcagtcagaaatctacggataccttctgactctcccagaatgtaactgctagtagcctactgctgaccagaagtcctaccaataacatacagtcatttagcacgtatttggtatgttacatgattatatactgtattcctgcaataaagtaagctagagaaagtgttaggaaaatcataacgacaaaatatatttattattcattaagtggaagtggatcatcttaaagatcttgatcttcattgtcttcacgttgagttggctgaggaggagggggcttgatcttgctgtctcaagagcagcggagtcataagaaaatgcacatttaagtggccccatgcagttcaaatccatgttgctcaaggctcaactgtacaccgaactgaaaaatgattccatttttagtaggaaatggcctactctaagtcctactgcttccctttgcacttgatggcaagggtctttaactgtgtcagtggagctggtttggctccactgatagagactccctgaccatctgataggccacttttgttagaggagaaggtacccccttgcctacctgttcttttcttacttcatgggtcttgattcctgactcaggagcacccattacagaaaagccctgggactagatctaattttatttaatgaaaaacctatggagcatttactcttgcttctaataaattaacaagtcagggctttcttctgaataggagggtctcttgactctttgatatttgacttttgaaccagactagatgaggcagagcttcagcacatattttaccagtgtcttcagcaaatgcctttctctttgcaaagctccatattactaccaaaaattaacccaactaaattgtaatttctactcacccacatttattgagtactgtgtttccttgaaagatctcaaacaaggcaccttcttgcaagatcttcaccaccagaccttcatgatagtcacctcctcattaggctgagacgcatacacagtgattacgttcagacacagggactcctgtgtcttaagaccttgtgtgacccttgtaattaaagcattacactttgcaaaggctgacagtggtataggggctgtctgaaactattcagccatagcctggtctctgctttctttttacaaatgggaggttggctaaggcagacacagggatggctaagagggataaaggacgtgacttccatagaaccttttgttcctagaggaacctctccatgaaacacacagtgaaactagattaaaccaaaaaacgccctcagctccagcagatcctgagctacaaagcacctcttccctaccgagccttctcacccatgcgcactgagtttctgagtatcagaaagtcaggtttctgaatccctagagaaagtaaaaatttccttggacacaatgggttttctttgcttcctgcatgacagtcacgaaggggaatctgaaatagagaacttgaatatgcggcttgctgaagggaagtgtactgtacagtagccccccttctccacgggggatccatgtcaaaatccccaggggatgcctaagactgcggatgggaccgaaccctgtatacgcttgcctttaatgccttttccatttcagctcggcacttagcccacactgtggctgtaacttttgtagttttaggtacagcagcaaaactagcacaaatttctttgtcctttttcacaatttcatggatagaagattgattcttactgtagatcttagcaatctcagcatacttttttttttcttgagaactttcaccttttaactaaaggaaggacttcatggctggtttttggcatatccagattgccagcatcatactcttggaactttgaggccattgtgaagtcaaataatagttcctgccaggcacagtggctcacacctgtaatcccagcattttgggagtccaaggcaggtggatcacttgagctcgggagtttgagactagcctgggcaacatggcaaaactctgcctctacaaaaaacacaaaaattcaccggtcacggtggcacatacctgtagtcccagctactcggcaggctgaggtgggagcatggcttaagcccaggaggtggaggttacagcgagccaagatcatgccactgcactccagcctgggcgacagagccagcctctgtctcaaaaataaaaaaggaacctaagcactgagaccccctgacagtagatctggtaactgagatggccactaagtgactggttggtggtgggggtgtctacagcgtggagatgctggaccccgagagagagggtttatgacccaggcaggatggagcaggacagcacaagatctcctcacactactcagaatgactcacaatttaaaacttatacattgtttatttctggaattttccatataatgtttctggaccatggttgaccacaggtaaatgaaaccttggaaagctaaaaccttggataaggggggactactgtaatataaagtttacagttcctggggtgaaagctcaggcagaccctatctatgcattattacaacgtaccatcaattcaaaaccataaatttgcagaaacatcgttgctttaattcctaaaatattgaatatgaataataaaaataatatatgctttgtcttagaagcacctttttaatatgattgatgtgtattgatctgtttcttcattctaacatgaacatttctgtaacagtcatttcccctgaaatatctaacctgtgggtacctgagacagcttgtcagttaggaagaacagtggtggcgatagccacgtagggctggtttggtcgtgagtgcaagtgtggttgcagcagctagagcagaggactgtgtggagaacatgggtcaggtcagaaggcagtagccaggagggatgcagagtcgagagagaatttgttgattggaatgactcaggttgactttcaggatgaagagaaggggccaatagagagggaagagaggacagttgatgaggcaggctccaagagaggagggcaaagcgagatcaggggctccagtgaaatgcctgagtgtgatgagaagagcgctgtcttgtgaggctagagagggaaccaaggatgggtgggcctgggaaggctggagaggtagcctgtcagggagctgctaacccacttagaaatactcttattgacataacaaggttttttgttttggttttttgtttgtttgttttgagagagcgttcgctcgttccccaagctgaaatgcaatggtgcagtctcagctcactgaaacctccacctcctgggttcaagcgattctcctgcctcagcctcccgagttgctgggattacaggtgcatgccacgggtgcagtggctcacgcctgtaatcccagcactttgggaggtcggggcgggcggatcatttgaggtcaggagttcaagaccagcctggctaacatggatataacaaaattttctatttcaaaagttcagtcgtgggcacaagttgattttgccttacagtcttgatagtgaaggtgcatactatttttaaagctgtattccttagatactaccatattatctaatgtttctaataatggaattagcaaaaaatgactacatcatccaaatttgactttgtactaacatacttggcgtactccatatccctgaaggttaacaagagataaatttggcctagactggtcttttcctgaattcatcacttaaaaaaggaaaaaaagaatggggaggaaaagccacgttttacttttataatttttattccatcattaaaagtacaacttgctttatgatctgaagaaataccatctaagtctttctattaggaacaaaagtgagcctttcagggaaaaaaaaaaaaggagctgggcttaatctgcattagccctttgatgtattcccagattttaaaaagcttcccactgttctcagccacgttgaaacagacccagccatgtgtccggcgctgtccttttctcctctcagcacacacttagccggagacaccttttggccaatgggccaggattcttccattgcatcttcagcatgtgaccgtttgtgctggctcattgggagttctgctgctcagtactccttccccaggcaaagactcttaagttaataattggttcagaagaataaactataccgccctcttggtcttcttttggacatttctttaagatgaggctcttactggtatatctggggtactttattgagaaatagaaagtgctagctgaaataaggcgtatcagtctagagttaggaagtgagaaatgcaatcggtaaattttgcttttaaataaaaatggaagccccattttaattgttgccatttctagtcattttatcatttttaacagcctggttttctattttagagaagttgctgaccaatatttagagagcacctccctaatctgcacatcctcttgtgtgtgatggtgaagtgatgggttggaatcgtttttaatgctgtttccattgatgggacattattaccagaaggagtgctttgtgccagctggtttcatggatggaggaaaacaatctgggtttcagtttcacaaatagaaaaacaaaacctgagaggaaaaggaagtaattcgttagcagtggccactgtgcagagtaggataacctgccttcaaagatttttgtttcatgcactataatataatgtttaataaatactttacttcaaagaacctcactacaagaaaactggccgctttcctgctattcttgttctccggctcagtatgactataagtagctcatatccggtcctctgtggtctcaggtggtcgtttgtgtttatgatccttaagctgaaactgtaaggactgtgtccctattttaagtctttagcagatccaccgtgttctgcaggaattgacagaggctctcgtgaaacccttgacactttgacccatcttgaggaaaatgcttagatgctaaaagcagtgtgcatagggattacgtcctccaaaaatagaaaactctaaatttactaagcagggagtagagaaactcatcagactgcacctcaagtttttgatgtgttctggtcgcctctgcactcccattctagacttctaaacaacacgttcaggatctctgagataaaagctggactgaagttacagaaagagcattagagatgtttgaatttttcttttttcccccctgtagatatatttggcatatgtagaatttgagagtccactattgataccagtttcttccagatattaacacatatcaaatagacagctagaactcagaagaaactaatggagctctgaaagaaaccattgttttttccactataaatcttaactcaacagcatttagggtctgggtggagccagtcacctgggcagctgcttcacacccattttgaattagctgcccagtgcttctggtgagcacctcggtaggagccactgctgtgaactcttttgcaagttctggtggtgactggtttggtttttattgctccctgtttgatgcactgataggacctagggctgttcttagaaatataggcctgagacgacttaaatttcacactggttttgtcttccgtttccacattcctctcactgactctccctcccttcctgccctctctctctctctcatatgaaatgagtttaaaatcagaggggaaggattgctttaatatttagcagtctaaacagagggggacagggctgaagaggaggaagggagtgaatgggtgtagaagagaaaagctgttcccaccccattgctttaatgacagtggaaagggtgcatggattgggcctgtgtttctctatcagctactttgttctttaaagcactggctagctaagccatctctttctctcccatattttgcctctttgagtgtttgcctagaaccacttagctgtggcagccctgctgatggggcaaggtgctctgcaagtttctaggcaaggtttctggatccatgttgaaattgaacgcagatagcacaaccatattataacagctacttacaaaccagtcagcacatgtgtggtgagcatttctagagttgagttattgcttaggtcaattgtaagaggagtttctctgaaagagttctgctctttgaactggcaaccccaactctagaacttacagaattgtttttgttaatttttctggcaagagattcatccaagtttcctaaacgtactacaagggtatatgtatacagagaccttaaggaatggccagccatgcaaaccctagggaacatcttatctgacagttcttgggatccacagtggcttgggtcataatgataatactgtaactgggagagctgatgtatatggagcactcagtatgtgtgaggcaccatagattctctcttcatttaatcttctcatgagaaatacagacgttaaataattttcccagggtcacataagctggtactaggaatgaggcttaaagcagggctctctaagaacaaaagctgtgatgccttagcatcattgacagcagctcccaggtcttactcatcctagtgcagtcccgttagtctacctgagctccccctaacacaggagttggcctctgcccactggggctttcattcccactaccacccacagtttctgcatatggcaggtcggagcccatcgtagtgtcatgagccattctctaaaccaccgtctgcctgaaaactgcctcattctctgtcattcctgaaggaaggactctggctggcccatctcatctttactcacctaggtgttcaatggatcactgggtaatctgagggttgatgttcttctttagtctatcaaccaatcccagagatgggaggcagggcttacataacactgtaaatactgccacctgggatgacttctgcgggagaagtactgagacccaagtccaccatgggaactaactggataagtttccgaagatttatgtcagtaacattcaccaccgtgtcctttgtattcacaaaataattagaaactacctgactgtccatcaataggagtttagttaaagaagttttgttgttccatatggcagaatattcatatgcagccattaaaatagtgatcaggtaaatgtttacaaacatggaaagatgcaatatgaactatattgtaacatgaaaaaataaagttaaaatggcccgtgtaggatattgctttgttttacaaacacaaagttgaggctgggtgcagtggcttatgcctataatcccagcactttgggaggccaaggcaggatgatcacttgagcccaggagtttgcgactagactgggcaacctagtgagacctcatctctgcaaaaaattcaaaaagtacaataagccaggtgtgatgatacatgcccatgaccccagctactcaagaggccgtggtggcaggatcgcttgagcccaggaagtcaaggctgcagtgagctgtgatcgtaccactgcactccagcttgggtgacagagcagagagactctgtttcaaaaacaaaaagcccccacaaacatgaaaggcttaatccaggactagtaatagttgccgaacttgagcggaattgtcttcatgctcttatgttagcatctgatattttataatgagcatatcccttatagattcagcaatatatttgaaaaatacaccaaggtaaaggagttgtgctaattaaaagtagctgaaatgaaaaatattgattattgaggaagaaaaacaatgaaagtaagacatagaggcctcagcagtattactgataactcaatcattgttacctgtataatagaacaaattaagggcagaggttctgaactgaagcagtgttattactaaggtgcttgaaggggggaacccacatttctttaatagcaacactccaggtttctaacatctggaagtatcacaccatgaattttttttaacccagaaaaactgggaaaaacttcaaatcactgaatgacgtgttaaccaagtttctgactttaagactttaagattattgactctgaatttacatagaattctaagaatttcagttagttgattgtgtgtgtggtgtgatgtttaaaataagtttgggaaatgctgggttaaattaatattttttatttcaggatgtctcaaaatctttactaagtggatgtctgttttgaatctccaagatggaatatagaatgcagcatttctcaaatggaatttgaccactgagtccttgttttctttgggcatgtactaagtagcctttcccagagctcattttgtgggataccataggaaatgctgcgatgggaccttttaattaatttattttttgagacagggtctccctctgtcacccaggctggagtgcagtggcaggatcatagctcactacagcctcaaaactcctgggctcaagcgatcctcctatctcagttcactaagcagctgggactaccgaagcacaccaccacagcctgctaattaaaataaaaaaaaaatgtagaaacaaggtgccactatgttgcctgggctggtgttgaactcctaggctcaagtgatcctcctgcctctgtctcccaaagtgctgggattacaggtatggccactgtgcccagccatatatgtatatatatatattttttaatgaagccacaagcattctgcctctgtgctttttatttatttatttatttatttttgagacggaggttcgctctggttgcccaggcaggagtgcaatggcacaatctcggctcaccgcaacctctgccccccaggttcaagtgattctcatgtctcagcctcccgagtagctgggattacaggcatgcgccaccatgcacggctaattttgcatttttagtagagacagggtttctccatgttggttgggctggtcttgaagtcccgacctcaggtgatccacccgcctcggcttcccaaagtgctaggatttacaggtgtgagccggccgaccctatatattttttaaaagcttttaagaaacacagtaatctttgagttgagattttgaaaaaaattgcaaaaatattgcacattagcattttaaagttagtggaggctgggcatagtggctcacacctgtaatcccaataccttggaggctgaggctggagggtcgcatgagctcaggagtttgagaccagcctgggcaacaacatagtggtatcctgtatctacaagttttgtttttttgttttgttttttttttgttttttttttttaattagctggtgtggtggtgcatacctataatccagctactcaggaggctaaggcaggaggatcacttgagcccaggagtttgagcctgcagtgagctaggatcgcatcactgcactgcaatctgggcagcagagcgagaccctccctcacaaataaagttagtggaaagtgctatagtaaacttttcccagttttcccctaatctgttttaccatgggccactcccttacccccacttttattttttttcacattagctattaacatgccctgaaagtaatgttccttagaattccatcaggcaacactactctagatcagatctgcaaactacaccccaccaactgtttttgaaaataaagttttggctgggtgcggtggctcacgcctgtaatcccagcactttgggaggccgaggcaggcggatcaccaggtcaggagatcgagaccatcctggctaacatggtgaaaccccgtctctactaaaaatacaaaaaaaaattagccaggcgtggtggcgagcacctgtagtcccagctactcgggaggctgaggcaggagaatggcgtgaacccgggaggcggagcttgcagtgagccgagattgcaccactgcactccagcctgggcgacagagcgagactccgtctcaaaaaaaaaaaagttttatcggaacacagccatgctcattcctgtatgtactgtcagtggctgctttcacgtgactgaagcggaactgacagtgtaacatgcaaaacaggtaagaaaagattgaccatctagcccattgtagaagaaagtttgcccacctctgacctagatgattagtcataggtagttgcatttgcaaattgactaattttctttttacactccagcatgaatacatgcaattgaacagctaatataggtgtgtgtatgtgtgtgcacatatgtatactaaaatattgtaaaatgtcaagtgttgcaaataacattgttaactgaaagtgacggaatggccggccaaatttatatttattgtgtcaaaaacaaaatgtaccagacaattaagataattttacccaggccactgcagtaggggtaacgtttattaatgagaaatgtctcagagagaggaagaactagggttttataaatgcaggtgaacaagggaggggtccaagaattacggggttcatgaagaagagtggaagtctatggggaaggttgctttgcctccagccatttcctgggttaagaaagaggaggaagattctgtaactgtttctgtgttctaggagcacggggctcagggaaagttcagcattgtcagttgtcaacaaaatcagtaagtgttattaaataccccatggtgtgtggttctggcactgaaatggggctgtttcctaaggctctgtccatggccacctctgtctatttctgcattctgtcttgcattgcttctgttgcctatatcctggtcagcacagtttatggtgaatcattgcttattgaaatagagacggcaataatgaagccagctattataaattagagcaaatatacacatccaatacgttttaaacgcatgtgatctctggagtagtatcactaggtagcttccatttcagttcgcctttggtatattactgtactccaaagaatatcatttttccctctgtaaaattttcctcatgaaaatggtcaccataggtctgatttactttttggatcagtaacaggtcacagcataaatcccattcctgcatcaaggcggaacaagaccctcacactttggagggagctgagttcctgtttagaagaacatgcacagttagataaatctgttcacacggcttagatgatcagagccaacatctgatgactatgagcaaggcacttttctaaacatttttagtattttctgaacagttttgttgaggtatactttacagataacattcacctcttgagctgcagttcaatgagttctcgtaaactgagttgtgcagccatcaccacgttccagttttagcacatttccatcaccccaaaagttcctttctgcctgtttgcagccaatccctgctccctggccagccacaggcaagcgctgtcaatgtttggacagtgttggattacctaatggactcttcaagacagtcctttggggtgttactgtcattctctgttttacacggtgaagaagtgaggcactgagggcactcagggtggtttcaaatgaccgaggccaggtgctcagggcccagaaccctcttaccccctccaacttcagtgagcttcaaaatcacctgctgagcttgtttgaccacagacttgtgggctccacccttgaattcctgacgccctaggtctgggatggggcttgacaatttgcatttgtaaaaagttcctgaatgctgctgctgctgctggtcagggaaccctgctttaagacctcctggtttatgcaatttcaaacattgtaagaaatagtcactcatgtgattggtttgtgtgcttggtgtagactgtacgaggatttttcaaaagtaagtattgttcattctaaaggaaggaaatgtatgttatgagatagaattatataataaacagaaccattaaatgccatctgaaaagtggtgttttcaatggcaggaagtagcattgctgcgtattttgtgtgtgtgcgcaactcagctttgtgtcattgtgtaactttaatttgaaagaacatcacgtgactgctgttttcatttctgccttttaaaaagcagacagctattcagaacagcaagaagcagacccaaactttgtttgtatgcccctagtcataggcaaaaatggaaagggtaatttaccaaaaaagaagaaaatagataaaaaggaaaagaatggaaagaaagtactgactcactgcaaacagctgcaaaatgttgcccttgggatagaggttaactcggttgtgaaataatggccaaagcggtgcactcttaataacttttttgtagccctggagaaagcttctggattgactgtgagaagcttggcagaaggtgctgcggcctggtggctggctcagcaggaggcctgggattgaaagctctcggtttgtacaagctcttttggatttgtaacacttttattttaaatctccaataaatgtaaatattttggtccctttttttctctattttttaaaataaaaatattttagtgaatatgagttaaatgagaatcaagtggcttctgggcctccctgaaagatcaagtggaagcactggatgactctaatgatgccgaattgtaatccataaagcacctgggcagagttcaatcagaggtcccatttcagaagttttttggaatgtagggaaagaattacttagaaaaggttcatctacttggagaggagatggttcaatatgacttttagaagaagccgcagtccctgccccacaggggctgcttagattgcttagatggattgtcatctctctctctttttttttttgggacggagtctcgctttgtcgtccaggctggagtgcagtggcatgatctcggctcactgcaagctccacctcccaggttcacgccattctcctgcccctgcctcccgagtagctgggactacaggtgcccgccaccatgcctggctaattttttgtatttttagtagagacagggtttcactgtgttagccaggatggtttcgatctcctgaccttgtgatccacctgcctcagcctcccaaagtgctaggattacaggcgtgagccgccgagcccggtggactgtcttctctctaagcagtaagagacagtgggaactgcagaagggtgtttgcagcctcatgcagttgactgaatgaattggccccagagtcacccctagcaccatcttgatatggacaggaggcagggaaatactgggtagaagagggtggttccccagcaaaggccccaccctcaagcctggaaatccggagccctaaatgggaacaggcattcccgtttttgtgcccaaatgttgccttttggctcaccacgcccccctctcctgtatccatataaaccccaaaccccaggctccacaagcagaagagtggcagagcagtgcagcagagaaggagaaaagaaaaggtgcttctgaacattgagaggagttcggctggggaaggtagcagagatcagctatgggatgaccaaactccaggggaaagatcatcttcccactctgtcccctttccagctccgcatctctcaccgagagccatctccatcactcagtaaaatcctcacattcaccatccttcaagtctgggtgacctgattcttcctgaatgctggacaaagacttgggtaccaagagggcagggcttacagggctgtcacccttattctccgctgagctgttttaacacgtagccatccgcagatggcagcttctaaaagagcattaattgtaacagacccccagacactaccatggggccagagcccaaaagtgctcaccccagctcctacacctgcccctgcccatctgcgtgctctccctcccataaggggtttgagcacgtgtcggccaagcaaacgagcttcacccctgtcacaagtcctgagaggagtcagggaactctcccatttcattctgacacaggtgggactcagcattctcagaccttcaaaggcctgttgggtggatgtggaggtgtgcgctgccccaccaagctgatgcctgatcaggggaggccactagaatagtctcttgtacagcaacagagcctcttactacagtgagcttctcctggggctttcagagtacgtccgagctccacaccaagaagagagccaacccacgtggatgcagctcggttcttagggctgacttgaaacttgataagactgcctcaagcatgtgccacaaccccagttcttgcaaacccccacagagtcttgagaaatccctcttgtggtccaaattggggaaatatagaattagtcaaaagaaaaggctgaagtcttggtcatctacatgcttgcaaattccagccttcctggcctgtgagtgttgcatgaatatagcaggaagtcagcactctccatctttcacaaaacgtgatgtgtttcagtccgtgcccggtgaacactattctccacctccctccctcccaacttgcttgctttcagcttctctttaaagtacaccttaaaattcaatctatcattcagacatagagagcagtggcatatgagaagcaaacatttggctgggcgcggtggctcacgcctgtaatctcagcactttgggaggccgaggtgggcagattacgaggtcaggagctggtgaccatcctggccaacatggtgaaaccccatctctactaaaaatacaaaaatcagctgggtgtggtggtgcacgcctgtaatcccagctactcaggaggctgaggcgggagaagggcttgaaaccaggaggtggagattacagtgagctgagatcatgccactgtactccagcctggtgacagaggagactctgtctcaaaaaataaataaataaataaataaataaagggcaaacttttaccaagttctcatctcttaagccattgtttgtttaatggagtagtagatgatgtgggttgttatctaacaagaacattgtcccttgtgggactgcacttagcattcaccttcggatgccatggctaggtcaggatgccagcctaagcagtcttgactttagatttgaaattccggccgggtacggtggctcacgcctgtaatcccagcactttgggaggccgaggcaggtggatcacctgaggtcgggagtttgagaccagcctgaccaacatggagaaaccctgcctctactgaaaatacaaaattagccaggcgtggtggtgcacgcctgtaatcccagctactcgggaggctgaggcaggagaatgggtttaacccgggaggcggagtttgcggtgagccgagatcgcgctattgcactctagcctgggcaacaagagcaaaactcaaaaaaaaaaaaaaattttgtaattccttcaacacattataacatgacaagtgcttcttgccttatctactagtgaagactctgcccggcccgctggcttcctaacagtcctgtggcggtctgttctttcctgtgtacactccttaaattgtgacatccctacttctggaaagctcaccatttcctatacccctatttgatttattttatcccaagacttatctcaaatcctccctgctcccaaaatcctcctctcactgccttagttctccctctgaaattccatagcatttcattttctcaacacagactcagagaaatttgctggtaggagggaccttagaggtgcgattctcaaccggggcagtattgcccccgggcatattcggcaatgtctggagacatacttggttgtcacagctgggagggagtgctatggcatctagtgtgtggaagcccgagaccccgctaaccgtcccacccaacacaggacaactccaaaacaaagattaatccaggctttcggctgctgttgggaaacttgtccacattaccaccacatacctggttccacaatttacctctacatgtgcatgttcctgagtaattgcacactttgtaatgtctcgtagcccctatagctagtctagttaatttctggtcatcatggaaaatgccacctctctgaaatggccagcactggagagacgctactgctgctgatggtgaatgtcaggggactactaggtgtcccttctatttttgttaacttgtagttatttgtaggatgattgcctttagtgcagaaaattttttttaagtttataaagcttgtgagaaaaatccttatttgtaaagaagctcagtattattttgaatgttcttgcttctcatttatgactactcaataaagaaaataccttttcctgctctgctgtccagtttgttgggttaatttgggagatagtgtcagcaccctggaattgtgccaacttccaattatcactctgtgtaaccactgacttcaatttcaaagtaattactgcagatttttctcactaccctgaacatagcctacacgcttttaatcctacacttatttttttccccatctaaaaggaaaacttattttgattttgatactttttaattttttaaaacttattttgaaataacttagacttgggaaaagttgcaaaacaataatacaaagaatgtccagataatttcacccagagtccgcaaatgttaacattttatcagggttgatttattgtgtattcctctctttctctctctctctctctcttcccacctccaccatctatatatgtaaataattggtatcttctgaaccatttcagcaaattgctaacagttcttaagtgtgtatttcatcgacacaggacaacattcccttatggaactgcaatgcagtactgttaccacaattaggaaactgacattgaaacagcaccattgtcttatctacaaacctttcaaattttgccagttttcctactctttaaaatgttttcaaattgttgccagtttactcactacaaaaaatactgtctttaaagcaaaagaaaaagaagtgttattttctggcccaggatccgctcagagtcacaccttgcattgacttttcctgtcctgttggtctcctgaatctcgaatcgttcctccgttgttctttggcttccgtgatcttgacatttttgaagacaggccatttattttgtcaaatggctctcaatttggattcatttggtgtttcctcacagtcaggttgttactcatttttggcaggaacgtaacggtggtgctgctgcgttgtcctcgttgtcccctctcgggaggcgcatgttcacgtttctctttgtcccactgttaatggcatcactttgatcatttggttcaggtggtgtttgtccctttctccactctgaagttactactttcctttttccatttatctggtaaaggaaatagacagttaagctggtaatttcagcataatatggtgagtgttaaacagacagccagggtgccttgggagccagtaagtagatgtcacccaacctggtagctcagggaaggcttctggagttgatgacacctcaactgtgacttaaggtaatgattatgagtcagccaagccaaggaaaatggggaggatactgtagaaggacatgataccatgaacacagccatggagccacgaaacttcatggtgtgttcaggtcgctacagtggctggcagcttgagttctaggatggagttcggaagatgtcacggaatcccagtatggcagtacaagtgcacttgttctcacgggaggctggaagcaaaggctgtgctccttgttcctcaaaagctctagggtctcttttgtctcttaattccatagttctctctcccctaattaacacagagctaaaaatagcagagaaatggggaattggggggaagattatagtcaaagaagtttcatcacaggatgcacagttaatttggttgcactggaaattggtttccttctcttagaaaataaaaatcatctttgcaaaaaattgtcacttctttttctttcacttttttgagggtgaaaattagtgaaaaatgaaaatatgaacaagttgtgcaaataaaactaaaaagtcaccgaatttggctttgaagtatgcatctgagaagcctactattctttggcttgaatgagaagtgtaagttgtggaatggtaaagcagtgtagcctctttgacacccagccaatttaatttttttttttttttttaattttagtggcagtaagtactgacttaccaaggcttggggtagcagatactatcacagctgccaggacttttccaggctcctgtcaagaaactgctgcaattctgcaagagtcttcagattaaattcatgccaagtcatttcctctgttcttctaccagtgaggtcacctttgcagctgaccattagtgatgctgtcagcaagaaaaggattatgaactgaggtctaaatttcagtgatgtctaggcaaaaataaatgttcaaaagaatttagcgaggtttccaagacctggtaaatttctccctaagagaaattgccagatttgtgggctcttgattttagcctgaagaatcacattcttcagcactggaagtttttccttctttttttacttttctttttttttagacacagggtctcactctgtcacccaggctggagtgcagtggcaggatcataacttactgtaaacttcgaactaccgggctcagttgatcctcctgcctcagcctcatgagtagctaggattacagatatgtgccactacacctggctaacctgtttttttgtagagacaaggtcttgctatattgcccaggctggtctcaaacttctggcctcaaagtaatcctctcacctcagcctcccaaagtgctgagattacaggcgtgagccaccacacccagcccaacattggaagttgtcatagttatcgccagttgcctctctttttgtctggagatgtgtaggttagccaaaaaaaaaaaaaaaaattaccgatttttttttattttttcattcacaaatattgaatgtcttctctatgtaccagatactattatgctctctcatggaggttagtactgtctactggagaagacataccaaaaacaagagagagagaaagaggaaagccacaaatcagttggaaacacgcccgtattagtgactgaagagcctgcaaatgaaagctttacaaattcatatggccaaatagatttccttgctccttgagttaaaattcacataacacaattaaccattagctaagttaaaacatacaattcagtgcatttattaacgttcacaacgctgtacaaccatcatctctctccagttccaagacgattcatcaccccaaaaggaaaccccatttccattaagtgatcactccctattcccccacctcccccagcaacccctagcctactgtttgcgtgtgacttcttccactcagtataacacttctgaggttcatccacactggagcatgtgtctggtctttgtaggtttattccactaccaaccatgttctttatgcttaaaataactcctccctattgaactgttttggagtgatatttcctggggtggaggtagtttaatgattcatctctgtcttgttagcatgcttgtttatggtagagagaaattttgtattctgccaccataccttgtcaaaaccttttaacaaggcattgatttggttctctggttctgagaacttggcagtggaagacaagacttccacccgcattgcaagcaaaatcattgatgtcaattcacgttattgtggaaaaccgtgagttgtgacaagtgaaagcttttcaccaagccacaaaactatgggcgtgtgcagtcaacacacggaacacaaggggtttgcttccgtggctcagcatagcactctctcactagttctaaaatattcatagcctttgctgttcccaaaagacgtttgaaaaataagacttctcctttgtcagcatccgcgctcacataactggtgaaactaggagatagttttgtatcccggaagataatcattgttccattcaggtgttgggcagagagaaatggcttatctgcacatctgcaggatgtaagagattagtgaaatatttgtgattctgatgttgatgacttttaatgtttgacagagaaacttttgcaattattttcttctggtccaggcctcactccttctagcccacatggctctagtcaacctcctttaatcagcagagtaataggcaagactgtagtaggatgcctcaagacagacttttatgttgggacaagtagtgtcttattaaggcggttccagcctttcatatcctgcctccttgggataaagagtgtttgtttacagagcttctgggatagactgctgcatgctgcatccgtacctctgttgcagaagcacatctgtcccattatgtctagtgacaaaaataagacctacgcctcagtgaactttgcatacatctgaatgtaagcaagacaagtatatttgacattttaaaaaggttttttctttcacagttttcaaaataacataggagaagcaaaggaaaaaatatttcttgtgtttctaattcacaggttgcttgagactttttttggaggtgctagcattttattggccacagttttgaaggaaaatacaatgaaatcatgcttctgtcgtttggggaaaaggaataacagattcattttttctttttttaaagatgagagagatagtatttggaatctatctttagactattctacctctgaatctaattgaagtaagaaattgggcaagaatggaatcttacttaccacccaggaaaaaagctaaacaattgtggctcagtccattttcccctgagactgtcttcagattgaggcgatcagtgttaaaatggatggaatcaccaggctctccacattctagtaagattgtagtacggttgaaagtcaaatgaaagtccagctcttcagtgtgtcatttcctcttgcagacaccagaccaagggcagtggtggtctggcgcttatattttgttattatttgttgagaccagaactctccttaaggatatatttatatatgttttaatattaaagtttcttttcaaggaatttatactaattagttcatgtaataataacatgtgcattccatttaaagttaccttgctaaattttctaagacttgttagcttccccatagtttttaataaaccaaaagatcaaacgaacagtccccagttgcccaaatattgagcagttaaggctggtttcagctcatctgaaatctgtaaacatttaaagagaacctctctcccagaagatagtgagcacggtggtattctccagtctcagaatattaaggttacttacagactagagaggccttcagtctatattaacgagttcctttcctaatctcacccttctaagaatatatttgatccaatttagggacagcaacattgaggccagagaaaaattaatggggtagtaactgtagacaccaaaacactccccaaatcttgagacatcaaataagcaagactgaatttatgcaaaagatactttaaagatgtttctttagctgggcgcagtggctcacgcctgtaatcccagcactttgggaggccgaggcgggtagatcacaaggtcacgagtttgagaccagcctggccaatatggtgaaaccccgtttctactaaaaatacaaaaattagccgggtgtggtggtgggtgcctgtagtcccagctactcgggaggctgaggcaggacaattgcttgaacctgggaggcggaggttgcagtgagccaagatcgccaagatcatgccactgcattccaacctgagcaacagagtgagactcttaaaaaaaagaaaaaatgtgtcactcagagatttttctacctagaacaagagtcatacatactttttgaaattattttatctatgtaaacttacgaggtacaagtgtaaatttgtgacatgcatagattgaatagagaggaagtcaaggcttttagatattcatcacctgactaatgtacatggtacccattaagtaatttctcatcatccaccctcctcccaccccgtcacccttctgagtctccattgtctactatcagaaaagccttctccagcagcgcattgtcagctgagtctaggagaagaaagccttctcatggacatgagctaaattccctgggaaaggccattccataatggagaaggccttctgttcacccacagtgtggtcctcagaccagcagcttcagcgtctcctgggaactcactagaaatgcagaccccaggcccagtgtggcagctcacgcctgtaatcccagcactttgggaggccgaggcgggtggctcacgaggtcaggagtttgaggccagcctggccaacatagtgaaaccccgtctctactaaaaatacaaaaaaattagccgggcatggtggcgcatacctgtaatcccagctacttgggaggctgaggcaggaaaatcacttgaacccgggtggcggaggttgggctgagctgagatcgtgccgctgcactccagcctgggcaacagagggacactccttctcaataaataaataaataaataaataaataaaatgcacccaaacctgaattggaaactcaggtggggggcctagcggtctgtggttttactagccctccaggcaagttttgatgctttggtgattgagaactgctgcttatgctgtcttggtggagagcacttcagccagtgcctcttctgctgattctgtatttatcaaagaaccactgactataatttagtgctcacactacagttaggaggtgtgtgagttccctttacaaacctatttctgattgtaaattcctaagatgttttacacatcagtatcttgtgagcttgataaaagtgaatccatctcgttcagagtgatgcattatgagtgtatagtggaagtctagcttctaagcctgtgaaacagaggcccagccccctgatccaggcagatttcactaaggtagaggccagggtagatgtccctgctgaacgggcaccctctcatcccacctcaccctggctgtgtgtactgtatatttttaaccaagaggagagcagagcggcacagaatggctggtactcagtattcctggtttctggattatacagatgcaagggaaatgtctcctagtcttatttcatgagttactgtgtagcattattgaattgcagtggtaagagggttaggtaggcctttctcatttttgattagacagctatcatttacaaattagaccacagggaatcgaccttaacttctgtgactaaagcttttggcagttacttttggcatttctggccctctagacttgaaaatgactgagtggttacaatttacaaagttaagagagctttctgttgattggtgtgaatggtaggatatgagacagactcttaggagtaaaggacagggatttagggaaaatcctagtggagtcactgcagccaggcagagttgtctgttacatgcagataacaagtcacgctgttggggttaattagaaaaagaggaaacaaagttgagaaaagaagagggaggcagagcagacggcagaggacaggaattttcagtgcagcgttgggaaaggttgtggaagctgaggctgacgcagacctagggcgttaaagctgtatttacagctggaccttctgattcctggggaggaggggaggctggatcgtgggtaagagagactggcagggccagtggaggatactctcccactggagttgtccagtgggagttgtctggagttgtcctgggcagaggctgcctgttgacagaggctcagcacagccatgcttaagataagctagctaagcaggtacgaggaaaaataatttacctgaagttctttctggccgggcgcagtggctcacgcctgtaatcccaacactttgggaggccgaggtgggtggatcacctgaggtcgggagttcaagaccagcctgaccaacatggagaaaccctgtctctactaaaaatacaaaattagttgggtgtggtggcgcgtgcctgtaatcccagctactcgggaggctgaggcaggagaatcacttgaacccaggaggtggaggttgtggtgagccgaggttgcgccattgcactccagcctgggcaacaagagcgaaactccatccccccccaaaaaagaaattataataaaataaagttttttctgtattaaacatcttgtgtttaaaagtctacagtgagtcaaggatgttgaatggccaaagatcataaatctctccctctttaaatgagctgtgggctgggcacagtggcttatgcctgtaatcccaacactttgggaggctgaggggcatggatcgcttgagcctagtagttcgagaccagcctgggcaacatggcaaaactctgtctttacaaaaaatttaaaaaaaaattagccgggcatggtggcatgtgcctatggtctcagctacttgggagactgaggtgggaggatcacatgggctgaggaggttgaggctgcagtgagctgtgatcacactactgcactccagcctgagtgacagagtgagatcctcaataataagcagtcttcagtgtttcattttacccaggctaaatgtatttgtagtatacatatatgtttatattttgatagattcatgtgagtaaaagatatacaataaaaattgacattaccgaaggggagtgggattagatgtgagagggtggattagtaaattgttttacacacctctttaccattggacttgttacaataagcctataactatttttaactccataaaatacattgttttataagagctgtcaaatttcacttgctcagtcccctgattctcattttcttataaaatctcaggttcctcaaatatgaattcttctgccatgagaaattagcaacatagtcttaaagtctggggaaagattatagtcagatccacatagataggacaacgttccaagtcgggagaatgttcatatgagaattgaatagaaggccaaatttttaggctaagaatatgatcagaggacacttccagtggagagagtcagcgtgaagagttgaggtgcatggctgttgtgcatctgagagcgtgtacgcgggcgtgagagcgatttagatccctgtgtgttgaattcgagacccacccagacagcctccagtgtcttctcagtgactgtgcccaagatttctgtccatctgtggacatgttttaatgacagcaattagtggtaatgatggctattaaatacttaatgacatttctgtgttctgaggcttcttcatacaagaattcacttactggccgggcaccgtggctcacacctgtaatcccagcactttgggaggctgaggtgggcagatcaagaggtcaagagattgagatcaccctggctaacatggtgaaaccccatctctactaaaaatacaaaatagctgggtgtggtggaacgtgcctgtagtcccaactactcgggaggctgaggcaggagaatcacttgaacctgggaggcggaggctgcagtgagccaagatcatgccactgcactccagcctgggtgacacagagagagactctgtctcaaaaaaaaaagaattcacttactttccacagaagcaggcactgttatgatccacagttcataaagaaggaatctgagacatggaaagtcgacctttcccaagcttgtaagtggaacagtattctgactccagatcctaaatggtaaaccactactctctgctgcctcgcagcctggagattttctgtaagagaggggctaaaataaaaaagcccacctcatattgatcacattcttagtaatccttgaatacgtttatattgtgtcattcatgaatgtcttttccctctggccagattatggtatttaggtcaggagccattttttcttgtttattttgtattcttacattgcccagatatgctcgataaatggtttttgaatgaattaaccaaactgtttctctaattcactatgcttttaactgtctaaggaaaagacaaccgtggggtccctcgctgcatgcctgggaacctctctgaacacggaatcaacttcctttctttgattttagagccagatgtgatgtttgaagaatgtaatctatttgctctcaaacatggagagcatagagctagaactccaacaattagaagttaatctgagatgtcctacaatacatgattttaaaataaaatccaccagtgtcagtctggtgcagtgactcatgcctgtaatcccagcactctgggaacctggggcgggcggatcccttgagcccaggagttcaagaccagcctgggcaatgtggcaaaaccccatctctacaaaacatactcaaacactaagcaggcatggtggcgtctgcctgtagtcccaggtacttgggagtctgacgtgggaggatcacttgtgcccaggaggtcgaggctgcagtgagccatgcctgggtgccagagtggtaccctgtttctctgcccaccctcccccatcccccccaaaaaaatccaccactctttcattctgaacaaccagagatgtttggaaaggacacaggaaataatacctggtgaatagttactctcgagcacttgctaggtgcgctgcagatcttcgtaaatttaatcctcaaaacagttactcaagacctgtattagcttgattttagagttgacatctgtctgagaaggaggtaacttggtcagaaggtgccatctcgttgggatgtcacagtcgggcctgttggcttcagagacttgggctttcatgctctgctgctgccaggacgggggccacatcgccctgtctcccgatttctcccatggctctccaggacttggccaccttcagcatcgtgtgttctgtacacagcacagcatgagggtgccagcagtcctccttggctcagcgtctaggatgtgtcagaactgtaaaccccaagattcttaggcaacccccctaccagcgctcatttctgctacttcagaccagaaaccttcgcgggcgggggtgggggcgggggcggcgggggtttcagttgctttctgcttcagttttcttggccgacggtctacctcacagtatcacagtcatctttactttcgtttactctgcctttctgtattttagtttctgaatttctgtcccataaagccagcatttaggcattttgaattttgagtttcttcagtgaattcataatagtaaaaatatttaagaaaacctgtaaaggcaagattgttgttgaagcccctcacattagaacacttcccaggtgctccaacctgggggggactgaggacttacatgggaagtcagagctccccatcttttttccccaaaggtcattcattctgacagcatgacttcaacttgatatgagcaaagagcatttcagataggaggagaaaaaggaagagggttgggcaccgtcgtgaaatggtacacttcctcaccgcggtgcttatctacataattgtgtttttataacatttcctttacttttctgtaagctgatgctgccctaattatagatttttaagagaacacttcattgtaccccaaattatacagtgctttaaaaaggtactttcttaccggtttaccaaataccttataaattcgtaattacataaaacaattcgagatacagaatagaaacagcctgtactgttaacaggtgttggtattgttatataattgagtacatggctttcaaagatctataatatttttcttgagtaaaaagaaaaaaatgactcattatagtcgtaatgtgtcacagagactcctgatcaaacagaatgcacatgttctattttgtgcattctgtacagttcattgtaaatggacttgcctttgtggaagtgaaagtgccacttattccagcaaattgcctttgtggcatatgcacctacttgttagacagcttgggggcacttgggccaggcagaggctgggccccctttatcatgggcacacctgcacacatggcactatggcgccacactccaggtaggctgctgtcattaacagacttgctccttgggaaacccactgaggacttctcagtgccctcctgcccatcagagaccacctcggaattcttagaagactaggaatggggcagcttcctagacgctagctcttttcccgccacatcagttttaggcctctcttatgatacaagtgattcagattacaaggtaacctcagtgcaacacaagggaagaaataaatcctctctgttattgagtgctgggtctagtgtttaattttctttcttttcttttctttttcttgagacagagtctcgcactgtggcctgggctggagtgcagtggcgcgatctcggctccctgcaacctccacctcccaggttcaagcgattcttctgcctcagcctcccgagcagctaggattacaagcgcccaccaccacgcctggctaattttttggatttttagtagagacggggtttcactatgtaggccaggctgttcttgaactcctgacctcatgatcctccagccttggcctcccaaagtgctgggattataggtgtgagccaccgcacccagcctagtgtttaattttcaatttaatttttggcactatttttttttaagttgctcatcttaggacagtataactggaatgagccttgtgtttccagttacaaaaacaagacagaacaaaggatgaggctagatttttgtattattgacaaccccatattcttccctccagaggagagatcatctttcggaagcaagcccgagatacacacagtcttacccattccttcaatgctgttgatgattagccttaagatggttcttttctctaaggaaaccctccccatttttgcaggatgtttgaaaaatgagttgctgaatgggcttcagatattcttattcttctgttttgttgggattttcttcccactcctatttgtgttaatttttccctcgaaaaatgagattgctgctcactgccgttgagcctccttgtggcacattcattggtccagtaaacgacttaactccaagaaccacctaccagtaacacaacaaaaccttgagtacagattgattcataaatggcagcggacgagtgttgaaagtgacgcattatgtcgctgcaatgtattgacattatcaattgtgtgtcactaaacagccaggctaactggatgatttactttgtgtttaactgcctttttcagttggagcaaatgttgaggaactgggatgcaatgtcagaaaccatatattttcttctgttaacaccagcttcactgaggcgtgttggttttggctgcaggctgtaaggctctagtgtaaaaaggtctaaacaagtgattaatgcccaggaggcagggctttacactgtctccacatcttttctcctttctatttgtgttgccttaatgcttggggtggggggttcaggctatttattgtgctgacgttggtttccatcctgagagtccttgatgtttctttgtggattttgtttgtttttaatattatttagcataataacctaaaccgtaaacgcttgcagttgcgatccaggtgtccttagttcagcagtcagacgtataataagggccactctgtacagtgaaaggtgacagctgtggcccccaaaaaagcagctctggactttcccctcccaagtttcagtcctggtaacttgaactagacttgctagtttcttgaaacattgttttattttcttgcaagttagtgtggtgttcatatttcacaacgctgaaagatacagtgtttctcaaatgtgcacttgccagtagacggatatgttaactgttaccgtgacgctgagaactggagctgctaactgaccctatgcgtttgttctctgcgtaaaatgttgtaacagtgctaattactaagcagctgaatttgtgagaaggtccacagcactaatctgcgcctcagtgttgccttgctagtgagaaaacgtgagcatgtactcaggacacatgtacttgatgatgaacttccaggggcacgtttatctgtggatcacggacggtttgacttgtgggacgtaacatttgatttctatatgtgcgcttttgagacactcgtttttaccctattaagagttgttgagtgcagaacaagacattttaaaagggaagagtaacattcagagattttaaaacggaagcttttaaattactacttgcttctgtttattttttattttttgctagttttagaaaaacaaggaagaatatctcaagttggaatagtcagatttcagtgtttgggtgatggtgttaaaatcgttgttttaatggtagatgaaaatgattctgttctgttggattcacatcctgaataaatgtttctacacaattagagtctataacagactaagccagcatagtggtggtgtgggttttttgttttgtgttttttttgttttgttttgttttgttttgttttgtttttgtctaaaagaacaacttcaagccttgggaaagaatttgtttttgccctgtggatgggtcagaaacatctgcttcaggtatagtttacaagcgttatttattaacccatgagccgaaaacccagatgaggagctctgactattgaaaactacacattccatgtttttataaatgtatattaagatgaattccacatacctattatttggatttctggcagccggaacttctacaaggaatttgtgtttttaaaaaggaatgtaaaattaatttttcttgtatcagagttttgctgtatatgaagaaatcctgctcatgggcagaaagcaaaggtttcaaaggaacctcatctccatatggttttactcgataatcctttatccaccatcttcagctctcattcctttgctttctcgcctgtggctacatttctatctctgcatcaattagcacagtgatttatacaacaagcaagcagtttagaggtaatggtacacaattaacatctcattccaccataaagggtatgctaaataccccagtcattgctttctctgcctggaattgaaataagtgtttgtcctaattcatatgctatctgatgtgaagtgggcctgctttgtaccgcactacaccattaatctaattatagatagctgcaaatgaagtgctgtctgagctgggagattgaagaaaatagccttttgtcatttagcatgactctgtgaagcaagatcacactttacagggcaatactacaaaatggaaatctcaataatattgctgcctgttgcatcttttctaattacaacaatattgtaaacacaactgggcgctgatataaatagagctgtagatatgctgtcatgtgggttgtaggagaaagtcctccgagtgctgttggattaaatgatgcatcctgattgacagctaccttgagactgcactgatggagttgtcacagcattatgctaacaggctgctccagcgactgcagctgtaggaggctgtggttcgccctgcgccttagctgctgcctgtccatgtccgctcctttgcctgggctgcacctccaaaggaaggacggccgtaggcttcaattctgtgtattgtcactgttgtgtcttggagatttgtggtggtggtggtgtagctcagatatcaggcgattgggccctgtgcagaagtagagggaaattattttgtatggctcctaaccttgctctgcttttcctcaagtgataattgtgtaccctacaaagaatttaggagagtagaacgtggttgaatttcaagtctcattccactgaactgttttaactcatatctagtttttctctgcttttcagccacgccagtgtttttaaagatgcatcatttttgcatttcgcgctttccatcactttaaaaacactgacactgtttctccagctctgagttaggacagtagacctttaggggaatatttgagtgttgctctcactgccacgctgcggaaatgaagacagagcttaatgttggagacctttggggccagaaggtgtaaaaccttgactaggaagagagcctaatctttgaagaagtgtctgcctccttacttagtgaggggtgcatggacagtatttggccagtgcttcaagatagctgatgcacagtgatttacagtcaaagatagcacctgcccttgagttggtattgactgagatggccaacagttgaggacatgaaagaacattaacagtcagtcaactgtacgtgtcctaattgttactggaagaatgacttataaatggaaactggaagtgagcccacttgaagaggaacggaggttgacagtggcactggaggctttgaaatcacagctgaaaactgtacagcaaactgcaagcgctcacctcgggagcagccgcagacctcgggatcattgcaacatttagcgcatggggtctgcagaattacattactgctacttctacaggctgtggaaaaaagtgggtggatttaatgctgtaaggaggtgcatgtactgtacaaatacagaagcctccagggtggtattctgtgtatccgtgaaagtggagtgtgtctcaaagtgggtcattctttgctgtctttggggtgctgatttctggggtgcaggcatacatgcccagttgcaggatgcttttcttaatgaggtccagtgataacatccctctctcacccagactgtgactagccgccgcctcctgctgcagcaaccactctcagcccccaggctttcaataggtccacggaagagctgcgtgtcagttttaaaaacaatcccactggtgtttcttgtcattgtcctgctcttgtggccttcctcctgaccctttcatgtcagctgtgattccttttctttctttcttttaatcttttgggagaaattttcttgttagacatgatttcacactgtagaggccataaaattaatttgcttagagacccgggttcgggtcacctttccgtcattcagtccttagataacacctcattccctcccattactgtcgtgtgtgggttgaggagtcccaccaggccaagccagagagcaactgttctgttctcacttacgtggtgagctgtttttcaagaacattttttttcatttggctgtgtggtctggagaacaccttcctaagccagcggagtgaagttccacgcactgaccagccccgagctcactggagcgagtcatcttccggctccatggcagcccagccccacccacaggcagctgcctgtcacccacgctggcatgttccctcatcctacccaggcagcgggaaaacctggctgcttctgggatcctactactctgtcctgtccacaagccttcagagtcttggattcctaccctcaaacatcaactttgtgatttatcttcttgaaaacaaccacaaaaacttaaaatcaaaactctctaagggagtttcgcacaacccttgaggaatagttaaatgcccacggtgaaaccgagcttgtaccccacggtccaggtaggggcacattcctgaagtctcacaaagcattggctctctgtgcccccaaagaatccagagatgctagtaaatagcagttttgatcagaagcttggaaggccctggtgtacattcttaaatgacttcttttctggggcatcaaaaagcttttacggttctcaccaggcagttcattctgatgggcccctacgctgcaccctgcttgggccccatcccggcacgcgccccgtgcagcacagcacaggccagctgagaggctgttttaagaaggcgtgtttgtgtggtacactcacgggctcaggacaacatcaaaggtaatcttaaaaagagaatctctctctgtcttctctttttatattcagaaaggtcatttctaaaccaactatttgcaccaaggcctctctggaggagtttaccccgttgttattttttacttgctattacaataagtcacttatcccccaaacagatttaagaacaataaacaaatacaaaaggaaaaggaacatctcatcagtaacaaagactgcatctaaaggcattgagtttgtgattcttttacatctctttccaagcaaagcaggagtcctacagagaaaggaatctgaaagatgaaaattataaaaatagtaaaaggatccagtgttcgtcagaatcttgtaatttctggggagaaatgaagctaaatacagtcttagcgcttcgttcatatgcaggctgatctgtgatataactaaacttagtttttggagtatatccactgtggggaaatgtggtaaatcatattctcagcgaatgaagatacttttcctgaatttaggcttcatattttgaagtcgaattctgcaaaacaagaaaaaaatagatctgtgtgctacactgaaaactgaacaaggcacgtcgtaagtcagtcacacagaaggcgcagctcagggcgataccaactagaaaagtaacttttttgttgactctgatgcctctagtgatgttggattttttcccccattgcagacagcacagataggaaaactgtgcaatttggtccaattatagtcctctctgtccctccacaccttcccccattgatttaatgaaggacttggaggtacaattcactgataaatagtccctctgcccagaatgtttattagactgacagcagcgtgcactctcctcgctttttccctcaccacttatgactcagatgaattttaataggagcaaaaagcttttatttgcactgtaatttcacttaaggaacatatccttcagaaactggcagacgcttctatgtcttgattgcaaaacacacactcaggagtaaagaaacatgcaaaagatgttattattcaacctgtcacagtgtcgcaaatccacttggaacttaggccatcaaagctctgcccccacccttttcagtaggccctgtgaagaggcacttagagattcccgccgtccccatgcagaattaaagggggaattatattttgtttttgcatccctgccatcatgatgcccacaggaggctttgagttacagcaggttttttgaatgaaatggagctgtctcactgctgcttctttcttacccaagagaaatcagacctggtagggatccagaaccttcgggtggtggttccaatttcaccaagagacacttcctcaaaccattttatcttttttctgtttggatagaccaaattgtggctcatagatttattcacggagaggataggaattctcttttttgaaatgttctgcttcactgaactgccctaaatatgcccgattgtttgagagccacctacagaaggtgccatgaatatacttgtctgtgcgtattttccatcagtgtttataacatcttgatgttattgtctctcagtgcagaaggctttctcattatcttgcatcttttcctaaccatcttgttacatcagaaagactacatagtgcctttaagaaaagccaacgttttcagtcatgaatataacattttctgtcactgaaaaaatggaattttaaatactattttgcccaaaatgaacactgaaccccattgtcttaacttactgatacgtagtgcagccgctcttggagggctgtgggaagctgcaacagccatctgctgccatctactggcgcctgtccacatgtcacctcctccatcccctgggtctgcccagctcatgggattttccttgatagggataagtttgtaggtggtgaagggaatacaagtaaaattctcagttttctttataacgttttgagatgtttttcttaaagatacaggatgatacttatcaatgattaattttaataactggaatagcccttatttcaagaactttctgaaatagctcaatatatgacagaaacaaatatattttgatgtgtgcagcaattgagaaccatttgaatttaaggctcttactgtaatttgaatttaaaagctaaaaattgatttagaatgaatgctacttttgaggaaaatttcatttaaactcatttatggtttggttttgtttttcccttaagtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtaagggctgtgtgtgtctctctgcaggacatgctggtctccaacttccccttccaaagcgacggctaacggcacagcacgattcggctctttgcagttcttacttaaccgacgccccctaaacagcaaaatcgattgcgtgtgttgtcgacctgtttcacgtttgcattacgttggtgccaggaccctcagcgcttcccctcccaaatgatctgggagtggagcagaaagaaggccagatgcattccatcattttgcaaatgcagtgttttgggaagtactttccttaaaagtgctgcttactctctagtatgctgtgctcaaagcatccattgaagtcatgccagggaataatactccgatgaggaactttttgcatgattcctggaacaaatgtctaattgggaagaagagttgaggaaaggttaattctgcaatctgtacagtaccagagcacttccattacttggtaaataaaatgtagcatcacagtttgaagtttttcatcttgatcttgtgacattaaagcacaaatcaaagctatattatttcctcgagataacttacatggatgaattgataggatgcacacattttcttagaacatggatagaaatctctactgatgagcagcaaaagtgaaaagaaaacaatttaggaggcaaccagatttccaggtacacttaaatacttgcatttttattcatgtgcaggaaaatagcatccggacatgactgtctctcatggatgaggtggtgattccgttttgtatctcaggtcactgggacttacattttagtgcctcctgatttctcaatagtacagataaaatatctgcttaacattgaggaaaaaatcaggtagttggcattggcttctagaaaagtatttgcaataaatgtgaatattaagaaaacatgatcagttttagttgtttgaatgaccagccctgaaactaatatgcgaagttagaaaaccgacttaacagctgctttacctggtgatacagaaatagaactgtccactttttcagaaaggcataaaagaggctacgtggctgtgaattgttgtttgctgtgaaagcattgatactcctggaagaaagccctctttaagactgtctaatgcccacgtgttaaggatttgggagaggccataagaaaaattacgtgtgtgtgtgtgtgtgtgtgtgtaatgtgtgtaaaattcaggggaggacatcttccttctccagagttagggtcgtaagaggatagtctcgtggccttgacattaagaatcgttcacttgcacgtgacattatcagagctgtcagtggaatcttctagtgactagatatgtaggttcgtaaacaatataagggttttgttttgtttttttcatttttcttaagttttttttctggaaggcatctatctagtctgtatactgccagcctgagctttccactcctaattgtgtggctttaattataaaatcgtgtgtgtgtgtgtgtgtgtgtgtgtgtgtgtgtgtgtgtgtgtttcaagtaagtgttttccttaaatccttttctaacacctgaatccaaaccggagtggagggagggcgggcagggatgagggagaccactcctgcctcaagcctggagggcaagagggtgagactgcagccctggcccctcacacggccctcaaggaggttgctcagaggcagtaaacggggcgctcccaaggccagatcagcgcagccttctggtttctttaacagctgctggctcctgatctgactttcccacataccgaaagggtttggcctttgtacgttccatttcctggttaataattgaatgtagaaaagcaaggcatttcgtaaatgggaacaatgtgatatcagtccttggttcattgatgtagctcagatattaaaaacacccaccaataattaaatgtgtgtactcattaagaatggtttgagaactgttaaaaatatgttacggcagagcaacggggcctatattttatgcattcctttaaattcagagtacctggggggcacgcgtagtgaacaggctcaggacctcgggatctgtcagctccctcctaagttctgtttgcgggggctgctcaggtggggcgtatacttgcttttatttgtcttttttggtacttgcagaacttcctttcatattctgtgccattgtgttttgatgaaacagccttttctcttgaattactgcttgtgaaaaatgtcccaaaccactaataccgaaacccaatgcagcctgagaagtttcatcgtcggctcttagcgcaacttctatagttaaattctgcttagtgtaattaaaacacaagaagcttccttggaccagaggcacgtcacttacttgaggccattgtgaggaaacactacctgtcacgttgaaattttgcggttttaagtgattttaacaccgcggggcgtgttgtgttttcctccgcactaacaatagccgggcgaggttccccttttatgggtgggaagataatggagtcagtctccttggtgtattttcaaggaaaataaggaccctaaaacaactaagggccttacaagtattctgtttttctttgaaatgttactttttatcgtttaaattccagtaatctatcatgtttctgtttagcttagctgaagtaaaacttgaccaatcgtagaatggtgggcctggcaataagttctaaaaaaagtgtcacataaatcgtaatgaacaaatctgttttgtgaagtaaacaatttgaacacagtttaaaaacctcaggaagaagagatgtggggtggccgttgagaagtagtgaatccgctcggggcgcttggtgtggcagggccttgtgcactgattcatttgaaacactcagcctgccctaaacacagaagctgtgttttatttgaagggcttctgtagggttcacacagcaaaagttcctaataactttttcagtgtctgttatatactatttaacattaaatgtggcaggtcacattttaaatgattgtgtaatagtttttccgaacacgtggagagaggatgttaatacacagtaaaatgcaggtaagcaaacaaatcaataagaaagtacagtggattattaaggtccagaatcagtaatataatttaggaaacaactgatagaataaattttagtgcctttttatatgccttctgaaaatgtttctgcagtaactcatttcagtttgaaaactcgttttcttagactcgtaacactattgtaaactgggagcacttctgtaatcaaagttagcatgactcagctgtttcaaacttctacctttatgatactcttgaacagaaatgttagaaatatatatattttcagaataacggtagaatacatttttccacatgtcaaattagacttatagctgctgaatttattgcataattttcactttgactttgaagtcaaataaagtcatgatgagcacattcgctttgttagccttttgatatcagaaacaaaaccaccccataagatagtcacccaaggaggcattttaatattgcatttagttaagattctttcaagtaatgttcgtattctgcagtcatcacagatttgcatcagaaatactcatttaatacaccaaacaaatgagaaacaaaccataagctgctatatactcatctgcatttctttctttcttaacaattagtgaaaccaggtgaaagaatagattgaaattaagtacctgttgctgctttttcttgcgaattagcccattcgatattagacttcgggatattttggtggggctaagatgaaaagatccacctcgtgatggaattgaccttcagcaggggacagtgaggtgtctgcggttgttcctcttgtgaacaacgccttaaaggcgagaaacagcctactgtacagtgtgccagggaaagcatcacatcggtgggcgtcggtggcaacaccacttacacttcaccctgattttgtttcctccttgcacgtgctcctttgacagggcaggctcccaagcaggtgtgcagtcagggccacaagacacaggcaccccatcccatctcagagtctgacgtcccctcctcccctttgtctctaagcctcatgtaactgagcttatagccgaccatacagaactggcaaacttggtgagatacctttattttttatttcttaaacaagattttaaaatttcataagctctcacgtatcctaacgagaaggcagggctgggccctcccgacgggtgtttgcctggcatcgcgcttgtgtgcctcatgcagcccaggctcgctcactgcatctttccctggcagaggggctagcctggctgcttcatagactttccagtttctggataccttgatttacaatcacaaaataattgcagtaattaaatttatatgttttatagcaatagttattcaagcagtttatttgacaagatgccagttttcacccaaacctcagattgtatctcacagcatgtacacagagatccatgcatttgttaacattttaagactttaaaattatgaaatactacaaacatgcagaaagttacagagaagaatccaacaagcactcctgtgccctttgttcaccatttccatatgtgtttcaaattttatttaacaatgagacattacatataacatgaacttcccctgtggcaagctcctccatctcattcctgtcctgtcttcttcagaggtaacgactacccctggatttggccttttaatcttttccagataacatttatttttaaatgttaagagttggtttttggccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactccagcctgggcgacagagcgagactccgtctcaaaaaaaaaaaaaaaaaaaaaaagagttggtttttgttggaggtaacaaatatctattagtagataagaggaggcagaaaaagatgaggaggtaaaaaaatatctattagtactgggaatttttacagttgaatatactcaatgataattataaaataaaaaatatttatgtggatcagtatattaaatattataggagagtcttctccaagcttggcgtttgatttttcaggagtgatctgcttgggagtagaaggtgttttctttgttttcaacatttttataagtgaccattctcagccttaccaagatgtaaactatctttttctcttttaataaaaataaaagtttacaaaaaatcatcctttcacggagcgctttcaggcagcatgctttacgaaggtagagggtccaggctaatttccaaaggtattgtgaatgacatcagtttccactagttctctttgtaactgcaggctttggctctgattttgagctaacttagagggcagcagggagtcatatttttcttcattttaaggaattttaaaagaaactggacttgttttatatcggccacaagtctgtactcttacccttagccccttgggtgctgcccagttctggggagccccacttgagagacaaggggagcaccaggcagacggcacgtgtgcctgaagtcccgagccggcagcggggctggacgggtggcccctgggttcccgcgccctccagagtgaggccgctcgtgcatgggccattaaaggagtcttcagccggagaaagggctgggcggcgtctcctgcccgcctggtctgtctttgtaatttgatgatggttccatccttgctcaaatactgcagtctcccgtggcctcctccccgtctcgctttacatgaagatgttgggatgtgaatacacgtttcttcttcaggaaatatcaggggatatttaccagcctatcttaccggctcagaggaagttgctattaatataatcagatgcgagcaggcagtgccttttcactcaatctgagatgcctttttttgtgactgttaactgaacctttcttcagatctaagggccttaaaatgtgtggcattcaggcacctgtgttccaagcagaccagcctttaacaatgaaatggtgggattttcacttttgtggcgtagacaccagggctgatattgatccgtgtttttccggtggtccggcgttgcagaagtggaaactgcagcgggctggtaagccctccgagccttctgtctaatttggcagaaaaacacagaatgtaggacaacaaaagaagcctcctttttccataaaaattcttcctcccacccacccttcttccccaaaaaggggacttaatttttcagctgcacgcagtgatttggtgctcactcttgcatcgaaacagttgcggtctgaacaggcaggaaacagttttcttttaattgccgaaatcattcggaagtgcttcatgccctgcttctgtacagcagatgctgtgcattaattggcctgcgtagaagtgacccagggttccttgcagcgggcccaattttaggcagagggtttaaatagcttatttattattttgtataatctggcgtacattgtgtgctcctgcacgtgtcgtatttcatggtctgcagtttctaatgtcatgtgggtttcaaaacctgtgtttctctggtaatgtactagcagcaggtaagctcaaaataccatccatcaggagctaattttttatccagatactccaatgactgatgaacctgtcttttgtatgaatgtttagcacagtggaaagccatatgccactggcaccgtttcctctgcattccttacagttgctagagagtgggcttcctggggggcggggcggctcgatgctgtgaacgtcccctggcctctatttcaacgataacacctttaaaacagccctgggtttgggcaacaaaaagaggatgggctgtcttaaaggagacctgactccctcgtcattttctttatcagaaatacgactgcacactcttaatagggaaccttgttttgttactccccgtctgttccaaacagacctcagcccattagaagggcctcccttgtgtgggagaccacagctgttactgtaaatctcatccactcactgtatcacccccattttgtggctctgaaggatgaaattgagaaatggaatactgtgcagtcatcctttacatctccaattttaggcctttgccatcattttcatgcttttattccaaatcaaataacattagtgagctacaccaccttctgatgaatatctggtcttgagcaccgctttcaagcctgtgcttgtgggggcttccttttatgtttggtggtcttttttcccccgttctcttctttttcttcctgcactttctttgagcgttcttcgtggtcatggcagtctgcagtttgaatgatcggcattgccaaatgtgtccctgtcttagcatgttttctgagagggggcatgtgcgggagaaggttctctgtcttttaatctttgtggaaggagtgaagagaacttggtagaaggatattgggggctttaatcagaaataagaagtggtttaaatcattagcacaacaaagcatactataagcttgaagataaaagtctctggggaaagagtcctctgaaaataaatggaacttgatagatttccatatcatttataacttcccttaattacacttggaagacttgccagtaaaactggaaaattggcagcctatatccattagagtcattttgccgaccatggcaagcagctggctttacgggatttgattcccatcactcacaattcatcatcagctggaggtgtctgcagctcttcagcacagagcaatgctgggtgacactcgggcccccacgacatgcgaaaatctgctgagtaaatgggccgaggtttctctcaagccttgtttggggcaaggccgactcctgcttaatgagtgccgctctgataatcggatgcgaacgtgaaccttgacctcgtgtcaaaggagaggacgcaataagctggatgaaagatacaggattcaggccttcaaactttacaccaattagacagggagcggggagatacatcaggcccactaggttcatcaaaaagacttgtgaggcttgtgaccattttgtaagcccaacattggagacatcctgtcacaatcattaagtctttatcagatgattcacaaaagtgttggagaaacgtgcgcacacatcctgcaggaacgggccccgcacatgggggcgtctgatggagacggaatggtggagggccctctctgtgcacccaattaatgcttggcttcccagccaccctgggcaatccggaaggtgttgcttccattgggcccactgcccagctccctggtgtaccctacatgtactctacggtgtgcgacacattctgcaggagtcagcgctgctgggagcaaggctccaaagtcctaaggtgagagcccctgctcccaagggccgagtgctggcattttgctgttgttggaaggagcccagctcaatgcccagccatccctggagcacgccctcgagtgtcagcctcttcccacagactggggcaggtgtagtttgtgtttccattgcattctttgacatttggtttgtacatttggttctccagctcaattttttccaaaggatgaaacatgttgaaattcaattaagctcgtgtgtgtgtgtgtgtgtgtgtgtgtgtgtgtgtgtgttggggtagaacatgtttctgttgagcaagatgtatctcactattttgtaaggcatgaaggaagtttttaaacaccatctcttagggatgaattagggaaaacggtctacaaaacagatggtgcaaaattaatagagaagtgtgctacttagtttttcatttacagctaaataatctaggctgggcacagtggcacacatctgtaaccccagcactttgggaggccaaggtgggcggatcacttgaggtcaggagtttgagaccagcctggccaatgtggtaataccctatctgtactaaaaatacaaaaattagctgggcgtggtggtgcacacctgtattcccagctactcaggaggctgaggcagaagaatcgcttgaacttgggaggtagaggttgcagtgagctgagattgtgccgctgcactccagcctgggcaacagaccgagattctgtctctaagatagatagatagattagatagattagattagattacataagatagatagatagataaaatagattagataggatagataggatagaccgagattctgtctctaagatggatagatagatagatagatagatagatagatagatagatagatagacagacagacaggcagataagatagataggatagagctaaataagtagactagtagacaccacgagaggaactagggaggggaaacaggaatgaaaggcggatggagcagggaggatctaattctatgattcagtgctgtgcttggatggggcagaagatgggatcgcttcagtggggacacgccttctttaaagtcctttgaattgaattgccggactctcacaatcagacagaaggactatttgaatttcaggcctccccacttttcctgattgtctcgggctaaatccgaggtttttttctgatgaacaactggggacccagcacttgcagttacctgtgcgttacctctttgcaaatcacccacattagaagcacagagccagccagaaagatggtcagtggcagccacagcagagccccttaagctcctgtccaccacccacttgctcccaggccctggcggggcccagagtagagctgtagccaggtcaggctggcctttgcccctagcgtgaccttgggaaatccccaggccgcatttcttcatatttgcagttgagttgctaacgcactcacttgaagatcctgtaaaacagaagcaggagctgcctgcctgtctggcccgcagattctgagcaaggggatgggaggggacgtgtggtggaagggcacacctactggcagagagggtaggggctgtgccacccatgtgaagccaatgtacttggcggggggacggggctctggccagtcctgggccctcagatgcctgcagaggaagggctgggtgggtgtttgggaggccggcatgcagtccccaggaagctcctccacctggagagagaacagtgcccagagcgggagagtggattcctcatttttggatggcatttctactatgttctgttgagtctcagatccacttcccagagagtccccggtcctgttgcctgagtgctcagtcctaggtcagagtcagtcgcagtgagtccagcttctaagaggacacggccaggcttccagggtcccctgtgtggagctggctggcaggtgtgctgcagtgaactggacctgctcctggattccctggtctttgcctgcctttgaagagagaaaaaaggctgtaaaatgccaactggagggagtgactgttctgacacccctgatgggggcctctgcattgtctctgcgctgcccctcccatccccctgcaaacagccctcgaggctgattcttcgctctccctggaatgcagatgccacgtgaaaatgaatcaaaaagggcagcgcgggcagcgcttccaggcccagctcctcagcgcggtgtctctcctccgtgccagcgccaaagccttggcatcgtctctcttcctatatttctatgccaggaagaagcagcccaccacctgaacagcagaggaaaagagtacatcggctcaggcgctccagagtgccagcaagacagcttgcgccacacgggggggccagagggggacttggagatcatctggggatttcaggaaagaacattctctaggcgcttctgaggcattggacgaatatggccacagtggtgtgaggggccaggagccccatgccaggacacccacccacaccacatagccattgccctaggaacctggacttgcccgtttcaaagactgggaggccaaagaaaaacctggccggctcaggacgctgacccatcggggcagagcgaagtgagtgcgcagcatggttttcagctgcagctcactcctgcagggaagcctcacgcttaacgccagtgggcttaacccagctcagcctggctgcccctcaggatgaaaggcaagttctgaacgcagtctgagcaaaggcccgtgggcgctcccagtctcctagcatggaatgcatgtagctctggaagtcattcctgtgtctggagggttttccggaagctgccttgtgccttgttgtgggtactcgctgtgtcttgcagaggatgggacagtggtcctcgtggcgccagggccgagctgttcccagttccccgggactatagacagaaatatgtatatttggtggtggttttttttttttggtaacagctatactgagatgtaattcacatacaatttagccctttaacgtgtacgattcggtggtttcagtcaattcagagttgtgtagttgtcaccacaatcaattttggaacatttttatcactctcaaaagaaaccctgtacccttcagcagtgactccccttccctcttcaaccccaggcaacctcgagtctgtctgtagagatctgcctattctggacatttcaggtaagtggaaaacattccaatttccgaacacctctgttagtggcagagccagactcagagatccccagggtaggccccgccgccagggtccccacttctccagggtcagggattttttttttttccaacgaggactttatgagagagagaatggcttttctctactgttcctaaagatgagcttggaataggaaacattagagattgttgctgctgttcatagacacatattttggggcatttgacaaagaatttcttaatggcttcattcctaagtgttaatgcaaaattagaatgcttttaaaacttctgcccatttttgttttccaggtagcagaaggtcaagaaatttgtgtgattgaagccatgaaaatgcagaatagtatgacagctgggaaaactggcacggtgagtccctaagtccccatcagcccaggccggccctgtgatggaggaacgcccacctttgaatcgtgggtggtttggctggaaagggccacagaggcgccctctccccctcgcttctacagaggaggacgttaggattgggagcttttgccattctgccctgatgcatccctgcctcgtagagagcgtggcttccaaaaagtctgtgctttatgttcaggtagtcaaagaacaattgttcttcaccttaatgtctttctttcaaattaaggggtctttaatttttaatgtttacatctgtcttgaaggcagttagttatctgagacttaggtgacacagcagcaaatggttttacaaattgcaaaaattaatgtaactcttcaagacaatttctctacaaagggaacaattcagttgcagatcaagagaagccaaaaccccatgtacatgtgggacttaattatttagggagaaaaaaatattagtactgaaattcattcatagtgaaacttaagtgtatttttttcttgaagatagaaaagtccttttaagcagtaacttcattattcttcctgtgactaaaaagactgaaaagatgccgttagtaggtaaatgatccttttgtgagggccgttgtggtttggaagtgtctgcatgggagagcatgatgggaagcgcaaggctggccgtgttctgcatgtggccatgccttggggacatcaggtgcaaagagagatccatcagttcataaccaggtttgcatcagagagacacacaacctctgtctcatgctctgtcactgcagaaggcaatgaaatggattctcagagaaggggcagcggggatgtcatgcctggtcccggctgggagaacagaggcccaggtgtatgccaggggctcctgagcccagcccgccggtctggaggggtgtggacagttgcactgtgctggtatggtgtgaagagtagaatgacatgatttgtggcgtttttaaggaattctttctaaattacttctttaaaaagtgaacaagaaaatgttggtttctgttcatgtaaaaattttatctgttctttgggatttaacatttgtgctgccctagtatcacgacatccatccatgatgagaacttggcctaggtgtgggggaccgagaacgtgtgtccgccgcatgccaagggccctgtgcggcaggtctgaggtgctaatgcagaaatgaccttggcctcatcagttccctgaaggggcatggtgccatgtggtagtaggtttcctgtcctcgtggcctgggtctccctcggccctcctagttggagtcttcctgtgcattctgttcacctcaccccatccccaggcctctcagttccaacccagccaagaagagcagaagtggcccgaagcccccgtgcaaagtagcaggccctggttcctacctgcgaggccacttttcctcccagagaaaaaaagttcacaaaggaaacagatcctctactctggtcatcgctgcatcactaacactgcgtcctctagtagggctgctaaatggaggcaggagcattgtggaaagcagccttttcagtccaagcagcatctgcagtggccgatgagttctaatccatttttcattttcaggcccaagcaagagcctccaagaagtcaaatgactgtctcttccccacctcaagcccctccttgctaattttaagtcagaacacaaatttcggaaagcaaaacttgataaagattgactgaaaccggtaggacaaaaaggcacagttccacccacccatggtgctggaaagggcgaccgcacagccccacctgccaaggactccatttcccttcagaaaatggaggtcaggccagggaggtcctcctcttactcagcagctgatctgactgtcgtgtgttttgttcctttttttcttttacactaagtattccattaattctcagagaacatttccacaacctcaaaaccacagagagggaggctaggggttagaactcacctggcagtgaagagcctgcctagacctgagggtgccagagcgcaggccacagcgcaaatgctccggagagtagccctcaggccagccactgtgagggtgccgaggacagaggagacgggaaaggggaggagtgagccacggccacggccaccatggcgcctccctgttcaccagggtcccttcgatgggctccggtggggtggggtggcttgtccctgtgctgctgagcttgcaggactgtgcatttttagaaatggattaggagcctgccgcctcttggttctggttactaattcttactctcccctccccctgcatttttcaaaattcaaggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtctaaata

SEQ ID NO: 57 - DNA, 32832 bp, Homo sapiens
  source 1..32832: mol_type = genomic DNA
cctggctgtgtggatgtctgacaggtgaggcgggggacgcagaagtgcagccgccctctcccacagcggagtccaaaacaggcctaccagtgagtaggacgtacacctttcagatcgctccattcttctggctcctgtccctcctctacccctgtattttgaacttttgtcctttctctcccgctctgtcctttacttctgtcttctttaccttcctactgtgacgggatcccactctctgccttctccttaggtttagattttcacttcgaccaacctctagttttgggcgaagtccctggcaattcggaggtacttctggaaagaaggtgcttttaatactttaggggccatgtcggtatcttctttggccacttaagcaccctgaactgttcccgttggcagaggtcactttttgtatggttccaaagggatgcgcctgcttcatggctgcctcccttctaggttgtgggttatgttattgtcagggtttttctaagagttttcgggaataaaagtgattttctgtgtgtaaacaggattaagagtgtaaacagtgttaagagtgagaggtagaatagaaaagacaggtctaaattgacataaaagcttacattactaactcgttctcagttttatctagaaagaaggtggtcttagggaagctcgaagccctggataacgtatgtgtgtaaagttttaaaccacttgatgattttctgccaatataattttgtgtttaatgatgtacttatgctaatatcaaatataattttcatgccctatgtttccatctccaaacccaactagttgaacatcaaagtaccttcttgaagtattaatgtgcaatcatacgtcagcagccaaagcttgaaacttattggttcaagaaatctttttctcactgatttgtttttgaggtgtgggggtgggattaatcattgctctttaactcattttagttgtcagtaacatatttgctttgcatgttgcttctttgaatgcttgaggcctctcttgatggtcttctgagaaaattcagaggtcgtattgccatccgcagtagttgtgtttttatctaaaaatggtgtctgtttccagcctccaccaattcacatgtgattttcaggaagtcacttaaacggggctctttcctattagttgttcagatttaggaaagcccacgtgaaatgagtgtgatatttcctgccaacagtttagtctcaggtggttttcaaattaccttttacaggattactattgaaacagtttagttgttgcttcattatttttttcatccaccttttaagctagtaaatgtagtggatggcttgcaaaaagatggatgacaaggaccccatggatttaaagaataaaaatcgtgctagtattaaaaaaatggaaggtttttttgttttgttttgagacggggtctctctctgttgcccaggttggagtgcagtggcacgatctctgctcactgcaacctctgcttcccgggttgaagtgattctcatgcctcagcctcctgagtacctgggattactggtgtgcgccaccatgcccagctaatttttgtatttttagtagagactgggtttcaccgtgttggccaggctggtcttgaacccctgacctcaggtgatccacctgcctcggcctcctgaagtgctgggattccaggcgtgaaccaccatgcccagccttttttgttatgtttccatttagactttgttctatgtactttttacatagttgaacctgttgcacttacaattacgtgtcttgagtcttttacttactactttttgagtttgtttctctttttttgggaaactatgcataacacatttttaactttttacttatacatatatttacagaaactgcataaaacataactgtataatttgatgaatttccacaaacagaatatatctatgtaagtggcaatcagatcaagaccattacccccaaaagcccctctcttgctcctgttgtattctagcaaccattaagtaaccattcttctgacttctgacatcaaagattagttttgccagctttctaaacatattttgataactacatgaaattctatcatttgtatatgctgtaattcacttattcatatgttatgagatacttacgattttcctaagttttctctattacaaataaaactataggaaacatctattttatatattactacagaagctttcccaggagtaatgttcctcagtggaatggcataaacatttctgaagcatttcatgtatattgacaatttactttccaaagtagttaaaatagttaatactgtcaccagtggtttatgtctcttgtttaacgaccccataataagtgttgagtattgatttcatttaagctttactaaactgataggtaagaagtggtatggaaaataaaatttgaaactccctttacttgttgccttatccagtataaaacacatagtatagtgaatatattaatgtttgcatctcaatatctttttaaacaatgggctctatatgtttacgctgtatgactctgacaagttttagtaattcaggtaaacagtttacggctttgtgaggtgggattttgatcaagcgactttatttctctgagcctcagtttctacatctggaaaatgatgacgctgaacccagcaacctagtataaaagtctatgctagttatccggaatatgcagctctaatgttggagcagtttataaactagcacagaagtagattattgaagaggccatttagctcaccttatgggttctgggatgaattgtgtgcatattagttaaatgcaaggactttgaaacaggctgcataggttccaatcaatgctggctcttctgtgcctcagtttcctaatctgtaaaataaggataataatagtacctacctcttaggggtattgtaaagattaaaattgctactctctgtgatgtctttatagccttctatgttactggcacatagaaacgctgcaaattggagataatgccttagctgaattagccagagaagaacattttaggcagaaggaagagcaagagcaaattcagaaaactttgacatatgtgcagccaactgtaggtaatccagtatttctagtgcacaaaatgcataaagaggacaaagacagagatgggtctgagggggaaacagagaccagttcatgaaggccttgaatgcctgtttgtcttattcatcacttttttctctattacccaacataatgtcggtcataaactgatatttaataaaagcactttgaatgaaaaaattaattaggaggctgtagtatatcttccacatgatacagagtctttgaaaaattccatgaggagtgtgacatagtcatatttacattgatgtcattgtatggaagggattcgtatagaatggagtagaaaaggagtaagactggtcagtaagaccagctaagaggctactgaggaaaaagactgaaactacaggactgatagtaattgtgaagaagaggggccaaagttataaaatatcaggtgcaggaagcagaaaaggggaagaaatgaaatcagactaatacatcctctttcttttctgttcctttcttatgagtagctcctatttcccaccccctcttctaaatgtttttactctatgtttctttttctaggtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaagggtgagattttaatgtaagacataatatttatgataagtcatatgcctcctagttttttattttttgggggttaatctctgtaaagatgatattcactctataattttgtagttaaagactatactctgaaaaaagtggatttttttaacttctgtggtcaaaaagataagtgaattagaataaggtgctaaatttttgaaagaaaacaacacatgcacgttgtttaaaaggaattaggtgaggtaaagttgcatgaagaaaagaagacattagctttgccttcgaaaaatgttcaattaacattgttgggatagcgattggagaggaagatagtttagatgatgcccaaagaaagtgtaaatgtgataacgtggtacaaacatattcagtgcaacctggcattcattcactgaaaattatcttaactattatttcttctttctgagctgtaataaaattgtactgtttgaatactaaacttgtagatttataagtttgtattgcccatggaaggttgaacttacatttagtatagactattttagttatttaaaaattttgtacgatggtcataattctgttttccagaatatttgaatagccaggaatcctttgtgaccatattagataaaagaacaaaatagtaagcaagcatacaaatgctaagttatttttgccatatatgaacagccagatcttttcatgaattttagaaatatttcaatcaagtaccatatcttcagatagatacgagatgattgagatttgttgtttctcccattctttcctttagtgaggtctggaactaaatttgtgcattttggcacaagggaaacaactgactctcttaagaagtgaagtatctttatttaagttggttttgacatgtatgagcataaaaatagttgttataaaagtgtactgttatgagatgaatcaacatttttagtagtgttaaaagtaaatcattttaccttgattccagactcttgaatcttacattatttttctttatatatttagctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaagcttactggtaccatccaaaatgatatactaaaggaatttatggttcgaaatacatacatttttcctccagaaccatccatgaaaattattgctgacatatttgaatatacagcaaaggtatactttgtggttattataggtttttctatagttccttgaatgtaggaatttttacaacatgctataactgaatttaaaaatttagtctgagtaatataaatttagaatgttttgttattgttactttttgtttttaatgtactaattttatgttctgtcgttacttgcaggaatctgggcaacagatctttactgtgttttctttattcctaaaatttaactctgataattgttagattcagggaggtcttctacttacatttttaaatttccctccgaaattcagatgcagttgtgaagtagacactggtatcagacaaatggggattggaatatcagctttatttctgctaaaagctgaattggaagatatcacttatcactcatatctgcaacctcaaggaggtccctaatattcacccttgaattaggctcatctttcccaataagaatgatgggaaaaatccttccatagggacacattttcctccttcattttcctgtgagcaatttgtttatatttccccccattattcactctttgcttcttaccagcaacgtactccttctccttacctacgttaaagttagatcattatttcatggcacagagaaaatcgtcatcaaccctttttatctttatcaacccttgtaattactgttatctccaaactctagcaagcattgtgtagcaagcattttatgtttggttaactcttggtaaagatagtttttcttggctgtgcaggatatgtgtgatgtactctacctaacatgaaattttaggggaatagtggaaatacagtttttgtagtgattgtggtggaaagaacctgtctgggatatgcttagtattaaatgtcacagtaaatcaaactgaaatctttgatttttaaagccatgcattttatcccattttgtttcaacatatagtactaagaatcaaatcattttattttttttcctactgtgtacttattcatgtttgatgccttcattcaaactagaaaattaataactagtaaataataataaatttatacatcttaagcagattaacccaaggtttgggtctacaacctcttatgaggtccaagtcattggtttggaattaaaaatgcttcatttagttctcaggccaaaggttacattcctaacctcagctagctaattccacaatttaaactttcagaatggttagtataaattcttgtccaccagaaaaataaagtaggtacagtcctgatgatggttcatggacgaaccatttaaattggaaagcaaattaaatgtaacaaataagcattaaatattttgttaacattatgaactaccaagtttatttgaatttaacatcattttaaaataatgtttatgcttagaaagtggatttaataggaccttttaatatttttacttattcactgttacaatttttttttttatgtagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggtgagtaaattaaacctagatattgtttcaacattaagaaatgcataggaccattttatatattgataaaatgaatttataaatataaatgtcaggctagatttagattttcttatattttatctgagtgataatgagagaaaaagccaatatttctaataaaaaatagaattaaatttggctgtacttctttgtaaatttgaggaatatcttgtctccagctatttagagaacacaattaagttccacattttaacaaattacattaaaatgtaaacataatgttgagacagttttttctaatttttccattttagaatacagaattcatctattattatttttttttctgttgcactatctaatgtaatgttttgggatccactgtgctgttgaaacatttgtttcacaacagtttcttaataatgttgtatgaaaaatatgggaaaacttaaatgtagtttatgaaatatttaaatttggaagtcgaaagtcattcggtggttcaatcagtacagcaatcacttgctaagctttgctgtgccaaacactagcctatatgctgacaatacaacatgtagaaaacatagcttctgcctttagtgtttatagactactgaaatgctcctttgtaccagggatttgtgtacttactgtgacagcagttcccaaagtgtggtctaagaacagttgggcattgctaagactctttctggggtatttgagatcaaaactgtttttatgcttatgttagagctttatttgcctttttcactttcattttctcaagaatttatagtgatgtttttcagaagctacacgatatgtgatactgcaacagattgcagaaacagatatgagactccagctgttttctcttaagccatacattgaagagatttgcaaaaatgtaaaacaatgatgcttttattatatatatatatatttttttaagaagcatacttatttttcataagaaatgttactaatgttaacatgttgtgggtttattttgatttgatttgatgattattgagataggatcttgctctgttgcacatgctggagtgcaatggcatgatcactgctcattgcagcctcagcctgccaggcttaagggttcctcccacctcaggctcccaagtagctgtgactacaggtgtgtgccaccatacctggctaagttttaagttttcctgtagagatggggtttccctgtgttgcctagctggtatcaaactcctgggctcaagctatcctcctgccttggcctcctaaagtgctgagattctaggcagtagcctctgtgcccttccttattgttacttttgaatgaactagtaaataaaatattgatagatattatacaaataaagaaataaattctttggaattttcagtaagttttaagagtagaaagggaacctgagatcaaaatatttgaaaactgctgtgttaagaacttctttcaaggctgggtgtggtggctcatgcctgtaatcccagtgcttcgggtgaccgaggcggacagatcacatgaggccaggaattcaagaccagtctggccaacatggcgaaacccagtctctattaaaaatacaaaaattagctgggcatggtggtgcttgtctgtaattccagctacttgggagggtgaggcacaagaatcgcttgaacctgggaagtggaggttgcagtgacccgacattgcttcattgcactccagcctgtgcaatagaacaagactctgtctcaaaaaaagaacttccaaaaatgtgtcagaagtagatttgcaagctttgtgcctttagagacaggcaagtaacctaaatgtttaaatcagcacagaatataagataaaagggagaggtgaagggcacaaattggagaagtatatgcctagaccaatgcacaatcattcttttacaaaacacttttctggctaaacaaagcaaatttgctgttttatttcattcataggtgactcctgtcttacatattgagtattcctaaaatatacattttttaaataaattgaatctttatttaatgaagggcataggaagagattctttcattaagaaaaccaattacaaagtgaataattcttacctgaagcaaaatttcttccatatgcataaaactgtaattttatgttaggtttaaagttacataaatgtacgtgcactgatcttaattcaaattaagttcttcgaaattaaaatatagaccttgattttctagtgtgtgatacaattagttttattttctgctctatattgttaactttaattaaattctggacctaacgttactattttaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggtatgtatataatttaaaatgtagaattttaataaagttatatatatatattttttctgagcaatgtggcacaagcaggaaatagaattaagaagctatctgttaatatttgaaatgataaatattctgaagcataatgtatacttaggtttgtaattatacataatataataaataaataaataaaaattgtctccctctggtggttaacaatataaaatcacttacatcctagcttccctgtagtgctgaaacacttgtaaaagtaaacaaggctgggcgagttggctcacaccagtaattccaacattttgggaggccgaggcacccagcctggccaacctggcaaaaacctacctctactaaaaatacaaaattagttgggcgtggtggtgcatgcctataatcccagctacttgggaagctgacgtaggagaatcacttgaacctgggaatcggaggttgcagtgagccaagatgacgccactgcactccagcctgggcaacaagagcacaactacgtctaaaaaaaaaaaaaaaaaaaacaaagaaagaaagaaaacagaatttgatgatgagaaggaagcaaaagtcataagttagtactctcatataattgtaagagttataattcttaacataaaactgcctatttaaaattaattatatatacatacatattttatgtgttaaagttatgtatttaagcaagcatgcaagcagactgtttaaagactgtttttacttgggtaatttaatttgttctcttaaaaattgtatagttatggccttgtttttatacatgttctctttacatatgaaattattttggtacatttaaaaataatttatatgtgcaaagttacattgcttttatacatttaaatgttgaataataactattatactctgtatgaaataaaacttcaggttcttataaatggagaaatagacctggcacagtggctcacgcctgtaaatcccagcactttgggaggccaaggcgggcagatcacaaggtcaggagatcaagatcatcctggctaacatggtgaaaccccgtctctactaaaaatacaaaaaaattagccaggtgtgttggcaggcacctatagtcccagctactcaggaggctgaggcaagagattggagtgaacccgggaggcagagcttacagtgagccgagattgcgccactgcactccagcctgggcaacagagcgagactccgtctcaaaataaataaataaataaaataaaaataaataaataaatacatggagaaataagagatttttagggttggaaggaactttaataatcatttttattttaacctgcttattttttcagctaaagaaactgaagttcagagagatccaatgacttgcccaaatcacaattaggcatgcaataaactagaactcaaatttctgatatctcagttcattgttcatctattttattaacatttattcagtgcctgttttgtacacatcattgtggtagatactgtgaggtagacaaaataatcagcaaagagtgaattatgaaatgaaggactatataatcttaagtagaaaaagaatgcattgttgatatacttatagaaaagtatttaggcaatataaaagtaagcacaacaatatctgatatttcagaggattataagaggcactaaacactgaactctgactcttctaattttggcttctaaactaatttgtctgaatttatttgctattctgaagcttaatatggaaattgacatagaaaatatgcagcagttgctgtttaatcatgttgctgtttatagttgcaatatctatcacctgtttctttgagtttttgttttttatcaaatattttaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaaggtaagtttttccactttgcaactttgttttcagaatttacagatttgtaaagatttatagattttaaaacttacaagtcaagatttatagattttaaatttataaatcaaatcacttacagatttatataataatttaaacgatgtttgcaaaaaaaattcagatttgattttatagttttcaaaacaatccatttaaaaatacatttctattaaagtattttattaaaagaattaaaaagacagctagtattaaaaagctcatacaaagaacagcagtttttgatcatccacttgttttttcctgcttcctggagtaagatacatacttctttgcttatttttgtttttatctgcatagtttaaaatcacatgtatactatttcttgtaattttatcaactgtagacattacacatgagaccttagacactatctattgctttcctagtagggtagtttagattttggctgattcatacccctacttttcctcctcccttactaccaatataattatatctcaatgtaatcttttctgaattcttctaatgttctcatttgacttaaattgttttttctctatttctgctcactattgctgttctttgactcctctttgccattatagtaggaatatattttcatttctcctctgtttaattctgaatcttgaatcccatgtctatctcttggttatttggaagtacatctcatagaaacctgctaaaaatggtgcatgggagataaattatttgaaacttttcctgtttgggaatgtctttattctatttttataattgattaatagcctgactaagcttgacattatttccattcaggaaattcataagcaagtttataagcattgatctgttttttattctagatttttattctggctttcaatatttctgatcagaaatttgatgccattctcattcaggatctttctttctgaaagtattgggacctcttctttattttttgtattgatgtataacttggtgtattttttcctacatggtactgaacctttattgggtctttttcatctcacctttttttaaaaaatatttttatagctctaggaaattttcttgtattatttctttgacagtatttttcttgtcattttcatatgggttctctttctagaactcctagtcataagctacggacctccttaaataatatcctgatgtgctgatgttcttatcttttttttttttttttttaagacagagtcttactctgtcaccaggctggagtgcagtggcgtgatctcggcttactgcaacttttgactccctagttcaagcgattctcctgtctcagcctcccgagtagctgggattacaggcacacaccaccacacccggataatttttgtatttttaatggagacgggggttcaccgtgttggtcaggctggtctcaaactcctgacctcgtgatccactcaccttggcctcccaaagagctgggattacaggcatgagccactgctccctgcctgctcttatcttttctatagtatatctgtttgccttttttttctgtgttcttaaagatttgtcaactttatatttctacttatttttacattcatgtattatatttttgattcgtagagctcatttttgttttctaatttcccccttataattaatgtcatcttcatttgtttcattagtacagaatccatttatattctgaattcatgatattttctgaagttttcttttacatcctgtattgtctccattttctctctgtgctttttgtttttagtctttagtcagagtacaggcttttatttcagtaagacatcttacccttacttctgtctgtatttggtatttgatagttcattgtgtctcgagttcattttctgtagacagtaaactttggttctcctgacagaatgagagaggggtggttgcagactctcaaattgtcttcttctttttagcttctcattttacacttacgtagaatccaatatagattcttctttcttgaattcatcagggaaaagcaggttgaccttgatcctttctgctaagtcatatatcattccactgtctgttttctgccttcatatatgaagctatgattgaaggtttaaatgtttcctgatttcattaaagatgaggttacattgtttctctgcagctcaaatcaaaagtaaattgcattttaaaatatatttttcttacagactttatgtaattatgaaaactttatgtacctaaaaataaagattagagaattgatgttgctttaattttctcccaagacttaagaggttttgtgttttttggaatatacttgttagttgtcttttcaagtaactataaacacacaaattctaattaatgactttgatgtttatttaattctgttcttatgaaacattaacatttagtttataattttattaatattagtaattatataacactcataacaaatttatatagtttacacacatttttaatattctcttttagttttgttaatgtttttctttttagctcattaatgaaattgaagaaatgggtggaatggccaaagctgtagctgagggaatacctaaacttcgaattgaagaatgtgctgcccgaagacaagctagaatagattctggtaagatagtgagaaagttcatatatgaaatccagtagttaaaaagaaattcatttctgtttgaagataacatgtatagttaacaaaacaaaaataatgaaaaatggaacttgggtaaattttttctcatatacttgtatctatctatatatgtattttcacatacatggatgcacacaggcaagcatatgtacaaagtgtgtgtggatgtctaaccattgtatatatgtacatgtttgtgggtagatgtcattaacattttgaagatgacactgttgatgatcacagtgttctctgcattggagtattcattcattcaatgaatacttctttagtttattttgtttgaggcacttgctatgtctgggcatacaactgtgaacaggacagacatgacctctatgacctctatgcacacaaatcttacattctagtaaaagagaggaaaatgaacaagtaaataaagaattatagatcatgataagtgctatgaaggaaatatgaaggagtataaccaggggtaggggttgtgggaagttttatataagagtaataatctggtagtttgaggtaaaatatattctttatcatgtaaggaagtatctttgtaattttgatttactaatagattatagaagggttctttttttgtttaaaagtgactggctgaattcaaaaaaatattagaaaagctactgggtattcattctctaccttataaatcttagatggcagctgctctgattgttatttcgaagtgttaaaagatttattagaaaccgtgggaaagtgtatattaatagtttggtagaataatgaaagtccttccttacagagactctgacatatacctctactttcctctcacacccccttctcagattgggatttgctgatctatattgaagttgcattaagaattaagaatactacttaaagatattaaatttataaggaaaatacatcataaccagagcattacaattaggtaattatttgtgaataaaatttttctttgggaaattaccaggttctgaagtaattgttggagtaaataagtaccagttggaaaaagaagacgctgtagaagttctggcaattgataatacttcagtgcgaaacaggcagattgaaaaacttaagaaggtattaatagcttgcttttttttttttttttaagtattttctgtgttctgggctctggctaagcttttaaactgtcctgcttaaattaatccttacaacagcatgaggtgtgtattaatttccatcatttcaaatgtaagggaactaaagataaggcattgagaaacttgctcaggataaatagacaaccaggactcagtcttagtctgttgacaccaaaaacttgttttaaaccatgatatctacctctgtgaaacttataagttgttattaaaaaccacactacaataataataccttccataatttatagattaaaaccaaggcttagatgattatgtaacttactaaaaattaaaaacagaataaagtttagagttattatttgaacccagggcttcttattgtaatttctttcaccagaatgatggcatctgatactactttgaaataattacttgctttttgatttttaaaattcaactatatttggtagtgctttagtaaggtacagtttacaataaactttatttattttgattgaaactagagtatcgtattcccttcttatttttagtttgtcactgagttgatccagagcatatgaaatactaaaatagataaatcaaattaattgtcactgttgtaacctatatatttttgttgtatgaagctactttggcctcttaatctttggcatttgtaagtactgctgtttccaaggtagggagcttatacatttaatggttttctttgtttacttttcctgagattgtttaatgtatggctttttttttagttcaatctataaaaatctaatagtatttatttttggaaaaccctttcttttctgttatactttaggttattaactttatatcttcatagcctgaaggatttcatttatcataaataatgataagccttattttgggcaacagagagaaattcattaatgacaatatagcaataatagttaacatttattgagcacttactgtgtacccatactgtactaaatccttttcttgaattgttgtttttgtgtattgttttatttaacaggtagttactatttttatttccatttacagatgagggaactaatgattggagagtctcatttagttgctcaagtttatagtataagtgacaaagctgggatttgaatgcaggctttttgactctagagccagtttaggagaaatggatattctgatgtaactttttcctagttttgaactttcttaggaccatgaccaaatcaaagttcttctattacaaaaattaattttcatagctagaatcagatatttttatagcaaaatatatttctgctgcaatactctgagctctctttagtaatgaactcaagtttatattttcttacgctttccttttacctatggttttaacaatattttacctgtggtggtaatttttttaaaaatgtgaactatctcaacagtaattttatattaaattatttttctgtaaccgtcagccctaattaattttagcatctgttttcactccctgaattttagtaatctgttgttgagataattatagcaaactacctaatctaaggatgactaattttctagtaaaccagaaaaggtgtacttcttaggtctttgctcaaatgtcaccttatctaagaagcttacagtgatccaatatctacaatagcaccctactaccttgtgccaaatcacttcgttatttactcgatttactttatttttctcttaaattgtatgtgtttattgtttctttctccaataaaagataaagaaaaatgggcatttttatggagaatttggagttgagttttttcttgctctaaatatagttggacctccatatctgtgggttccacatctatagatttaaccaataatgaattgaagatatttgagaaaaaaagaatggatatgtctgtactgaatatgtacagacttttttcttgttatttcctaaaccatacactataacaactatttatatagtatttacattgtattaggaattataagtaatctagagatgatttaaagtatacaagaaaatgtacataggttatatgcaaacactacatcattttatataagggccttgaacatccctgaattttgctatctgtggatagggtgggcagtgggtcatgaaaccaatcactcacagatactgagggatgactataaattttctgtacctctgcttatatatgctatataatactagtggcatcttgagcagtatattttagactcttttacaggtggtacaatttgtaaaaaaatggatttatgcaactttattttgacaaattattggcagagcagagttaggacccagggaaaacttttttactgtgcttttcattgtatatctttttcttagtccctctttcgctctcgagattatttttaaataaaagtatagcaatatgcatattattatcaatacattgttatttatctaaaggaaacttaaaatataactaaaatattctctaagttttgattttttttcttgtcactattaatctttagtgttccttcaaaatacttcatatgaaagacccacttgtttacaatgtcttggtactttagaaaagcctaagtaacatgtgctacttgggaaggtcagcactattattgcccttcatgtttctgatttgttaggattataccaaatgtaatattattttaggaaatcctgagtgaatgaatgaattgaatgaataaaattcctaggttatatattattcttttcaattttttcctcttaaatttggagttaggattatggaaaaaaatgccatatgctatgcatcagggtctaatctcttgatctctgttttattctctcttcatgtaaattgtccctttccttgactttttccatagatcaaatccagcagggatcaagctttggctgaacgttgtcttgctgcactaaccgaatgtgctgctagcggagatggaaatatcctggctcttgcagtggatgcatctcgggcaaggtgaagatatataagtttggaggtttccaaagactaaaagttgaccagtttagcttttcagagtatacttaaataaaaggttgatcctgtaaaccatgtgagcccaaaagaaaataatggcatccatcgtaaatttaattcttatcattttaaaatttctgtatttaaaacattcatgttttgagtgaactgtattaataattgtgtattttactgtggctgaggaattttgaaactattgaaatgaatccatttcactgattcgcaggttgaaatgtgttggactctcaagtatatcaccaggtttatgcctattaccttggtattttaccagttaaaatggctgtggggtggggaggggaacattaatctgagaatttataggaaaaacttgtcatcccattgcttttgaattagttttaaccatgaagcaaccggaagagcaaccaacttccccacacccccctcccagtccttcccttgttattggagccatgtgttcctttaggagtagaatacttattaattgttactagtcttttatctccttttgacattttggtctactgcatttgattttctactgtaatataattgctcttactaagttcactagagacctcctctttgtctgatattgtgaataatttttagtccttatcttgaattctctacagtatttaacattattgaccacctcttccttcttgagacgttttgcctttgtaacccttaacatgctcctttgtctcctaacttttgtcatcctgcatttaaaaaaggctgagtgaaaaacagaatctaatctcatgttatatctgcttcagtgttcccatagacacgatatttggcaaggtaaagttttttgtacttactacctaataggatttttgtgagaagacattaaatcattaaaaatagttcctggaacagaatatggcacttaatgtgttaatttttattatttttctatttgttgttatttaaaaattatctcattatatgtatcatatataaataaatttattatattaagaaccagaaggagtctgaaatattacccttcttgcaagctaacaagttatcctgtatagtggggtgttggttgatgatatgagatccctggatcagaacctaatgacagtttgttactacaatattaatagccataacatcagcaggttttgggctagttcctttgatgcccaattgatgtgagtgatgtgaaaaggactgctagatgatacctcatgtacagtgcattgggttacattcaaggagaggaagcctgagcttagggattcggaatcttttgtaatgggtaataagcatgtcctccatttttctagaggaagacattattatattggacagaaagcaaacctactctttgctctggaggtagccaatatttctgtcttctaaggcgattcactatacagacatctttgaaaagatagtccagaataaagaggtgtcagtgctttgctccacaggatgtgcagaaaagcaagtgacccatggaaaattttctcccaatatatggcagtatcattaaatgattacttttgcttttaagtgtttatttcttaatataatgaagttttaaaaaaatatgttgctttaactggttaaggtatagtataacttgtatgtactgtttttttctactactaatttcattaaaaaaattagatgacttttattaaagtcctttgatggttgcccattccttttatattcaaacctaatcttccgatagtctgcaagatgtgctagatgtgactcttgcccatctctctgacctcatcttataccactttcctcactatgccgtgttcctaatgcccttctttctatttttagaacataaaacatattttcctacatctcagagcctttgcttttagtgcttcctttttcaaacactcttactgttttatgttcccttgggatccccctttttataatttatatcttagttcaaaagtcatatcttcacatcttcaataactttaaaatggttcttccagacagcccattccatctttgcgtggtttagtgtctttgtagtacttattaccttatgaaattgtcttactagtttatttatttagttatttatcatctgcatcctctgactagatgttacagatgttaatgtctataagaacaagtactttttctttggtctcatttattactgtatcgctatagtagatatagagatatagtaatatctggcacatattaggcacacagctaatgttggatgagttagtgaacaaatggatggaatatgctaaaagatttacttcttatcaaaaaatatttatgggagtgttgctgtttatccatttgtgttaagtggtgaattattcagcaaccttcaggtacttgtctatatatataattattaggtcattcagtcatttcttggttgacaaatgttgaaaagagaattggatgcataaaggcatccagaataaatttttcttaagtaatttcagaagagatgctttcataatgcattaaaaaattcttattttacatttttacagtcatttacttatgtaataaaatgtttaattatattgaatattatggtaaacagatatctttatcacaaaataatgaagttaatggaaccaccatttcatgtttcagatgtacagtgggagaaatcacagatgccctgaaaaaggtatttggtgaacataaagcgaatgatcgaatggtgagtggagcatatcgccaggaatttggagaaagtaaagagataacatctgctatcaagaggtaatatgtaaggtttcttaggccagaatttcatcttttctgttagcacaatccccttgaatctactgggagcttaatttccttacatacaactgagaaaatttttgaattttataataataaatagtaaattaaatattaattatatagactatataacatataatagagtatataatttattcattacatataatatataattagaaatatatcatacatgatacatattatatatctatactatcattttaataggtacatgataatatttaataataaatatcaaatattgaaactaatattagttttcatataattaatactattttgaactttcaccatagtccccttcaggagtttctcatgtcaaacagatgtttaactaacaatgatattgcttcatatcctccaggtatttatatttcaatctgcttactatggtagagtttcatattttttgaagttgtttacatttttcattgcttgaataattataaaatcttaattttcataattgaaagtaaacatttagttggcatctatgcatacattacaatcagtatttattgaactgataataacttacatttatttccacagcatgacttggaaatatatattaatgtgatcatatttctcaagtgtaagaactagctttttgatgattggtctttccaacctctgtaacaagcttccaattaaaaactgaatttccatacttgtacactagataaatatcaaaacagccaaggtgaaagtcatcaaaatggaacttttttcttttaacaaagataagtgcttttttgtgttggaagtaaatttgtcagtggagcaagcaagcattttgatttatatagcatgataagaaaccatattgctgttaccttgggagagttcacacttatgaagggtagatgagatatggacaattcaaagcagccagtctatcacatatatgtataaatgaccatgaagtcactttttagtttatatttcaatctttctgcatgttgtactctgtaccctggctcacgaaggtgggaggttgtcattttttgtcttagttcaccgtgatgttctcagtgttatgtgcttacagtctgtgccatctttcagactttcctctaagggggaaatggctttaatggagctctcaatgtaaaatagatgcattaacaaaatatggacgagagtagggagatcatcacaaagaatagctaatggatgctgggcttaatacctaggtgatggggtgatctatgcagctgtttaccatggcacgtgtttaactatgtaacaagcctgcacattaacccctgaatgtaaaataaaaattggaaaaaaaaaacaacccaaaatacaagtaaacaaattaggtgcttttaaataaacttgaaagatttgctgtgaataaattagtttttatatcttccctttggaaaattagtatctaactactgatatatttttaaatgtttttcagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccaggtactaaaaactgttggggggaatttcaaaagtatttactagtcacttacatttagaaaatgtagtaaaatgatgacagacattgagcaaattaatacatctcctggtaactggtatgtagccactgacttggcaaatgcctttctctccattcctgcccataaggcccaccagaagcaatttgccttcagctggcaaggccagcaatatacctttactgtcctactgcaggggtttattaactctctggctttgtcataatcttattcggagagaccttgatcacttttcacttctgcaagatatcacactggtccattaattgatgacattatactgattaaatccagtgagcaagaagtagcaaacatactggacttattggtgagacagttgcatgccagaggatgggaaataaatctgactaaaattcagggaccttctccctcagtaaggggtccagtggtgtgggacctgttgagatattccttctaaggataatcttagaaggataaattaatgaatttgtctcctactaaaaccaagaaagaggaacaatgcctagtgggcctatttggatttttggaagcaacacattcctcatttggaatgtgttactctgtgttactctggcctatttatcgagtgacccaaaagactgccagttttgagtggggtccagaataggagaaggctctgcaacaggtccaggctgctgtgcaagctactctgccacttgggccatatgacccagcagatccaatggtgcttgaggtgtcagtggcagatagcaatgatgtttggagcctttggcaggcccccataggtgagtcacagcagaggcctctaagattttggaggaagggcctgccatcttctgcagataactactctccttttgagagacagctcttggcctgttactggactttggtggaaactgaatgtttgactatgggtcatcaagtcaccatgcgaccagaactgcctatcatgaactgggtgctttctgacccatctaactataaagtgggtcttgcacagcagcattccatcatcaaatggaagtggtatatatgtggtccagcttgagcaggtcctgaaggcacaagtaagttacatgagaaagtagctcaaatgcccatggtctccactcctgccaccctgccttctctccctcagcctttatatatatatatgtaagggggagtttattaagtgttaactcacatgatcacaaggtcccacaataggtcttctgcaggctgaggagcaaggagagccagtccgagttcccaaactgaagtatttggagtccaatgttcaagggcaggaagcatccaccacgggagaaagatgtaggcttggaggttagatcagtctctctattcacatttttttgcctgcttatattctagccacgcctggcagctgattagatggtgcccacccagattaagggtgggtctagccctttcctagcccactgattcaaatgttaatctcctttgacaacaccctcacagacacactcagggtcaatactttgtatccttcaaccaagttgacatggagtattaaccataacacatatagtccaattaattatgatagaaataaaaataaaatataattaatctttcagacttttaaaagtgtcagttcagaactaaaactgattatgcctctggaactatgaagattactttcaaagatcttattgtactctttattgagatttgactaatattttgtgggaaagatagcccacatgggattggtgaaaagtgttttgaaaaagaaatcaaatagcaatataaactcaattcataagtaaggttattttcgtttatttttgttgtctttttttaactctctactaatatgttacttagtcacagaatattagacttagacaggaaaatagtttgcaggagataaattacactgacattttccatagaatgataatacaaaaaaatttgactagaaagtacattgtaataattttatatgaaaagccttctctactacatatgtattgatcatctaccagatgctaggctctgagttgagtaggatacaattttgtcctcgaggttacaatctcctaacaaagagagatttacttacttgtaattacatcgtatgaaatttactatgtaaattattactatttcgtacatagtatgaaaattactataactaaattactataactttatactatactataactatagtataaaattactataactaaaatatggacaaagagggcacctcacttgttacaagaaacccagaaacttatatttgttgatccttaaaacttatgtttgtttcagaagcacagtgccattcactttctagtaaaatcactctctgaagtggatggaggagagctgcaactagattcaagcagtacggtgaagaaaaacaatgagaaacaacgaagaccttaactagggcaatgtcagggtctcaagagaaaccaaatctcagctaggattttgaagaaaatttaatggagggactacttacagatatgtaggcaggattgctagaaccactaaggaataatgaggcctccaggaattaaatttttaagaatttcaaaagccagttgtttttcatggtgtgaaatggtgtctcatttgtttaagttccttgtagattctagagagtagaccttttactattgcctaaaaccaaaagtgataagtactaaaaacttatcactccctatatttatatattttattatctgctttttaggttatttccatctattttttctatatggtagtgatactgtataattgtgtggctattgtgtgtctttttttctgctttgcatttagtaatgtcatgttaatagggtgaaattggctatggttggaatattcacaacataaaaatcagcaaacactaaaaattagggattgagttattgttttcagaaaatttgatgaaaaatgtaaataatcagaacaaagttctctgagggaaataatgtaacgatgaatattaaatttaaaagtttctgatatctgtaggcattacattaggaagaccccccaacatttgaggaaacattcttttagtattcaaaaaaatattattttttgtttgtttttttaacttttattttaagttcaggggtacatgtgtagatttgttatataggtaaacttgtgttgttaagcctagtacccattagttgtttttctgacctccctcctcctgctcctctaccctctgataggccccagtgtgtgttgtttccctctttgccttgtttgtgtccatgtgttctcataatttagctcccaattataagaaagaacatgtggtatttggttttctgttcctgtattagtttgctaagggtaatggcttccagcttcatccatgttcctgcaaaggacacgatctcattctttttttctggctgcatagtattctttagtgtgtgtgtatcacattttctttatccagtctatcactgatgggcatttaggttgattccatgtctttgctgtggtgaatagtgctacaatgaacatacatgtgaatgtgtatttttttttttttttttgaaacagagtctcgctctttcatccatgctggagtgcagtggtatgatcttggctcactacaacctccacctcctgggttcaagtgagtcttctgcctcagccatatgagtatctggtactacaggcacgtgccaccatacctggccaatttttgtatttttagtagagatgggtttcaccatgttggccaggctggtctcgaactcatgacctcaagtgatccacccgcctctgcctcccaaagtgctagaattacaggcatgaaccaccacgcccagctgcaagcatgtttttataatagaaagatttctgttcatttgggtatatgtacggtaatgggattgctgggttgggaggtatttctgttttgaggtctgtgcggaatcaccacactgtcgtctacaatggttgaactaatttacactctcaccaacactgtataaacgttccattttctccacaaccttgctagcatctgttattttttgactttttaataatagccattctgactggtgtgaaatggtgtctcattggggtttttatttgcatttctctaacaatcagtgatttggagctttttaaaaatacgattgttggccacatgtatgtcttttttggaaagtgtctgttcatgtcttttgcctgctttttaatgtttttttgtaaatttgtttaagttttttatagatgcaggtattagacctttgtcagattcacagtttgcaaaagttttctcccattctgtaggttatctgtttactgtgttgatagtatccttttcagtgcagatgctttttagtttaattatatctcatttgtcaatttttgcttttgttgtaattgcttttggcatcttcatcatgaagtctttgcccattagtatgttctgaatggtattgcctagattgtcttccagggtttttatagtcattatctagtaataaacaatgatttatctttactttctgactgtttagactcctcgtgaagtggcccagcaggctgtggatgcggatgtgcatgctgtgggcataagcaccctcgctgctggtcataaaaccctagttcctgaactcatcaaagaacttaactcccttggacggccagatattcttgtcatgtgtggaggggtgataccacctcaggtattttttatctctatttttctagtactgtgatgggaatcttgagtaatgatagcttatttgtggttctaaagataaacttgtagatttaggaacatattatttcctggtgatttcactaaataaattctacaaggtctaaaagtggacagtgttgttttgcattcaagttatattgcaatttattatgtataatttaacttaacactttacaaagcttcaatgagagaactacctccttgcaaaccagtaacctatgctagatgtttaccttcattctcaataaacagttatggagaaggaacaggataaaagtaataaaactcataagtggagtagagaacagtggtagtaaatacacagtgaatatatcaaaacctagccagagatatagtgagtactccttgtcctggggggtggaatgagtcctttagtttgcttgcttctatttagaaggagctaccttgtgcttttcctccaggatggtcccatccctaaatgttatcttacctcagagctatatcatttacatggtcctataaaaccctttattatttaagctaatctgattagggcttggtatttcgggagccaaaaatatcctattgcagacataaatggaatcagcttgtcttgaaaattataggctgaatggggaggaggtgaatacatgaacaaaactgtgagtcctcttagtagaggagaaacagatgttacctacaatgatatcagttaatttattaatgaggtagggagacaccttccacatatgacattcctggccagttaaaatagttatttaaaatacaaataggttctgtttccaatccagttctcaattatatcaagattttcttttttactgagaatggaaaaaatgtcaagttagaagaactgtatatgaagctgtcgtaagtaaatgactcatagatgctagctgcaaaggccccatcactatagcaggaatccatcagtaaaatgtgaccttgtttccagctctacagtttttttttcctccattaatactcagaatatagaatagtacattcatatactacttgtgaaaggagaaaattcatatgaataaagttgtgagattcgtaataaagtggggctactgaacaaactacatatttattttctttccaacaacacattatttaatgtgatataatcaacacaaaattctttttgttaatatgcttgcctattatattcataaaataggtcattatttgagaaaataaagggtagttattctttattgcagtctgtctacagaacgcttctatcagcgttgcagttttagagtctgtgatacctaggcatgatattaaaatgtaaggaccaaaataattagccagtagaaaacatttgaattggaattcatgttgagaaaaaaaaaatgcctgttatataagtgagctgacattttcaagaattatatttcaaataagttgtattaattctctggatatttaaattacttagaacatctttaggtgtttgccatgtgatttttcccatgaatttaacaactaaggataaggaccattttctgtgttatacttttgtgtgaatatgggtattatataattatagcagttaacacccttgtattttctcactatttgtttgcagtgaatatgtaaaatgttgctattattcaattaaaggtcacttagttttaaattagaaggcactaatatctagtggctaatcaaacagatacagcttctgccatgtggagcttaacagtttctgcagtctgattaaatgaataaacgtggtctctcctcatcagtatgttactacgatcagtattttctaactctcttagcagcagtcgcctccaagttttttcagcaagttgagtagactcacaatgcctgcttccatcatgaagcaggcactgtgctatccctggcccagctaagtggaggacattcaaacatatatttttatttggaaataatttcaaactaacagataagttgcaaaaataaaaatagtacaaaaaatatctgtatacaaccccctcacaaaggtatattttacaaggcttatgtaagaaagagttagataagtcacatacccttttttcagttgcaacatcttgcagttctcttccagttgaatcctccattctaaatccataactcagatgtcaggacaaatggtacatgggatttttaggaaggagagaagtacaagacctattaatctgacatctccaatttagagatgattattattacatgtttcattcagttcccttatgagctcttaaactctgtatcatctactcaagaacaatgacatgttttgagcacttttatgtgtcaagtactggggaaacagattggacatgatctctactctcagaatttcacagactagaaggagacaagttcaatgagatgtgttaagttctgttgcaatattatagtattataagaatattacaagtatataatagagacagaaaagtagtagttggggagtaattagcatgaccatataatttatcacttgagaatagaaatgggtgctcttaaaaagggtgctgcaacaataaacaaaaatcagactgtcctgtcatatatgatcaccctactggataatgatcaggttcttgtagcacatcctaacatcaatcgatattgcagctacaaatgttcagatgttataacagcctaaatcctgcagtattatttgtgcccttgatatcttttcactcatactttgactgttaaaataaactaaaaaggccaggcacggtggctcatgcctgtaatcccagcactttgggaggccaaggtgggcggatcacgaggtcaggagattgagaccatcctggctaacgtggtgaaaccctgtgtctactaaaaatacaaaaaattagccgggcatggtggcgggcgcctgtagccacagctacttggaaggctgaggcaggagaatggcgtgaacccgggaggcggagcttgcagtgagccgagatagcgccactgcactccagtctgggcaacagagcgagactccatctcaaaaataaataaataaacaaaacaaataaataaactaaaaaaaatcaacagcaacagagaatgaaaaaaaaaatgggcttattttcatttatagaaaatctatcagttgtccaaattcaaagtgccatcattcactaactgcagacaaaatacctaggagaaaatagttttttaggctcaaacttatcacatcatactaaatttaacacacataatgacaactagtgaaaatttaggtgagagaaaattatggcttaaggctcagaagttctcagtcaggatatccagcttcctaccacaagcaacacatagaggcatttagaaaatgggcggagtgttttgttttttaaataacttgggctgggaggctggtgctgatgactattagtagcactcccaatcaaggaagaattttttagccccaaatgccagtagtataccagttgagaaggttttgggtaattgagtgacaaagaagaaaggatagggttttatttccgtgaaaatggaaatagtggctcttattaattaaacacattctttcaacaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtgtatttacgtggcaaaagagattttgggaggagtcctcagccaaattctaccagaatcaccttaataaaagaagtattaaaatcaagcacagcaggttggaatatggggaatttgacagtatatttcttcaagtctgagtttactttcttcctgatcatgaccatctgaccttgttatttctgggcttggctcaagaccaaggagagtggatgttgatgaacattcctttaaataaaagtgcttaggttgtagttatggctttgtctagaatggtgatgtcaactgtgagtgtaggtctgtgatatagaaagaattcaactttccagatctagaaagatgctaccttgcatagatttgctccttaaacataaattgcaaaaataaaaatatcacagagaacacctgtactttgcttactgaaagatttgctcactaaagaaggaaagttgccatttacctgtttaacaaatctgcacatcctgcacatgttccccagaatgtaaaataaaaaaagtttaaataaaaaaggaaagttgtcctttattgttaacatgatccattacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacactaatttagtaagtatttggtttctgtgatgtgttcagttgcgtgctgggtgacatgtgaaataaactcatccttgaggaattta

SEQ ID NO: 58 - DNA, 20265 bp, Homo sapiens
  source 1..20265: mol_type = genomic DNA
aggccgaggccgccagtgcccgccggccgcttccgctcccggcgcaggcgcggcagcttggccagagcggagggggctcgggagaggagtggacgccgctggccaggatggtgctggagagcgtggcccgtatcgtgaaggtgcagctccctgcatatctgaagcggctcccagtccctgaaagcattaccgggttcgctaggctcacaggtaatcctcccccatcagccagtccccatccttgcacgttcgccaagcgggggaaggaggcgtaaaaatcctagggccaaggggcgggacggagctcggcgcctggcacgtgatccccgcgcgcagaggaaggtgggcgcgcgccgacgcagctgcctggggaacgcctgtgaggcagtctccgggtgcttgatgccccagggtcttttgtcctcggagttgtctccggtgtcattccgtggcaagataccaggtttttgcagagaaggtgctgagttgggaacaggccagtctctttcatctcctgtcctgctcatcgctctctgtagcgtacttgtttattttaaagcgggctaagtcgtcgttatctaaggcctcatgtaacaggcagccccagctaccggctgggttgtaccctcagcatgtgggtgggagtgtgtgggagagaaatatagacttacacgtaacacgtatatgaccgttttatttagtaacgaaattaggagataacctccattccctcaggttagaattgacctatcataggtggcatttgaggtcatctccgtttctacggtcccggggcccgctgcggtaacttaagttggaagaaagataccttacccaagaaagtattcgaaggccggtatgaggagtgaaatcttagaaaatgaaatttagtgaatatatgtaacgttctatacttaaggaccctcacttaacccacacaactcatgaggatttcacatctaaaggatgaaaatctccagaatgcagtcaacacttgggagattgtgttgagttatgagcatttcattgtaagggggatatttctaaacggaactcagaccgagtaggatggtgaaggaatcagcaagtattgaactcctatgtcctaggttatcagggagtgcaaacatgaattaagataattctgaggtaaatagggttgcttcgccgggaacgttctaaagatctgtagtacctgacctaaaatacagcaatcgcacagctgtctggtagaagaaaaataagatttgtgtagactaaaatatagaactgataacaaattaaccaaattagtgaaggttattgggaggtgaatttcagtctaaggaagatttttttttaaattaaagaatgctttccccaaacaaatgtggtgcttcagtgatagcccctctcaaagatgaaaaaaacaaacaaaaagactctggtggtgggtggtcgatagatttagaagggataaactagatgacaaattctcttccaaatctagagattcattgaattatggtcagacagacgctctgttgagtggattgtgagattttaatattttttaaatattaagagttttagtagaaaacatgcaattgaatagaaagcatggtaacaataataaacattaaaaaggaacattaaacatcagaagcaatgcaaaagtaaaataaaatgaaaaacgtttcacatcaagtgtttataaacatcagatcttttgatcctaccagtttactctgacagaattgcagcaattccataaaattttggctttccccacttcttttacttaagtactttacatattttaatataatcctcattttttccctaacaactaaatacttattttagttttaacatcacaatgggcctaaccattcattcccttacaactggaaattagaaatgtttctattttttaaaattcattatgtaatagttcattggcaagtaagcaaataccagttgtcatatttctcccttttggatgtcttcacttaaatagcaataccaggccaaaacggtatgatcatattgtgacttttgtacccttttgtcattttgacatttgtaccttcttactaatttgcataagttaactgttgaggaatttttaacagtcaagaaaggaaaatgtccaatgaattacctatgttttttccagatggtggctgcatttgtattagtttcgattctctgtaaatcaagtataattgaagaaaattagaaagtatgaaactagatttaatggctagattttagaagtatgctttcttttcttgaggatccctagtgtcaacaaatatttaattcctattaaagacattaagaaaactcaaccaaaaccttttctctcttaagaatatatagtaacttcctcttaaaagttgttaaatatttaatatgaagactgattctcagaaataatgaccattctgagaagtattttaataacatacatttaacttaagtcccattacagtgtggctatagttaatagttctcattttattgctggtttatttaggaaacatgaacatgcttgtaataactggtttatgaaaaacatgagatagccctttttggattggacaaaacaattgcagggtttattttggagtactatagaagaaaaatttcagtggctattttccactctcggtctcccattctgaatagattgtaacagttaatgacatttggctttcttaaatgagttacttgtagaatccataatgtacacttttgttaaaataaaaacctggaagacaactttttagcaattgtttaaaatgtctaggagaccaaaaaatatttccattttcttctatgaaaattagagcaaaaaacaatacagttcacattattattgcctacatttccttccctatttaaatctagctgttttttaaagctattgactctcttatgatgactctgcattcttagaaaccacatggagatctttaatgaccatatactagttaaatacaggcagttctcacctatcagaaacaacttaactatctttgtttatgtcacattttcaagagtgaggcgttcaagataaattactgtgattatctaatttatgtttaacttaggtttttgttttgttttgttttttgagagggagtctcttttgcccacactggagtgcagtgtcggctcactgcaacctctgcctcctgggttcaagcgatgcttatgcctcagcctcctaagtagccgggactacaggcatgtgccaccatgcctggctaattttttgtatttttagtagagacggagtttcaccatgttggccagtctggtcttgaactcctgacctcaggtaatccgtctgcctcggccgcccaaagtgctgggattacaggtgtgagccactgcgcccagccctaccttaggttttaagtggtaatagtaaactcatgcattgaaaatattttatcttttctacagttaagaaatagaaataatttctgtgtttagctacatatgataaatgagaaaatatgttataaaataactagcaaccaagctgccagtattatttttatggtatcataagatgatatggctatattatatgtagatgtttgaaaatttgaaatggaaaaattctgttctagttctgtggaatgtaattcctcattaagatcggagtttgtctatgtcatttttatgtcattttatgtcatttttagctattattaaaaaatgttttaataatagtatttatatgtcataaggaataggtgtcatagctagcctgtgtcactatatataataaaaggttaaacctaattttgtttcccaaagaagatacttcattttgacaatgtctaaactttcagaaaatttatgctaaaattggtagctaccgtattattccgttttcatactgctataaagaactacgcaagactgggtaatttataaaggaaagaggtttaatccactcacagttcagcatggctggggaggccttaggaaacgtacaatcatggcggaaggcgaaggggaaacaaggcaccttcttcacatcatggcaggaagtagtgccgagcaaaggaggaagagccccttataaaaccatcagatatcatgagaactcactcactatcaccagaacagcatgggggataccacacccataatccaattacctccacctggtctttcccttggcacgagattatggggattataattcaagatgagatttcagtggggacacaaagcctgaccaaatcagctattcaagttgctttgaaattttcttttctgactagattttggttttcttttgtgagaaagggtttcactctgttgcccaggctggagtgcaggtggcatgatctctacccactcattgcagccttgacttcacaagctcaagccatcctcccacctcaacctcttgagtagctggtactacaggtgcacgctaccacacctggctcatttttttgtatcttattttagagacggggttttgccatgttgcccaggctggtcttgagctcctgagcttaagctatccactcacctcagcctcccaaagtgctgaaattataggtgtgaggcactgtgagtggcctagattttgtttctctgatggtgctggttctttcattcttcctttttggtcctgttatttatcttaatagtgggatacgtggaaggctgaggcaagagaattgcttgagtcgtggcactacattccagcctaggcagcagagcgaaaccgtctcaaaaaaaaaaaaaaaaaaaaagggatgtaaaagtcaatatgtatattaggtccttgctcagtattgagctcaataagaagatgaacaactcacatttaaaaattggcaaaacaggccaggtacggtgtggctcatgcctttaatcccaccgctttggaaggctgaggcaggcagatcacttgaggttgggagtacgaaactagcctggccaacatggtgaaaccccgtctctactaaaaatgcaaaaattagccgggtgtggtagtgcacacttgtattctcagctactcaggaggccaaggcaggagaatcgcttgaacccaggaggcagaggtcacagtaagctgagatcgtgccactgcactccagcctgggcaacagagtaagactctgtcttcaaaaaaaaaaaaaaattggcaaaacagaaaaatgaacaaaatcttatcctttgcagcaatatggatgcagctggagaccattatcctaaggagattaacacagaaacagaaaaccaaataacacatattcttacaactgggagctaaacattgtgtattcatggacatgaagatggcaacagtagacactgggaactgctaaaggggagggaggcaggaggtcaagggttgaagactattgggtactatcctcactacctaggtgggaggatcagccatatcccaaacctcagcatcacacaatatacccatatgacaaacctgcacatttacctcctcaacctaaaataaaagtcgaaattatattaaaatattttaaaaaggaaatttgggcacacacaaagggagaacaccatgtgaagatggaggcagagattggggtgatagacctacaagctaagggacaccacagcttctccctcagatcctccagaaagaatcaaccatgctgacaccttgattttggacttctcgccactagaactgtgagtgaatacgtttctgttgttttaagctaaaaaagaaaacgaaaatgcaagcacgaacacattgttctctgcagtttagggaatcctagtagagactactgctcacatttgttctctcttctctgctttaatggccactaccttagttttatctcaaactattttcttccagaccatttccatggattttcaacaggttgtcttgccttgtcttcttccactagccctctctgctattcctgtggccctctaatccatcttccatctgataccagagtgacttcataggtgaacaatttcctagttaggctaatattcaaatatttcagtggtttcctattatgcacaggttagattcttacttacctgttgaatatcagagtttgtcatcatacggcacctgctcagttctacagctccctttcattaaattctaacaatactatggtgcttagtttcccagacacttaatgcatgtcatatctccgtacctttgcctatgcagcttcctctgcatggaatgaagctcctcctcccatattcccatgaacttctgtactcttcatctttcagaaacctatttaagtatcaaaacctgtacagtttttgctcatgccagtaaaaagtgaataacttgtacctctgcgttgcttctgtattattgctgatagtacacagtattatgatcgtcttttataggtctgtcttccatactaaatggcaagctcctttctaacagggagtgtgttttataatttttgtatcttcagtacctgtcccaccacctgatacatgtgagtgaggtattacaattttagaaggtgctgaaagtttttttcttaaatattttaagtagtcttcctgtattttaacttacactgtcattattcataagccatgaacaaagacaagtaagtacagaccttgtaggaattatctcaaatgccagtttattggagtacaaactcaattaggctaaaacttactgaggtcttggtttatgtaagtctctgttaaagggtagggagttagggattttttgtttagttggggaggagacaaatatttacctaactatatagttttaaggcagaatgcattaatagtttgaattgtgttctgtagtttttactgagtgggttcctacttcattcgtttctcccagcaatcctatgaagttagaagactctttacttttctttgtgccttgaaaattctgcgctcaagtgcttgagctcctggcttctcattcgttaggtctctgcttaaaggttcttttttcagaaaccttccctgaccccttacctaaaattgcagccaccctactgctttgccccaggttagtttttctcttatgtcatcctttatttcctttataacagttactatagtctgtgatcatcttgtttatttgttcacttgtttatagtctctgtcctctgaaatatataccctatgagagaagggaccttatctattagcctgtatccccacatagtgcagtttgtggagtgtggtaggtactaagtaaatattgttgaacaaatgagcttacagttgttattcctgctttacagacaaaagaaacctggttccaagtatatgaaaatctggatttataccacagataaactgaattagttgtttactgaagtcctgttatgtgcaaattactaagcactggttacatagatataaataagacagctactgtatttgcatttagcacagtatctctacatagtaggtgtattagtctgttttcacactgctataaaggtaactactcaagaggccaggtgctgtggctcatgcctgtaatcccagtactttgagaggccaaggtgggcagatcatgaggtcaggagatcgagaccatcctggtcaacatggtgaaaccccatctgtactaaaaatacaaaaaaattagctgggtttggtgatgcacacctgtaatcccagctactcaggaggctgaggcaggagaatcacttgaacccctgaggtggagattgcagtgagccaagatcatgccactgcactccagcgtggtgacagagtaagactccatctggaaaaaaaaaaaagataatacccaagaatgggtaatttataaaggaaagaggtttagttgactcacagttctgcatggctaggtaggccttaggaaacttacggtcatggtagaagggagcgcagacaccttcttcacaaggaggctggagagagaagagtgaggagtgaaagggcaagagccccttataaaaccagatctcatgcgaacagcatggggaaaaccactcccatgatccaatcacctcccaccagtttcctccctcaacatgtggaaattatggggattataagaggtgagatttgggtggggacacagagccaagccatattattccacccctggctcctcccaaatttcacattcattttgcatttcaaaatcaatcatgccttcccaacagtcctccagagtcttaattcatttcatcattaactcaaaagtccacagtacagagtctcatctgaaacaaggcaagtcccttccacctatgagccagtaaaataaaacataagttagttccttttaagatacaatggcagtacaggcactgggtaaatacacctattccaaatgggcaaaattggccaaaacagaagggccacagggcccatgcaagtctgaaatccagtggggcagtcattaaatcataaagctccaaaatgttctccttgaccccatgtcacatctggagaacactgatgccaggggtaggctcccatggccttgggcagctccttcaagggctggcatcgagtgcctgcggcttttccagatgcatggtgcaagctgttgttagatataccattctggggtctggagcaggtagccgccttctcatggctctgccaggcagtgacacagtggggactctgtgtgagggctccaaccccacatttcccctttgcactgccctagcagaggttctccatgaaggctccacccctgcagtagacttctgcctggacatccaggtgtttccatacatcctttgaaatctagggtgaagttcccaaacctcaattctagacttctatgcacccacaggcccaacaccacatggaagccaccaaggcttgtggcttgctccctctgaagcagtggctcaagctgtatgttggccccttttagccatggctgggacacagggcatcaagtcccaatactgcacaaagcagcaaagccctgggcctggcccacaaaaccattttttccttctaggcctctgggcctgtgatggaagggcctgctgtgaagacctctgacatgtcctggagacattttccccattgtcttggcaattaatatttggctccttgttacttatgcaaatttctgcagccagcttgaatttctccccagaaaatgggtttttcttttttttgggggggcggggggaaggagggggacagagtctcacactgtcacccaagctggagtgcagtgacacaatctcagcttgctgcaacctccgcctcctgggttcaagtgattctcctgcctcagcctcccgagtagaactacaggtgtgcaccaccatgcccagctaattttgtatttttagtagagacggggtttcaccatgttggccaggacggtctcgatgtcttgacctcatgatctgcccgcctcagcctcccaaagtgctaggattacaggcatgggccaccagcacccagctgggtttttcttttctgttgcatcatcagactgcaaattttccaaacttttatgctctgcttcccttttaaacctaagttccgatttcaggtcatctctctctcaagtttcatcagtctcttgggcaggggcaaaatgccaccagtctgtttgctaaagcatagcaagagtgacctttgctccatttcccagtaagttcctcatctccagctgagaccacgtcagcctggatgttattgtccatatcactgtcagcattttggtcaaaaccattcaataagtctctaggaagttccagactttcccacatcttactgtcttctgagccctccaaagtgttccaacctctgccagttacccagttccaaaattgcttccacattttcaggtatctttatagcagtacccaactctctgttgtagcaatttactgtattagctttcacactgctataaaagaaataaaaacataaaataaaaatactaccccaaactgggtaatttataaaagaaataagtttaattgactcacagttacgcatgactagggaggcctcaggaaacttacaattatggtggaaggggcacctttttcacgaggcaggagagaagagtgaagagcaaagcaggaagagcccattttaaaaccagatctcatgagaactcactatcaggagaacagcatgggggagattgccttgatgatttaatcaccaaccaccaggttcctcccttgacgtggggattatgggattacaatttgagatgagatttggatggggacacagagccaaaccatattagtagatacttaataattatatagtaaatatttaatttttatagtaataattatatagtaaaaatttgtttaacaatgagaaattgatttattctttcagaaaatgtttagtaagcacttaataaaaatcagaagggggggattgattgggaaagtactacaagagcaaactttctggggcaatggaaatgtattttgtcttaggtggtgtttataggtccatatagttacaaaactcatcaaactgagcgcttcacaaacacaaagcttggccaggtgcggtggctaatgcctgtaatctcagcactttgggaggctgaggcaggcagatgggagtttgagaccagcctggccaacatggtgaaaccccatctctactaaaaatataaaaattagcagggcgttttggcaggcacctgtaatcctagtgactcagaaggctgaggcaggagaatcgcttgaacccgggaggcagaggttgcagtgagccaagatcatgccactgcactccagcttgggcgacagagcgagactccatctcaaaaacaaacaaacaaaaagcacaaagctcaataaactgaactgtaaattaaacacttcaaacaaaagtaagttaaataaattgagccagacgttatatagacactggggacacagatgatcagacaaataaggtccctgcccttgtatctctctttttcttttattttttattttttttatttttttgagatagagtctcttctctgtctcccaggctggagtgcagtggtgagatcttacctcactgccacctccacttccgggatttaagtgattctcctgcctcagcctcctgagtagctgggattacaggcgtgtgccaccatgcccagctaattttctgtatttttagtagagttgggatttcaccatgttggccaggctggtcacgaactcctgacctcaagtgatctgcccacctcagcctcccttagtgctggaattacaggcgtaagccaccacgcccagcccccttgtatctcttatattgtgagtggggaacatgataggtagatgcagccattaaaatttatgtttccaactgatattaaggagttggggaaataatataataatctgacataccattaagtgaaaaatgcaatatagccttattttttaagcatttacagcctatgtatttacataccaaaaaagagatacatttaccaaataaatacataaatgttattttttataatcctaagacaaaaataaataatatgctgaataaaatacattattttatacaaaaatttgcttggtgtggtggcgcacgtccataatcccagctatttgggtggcggaggcacaagaatcacttgaacctgggaggcagaggttgcagtgagccaagatcatgccactgcacatcagcctgggtgacagagtgagactatctcattaaaaaaaaaatatattttaaattattttatttggtcaggcacggtggctcacgcctgtaatcccagcactttgagaggccaaggtgggtggatcacctgaggtcaggagcttgagaccaacctgaccaacacggtgaaaccccatctctactaaaatacaaaaattagctgggtgtggtggcgtgcgcctataatcccagctactcgggaggtcactgaggcacgagaatcgcttgaacccgggcagtggagattgcagtgagctaacacgacacacactccagcctgggaaacagagcgagacgctgtctcaaaaaaaaaaaaaaaaaattttttttgcacattatttacagttagtaatattttcctttcaaagtatctaaaatatctgtaatagctgaacatatatcaaacagatctatagagactagcacatgtaaaattttttttaagtttcttgtttgattcttctgtattttatctttcttcatataaaatcagccttaattgacagagaaatattctatgtactcattcatatgtgggaactaaaaaagttgatctcatggagatagtcaaatggtagttaccagaggccaggaagggtagggagggagagaatgaagagaggttggttaatgggcactatagtacggttatatagaaaaagttctagtattcaatagcataatagggtgactattgttatcagtaattttagtgtatatttcaaaataggagagaaaatttggaatgttctcaatataaataaatgataaatgaggtgacgaatatcccagttacactgagttgatcattgcacatcatatgcatgtatgcatgtagcaaaatatcacttgtaccccataaatatgtacagttattatgtatcagtacaaaaacagcctgaataaatgtacttacagtcatttgaattgagcttttcaagctgtattgctttcatgtataaagtttttcagtagttaaattgtagttggttatctttaaaaagtagattatgttaagactttggtaagttattactttgttgtaggaggtaatagtacctctcatcactgtatttttaagcatagtgttttaccaaggaattaagtgttcaaaagaatattttctgaagtggattttaaaacagtagtaataccatttgttcttgaggtttgtgggttaagataggaaatgctatatttaagagtctaacattaaggttttcaaccaggcatggtggctcacacctgtaatcccaggacttcgtggggctgaggcaggcggatcacttgaggtcaggagtttgagaccagcctggccaacatggtgaaaccccatctctactaaaaatacaaaaattagccagacgttgtggtgtgctcctgcagttttagttacttgggaggctgaggcaggaggatagcttgtgcccgggaggtggaggtggtagtgaccaagagcacaccactgcactccagcctgggcaatggaagtgaaaccctgtctcaaaaataaataaataagattttcatctttgcgttcccattcactcgctttttgataaatttaagctcttatgacttctaaaatattgtaatatgtacaataatacttaatgttattctacattgaacaaacatttaatgactgctatttcgagttacatactggatgctggggccaattgcaagctaagataattagtcagataaaacagaaggaactccatatgcaaagaactcaaaaaggctgcttactagacagtagctttcgctggcctcaggtacatgaagagaccatgtttgtggaagttgaagctggaaaggtagccttgccattctttggagatggcaccttatagagccaatgatctatagtagcattgtccagtaaaactttgtggtaatggaaatgttctctgtactgttcaatatggtagtcagtagtcacatgtagctagctattgagcctctgaaaggttaccagtgtgtcttagaaacagcattttacattttacttaattttaatttatttacatgtgaatagccacatgtgtttgttttgttttgttttgtttttgagacagagtcttgctcttgtcacccaggctggagtgcaatggcatgatctcggctcactgcaacccctgcctcctgaattcaagcgattctcctgcctcagcctcccaggtagctggaattacaggcgcctgccaccacgcctggataattttttgtatttttattagagacggggtttcgccatgttggccaggctggtcttgaactcctaacctcgtgatctgccctcctcagcctcccaaagtgttgggattataggcatgagccaccacgcccacatgtgtatattaaccgtgttttcaattttctgtattttattatgctttaatatcttaggagccttgttggctgtggagacaatttaattcctagagatactaaataacttgcctgtgagcatgcctttcatatgcaaaccaaccaatccaaagcccatgcccccaaccacctcctttatctaacccttacacatgaagtcagtatttctccagtcaatatttctcctgccctaagtcaccccagggacaggtaggagacgactagggaccactacttttgcccagaacccactgaaattattcaagctagccagtcctgaacagtttcctgccttgccttttccatggaaaccacagtaaaggcctgtgcccatgctttttccctttcctctttcttcctcctgatcaaccctagtacctctcatgtggccctgcattgcatagtgtatcctctcctcttgggaactataagtaataaactgttatttcaagacagtttctacaagtctgttgggtacaaatctaaacagtatggctagtggtgcccatattgaatagcacagatcttatacctaggcctccttctccccgcaaaaacagttctgtgttatctccagagctttaattcactcaaagaacctatttggagtgtctccactttggttatgagaatgtaacagccagcatggcagacaaagttcatacttttacagagttttattctggtaactacaagattatattcctgaagatttttgcccatatagcattgtcaagttatttggcaaaatatttttttcaaaggagttgctagtacttcctcaccaatctctataatctctgaataaaagctaccatttattgtgtcttttttgccagccactcttataggtgctatctatgaaaatggtagataaataggttttttcatttagatttctttggcatgatgttatatcaaaaataattccattttggaagagttcatattgtctttctttcaatagttaaatagtactattatctcctgagagtagttttaccaagataggcacagattttaattttagatctattgggtttgattcatgataactgacaacaggctttggatttagggtgtcctggactaaacctgcttaggctacagttttctcacatgtaaaatggggataataatgatacctaccacatatagttgtttaagctaacatagtgttaaatgagctagtgcccttatactcttagcataacctgttcatttatctttaatgtttattagcatgagttagcatattattttctgtttttctcttttctcaactaagctatttccacatagtgcctagcaaggtatcagattcggcattcagtgaaggaagttaactggtaattctataagaacagaaaagagcccagcagaggcagggtgctagcagacatttgataaatgtatgttgaaatgtttatcttggtttcctggtatttttgtgtccacatgcatagggactgtttcatttgtatcacttatattccctgtccccttaagacaggctaggtactccaaaaggctttaaatgaagtttatggaattagatatatcttaaaatgagaacattcaacatagaaggtttcaatttgttctttaaaatagtagcttttacacaaaatttcagtgttctttagcaacatttaccaaaaatgtaccttaaagcatcagaggacatgttctctctgatattatgaatcagtggtaaaaattctgcagatattctgttgtatgattttgacatagtattaaggagataaaatgttttcttaacttataaaatatacattgaattttgtttatagttatagtgatcataactcctaaaataaaaatagacaaacacaaatagacttgatgtagacaatgagataggatatttgaaatggaacctatttctgaaaagttaggtttctagtttcactggtctcaaattataaataaagtaaggtggtctttggtagagctggctttattgtgttatttattcacagttttatggatccattaaaaaggaattaatgtaaaaagtaacaaagaataagctcaaggatgaaactagacatgctattttgaattcttttccaagagcactgcagattctgacacatctacatgtttagtttcagaatggcttcggttattgcctttccttggtgtactcgcacttcttggctaccttgcagttcgtccattcctcccgaagaagaaacaacagaaggatagcttgattaatcttaaaatacaaaaggaaaatccgaaagtagtgaatgaaataaacattgaagatttgtgtcttactaaagcagcttattgtaggtgttggcgttctaaaacggtaagatgtctgtttacgtgtacactaaaattttgcagtgctaggattgtttcgcctcttaaatccccagttttgaagttctttaagatgagagaattttctgtaatatttggtattgaaagaccatattcctaaattgaagttttcatgtcatgatagatactacctacattagaaaagttggagcagcaaagaagaataaaaatctaatgccttcgcaatgtttggcatttatgtagagtaacatgtattttaaaatacacattctttgagagaggacctaaggtttaatggaaaaaagctttggtgtcatagtaaatagtggtcaaatatacttgtcacagtatgagtttggttggacaagttacttaatttttaatctctaatcttcagggtttgttttaacctgatacatccacattacatatctttgagaagtgagatgatatatgtaaactgctttaataatatgaggtagtaaatgatagcctcaattatagatgatttttaatgtgggaaggagtttggagtgataagtactataagtagttgacaaaatctgtttcttgtacttgatcatagattatttgaggtttttaatacagtattgctcatcacagcatcctttgtaatagcaaaatttttataaactaaatatctgataaaaagggaatgatcatgtttttaaaggatatataatgacatgagatcctgatatgagtaagaaagcatattacagtgtgatcccaattttgtttaaaaaacgaatacacgcaggccaggcgcggtggctcacgcctgtaatcccagcactttgggaggccgaggcaggtggatcaccaggtcaggggttcaagaacagcctgaccaacatggtgaaaccccgtctctactaaaaaatacaaaaaaaattagccaggcgtggtggcatgcacctgtagtcccagctactcaggaggctgaggcaggaaaatcacttgaacccaggaggcagaggttgcagtgagccaagatcacgccactgcactccagcctgggcgacaaggtgagactgtctcacaaaaaaaagaaaaaaaagaatacacacaataaatgcataggaaaaaatataccaaactgttaattattattatgtgtatctggatgggttatgagtgaattttttaaaatttatttttatttattctttatttatttttgcgggggacagagtcttgctctgtcactcaggctgaagtgtgatggcatgatctcagctcactgcaacctccacctcctgggttcaaggaattctcccacctcagcctcccaagtacccgagacacaggcgtatgcaccacgcccagctaacttttgtatttttagttagagatggcgttttaccatgttggccagactagtcttgaactcctgatgtcaagtgatttgtctacctctgcctctgaaagtgttgggattacaggcgtaaactaccgcaccagcctaaaatatatttttgttttcaaaaattgtgtggtatgcatgagttttatagcaagaaaaaattataatttattttgaattaaattccattgttttaaaattaagcaataggtgagctcgaattttaagctccacaaatgaccaagaacttattcgattcccttttaaacctgttgtctattttaatcactcatatggactcattcataggtttttatttaaaatctaaaccaaataatgaagtaactgtttaaattgttagattttgaatatggttcagttggatgtagaatgtaactattactcaggaaaacgatctgattttttttagcaagtgatatgctttctttctgagagcatttcacaaatgtttctacctaatgaatcatattttaaaaataacacttgtaattcttttttctttttagtttcctgcctgcgatggttcacataataaacacaatgaattgacaggagataatgtgggtccactaatactgaagaagaaagaagtataataataataacaatattttctcattctttgtgtatagaaaattttaaaatggtggtcttaattattactactggttgaacaattatttcttccaatttattttcttcctgcactactgtttgtatttgatcctttgtctattcagtcacttaattagaaattaaattgtcaagcctcttattctgacttcaaagaattaatgtatcttccaacaataaaatcacttctgattttaatctaggaaaacctaaattgtggctatggatccaaagctgtttgtttctttgaatatcaatattttcaacaggatcttgtatttaaaattcccacctacattgttaaatatgttattttttcatatctcttttggttttgataatctgaagtgtttttttctcgttttggccttccaaactgcatttggttaggtgaattaagaaaaatattgccatcaagaattacttgtgttttcacagagatagactctttgctttatagagattgttgtgtatttaatatgaatatcccagctttagaaaagaagtaaactggatacaaaaagttccattgaggaacagttatttacagtataaaagatttgtttactttacaaaaggcttgtgtctgtgtgtgtgtgtgtgtgtgtgtgtgtgtattttaaactgactcagtgacagctggggtggaatggcaagaacacttacaaccaaactcatgggctgctgcaatttgaagataattggtaataaacataagacattaattcatattaaaatagttcagtgttcaaaattgtgtttatgtggatatttttctctttttaacactataaaccattaaaatacagtcatcccttgtatacgctagggactggttccagggccacacatataccaaaatctgcccatactcaagtcccacagaaagtcttgcagaacccatatgtagaaaagttggccctccagttgaccctccgtacacatgagtttcacatcccatgcacaaatgctgatctgtgtgacctcacctgcatttgattgaaaaaagtatgcgcgtaattgtacccacccagttcaaacccgtgtgtaagggtcaactgtacaaaaaagtttgtgaaataaacgtactggagaatctttaaaatttttgtgctttttaatcctactattatgaatctttttagtttcatcttacattactactctcataatagctatccttagccaggtgccatggcacaggcctgtagtcccaactgctgggaagattgaggtgggaggatggctgcagtacaagagcccaggagttcaaggccaggctgggcaacctagtgctccgcctctgctgggctctgtagggaatcctttctgttgtaaaagagttaccatttaactcccttcactgagtgcgtttctgagaccttgctaggcactctggaaactgcttagttgagaaaagacaaatacaaaagcttttctttagtctatttaagatacagtttattcagttcactttgctttctttttataagaatgtacaagaggcagacagaggtaatccttctagaaataaaactaattgttattgggcacttgtatgtaccagacactacactaagcatggtacttgggtttttaatttattacatgtaatgtcagtaggttcaattatatgatcgtaacatcttcatgaccagcagcatgtattttagagttagaaatgtagtctggtttttgagaagttttacaaggtgtatgtccaaaattgttctttcctcacatgtcagtgggggataaatacagcattgctctca

SEQ ID NO: 59 - DNA, 72468 bp, Homo sapiens
  source 1..72468: mol_type = genomic DNA
ggagccggcgcggccgcgggccaggcgccgaggtgcgcgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgtgagtggccggcggggcccccgtggcgacccccatggcgacccccatcggcgaccccatcggcgaccccggccaggctggctgcggcgggtttggctccctgcccctgggtctgggtccggggccggcgctccccggcgggagtgctgggccgagaccggagagcgattgtacagcgcgcgggcaggaaggattccggggtcggggccgctcaggtcggggtgggggctccaggcccgcaggacagagacgtgcggccgccccagccccctcctcagcctgggaggcccctccccgcggcctctgcgccgaacaaagggccggccggggagggacggcggcagcgctgggtctggactctccgggactctcggggacccgcggggctggggccgcccgaccaagcgagggcgggggggaggggtctggcctgtcctccgccatcctcccgagccgctctccctcagactagggtgagcttctgggttcctgagatgggggaggggccctcccatgacccccccaccccagcccgggctgagcgcagctgtctgtcctgccccctcggcgccgacgcccctccctggccccgcgaaccccctcagctcctgcgctcagctcctgcgctgtcccatctctgcagccgccggccgcccccgtgcacatcccgggctcaggacccctccttggcagagcgaggcccgggggaggggctgcggcagacctgggacccccagccctgggcctggaaggggctgtcccctcttcccgggcgaggctcagggaacggctgcctcctggggcagggctggcggggggcggccgaagcctgcgtccgtgtgcacctgggtgttcgcatgtggaattgcacggcccgctgcgtgtgcggcctgtgcggccggtgtgcacagcctccccgcgccagggcgcttgctctcccatcccagctgaacaagggacccgctgagctccgggaccggccattttgtgtgagaggcattttgggatgggagtgaggggcagactggtcacaagctggtcgggcgcccacctgggccgagaggggtgtgtgccccacgagtgtgccccagcctgcgtgtggccttgagtgtgcccttagcagaccctccgtggactgtgatatgagagggttctggggtagggagaagatcccagagggaaatgccaggccgcttacagggagggtgtctccgtggagggcccctgggcacccagcctgggactccccaagcagaagcttctccgacctcctgggtcctggaagccctgtggcccccaggaggtgagtctagcttttccagtccagggttcattcccgaatccccagatgagcttctgtgttctcaggaatggcctcccctgatggcccccacctggctgggggccaaaggggctcttggtgggccggtactggtcagccaggtccctgcccaaggtgactccccggaggagggtaggatagaacccacccccacaaccctcctgccctgacagcctggccagcgccccgctctgcgtctgacccagggttggttctgctttgagtccatgatccaagggcccagcgtggctgttcctgaggtttcccgttgggtcagcagctctccgcatggccgccccctgcctgggcctgcgtgggtcagcccctctgtctctccttcctgtctctgcctcctgagagcagcagtccagaactggggcaaagcatggggacacttgcacatgtggggtctgagccgtctcttcctgaccacccccagtccggacgggccccctctaagatagagcagcagcatgcgggggcttcaggcgagaccctcaacgtctgaacagccccgccttccagcctgcactaggcctctcctcagctcctttgctgtgggcacggagctccctgaacctccctgagctcccaggctctcctcagctcctttgctgtgggcaggggtggcttggactcagggaggcggcccctttgggagggggattttttctaagcggcggggctggagagcagggtttctggtcctgcctcgggttggacactgggggctggtctcagaacctctgcaaacctcagttttccgtcggtaacgtcggcacagctgcttctcaacccagggctttgtgaacaccactgctggggggcatcacactcttccaggccggcccagtgccctctgtgaaaggggatgtggctcagcactgctggtgcagctcaccgcccggctcccagacccctggtgtggtgtttgctgctgtccccgtggcccagcccatccttggagtgcagcccccacctccacttgggaggcctgatggccccatgtcctctggcccggcatggactggcccgtgtggcgtgttaggcagcatttggtctgtttgttcatcagctaaacggagacggagctcagttgggcctggggcagccgggagtggggggaaggccagggctccttgtgctgccgcacccagctgtggctgaatacaggtccccaggcccacctgccttttgcctattgccaccagtgtctggcttcggagaggtcaagttgtgagaacctctctgggcatccctgttggacccggggtagccactgtctggggtagagagggcggtggctgctgccccatggccccagggcttggtgggcgtcaggccaggcccctgctgcccccgctctggggaggtggggacgtccagcactgagttagagagggacttcatccactgttgctcctctgtgggagccgtggcctctgctcgcactgcctgggtgctttcccagaggctctggagacagggccttctctgagttagaagggcgtcagacctgctctctgcctggtcggggcggggtgctgggccacctctcccagacctcccaaagggagtgtgagctgcagaaatggcccgaactagcagatgatgtgcccctggggctgccgcaggggactctgggccagatcaccatggggggcccttcggagcctgaatcccgggctccagcctctctcctgcagcccatctgcgcataggactggagccgggcactgctccaccacggagttgaacctcctcgtccaggatccccgcgtgggttgctgggtgtgggaaagggagctccgctctgttcccgctgggtgcggacctcagttaccgcttagttacagcctgccagagggtcacgcagcctggttcctgtggatggggaaactgaggcagaggaaggttgagtgagctccagagttgtcctgcttaactgaaagggggggtcccagcctgagatgagagcttgggggtgcagattgcttgatcttgccagcagcccagccacgtggagtggccagagtgaagctgtgtttaaaataggccagatgggaaatctggcaccggggagggcctgtccctggggctcgctgtgccatcctggcttttgcgccaggcctcagctggggtccagggttttaggggcctctggccctgggctgcttgaccaggtgctgtgtcccatttcactgcagggaagggcctgggacggagggcctatgttcaagtcccccggtgccggggcccaggcgcttcccctcacagtcctggagaactcgggtggtgctgagcacaggccgctgggcctctttcccaccccttcattcagctctggggctggtgtgagccctcgaagggctggctggggtgggcaggcgcctggcacagtggtggggttcagacactctcttcttggtcaggctgctttgaggggtgagtgcaggcctgggctttacccagcacagagcggggccctggcaggaccagggtccagtctctgctgacggagcattgtgtgccgagaaagagactcgagtgcttgaacggccacattccccttcttcccacagcctcctgtgtaggaaatcttatggaaatttcccaaaaggtgaagaagcctcggagagttgtggtttctggggaaacctggatttctctggttcctggaccccttgggaggtctcgggcttcctcgcaggatttctgcccctcaccaaataatttaaagtgaaattactctggagtgataagacattgtacatgatgctgcttagttacacagtggagtcaatctctgtgcacattctgtgtctgtgagaggataggagctaaaggataagcagaaactctcctcctgaccattccacagtgagagcagagaaaatctgttttattagaaatcactgcaagccaatctctgcagagacgcggtctctccagaggtgccggcgccctggatatgggcactgctgggcactaaggattctcggcccccaggatgctgaccacgtgggaatcctgtctccagttttgaaaatgcttaaatcctggagtgtttcagaactggggtcacttctcacggcacaggctgagtccagtggtggagagtggcttaacatagtgattttcccagtttgttttagtcaataaacaaatgaatctatggatctccgttagtccctgtgctcctgacacgtccatggcccctgtgtgcacactcagcaagtccgtctggcagctgctcgcaagagcacggggctagcctctgccctgtaggagtgacattccatagcctcacaggagctgggctagcctcagccccataggaatgacattccacagccgtagaggagccaggctagcctcagccctgtaggagtgacgttccatagctgcacaggagccgggctagcctcagccctgtaggaatgacgttccgcagccgtagaggagccgtagaggagctgggcctgaagctgcttccagtgtggggagatgaatctgctacacagagtgggttccctcctaggaaaatgggcaagtctggaggaccaagggggacctgtgggggccttgaatatggggagaagggatatgggatggccgagctgccttgcccagaggcaggggaggggcagcctgtgccctgggccctccgaaggtccacttgaggtttgacgggaggctggggccagcggccaggccgtgtcctgttaaaggctcaggcgggagcaatgtgcccgttttgggaggatggggggcaaggatggtggggtgatgcctgcgatgtcccccgggggagaccttggccttgtgtccgacatcttgtcatcacagacagagcccaagcgtgttacctcacggggggctgtcttaactattttccagtgtgcatgccaggcagctctgagacgggaaactgctcgtgtgtgcgcggtctgtggacgcagccccgctcccctctgtgcttccgcccgtgtgagacgtgctcctgtgtggccgtgacctgtgaagaccctgcgtgacccgtggggcgtgaggctcggggagggcagggctggggctctggccgggggcgtcatcctgagactggccagcgtcgggctcctagacccgagtttccttgtctgcgtggtgggggtaacctgtctgcatctgtgtcacgtgatggccgccgggattcaacgtgtgagtcactccacacgatgcctgatgcgtgcgatgttccccaagctcgtagctgtcatcgccgtgaccgtgaggctccttcagcagagtggaaggcctcaccccggacggagcgtggaggccaggagggaggatggctggccggtccgggacggcgtcgctctgcccctccggccgattctcagtcccattggtcagcggctgggccgtgacggagaggcctgcgctgctgttgagggccaggtcgtgggttgaagtgcggggcccgggctcgagcgtcggaagcctgcgggggtcgtgggttgaagcgcggggccccggctcgagcgtgggaagcctgcgggggtcgtgggttgaagcgcggggcccgggctcgagcgtgggaagcttgcctgtttgtcgtgtgggaccggccgcggagatgccggctgttcacttggaacgaaggtgcctgccctgtgtgtgccgggtagtttgggggattgtcttcctgttcgtggcttccggcgtgttcccagcatcctgagggttgaggcttggaggacaggaatgatcttcggcttgagaaaccactgtgggcaggttttaccagggaaccccttaagctgtgaaagagctgcagtgcaagcttctagtttccacgcagaccgcgccagagaacccgccgggccgcctcgggacggcagcagaggacccgccgggacgcctcagcaccgacacgcgcccagccatgaggccgcctttagcacggagcgtcgagcggaaacggcggtgcccggaacgcggatgccctttgcagggctggagctcagctctgccttccgacaacacttggctgacagctctgggagtctcaaaacggtgcctttgtggaggggagggccctggacatcctcagaggaggaagcgcgtcctgggtagggtgggcggcacctgttcaacacgcctaacagatgcaaggtcgaaggaggaggggcctgcagatctgagcttgtcgccgaggaactctctggaaatggctcccgctggcccctgcgtgcgacccctacgctcaccagcccgtgtgccgagctttctctgttgatttcggagtgggttctggttcctgcctccctagtgggctctgagtggcagggccctgccgaccgctggcctcagcagcgggtgatggagtgtgggccctgcaggaggaggctctgtccttgatggctcctgggtgagggggtgtgagggaggcggccagcacaaggcgggtgggccctgagaagcccctctgtttcccctttagcctgagaaagctgtacccacagagctggaggagggagtggctcaggatgctgcttagcaaataggttggtctggagtctgggaaatggagggttagactttttgttttctgaagctgggatgggtcgtgcttttaattcgtccaggagaacatggggctgaagagctctctgctcttgtggcccctgatgggagtgctctgaggtctggcaggccacagagctgctgggacggcctcagccccaaacctgcgcctgtcgcttcccggggccaggccagaggtttcccagtgagagctttggggtcgacatttccaggaggagaaggcacttctgaaatagcgtgcccttggtgagcttgtgtggcttttctttctctgtaacctgctctgagttgtcccattgagtgttctggggatgtgggcatctggagcctgtggagaggacgggactgggggtgcgtgggggagacgcccctgccaaggacaggggagaccccctcagtcccacctgggagagtctgtgcgcggggctgtggttgattggctggcaagtttgaatgcggatcaatgtgccacttgtttctaagtcagcagggcccctgcccccacacactgagtggctggattctgggagccttttcctgtggagagtggagctggagtgtggggcgcagggccatggccctgttccagcgtcggggagctagtgtgcaggtgctttctcctgttagcagtgggcctgtgctgtgctccctgtggggttaggcggccccggtgggagcttcagtcttgaaaggggctcatagccctggggtgcaggctgctgtgcgtggggggcatcacacgcaggtccccaggatgatgtgtggtggaggacggggcgacgggagctctccacagagcttcatgtcccttctgttgtctaaaccacagaccccgtgccaggtgaggggctggggtgggtgaggctaaggtacctgccccgaggcctcggggcacttggcggcccctccacccccacaggagacatcggcttgagtggagaggccagcctctgagaaggcttctctctggccaccagctgcccagagctcccagcccagggccagcagcttgtgctggccccagacaggggatgctgggcggcctctcgcagggggagtggtggttttcagacagtggctgcctcgctttggggatgaggatgttttccagacgtgctctggaactgacattaggctctgctgcctacccagcttgaacaaaattaggtctttcatttttttgggttgctgggaatggctttgtggatgcataggagagcatggttgctccaggaagtccggcggggagtgggttgaacaatcggagtctcccatccctgaatcatctcagtgggggcggacgggcagctcctgggggtgtggcaggggctgggctccaggctgcccagcctgcagggagcctccttctagattcttcctctgtatctgtggcgtggaggcatctgctgcctctgtctgcccccgcctcatcctccaggtcttctctagttttgttcctccccatggagcccttacccgtgacgtaagctgaacacctgagaactttcgagcttgcttttctgtttaggtttggaaaaaacatgagaagggtgagtgggagcaaaaggccagtttctgcctggctccctgtcctgggaggaggtggggagaagcctcgggcagggatgagaggttgggatgtctgccctgaggggctgtgggcgggaggccggaggcgcctggttaatgtgtttctgcccctgtgtgcgggtgcagggttctaagctgggactcagggtgcagagggcacgtgtgtgggactttaaagtttgtcatggaggctgagccctggggaagggcagcagcactcggccggctgggcttccttctcctggagtagggtggtcagggaggcagggatatcggggagcgccaccccaggacggagcaggaggcagcctggagtcccctttgtagaccagataaggccaggcagggcctgatgtccgtattctattatttatttattttaagtgtgggggtctcgctctgtggcccaggctgagtgcagtggtgtgattgtagctcactgcagcccagaactcctgggcctgagcgatcctcctgccttgacctcctgagtagctgggagatgacccccttcttacccgttcttccagaataggtcaaattcacatgacatgtgcacacacacacacacacacacacacacacacagaaaagacacccacggaaaccctgaaatatataaaatgatgtccagccagtatgatttgccccctctgcgctgccccatctccgtaccgggtcagccatggcccatctcctggagccgttctctgcatgcgtgccacggtacagcatgtgtgtgtctgtgtgtgttcactcacttcttttcacatgtgtggagtcactccgtgtcctgccttgtgcgtgtggccccctctccctgcatgtccccctctaggctccgtcgggcgctcacgacttctctgaccggtttgcagtgatggaccttgaagcaggtgctaggactttgccgctgcaaatggtgctgcgtggggctccatgcacatcttcacgcaaggtgcaggtcggcaggatgaattcctagaagctgcctggtggctgtaaaaatgttctcatcccaaaggaccaaatatgcagagaagtttaacactcacttttcctgtcattgaaaagttacatttttgtggaaacccgtccaggctggagacagaaggtgtgtgcagggagaggaggctctggggcaccactctaggctgcctgctgctcaggtggttgatgtgggggcagatgccctgttccttggggtaggtgccacctcctccctgctccctggggtaggtgcattttcctccctgctgcctggggtaggtgccgcctcctccctgctccctggggtagatgcagcctcctccctgctgcctggggtaggtgccacctcctccctgctgcctggggtaggtgcagcctcctccctgctgcctggggtaggtgctgcctcctccctgctgcctggggtagatgcagcctcctccctgctccctggggtagatgcagcctcctccctgctccctggggtaggtgcagcctcctccctgctgccccggggtaggtgcagcctcttccctgctccctggggtgggtgcagcctcttccctgctccctggggtgggtgcagcctcctccctgctccctggggtagatgcagcctcctccctgctgcctggggtaggtgcagcctcctccctgctgcctggggtaggtgctgcctcctccctgctgcctggggtagatgcagcctcctccctgctccctggggtaggtgcagcctcctccctgctccctggggtaggtgcagcctcctccctgctgccccggggtaggtgctgcctcctccctgctgccccggggtaggtgcagcctcttccctgctccctggggtgggtgcagcctcttccctgctccctggggtaggtgcagcctcctccctgctccctggggtaggtgcagcctcctgcctgctgcccggggtaggtacagcctcctcctccctgctgcccggggtaggtgcagcctcctcctccctgctgcctggggtaggtgatatttctgccctcctacctgattaggctctggggccactcttggggatgggggaggagggccggcccccggggtgctggccatggtcctgaccaggagctgcagttgcggctcctcgtgggccagaggatccccttgtgtgattcttgtttggcatccgcccaggccatagagtcaggggcttggctcacctctgggcagctatggggaaggggctggtgtttgggaggtgcccgaggaatgatcggtggggggtggctgctggggcaaggtacacgaccggcttctctcctttacaattagcactgagccagcttatctgagaccatcccttcccacgggtgccatttaattagccaagagctgagttaagatcacgtgaagaaagttgggggggccttggcctgagcggcgggtggacagggctgcgtctgtcagggtgagggggtctggcggcccctgccgccctcgtttcttaaataaacgtttggtcgtggcttattttcttctgactgcaaagtaagcacatccaccgcaggagactgggaaagcgtggaaaacagggaaggacgtttgctcttcctggtttctttccaggtgtctgcgcccgcctgtgcgtttctaaacagaataggattcaggcggtcccgtcccgctgtggtgttaacggcatactgtccacacttctcatgggcaagatgagtctcgcgtgccaggtagttggcttgtctctgacctggggctgccgcagcacctgtccagccacctgtggacatggatgacggcagagtccctgtgttgtgtggtgtccctgcgtggatgtcgacaccacagctgtcctggggacgtgtccacatgaggcttggggaatccacatgtgtcccatccagggctgtcctgcaggccccgggtctgcctgaatgtgattaggtgatgaggccaccctggccaggaaggctggtgaggggagagggaggacgcaggctggcccaggaggggcttgtgttggaacgagattctttctgtggggtgagccctccgtcgccggaggtgtgcaagtggaggccgagagagagcactcactaggacgtttgtagggggccagggactggagctgtgagccgtggaccagctgagggcactggcctgcttgggagggggttaggcgtggctgtctcagggggctgtgggggggaaggcctgctgggagcctcggtcaggagtgccactgttggggtgccctcagcacctgaatgggtttcgggtggggctgacaggcagcttgagcccatgaagggagtgtgggatgtctcaggaggagcccccttgttgagggtggggggagcccctctccaccccagctcccctgggacctcatgaagcctttgctccccaaagctgctaagggcttgggtaaggccagggagggacctgcagggtcaggagcccaggccaggccaagcaggggtccccaaaggtgctggggatgggggtgtgcatgacagggaagctccggggctcgggtttggggaggagtaggctgggctgggatggggacactggccagggccagagccaagcttcagccacagaagaaggggcgattctacagctcacaaggtccccgggtgccgtctgcttcctgtagtgtaaacgcacctgtccacattccagccttcctaccgagacaacagcaccatggactggaggagtctggaggggacaaggtgtggtgagtgttaactctccccacccaaagctatcctattcagagagaaactgaggcacaggtgggtggacaccctaggcacagagccactgatgggcaggcaggttacctgtgtgcgcttgctgtcccagaccttgacaacacggtttattttgttttttaaaaatagaggttaaattatcctaacatgcagatagcattttaaagcgagtaattcagaggcgtttagagtggagaatttagtgatggtctgccgccaccagccctatttgaaaacttgtcaccccatgtggacactcttgccctctgccatcgtgtgccccaccctgtccctggcagttgccggtctcctgcctgtctctgtgacgtgcctgttattttattttatttaatttatttatttttgaggcagggtctcttttcgcccaggctggagtgcagtgtctcaatcacagctcactgcagcctggacctcctggactcgagccatcctccagcctccgtctcccgagtcgctgggactgcaggtgccccaccacatctggctaacttaaatcatttgtagagatggggtctcattgtgttacccaggctggtctcgaactcctaggcccaagctgtcctcctgcctcggcctcgccaagctctgggagtacaggcgtggccgccgggcctggcctgtttgcttcggatgtttcgtgtaagtggagttgtcatcgtggtgccgttttgtgcctggctttccttgccgagcctgccctcaggttccttcgtgtttagggtactccttcatcctctccgtgtctgggggccgctgcctcgtccttcctgtggccgcacggacggacctcagtttatctacccacccaccaactggatgttgggttgcgtctgccgtgaggctgctgtggacacgcggtgagtgtctctggacatttcgtcattcctcttgggacgaagcctgcgtcacatgtggccaggtgccctgggtgggccgtgccctcctcatctcagccccccagacccacacaggccccctcccggagccctcgccttgctcttcccgctgtgcggaaggtggtgcagtgacgcctgagtgtgggccccaggcctagctgccagcctgggctctcgagcaggttcaacttggccagggcagggtcttggctgccgcctgcctggatgtggggagacgcctctgtgcaggttctgggctgggcacttggggccactgtctgagcagaggatgtggggtcctgcctccgggagggcgagcagaccgctgctctggggggacagtgctcggtcaggctcagggccctggagagaatacaccagggagacttgggggctgcccggggaagggatggtcgggcagcctttcagagaaagtgacctgagattgaagcctgggggatgagggggcggctctgggacctgcgggtaggagaggattccaggcagcaggaagtgcacgtgcaaaggccctggggcagggacggcgtttgccgagggcaggaggggagcagggtggatgggtcgcgtggggtccaccatgaggcactgcagcggcctcgagggccaggccagggtggggtctatcttcagggcctggggctcgcctatgctggctgccattcccacccagcttctccacatgcttctgggatcaaagtggctggtacaggggcgcttctctgcgggctcagtgggttgggatggggcagtggagagtgggtagccggggcatgccgggaggaagagtaaagtccaggggaccccaggccaggggctgcgagcccagggaggttgcggggtcggggagggcgggccaggacctctgcatggggctgggctgggcactttggccagccctgcttggtgcaccggctgggtctctgtccagcacctgtggtctgggtgggacaggtgactaatggagaacaaatgagccctgcggagcttccgtctccagggaccgtgagcaggcgctgcgaagtcacgaggcagtgcccggggagctgatttaaccacgtgctgagccagcgggtttcctgccagggcctgggagtctgcccacagctgcagctcccagagcccctggggtgcatggcggatgccccctctttctgggccggggcgaaggccctggaaggacctgtggttgctgcagcaatgcagggggctgggggtccctgtgggccttgggcgtctgctgcgggagtggttagggagcaacgtgcaggtgggcaggacccccgcctccagctcctccactcctgttcccgagggagccacagctggctgaaggaagtggccatcctggggccatggtcagtgtggggcatcgagagccccctgagagcgcctccctgcccaggatgttggaaggagggctgtaggtgccaggtgggtgcaggcgggcataggcaggcccaggccgtttggaggccgtgagcatcaggctagcagctgggccttctgaggacctgagacttcctgacctgtgtcctgtcagggtccagttgagcacccagtgtttgggaggctcggtcccacctgggtcacctcccgtccctgccccatggccttaggctcaggtgggtgctgccggaagctccgaatgagggtggaccctggcctggcaggtacaagccacgcagtgctcagcatgaggcggctccacgcgagaggtctctgtgtgcagctctgcaggagcgtggcccttgtcccctccagccccggcggtctgcagtgatccatcacgcttggttcatgcccggttcacgcctggactctgtcagcggcgcccgcgcccgtcacttctgaggtgggaggtggcgtgtgtcctggaaacagagcagttcattagatggtgaaattagattccaggttgcagcgtggcggctgcctaatggacgaggcgagcggggcccccagggaggctcgagcagtcctggacctggtgcccactccggcctcacgctggctttctgctcatccccggggccctgctgggctcccaggtccccagccccggggaggtgcagcctcatcagcatggacattgttctggacagggaatttctgcctaaggaggctgcgtgggaccccccaggaccccctgcagtgggagaggggtgcatggtgggggccgtgcagccagccagctctggccaatccgcacgtgggcctctgagagtctccggagcctctgttttcccgactgtgaaatgggcacgtgactgtagggctgcttccctcctggcaggtcatgggtgtgctgagaagcttagcccgtggagtgggagtggggtcttgatgtcaggggcccctcctgacccaaccctggctctgtctgaggcaggggctgagggtggcggtgaggtggtgacgccttccctcctgcccgcccatccttcacgtgttccgttttcatttaactaaatacgcaagatgagatgaacagccctggccaacttggagtcagcctctggggaaggggcctgactggaggatccagagtcgcagagcgagggggctggctgtgggactgactcggggggcccagacccctcctgcgtcgagtcctcttccccaagtgcatgaagcgagtgaggagcggggtggcggcgtctgtgtcatgctttcccagaaaagaaatatccccttcaaccagaatggggaaggaaggcgggggagacctggaagcacaggagtctcccggaggtggggggcccatgagcagaggggtctcccggaggtggggggcctgtgggcagaggggcctcccggaggtggggggcccgtgggcagaggggcctcccggaggtggggggcccgtgaagcagaggggcctcccggaggtggggggcccgtgagcagaggggcctcccggaggtggggggcccgtgaagcagaggggcctcccggaggtggggggcccgtgagcagaggggcctcccggaggtggggggcccgtgagcagaggggcctcccggaggtggggggcccgtgagcacaggggtctcccggaggtggggggcccgtgagcagaggggtctcccggaggtggggggcccgtgagcagaggggcctcccggaggtggggggtccgtgagcacaggggtctcccggaggtgggggccccgtgagtagaggagtttttgcatctcaaggcctgagggtgccagcgtgggggccccaggactgtggtccggccttaactgggcggtgggggccccaggactgtggtccggccttaactgggcacccctctggcctggtgaccctttggtccctcccatgggcccctccctgccccaacttctcctctttgcacttgggtcccaggtcccaggaggagatcccccgctgctccatgctcagtctgtgactgcattcggggtgcctgatccccgccatggcctctcttgtgatctggggctgtctgatgggcacggggctgggctgtgcgtcagggacgtgcggtgagccccagccgacgcccgcggtccaggtgtccccctgcccctctgctcagtggtgggtgccagggctctgtggatcctccctgcccccaccttgactctttgcctgaatctggggctggggaccagctacttgccttatctccttggcaacggctgccagggaagctccggaagttgaacccattatcataattagcttcgaaaccctttgtgttgtaattctgggctgcagagaagctgctcggtcctcccatcgtcctcccagcgtcctcccaccgtcctcccatcctcccatcgtcttcccgccgtcctcccctcatcctcccccattctcccgtaggaagtctcttctttcttttcctgcagacttggccgctgcctgggcaggagggggcgggcagcccttgccgagccagcgagacctcagctgagtgccccgtggtgggctgtgtcccccagcttagtgcaggaggggctgtacccacactgtgggcctgggtctgaggtggtgatggccccgtcccgagaggcctctggcagctggccctcagggagtgtcccacatttggacgctcgtcgtgcctgggaccctgaggccacatgggcagggagtgtgtcccagtgttcccggggagcctcctctcccgaggcctgggggatgccatcaggggtctcctgccgccctctccctcccctggttcagaggcagaggccctcacctgcctcagtgagcctcagtttccccttctctaagatgggcatgagtgtggatgtcttggggacaccacggtttgtaggcggaggcctggaagcccctgtgtcttccccacggttcggccgaccggatggctggccagtgcgtttgggaactatccgcagtttggaggtttcttccctggtctgtcctggggcctggagccacggccgaggcaccgggatctttgcgtcccccagacgggcccagacgcaccccgtgccgcctcctccctcctccaaggctcttctcgcacgtccgtctctctgcctcccctgcaccggccgcccccggcagcgccatctgtgccatctgttccaaaaacttaaaaaacaaaagtcggagctgttgcctgcactttccgggtggggctgtggcaggaggggcagcggcgggaggggcagctgcttccttcatgcagggtctgcgggccggcgaggcgggggcagatgggcggaagctgagctggaaggagctggagccttctgagggcctggctgcgagattcatctccctgaattctggctttattcctcctggtccacgcctgctgggaggagccacagatctcggccgcatccggctgcattctgtctccagggtttctggaatgctctgagatgcctggtcggagccaccttaggaagcaggctgagtcctgaacatttgggacctgggcctcgttttttttagtttagaggaaggttccctgcagcccgaggagctgccttcctggatgcggcactgaggactcagaattcaagtctgtggggctgtcgttgtccccaccccgccctgttctcaagtctggtcagcctcatcctcggtgggatgcagatacgcctgcccttctctcgccaggcctccccagcggctcctccctctgctgggaatgcccttccccttctccccctgtggccaactcctctgtatcctgtagcccccccgcccctgtacacgcctcctccgggaagcccacaggattatgtgcgtggctctgctgggctgagctgggtccctgagcccctcctgtgatgtgtgatgccctctgtgtccccgcggcgcccctcctgcctcccaagcctctgggctcctgactgggaagccagggacccccgcgtcctcccctgctcctaccccgctgagagttcagagaaaaccccgttaggcagacagaggatcgcccgcagaaggcgcacgagatgtctgcgcatttttcccagggctcagttaattgaagaacttggccaacgagcacaggaaattaatcgcggcttggaaatgggacgtcccttgcgtatggtttgtctgcctgggcctcggcaccactgccagcgcccctgcctggagccgggagcttcggggtcctggcggaggcctctgggtcgcacacgtgggcggggccgagtgccccctggcgacggtgcctcagggccagtgccttcgagctggaagccgtgggcctgtggcggcgggcggaggactggtgtctcctggggtgcccgacacagggccttcctggtgctgctgtgccgacgtccaccgcggggcggcagctggatagggcaggacctggctgtggcttgtggtcttgggggtggcggggaggggtgcagcgtggggcaggctctggctcttggacccacccggcctccacacgcggtgctgcgctttgagcttctcactaggccctggaccctcccctcagcctgcagggactattcttcctggaagcccccgccccaacccctgcccctgcagctggagctccggctggcgcgtcgtcccgggctgaggcattctggctggcctgtgtggaggctcccagttcccacgaggagggtcccggtggggcctctctctgtggctgcaggccagctggtggggtcctgggcaggtgtgtggcctggacctgccctggagccgagctgccggcgagagacctggctctccccaccactgtccttcagcatcagtcagggtgttctgtgcctgcaccgctgaatcagcccgttcctgctgcagtcccaggcctctggccgaggcccctgtgtcctctcccagcccgtgatgcccactgtatgcatacactctgtatacacgcagctgcgccatggtgcccggctggtggccacgcacctgcctcgacgctgctgtgcaggtgtttttcggcatgaacacttagctcagcggacttcaagtgaagctagtgaccctctgccgtgggggtgggcgtcgtcccagcagctgaggccttgagagcaaagactgaggtttccggaagaaaaaggattttcctcaagaccgcaacatggaagtcgtgctgagtttccagcctgctgccctcagctcagaggcaggcactggattacagcttctcaatggcatggagctgggacgtcctcggggtgtacgtgggtagaatctgaacttgggctcacgctagagatgctgacagttttcacatgagacgctttaaaatgtggctttggcccctgcgccttcatctttggtttgggtgctgggccagagccttcacaggcacagtttctgccgccgctgcctgtggctgagcagtgccaggcctcagttggctctggtgctggaatgggcagttggtggggctgaccttggccgggccgcctgtgcccgaagcctccacctctgcttcagactgtgtggtcccgggtgcttctgaagcacggccgtggtccttcccggggcagatcttgggaggaccaccctgtgccccgccttccctgccctggacgccctgggccgtgcagcagaggccgctgctggggagtcggaaggtggagctatggggactgcgcctgcccaggccagaggactcaggctgcctggacttgggggtctccagcgagtgggaggggggctgcagggggccatgctggcctccccacatccagagggtgttcagtggggagatgactgggtccgggcagagggaagccgtgggggtgtccgtcgtgaatcgagcctggaacagcatggccaccctcttgttcttggctgaagggagcttgcccaagtccccaggtcctggaggcactttgcacacaggatgggcttgacacgaggtccacgcgggtttgtgtctttccacagggtcaggcttttattgatgctgtttcaatcacaaaagccacgagctacgtggagtccccaagcaggcaggttctccctagagcttctgggtcatgctgcggtcacggccactccatgttggtcagtgttgcagaccgtatattgccgtgtgctcatctggtcaaattccactttccacccaaagccaggtttaacatcatgaggaaaaagacacaagacagagggttaataccagcccagaggcctggcctgggctgctgcaggtgactgtgagacagcggcggtgaagacagaggcctccagggagaactgagcacggaggactggcttgtgtgtgtccttatctggttggacttggtcttcatttttttgtttgtttgtttcttttttttttttttttgggacagagtcttgctctattgcctaggctggagtgcagtggcatggtctcggctcactgcagcctccgcctcctgggttcaagcgattcttctgcctcagccttccaagtagctgggattacagacctgcgccaccatgcctggctaatttttgtatttttagtagagacagagtttcaccatattggccaggctggtttcgaactcctgatctcaagtgatctgcccgcctcggcctcctcccgaagtgctgatgcgtgagccgccatgcatggccaggttttcttcttttttgctttttggtttttaaacagacatcttatccttcttggtagagtgccctgtgagacaaaatggagtcttttcctaagatggagttagttatgccaagggctctctgcacaggtctgccctcccctgcttccaagcccccgcagcctcggctccacagacgctgctctgccagctctcacctgggcgcctgccactcttgttcaaccttgaccccaccttgaccctgtgtgacctctgcgctagggatctcctggcttcccccacccccagcaggtcttcccccacccccagcagtcttcccccaccccccagcaggtcttctggggctctgcccccaggggtgactgcagcgcccagtgctgcctcagggagtcctggcccttgcatggggcagccacagcgtcccacacctggggcagccccagggccctgggagcgggggcaggcatcagtgctgccttattcctggaagcctaaagccacttggggagggagatccagccctgacctcatgtgtggtggccttgctgggcctctgcggccgccctcgtccggcacgtgtgctgggccgtgacctctggaagagcagccagggtttcgtctaggtccctccggagcagtgggaagagggtttggggcacttcgtccctttgggtgagggaggggtgggggaggagtggtggtggaggtgaggggcctgtaagtgagggacggggtgaggcggggtgaggggcctgtaagtgagggagggggtgaggcggggtgaggggcctgcaggggcagaggcagtgagctcgtgtggtggcgggcgggttccaggggcgcaggcagcgcagggttgtgtgctgggtgtgggtgctggtgatggcactgatggtgcgggacggggtctgctctgagtgctgtgtgtcagatgtgggcccaattacgtgctccaattgctgccaccacccagtgggctggtcctggtttgggggctcagagcctgagcctggggtgatgggggccccgggtttgtgcccggatggcctggccctgtccttctgcctccgcggccaaaagtctgagaagtctccctgcaggccgcagacactggggcttccctcttccctcttctcccaggagctcagacgctggggcttttccctcttctcccgggctgtggagctcggcctttggtgagtccctcctctctctgcggtgctccccaggggctctcccacaagacagtgaagccgtgagcagagtggggtcctcttcccaccaggcaccacagccaatgctgacctctgctccccaaaccctccagaccctccaggcactgcggccaacgctgacctgtgctcactaaatagctccgcacatcgaggacttgttttttcctttttgatccgtggcagcttgtgtcacagccgcgtggcttgtctgcccagggaggagctgtgggtcagagtagcatgtggccacagcatggtggagtcaggcgtgggctcgcagcagggacacaccgatgtcagctgctcatagcgtgaaaggtcatggtcttttatttgcaaggggcagaaaacaaatgcaaagggttgtaaggaatgggcttacataacctggaagtccaaggggcttcaggcacagctggatccaggtgctcacattatgtgtcttaaggcctcttctcccatccttctgtgctgccttcctcatgacctcatcttcaggcaggttttcctgtgcccacccgtcctcctgccagtgccccaggcctgcctcctcctagttggcaacctttgtgggaagggggtgtcttattcctggtagttccagcagagattctggggccaccactcgctggccgtggttggccagcctcgatcccatgagcatccctgcacccccagactggaaaggaaattgcaaggctgagacaggaggggtgggtctagacaggtgctgtgatgctccgaagctccaatgatgagggggcgtgaccagtctggagagactcccccccaggatgcccatgcctgtggccagtgccccggcccagcaggtcaggggtgggcgtatccgggctggagggacttcccccaggatgcccgtgcctgtgcccagtctcggccctgcaggtcggggcatccagggaatatttcctctgtgggagtggggagaggggagcggggacactgcccggaacccaggctggactgcagcactgctttggggacagagggaaggagatcctgagtgtggggaatctccctcccttgacacccacctggatgtgggcgccggggaagggctcgggtttgagacacaggagggccccacaggctccgtggcggtcgtgtggtgccgcagggtgtgcaaggtgatggcgagtgtgaagacagtacaggggcgcggacacggggaagcggctgctctgtggctccgtccccgccggctcctggttctgagcacggttggaacgagaggcagcaacacggtcaaggtgaaggcgtctctcacattgcctggaatgagggcgtgtcccacgcatggcctcctttatggctgtgacgaaggacctggacgttggacacgtccccttcacatcccagaacacctgcgaaaaatgtaaatgagacaaagcatttgcttcctgcgaagtgggtttctctctggtgtgcattcagtgacttcagcacgcgggagttggctttcctgccaaagcggcagcttgaggctctgggttgcacagctttgctcccaggaagagctgggagatcttctatgtctcttctatgtgggtggccttgttgcagccacaagccgggttcccgcggcagggtcttcgggggctagcgggctcctcctgtctgcagcttcctggggtgggcaagggagcaagtgtagcagagtcgcttgtatcagaggagaatgcagggctgagaaaaagtcacgcatttgggccgagcatggtagctcatgactgtaatcccagccctttggggggccgaggcgggagcatcacttgagcccaggtgttcgagactagcctggccaatgtgatgaaaccccatctccactaaaaaaatacaaaaattagcctggtgtggtggcacatgcctgtaatcccagcaactctggaggctgaggcgggagaattgcttgaacccgggaggcggaggttgcagcgagccaagatcacgccattgcactccagcctgcgcgacaagtgaaactgtatctcaaaacaaaacaaaacaaacaaaaacaaaaatacccacatgcatttgggggaattttggtggggtgtgaacttgagcatctgaggggaaattgaagaaggatcagtgagtgaggtaatcgcgtgggacgtgaatgggaagagcaatcatggtggaagtcactggcgggaggaggtgcctgcaacccgggaggaaggagaaacggagcctcctggcagccaggacgaggctggaaagaaggtgatccgaggagctcctgttgcttggctccgggtttaactggcagagagaagccctctgcgttggggtctggaggaggtggccgagagtgaggagaggggaaggctgatcggtgccttctgccccaggggttttgcttgttcctgtgtttgtagcagttgatgggcaggccttgctgttcccatttgactgagagttttggagacgttgccaaaggatgaggctgccaggctgaaaccagacagaaggggcaggggccagagtggagaggggggtgcgtcctggagggggcagctgcgcatagagggggcagctgccactgtggagttcagggtcccgggaggtggctatgggggtgccctctggcccgagcgagctctggtggggtgggtggggagtggggtcctgcgttctggagacgcggccatgctggtgccctgctgcggcctggtggggagtggggtcctgagttctggagacacagccatgctgctgccctgctgcggcctgtctgagagcgcgcgttccctgcccccaggttcctcctggttttctcctgcctcgtgctgtctgtgttttccaccatcaaggagtatgagaagagctcggagggggccctctacatcctggtgagccccgagggagggcgggggctggaagtgcccaggaaggagctggagctgcctgggcgtctgtcttccgttcctgttactacagggcctctgacgcccccagccccagctctggccatgtctttgtgccctgtcagttcccatctgcccccagccccacagcccgggctatgccccagccccaccctggctgtaactcagccctcacctcacccctcctggtgacctcacagtggctgacagccccgcctccatcgcccccaccctgggtgggccaccctccctttcccatccccactttatctctggagccggagatgtggggcgtccccagcagacggcagacgtgggcgtcggggtgggggctgtgacgcttgcagcaaccctgtgccagggcagggtgggcgccatggcaacgggagtgcagttcctgtgttgctgttggtaacggggtggggggccctcaaggagactggtccccatccaaatgcacctccctctactgcccgccctgctcctctgttctggggcttcccaaggtctgggtggagactgtggccccctttgcagttacctggggccttccctcagctcagccctgctgtgcaccccccaactcaaggcaggtcccccactggctcagacagggtcccccagctcagacaggggcccccaactcagatagagtcccccagcttggacagggcagctccccaaccagctcagacagggtcccccagctcagacagggtcccccagctcagacagggtcccccagctcagacagggcctcccagctcagacagggtcccccagctcagacagggtcccccagctcagacagggcctcccagctcagacagggtcccccagctcagacagggtcccccagctcagacagggcctcccagctcagacagggtcccccagctcagacagggcctcccagctcagacagggtcccccagctcagacagggtcccccagctcagacagggcctcccagctcagacagggcctcccagctcagacagggttccctagcccagatagaaccccctagctcagacagggcagccctgccagctcagacatggtcccctagcccagatagagtccccagctcagacagggaggtggggagggtggccccatggtgttcatgctcagctgtgttcccggatgcagggtctccagagggcccaacccttcctgcccagaggctggagaggggtgggggggtcagcttgcagtttcctttgggggcctcctgccctgtggcttggtccctgggccagaactgctcctgtgggtgtccaggctgggcccccaggccctcccccaggcctcaaggtggcctcagctttcctcccctgcaggaaatcgtgactatcgtggtgtttggcgtggagtacttcgtgcggatctgggccgcaggctgctgctgccggtaccgtggctggagggggcggctcaagtttgcccggaaaccgttctgtgtgattggtgaggcctggtgggggtggtattgctagaatcagggccaggcacccagggacggactcagccctggggggagctggggcgtctgcgtgggccagagaggctgggcaggactggctccttctggaagtttcttttcacctgctgacttggagtcagaggctgtggttaactctgcctaaatgtcaggaagaggaatgtggcgctgggctgcccatcctgggccccacaggcagggtggacgatagtaatgtccttcctggggcctgacagagcccacaccaggcgctgggcatacaccttcccgcccctctgcacatcctcctggaacgcggggtggggagttttctccaagggggtgcggggagcggcccagcagctcaccagctccacgcccgctttgtagacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggtgagtcacggccccaaggctggcggtgggcgcccccagccagcgagagtcctggcccagaccgggccccacccctgcctggggtttgcttcaagagccctgggtggagggatggagtcagtggtggctctggctggagcccatcaggtgtgaacgagcctccctcccctttcttctcggtgcttcttctcgtgacttgggccatctttgtcatctgtctccagaaagctgctttttcgaaaggccaggccaggccattttggcccctgccacccccaccttcctgccgcgaacccttggctctgtggttgggtgtcttctttcctgggtttttagtgcctggatcaatacaaagtgctagtcacctgcctggtggttgtttaagctgcggcttgcggcggccgctgtccgggggacccagagggtggctgtggccacacatgctgagttccaggggccccaggccccccagtgaccgagaccccatcctgccagactgtgctgtccctccaccttgctcacgggtgggctcatttgctcaaatggccccctccccattttcttccctcttgagccctggcagggtggtggctttgtctgcagaatgggcaggggtcagcccccggtggcccctctccctccctggacgctgtgggggttgagtgctgactgcagtgggcacccttttcacatctgtgcccggaggctcagggaggttgggggagggtctcaacagtcccaagattctccagccctgctggccgccagaatagacgctactgaccctggagggcacggtgggctggccgtgcgagccactgttgcccaggccaggaggctcaggggaatgggctgccgtagctaagatggtgaagccagcggcgcctcctggttcccctgtgccagccctgccaccgaccctggcgtggagcctctgctggcctcaggagacgggtccatccagcccctatatccctggagacagagcccaaagtgggctgactggcgaggctgcagtgctcctggaggcaggtggcgggtggtgatggtggtgagggtgatggtggtgatggtggtagtgatggtggtggtggtggtgatggtcatgatggtcatggtggtggtggtggtgatggtgatggtggtgatcgtggtggtggtgatggtgatggtggtggtgatgatggtggtgatggtggtgatggtgatggtggtggtgatggtgatggtgatgatggtggtgatggtgatggtggtgatggtgatggtggtggtgatgatggtggtgatgatggtgatggtggtggtggtggtgatggtggtgatggtgatggtggtggtggtgatgatggtgatggtggtggtgatgatggtgatggtgatggtggtgatgatggtggcgatggtgatgtgatggtggtgatggtgatggtggtgatcatggtggtggtggtgatggtggtggtggtggtgatggtgatggtgatgtgatggtggtggcgccggtgatggtggtggtgatgatggtggtggtggtgatagtggtggtggtgatggtgatggtggtgataatggtggtggtggtgataatggtgatggtgatgctgatgatggtgatggtggtggtgatgtgatggtggtggtgatggtgatggtggtgatggtgatggtaatggtggtgatggtggtggtggtggtgatggtgatgatggtgatggtggtggtgatggtgatggtggtgatggtgatggtggtggtgatggtggtgatggtggtggtgataatggtgatggtgatggtggtggtgatggtgatggtggtggtggtgatggtgatggtgatggtggtggtaatggtggtggtaatggtgatggtggtggtggtgatggtgatggtggtgatggtgatggtggtgatggtggaggtggtgatgatggtggtggtggtggtgatggtgatggtggtgatggtgatggtggtggtggtggtggtggtgatggtggtggtgatggttttggtggtggtgatggtggtcatggtgttgatgtgatggtggtggtgttggtggtggtgatggtgatgcttctggtgatggtggtcatgatggtggtgccgtctgcctctcaggagctggtcactgcctggtacatcggcttcctttgtctcatcctggcctcgttcctggtgtacttggcagagaagggggagaacgaccactttgacacctacgcggatgcactctggtggggcctggtgagttgtggtcattgtggttttccctttccctgctgatacacccctgtccctgtgctgggaccaggctctcactggctgagcctgctccatacatctctttggggccacctgctggctgcccgtggtcatgatggcttgtggtcgaggcggggtggtggttgccaagctggcgggggagtgggtggggagggctgggccccagagagcctgagctcagccgtggtgggcatcttccttcctcctgagctcagccgtggtgggcatcttccttcctcctgagtgaccctccacctgctccgtgtcccgattattgggggaaaggggagaagaggcatccctaggagatctgtcctgggcagccctgagtttttggagactaggtggctctgcaggccccactctgatcaggtctgaacagatctggcccctgggctcctcctcacctggggccacagacaccctcaggctgctggtgcacaggggcagggtctgtgctctcctgggaggctgagaccagaccccgggcctagccccgcacatgccggctgagtgggctcagccctgcggggaaggcatgggcagctccacctggtgcctaagccggatgcagctgatccgaagttattttattaatttcatgagacctggacactgtcttcccagtcggggcttgggtgggggttgagagctgagcgtgccccggggcccaggctgtggaccatacagatgacctggactcactgagccatcttgtgtggttcaggccccaccacagggtcagggtggggcccggggcgtcctgagctgtgactgctgggccctaggacttttgatggggacaagcccatcccccaggtcttttgtgggcaacagccttcttatctttacgattgggtgttttttcagagtaatgcttgtgtatatttttaaatgtcagagagttactaagccttatggtgagaatagagccccactctgtggccgcggtgccctcccctctgggtccctctgcagcggatgcggctgcttctgtgtttttctttggggtttacctgattagtcttaaatagcaaatagggatgctggtatttcctgattcaaacgcgctgactgtgtacctcctactgggatgagatctacccccagtttccctttcttgcagcctttgggggttttcagcagtgtggggggaaccccgccctcacctcccccgcaggccaggccccatctgccaggcctccggcttccttttccttgaatacaaaaaattagccgggtgtggtggcgggcgcctgtagtcccagctactcgggaggctgaggcaggagaatggcgtgaacctgggaggcggagcttgcagtgagccgggatcacgccactgcactccagcctgggggacagagcgagactctgtctcaaaacaaacaaacaaacaaacaaaaaaccacgcctcctttggtaacgaaattgtgtagagggctgaggccctggcttagtctccccaggagaggtttcttggtcaggcctcgcccagcctcccgcccactctgtgtggcagcctccttcccagagtctcctgtgcgctccgcgtggtggtggcagccaaggcccccaggtgctggcgctgctttgcaccaggccacagcttcctgtcggtgtggagcaggtgcggcccagccggcccaccctgtcctcagaccacacagcagcgtcctcggaacccagggtaaactccccaaggtggggctgcaggtcctggtgagaggtctccccttcccggccctgctgtctgcgctcaggcctcgatccctctgtctgtttatctaagactctgccctcacagggcctgtcctgggcccaccttctggtcctagccagagtggcctccgtgcggctgtcctgagcccgtggcttgtggtgcgtgcggttctggcaggcgggggtgggctgcggccccaacatgtccagcactgagtgcagggtgcctgcccctgccttcctcggccccggcacaggcatctcttgtcggagctgcttggagacgtgtccgtccttcgcttcccctcatccaggccccgagtcgggtgctcctgggctcaccgggacccttggggaggtccaacctggcctgacctcccccttgcccaccacccctagagaaactaagcacaacccctggggtccctgctccaggagcagcccaccccgccatggctcggtggagaccactcccccgcctcttgtggtggcctcctcctgcccacccctctcctctggcctcagctcagctcaggctcagcgagccccctgcacgccctgcccgttcctctgggtccctctgggcactcccttctccccagctgcactcttcacctggcggggatgcagtgggggctgctgtcctagccgagcctcgtgggagtcacgtcgctgggcctctggttctcgatgtgagatggggacacagcctttggctggaccccgcttctggcctgtaggggaagaggagagagggctcaggggatgaggggcggccgacaccgaccctggcctcactgggcctccgtgtggatggtgacacgggggtggccccgcatctgtcccatcccaagccccgagtcgccagcgggcgtccagcctgccctcaggggtgtgagcaggcccttcgtgtgactagagcctgcggtcccacagatcacgctgaccaccattggctacggggacaagtacccccagacctggaacggcaggctccttgcggcaaccttcaccctcatcggtgtctccttcttcgcgctgcctgcagtaagtccagctgcccctgcctgccttggagggggacgaggtcttgtaggctcccgaggtgaccacaggcccctgggcacagttccctaggtgggacctggggcaggagcagctctcagcaggtccacagcccccaggagctggaggtggcagctcagggtcagaggccttgttccccaaggactggagtgggggttccccagccccgacaggagcatgcccaaggctgcggctgtagcttcagggggctctgttagtcactggtggcccctcttagtctgagtggggctgagcaggaggtccttgtgaccaggagcagggcggctggtgacacaggtccctcatgggtctctaggcagtgaggcccacccagctcagagggaggtggaggggccctgtcaacccttgttgccccagggcagggcagggcagggcagctggtgcacggcaagaggctggccccggtgtccccttcactgtgtgcccttcaagatgggcctgcagactcttctgtgtggaagggaaagaggccactctgagttcagtgtgggtcctgccatgtctcctgcaagccagagggttccttcctcttgatgctgacaaattgtggggatatgggttcctggattagtctgaccttgatgaaggtgggggaggcatggatcggtggagacgggtctgaccctgatgaactggggggtgtgtgagtccctggggcgtggtctgaccctgatgaattggggggtgtgtgagtctctggagtgtggtctgaccctgatgaattggggggggtgtggggccccagagcatggtctgaccctgatgaattggggtgtggggggtccctggggtgtgacctgaccctgatgaattgcagggcatcttggggtctgggtttgccctgaaggttcaggagcagcacaggcagaagcactttgagaagaggcggaacccggcagcaggcctgatccaggtgagtccaggtgtcccccggggaccagcacagcccttgtcctggtcccaccttgttgaggagtggaggccgctggggctttggcattgccctgtctgtggatgggccacagcgctcaccctctgcaggaatctgtggaaggagcgaggatgtgaagtgtgtgtgttgagaaatggctccaacccctgaggctgcacaggggtggctcgtgtgaggacgctggggtggcccttgccttgtgtgggtgctggggcccggccatcaggtcctctctaccgcaccctgggaggtgagcacacccgttctgcagctgcagggccaaggctcctagagcccacacactgcagtgagtcagtgcctgacctcgtctgacccctgatgctggctgtgggcccccatgatgcccgcccggaccccacccagtgccgtcccaccatttgggggtgggtagcgtgcagtgaccactgtggcatccacaagtaattcctgagccaccttgaaaatacggacagacaatggccgggcacagtggctcacgcctgcaatcccagcactttgggaggccgaggtgggaggatcacgaggtcaggaaatcaagaccagcctggccaacatggtgaaaccctgtctctcctaaaaatacaaaaattagctgggcgtggtggcgtgcgtctgtaatcccagctactcgggaggctgaagcaggagaatcgcttgaaccagggaggcggaggttgcagtgagccgagatcacgccacagcactccagcctgggtgacagagcgagactccgtctcaaaaaaaaagagaaaatatggacagacagcaggacccccttgggaccagccattcttgcagctcctccccaaagtcttccatccactggacccgcagagctgaccaggatccctgccagcggaatgtggctataggctctctcctgtcttagacagcaaatcttgagatggagataatcctgggttaccccaggtgggccctaaatgcaatcacatgcatccttataagaaggagatttgacacagaggaggggaaagcagtgtgaccacaaaggcggagactggagacgtggccacaagccgcggagtgtcagtggccactgcaggggatgtgcctcttgtggtcttggctctgggtccagcctaccttaaggtgtgtatttatcttccactataaaaactacaaacagctatttatttccaggcaagagttttaagaagaaccaaaatgcccccaaatctcactccactattgacggtttaaaaagtgaccacgtacgtgtggtgaaaaggttacaatagtgccagaaaaagcagcgtctgagcacccagggtcccatgcgccctgcttccctcgaaggtcactcttagcagctggtgcacatttccagagcacagctgggcctctccacaggcgcacctcagaggacctgcagccgtggttccagaccactacggtagagatacggcaataaagcgagtcacacaaatttcgtggtttcccagtgcatatggaagttatgtttacaggctgggcaccgtggctcccacctgtaatcccagcactttaggaggctgaggcaggcagatctcttgaggtcaggagttcgagaccagcttagccaacatggtgaaaccccatctctactaaaaatacaaaaaaattagctgggcgtggtggcacacgcctgtaatcccagctactcaggaggctgaggcaggagaatcacttgaacccgggagacggaggttgcagtgagccgagattgcgccactgcattccagcctgggaaacagcccgagactccgtctcaaaaaaaaaaaaaaaaaaagttatgtttataccatgccatagcttactaagtgtgcagtagcattatgtctaaaaaacagtaaaacactgcacgtactttcacttacaaatacttaattgctaaaaaaatactaacaatcacctgagccttctgcgagttgcaatctttgtgctggtagggggtctcacctcgatgctggtggccactgctgatgaggtggggctgctgaaggctggggctgtggcgattttttttttttttttgagacggagtctcgctctgttgcccaggctggagtgcagtggtgcgatctcagctcactgcaagctccacctccctggttcctgccattctcctgcctcagcctcccaggtagctgggactacaggcacccaccaccacgcctggctaattttttgtatttttagtagagacggggtttcaccgtgttagccaggatggtctcgatctcctgacttcgtgatcctcccgccttggcctcccaaagtgctgggattacaggcgtgagccactgcgcccggctgtggtgatttcttaaaataaggcaagaatgaggtttgccgcatcgattcactcttcctttcacgaaagatttctctgcagcatgcgattctgttggatagcgttttacccagtggacctcctttcagcatcgcagtcagtcctctcaaatgctgccactgctgtatcaactaagtttatataatgttctcattccttgtcatttcaacacagttcacaacatctttgcctggagtagattctgtcgaccaaaaaaaaaaaaaaagaaaccacacacatgtcaaatgtatttgggaattagaagaaaggattataaccagagatgaaccactgtggccagagggtgggggactctcgagagatgagccagtgtggcgagccacccatgtgccggagagggaggggcagggaagctctccctggctgagaagttcacataagctgcttggaaacagagttcactggctctgaggctgaaaaccagagttggcagccgttcactggttgagatgccgctgctgggccagtgttcttcctagagcatcttgtctgaattgctgcattcctgataaggaattccttgtggggttattttagaatgtctttgacactgtcctcatctcagccatgcaggcgtgagccctgccgccgtgtactctctggcctcggttggtttggacctgacagaagtgaccttaccctgctgtctgcagtgttcaccgtccatcccaagaaaccacttactttgctcatccataaatgctgctcctcacctgttagagttttatcctgagatggcagcagttcagtcccgtcttcaggctccacgttaggatggccaactttttttttttgttgttgttgagatagggacttgctctcttgcccaggctggagtgcagttgtgtgatcttggctcactgcagcctcgacctgccaggttcaagcgatcctcccaccttagcctcctgagtaactgggactacaggtgtgcaccaccatatctggctaattttttgttttaagtaaaggcagggttttgccatgtttcccaggctgggcttgaactcctgggctcaggcgatccacctgcttcagcctccaaggtgttgtgagcctctgcgccaggccagggcggctgacatgttagcaaatggcaaatcagcgtagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcgggggtaggagggggtttatttgggggcgacgaagaggtgtggagttagataggggcagtggtcgcacagcactgtgtgtgcaggcgctactgaagtgcacgctttaacatggctaacatggtgaacttcaggatatgtctatttcagcaccgcaaaacaaaacaaaggcatagagaacggaaatccagccaggcgaggttcagtctgacgtacaggctcatgccccgagccgggctgagtccccgccctgggaggttggaggctgaggtccctggccctacccatactcccagcgcctcaggttgcccagggcccaaccaggaggtcaggaaggtaacccccaggacaggtgatacccgccaggggccaggtaagagtcatgaaaaggaaagaacacagcctccctgcgagctcgctcagggccccgagtcaagccccaaccgctcccctccttcaggccccaccgtctgacaagcgggcttgcctgtctgtcctacagagggtaaactgaggctgtggggctgatgcagcactggggcctggcctgctggcccagagtcctgagtgcctggcctacagcatgggggtcccctctgccccgttccctccacgcccggccctcctgggcgcgcccctcgccgcctgcccctcgccaactgccttgtctttccctccgcagtcggcctggagattctacgccaccaacctctcgcgcacagacctgcactccacgtggcagtactacgagcgaacggtcaccgtgcccatgtacaggtaccgccgccgggcacctgccaccaagcaactgtttcattttttattttccatttgttcttaaaccccactttttgttgttcattattttgattgattttttttctttaaaatgtatttttcacaaaggagttctgtgtgtggtttatttcgaggcgttgcttctgccctttgtgttagagctgcggctttctcttcactttcatttcctcacccctttgctttatcgtcctggccgtgggtcgtgctgtgttttgtgcgttgcaaggacgctccccagggagctcaaggtaaatgccccccgccccgggctgctctggaccgacagctgctccccgggctgctctggaccggcagctcgaggtgcccaagcttcaagagtggaaccagtaccatgaccccgtcccccatcaaggacctagggctccggcgtggggggcaggaaagtaaccccggatcacagtgagactttcagaccaggaaactcaaattatcctgggggtcccaggtgttccccaacaggacagagcacacagacaaccttggagcccctcgggcagcagagaagggggcctagaaagtgcctgtcgaggcagtgctagcaggtcctgtgagcctgtgtggtcggagggcggctttcccgtgtttttttgttttacaaaagggcaggtggcagccagctgggattttcgttgcctggctcttgcttaaattaaggtctgagatgaggggttctgagggcctttctcctggtccacgcgggcctgacccctcgagtccgtctgtgtgggcaccaccttgcccgcccgccctctgctctgaggtggggaactgagccccgggacttcccagctcccgcgccccccgtcacctgctcctagggggtttctgtcccctggagccttccctaagggtggggccttccctgtgggtggagccttccctgagggtggatccttccctgggggtggggccttcccagagggtggagccttccctgagggtggggccttccctgagggtggggccttccctgagggtggagccttccctgtgggtggagccttccctgagggtggagccttccctgagggtggggccttcccagagggtggggccttccctgagggtggggccttctctgtgggtggatccttccctgagggtggggccttcccagagggtggagccttccctgtgggtggagccttccctgtgggtggatccttccctgagggtggagccttccctgagggtggggccttcccagagggtggagccttccctgtgggtggatccttccctgagggtggagccttcccagagggtggagccttccctgtgggtggagccttccctgtgggtggatccttccctgagggtggggccttccctgagggtggggccttccctgtgggtggggccttcccagagggtggagccttccctgtgggtggatccttccctgagggtggagccttcccagagggtggagccttctctgtgggtggagccttccctgagggtggggacttcccagaggctggggccttccctgtgggtggatccttccctgtgggtggagccttccctgtgggtggatccttcccagagggtggagccttccctgtgggtgtggccttccctgagggtggggccttccctgtgggtggatccttccctgagggtggggccttccctgagggtggggccttccctgtgggtggggccttccctgtgggtggagtcttccctgtgggtggatccttccctgagggtggagccttccctgtggatggggccttccctgagggtggggccttccctgcgggtggggccttccctgtgggtggatcctaccctgagggtggagccttccctgagggtggggccttccctgagggtggggccttccctgtgggcggggctttccctgagggtggggccttccctgagggtggggcaggtgcacagtgtggctgggaattctaagctggggtggggcccaggattcttcttgaggatcctgagttggccagggtggacagacccgcggcagtcctcagttgctacctgccttttcagggtgtcacttgggaggaggatgccagagcccttggcggtcctcgatgtttgcagtcgccctctggggtctgccccaacccctccctcagcaccatcccccctgcacctcctggaagcccgaccttaggagcctggccctgcttgtctttcctgggaatgtcggccatgcccttgtttctgcaaagtgacctctctcagcccagggcagggacagaaccagcccttgtgctaattttctttgttctgttgtttcccctactttcctcaactatttgtttcattttctttttcttatcccgttctttttgaaattttccgttcttttccctttgtgtgtgtggaaacacttgaaagttcgcaaactcaaacctacggggcctccaggtaggaaatgcatggacagaagccctgtgtgtgtgtgtggttctagttctgtgtctggaactgtgaccgggcaagcccctggagccccgtggcccacccggtctgcagagtgaccactgtccctgcccaccgagcatccctatgccccctgccctgcgtggccccatgctgggcggccagatcaccctgggccctcccctgcctggagcccacgtgccaaccctgccctcccagggcccatccacccttctcgtcctgcctccccccagccgctgcttcctgttgccagcccgcctgtgtcccccgtggtctcgttctgtcctgcttctggcctggctcccctcgtgcctccatccccaccccacaggccccatctgtgagcagagcaggaatgatggatggggggcttcccctgccctggcgctgggcacccatctggggccaagggtgctcccaggccaggacccccagaccagccacagtccttgtcccaccgtggctcacagggcagcctctgcgggccagctagcctcaggggtctgcctcagggtctcctgccctggactcaagtttctcctgagtcttgccctggcatcacaggggaaccccagggctccaggccgtcccacccctgtccccactgctgagagcaggaaacaaggctgtttgttcagactggagagcgctgagctgctatgggaagcctcacccccatacagcacaaagggcctttacctgtcgggtgggcaggcttgtgctctgtgatgacactgccctgcagagcctggggccagccactccccacatagaccagaagggcttcctgcacagaagcccttgatgactcctccaggggccagtcacccgtcctggaggagagacctggctgcccttcctgggaactgttagaatgttgactctccattcccagaaaggaagtgggtgcagtgctgggcagtggtgggtccagggctcctctgcccccgacatgctcagccataagacatctccaatgtctgcagaggccctgctgcccctggggccaggaggctggcgctgaagccggctgcctcctccccagcctctgctctctcccagggccgccccctccccttgttgcaccctcgtcccacagctccgtcctgccctggccctgccgcccgcctgtctgccctggcgctgctgctctgtgtgttcgaggcatggcctcctatgtggctctgagggctgacgtgtgtgtctctcacctgggcctgcgtgcgtgtgggtcccatcaaggaggggtggggagccacctgtggcccccagacagactccggccaggctgggctctgctgcgcccacaacaccagctcaccagctgcctggttcctgctccatcccgacttggacagcggactgtcctctgcagggagggggctcacaggagccccactcctgccagcattttgggggcacctctggggctgcagagggaacaaagaggggccaggcacggctttaccagctcacacctgcctagcctgtgggggggcaccagaggctggtggggtgcagggaggggcttctggacagctctggagggaggagtgtggctggacgaagtgggagtcggcagtagggtgatcaccaagccctgagggacaatggagtcagccatccttttgctttggaggcagtggggagccattgagtgtttggtcaggagagtggcaaggatgcccatctggaggaccaagtaagcctgggtgggcagaggcagggcaggtgaagagtctggaggatgtgggccacggcccagcctggggcagagggaggacacgggcaggggcatctccagggggtggccgtggccatagccgcgtagggagtcagctgggtgagggctgggctgggaggtggccgtcctgcctccaacgcagaggagagaccaggacgtggccccagtggggagtgctccacaggtgggtgtggggaggggtggaggccgtggatgggatggcagggcctgggagcagaggctgaggaggcggagtggagggggttcaggtgggtcagggagccgggtgggggaggccccagaggagggtgtctcttcctgaagcgagctggaatgctgtgagggcatgggtggtgaggaggagtgggcagagtgaggtgggtgggagtggggaggggtgaagagggggacgtcccacccagacgtgaggaggtgcctgcatacctgcctggggggcttcggcgggcccggacttggtcctgctggtggctgtgggcggcagggcaggaagacaggggtgggtatgaccaggactgggaagggggctcggagcagagctgggccacctgcggaggattcccaaggcatctgggcctgatgaggctgggctcatcctatagactccagaatgagctgctctttgccaagcagaatccttttctgtatccccacctcccaactcctccagctttggcagagaaagtggctgtgtagagaggggccggggccctaaatatattcgcgtgctgtccctctaggatgttcagggattagaagggggagtagcgcctccccctacctgcgcgccctcctccacctgctccaggctgcagggtcggggctgcatgggtggccaggcgccctcttccctcctccctgctgtccctgctggttgacaaggccccaggcacagccagagaatgaagatggctcccaggcctgcccaagagaggtgggcctgagcccagggcccagtgggcagctgcctgaaagcctggccacgtcacatgccgccgggtgtctgacactgcaggcgcctgcccatggagctgtgcaagcagagggaggtgtcccaggactcgggagggtgagacgctcactcccctctccttctcttgccccagacttatccccccgctgaaccagctggagctgctgaggaacctcaagagtaaatctggactcgctttcaggtcagctggggagctccaggtggggcgggtgggcgtctcagtcctcctgggggccccagctgcccacagaagacacgccaggacagtgccccagggactccagggagctgggacgcgcggggacgctggacttggtgatggtggtgctttctcttttcgcgtctgctgacctggtctgggctcccacccccagaggggcagctggttcgggggacgggcagagagggaggggcgaaggttgatatggggccgggggctctgcatggctcctaatggggcccaggcgcgtgggtcgtacgacaaagtgtcccagcccgtcgtcctctcgagtgcctggtggtaactcaggtgctgatggcgcctgctgcctctccttcaggcccaaagcccacggctgtcagagtgccggctgtcgaggtaggttgcagaagggcctgctgagcaggagaggtggaaggcgaatgcacctgccaggcctgcccaggcccagagccgtccccaagcagttccatgtctgaaagcccttggtggggcaggggcttccagtgggttggatgctggtttctgcctcctagagacactcttctgctctggaacctatcaggacgatctcagatcatcctggattttccgggcgggccctgagtccaacaacgagtgtccttacaaggagagggagatttggaagcacacagaggtgatagccagctaggatggagagagagactgaagtgatgcggccacaagccaagggctgcctggagccacagaagctggaagaggcagaaaggacccttccctggagctttcggagggagcaggccccgcccgcaccttgattttggactctggcgtctaggactgtgaaagaacaaacatctgttgttacacactccagcggcacttagttacaggagccgttgcacatgaatccagactttaataccgggagccgcgtgcggctgtggcaaacgcctacaagcgcgggtgtgacatcagaaccgggtgagccaagggctcgtttcctagaatcacaggttcatgcgtggaggactccagccccaggctgatgcacacctgcaatcacacacacctgatttaaatgattctgatgactttattattttatttattattattattttgagatggagtcttgctctttcgcccaggctggaatgcagtggtgcgatcttggctcactgcaacctccacttcccgggtacaagtgattctcctgcctcagcctcctgagtagctgggattacagacacctgctactacgcccggctaagttttgttatttttggtagagatggggtttcaccatgttggccaggctggtctgaagctcctgacctcaagggctctgcccgtctcggcctcccaaagtgctgggattacaggcgtgagccactgtgcccggcctctgatgacttcagatgatgaaatttgggactttttgaactgatgggatttggatgagattttggacgtgagtattttgaggtgcaggctggaagaaactgaggtgtcctgaagagatggtgggtggggacacggatgttgaaggtgcttctggtgcgggctcaggaggaagtgaggatgcaggtgttggaagctggagggaaggctgtccttgtgttgttggtggcagagactccactgggctgtgcgctactgttgggcagaggcagaatttttaagtgatgaactgggatatttagccaagaagatttccaagcaaagtgtggaaggtgcagcctaatttatttctgctgctcatagtaaagtatgagaggaaacagggagattcagagcagcacctggccgatccgccaaaagactattaaaaaaaaaaaaaaaggcattcagggcagaactgctgtaagaaaccagaacttgaaggtttgggaggtgctcagcctgtccagcttgcaaagggtcttaaattaggagattcactgttggcaaagcctgctttggagagaagcccacaggtgtggccagacagcctcatgctgaaggcaccaggtgtgcggctgcagcctccaccgtctccacagaggcctgaagatggagctatcgggaaggatgtgcagaggggcctcttgtctaacggcgttgcggcctgtggcatattcaggaggccctagaggttttggggagtttcataccagcagaaactagattggcagagacagcgttggacgaaggtaagagggcatcgaacttcgggagtctgcaggcaggaaacaggccggtggcgctcctcagctgtgaacacgagctgccctttaggaaacggggaacgatcccgaggctcccgcagaggccggcggggctgagagcccccgaggagcgtccccagagctgtgccacgtggagtttgccccgccggattggaaacgtggtggccggcggcccctctgtcattctccctttttgagtgggaagagctgtcctgctgttgatactttaagcagatggcttgttttctagttcacaagcccatgcatggaggactttagccccaggttggcgcacacccacggtctcacacatacctgatttaagtgattgtcatgacttcagaggatgggatttgggacgttttgaatgggtgggatttcttttttttttctctgagacggagtctccctgcgtcactcaggctggagtgcagtggcgcaatcacagcttactgcaacctctgcctcctgggttcaagtgattctcctccctcaacctcccgagtacctgggattacaggcacctgccaccacacccggctaatttttgtatttttagtagagacggggtttcaccatgttggtcaggctggtctcgaactcctgacctcaggtgatccacccgcctcggcctcccaaagtgctgggattacaggtgtgagccactgtgcctggccaacggatgggatttcgatgaggttttggacacacagtccatgctgcagagggtggagattttgggggatcttggcaggggtgagtgtattctcgatgtaagatggacatgaattttggggggtcgggggaatgcagtggttgaatgctggtctccaaaatgtcccagaatttgcaaatgtgacctgatttggagaaagggtccttgcagctgtaactgagcttgggatcttgagatgaggtcatcctggaacatcctgatgagcctggtgacagcttgagccctagcccggtgacagctgtccttacagaggtagaggaggagaagacacagagacacagagaatgtcgtgtagagacggaggcagagacggggcggtgcagccacaagccaaggacacctgggccaccgggagctgcaggaggtgatgagggaccctccccgagagcgtggaccatgttccacggcaacacggtccctgtcacatgaagtatttggaagtgcaccaaagagcctgcttgtaacacggcgtaccagccggggcaccagcccaggtgttcgaatgagatcgctggggcctccccatggatgagccaaatcacgatccgccgatctctcactcaatccataacgcctttacccgcggaaacagccccagatgagacgccggaaggcccagacagctttgcctgcaggacgaggccgggacagttggtcagcggtgcaaaccctgggctcactgactgtggcgcagtggagccacccctggaaagtcacgcggaagagaatcattccattaggatgagcgtggaaaaaagagtcggagcagctcactctgtctcgaaaattgattgtaaattaaactcccttccagagcttccttcagcaaacacgtgctttttggaactttattaatattggtgtggttctgattaaaatgagtgtctgtaaatgtggaggggtagagacccccaggtcagaagagcagaggcccccgccccatggagtccctcttccctctcggagctgcctccgtgggccctggggtgcccgttcctggggccgtgggctctctggggtgggtgggccagctccacccctgcccagccttttctgagacccccctcccctgcagcccctgacccatgggactgtggggggctggactggttgggggaccctcatgggtgctgagtgggcggccactaactctctgttgcttctgtttgaaggaaggaccccccgccggagccgtctccaaggtcagtgccccctgctgctaccctggtgtctgccgtgtgcacggccgtctggtctctctcccacacgtgtgcgcaacctgtcatggagatgtgagggccttgtgtgtgcttccgtgtgtgactgtgtgactgcgggtccagacccccgcctggcggtgatgtgggcccttaaatcactcttcctgctcaccccctccccagtgattcggttttactttgcagcactgtggatccgggcagctgggcggcttctcgggggtgggggatcccccaccccgcccacaagtctggccccagggttctcggaggcagggggtctctgttagtgcgctccctccagctgcaggcacatagcccgagctcacagctggcctgagtcgacgccggctggggtgaaagctccaagtgggcctctggccttcccgctgctctgggtccagagtgtctggagcatgtggcacagaccagggcccctcgtcctccgaggagggtgggacatcctctctgtctcacgcccctgggtggagattctggctggcctcctctccctgtttgccaaggtcaaagtgggccaagggtgcaggtgcttagcctggttccctctcccgggccccgaggttctgtgggtcgggcagattggagacaggactcgtgtaagggctctgctggggtgaaggatggagacagagaaaatcaagatcctttcacaagttaattctacgtctgctgagccccagcccccgacacatcaccctgaggaggtgctaggcttctctgggccccctgtgccccatccacatgttgcagagtaaatctggccccttggacctggggtccgagatggacgcctggctgcccctcctggactgcgggtgacagctggcgagacactgcggggcttgggtgcggggagatggagtggggctgagctgcatttttccagccaccccacatcccacagaaggggagtcatggtcagtgccttgagctggaaagacgggcaatgcttccggcccacaccaaccaagaaaaccaccaggggctcattcatcctctcaaagaggctaagaaaacggacgagggcccagaaagagctgggtcggcagcgtagcctctgctggtgccagcccccagtgctgccactgcctcccccgcccctgctgctggccctgaggctgggagtggctgtggggatgagcactgtgccccccacaatgggcacccttggctgtgatttgggcggaacctcggtgctgtcccaggtggacgcgaggcttcccgacggcttccgcgtggcagggccccacgcccttgctgggagcgacgccggaacccgccccgtgcctcacggcccctcgtgctcgctgccccagcccggcccgctccacgttctcgtctcagcctctctctttctctctctccctcccaccctccactccacccatctggacacccgctgcccccaagtgctttaatccctgttactgcccttctcgggcccctctctcgtctgccctctctttggggatgaggtgctggccctgaaggcgaactccaggtgaggacacgcgggagcctccgggctctccggtaagctctgtggctccccacccctcccccgtctcttccccatgtgtccggggggtccttgcctgtgcctcccacgccctcccccacgggcgagcacccacccgccccggccctcctcctgggacgcctgtggtgggggacgtggggctgctgggtctggggcttctggaaggtgcctggggtgcggtgggagtgaggagcagtctctgcccttgaagaccctccccgcccatcctggggtgctcacctggcaggtcacggggtggcatctctgttccctggcctggggcagccgcagcctgtccagtgtagggtcgtgcttaggaagttgttccgcaatcattgcctgccacgtccctgggctgctgggtgaggggcctgctctgcgaagcttgatggggagctcggctcctggcgcccctctgctgcctgacctgggctctgtgagtctggtgggacctgtgcctccgcctgccctttggaggtggagcccgcaccccgcatggcaggaccccgctggtgtcagctggtcttggcaggtggatggtgtggacacagggaccctcactcactgctgagacccccacccccatcctggctcagaacacaggcacgtggtggcaggcgacccggctggcgggggctcggttcccgtagggaccactggggctgtgctggagtcagaggaagcgtctacgttggggtcgggtggggagccaggcaggctgcggggctcgggccgtgctgccccaggggggtcccggggggtctctttggccacggcggttctgacttgtgctgtcttgtccgacaccccatctcactgcctcctgcccccgtgctggaggaggagcccccaacaccggctgccccctcatgcctgtgcgggctcccccgtgcctgttcgggctccccctcctcttctcaagcacacgtgtccgcgtgtttttggtgcatgtctgtcctgtcgggtctcggtcagtgtctgtgggtctcgagctcactgtgggcctgtccgcctgtccgacctcgggtcacagggccttctcacgcagtgtggagctccctgtggctgatggggcaggaaggaagcccagtgccagctgcggaccccagggggaggtgcagctgcacgggtcccccacaaagctttgggggtcttggggggctgtgcctgcagcgcctccctgccagctctccccggctctcagaccacgttgccccatacaggagctgccagccacatgtggctgttaaaataacatggattataacgggcacggttagagattcactctcgagtctcaggtgcctggtggcgacagccggagcttcagtgtggctacaggacgatcccattgcagaatcgggcggcagggccggcccgggaggggcctcttggtcaaggcgatcatgctggggtcaaaacaggagaccttgggaggtttggggaagcgggaccctgcctccttcatgctctttccctggggtggggaaggtctcctggggccctccaggcaggggctctgtgcttgggcctgggtggtgctggtgggagtctgaggtctttgcctgccaggaaggcctgggtgtcatcgtagctggggtggtcacagcgggagagactctgagcagccagaacctcaagccaggcgcagggagccggctccctcctgcctcgtcccaccgtcgcgttcgtggttaaccagcaaacagagtccagcctttgcactacatcccttcgtgcctggggaccccaaagtcgcttgtgtactaaaaagccggaccggcacgggggctggggtggaagccggccacccgcccttggagtcttgcaggctggtggggcttggggaagggtccagagccctcagcctacccgggcggctgagtgctgccgtgactggagctagccgtgtctgtgacgccgctcggagagctgcctgcgggtgcgtgcagggacatcggtgtctaaacacacgtgtgcgcaggaagacgggaggctgggtgctttcttcctagagcctgtgtgttctgagtggatgccgtcgccacgctggggttcctggggcaccgagtttgagaagtgctgtctcaggaagcagtggcaaggaggttgggggtggctggggtggggaaaaggaagagttcttgagttcttggtgattggtttcattttttgcttaatcatttgcacattgtgatgcagagctaaatcgccagggtttttggggagattcttgggaaaacgttccgtgttttctgagccttttctaaggaacgccccggcggggagctgcgctcctgaagggcttcacaatgaggggatccactgagccccaacgtgactgtcctcaggggagcccttgaacccccagatagccatgcctgcagtggcagccacgcctcctgggtaaaccgagacccacctccaactgggggactggctggcatggccaaacgtcgccgattggtttgcaaagcgggacaactgcacgttttcctctctcaaatgtgtgtgcttcacacccacgccctttcccggggtcacgtccttcccaagcagggcttctgcggcgtctgaggccacatgtattattgttttgtcagcatgaatactgcaaaaaataatacatcttttaagacatgaacccaaactgtggctttggaaggaaaaggtatttttggaggaaaaaaaaaacagggatttttttccttcagaaatagggaagtgttttcttctccggacggtggagacgatggtgcaccttcctcgctggccttgcttgggcgcaagctctgccgctggggactgcacacaacaccctgggtggttgcagtgcctcagtttccctgctcccggccgtgtgctgttgccggcgcccaggactaactgtgctctcctcatttccagtaaaggcagcccgtgcagagggcccctgtgtggatgctgccccggacgctctaggtaccgcggaacacgccgcacggactgacggctgctgcacggctcctctgcccctccctgcttactagaggttctggaggagccagggggaggctggcgccccaaccccaattctgacccaccgccctggcggtgcgggctcagctccctctattctagccgacagctgcgtgcagggcggagctgggggaaggtgcttcttcttgctccccacgccaggcgatgtcctgcgcacagccagaggggccagccaggggctctgaacccagcaaggcgtccgtgcctcctggggtccccgactgctcttcagggagcgtttcccctggggctgtcactctagcacctctgctgcgtacctgaggatgactgagccttcctggctgcctcgaccgcgggaggcagctccgtctgtgtgtgccgggctcctcagggtcctgatgcatcagaagccccagaaagccagaggcccgcggctccctctcccaacaacaggcctggtttagggcaggtggaaataggacgggggaggagccgccccctttgcaccgtgggctcctggcctgcaccgtgacccgcacctcccctgtccccgcgtcccctgtctgctgttgggtgtgtgcaggcctgcgctgggggcccctccctcctggccagcacagcccagcaaggtggaggtggctgtgtcgtgctcctgtggggctctccttggcatgtgcatgccgccggtggtgctggccttggagggctggtggggctgcatgctgcctatctgcatccgtgcatgcttcggaccctgctccatggggggcccgcgactccatgccaccctctccctgtgactttgctgcttgtgtgcttctgggggcgttggtgcttgcggggagactgttggcagctccagagagggagacgggcgtgtgggctgcctggggcatggcctgctggggcgctagcagctgtcctgcgtgtccggagcatctattcagggtgcttctggccgcaggctggtccctcagggcaggggctgaggtcaggctgcttggggaccagaggggtttgaaagtgggggtgggagcccaggccagagaacaacccagggcaggccctgtcctgctgcgagcagcccccacgggaggccccttcatcctcacgcttcctgggcgtcgttggtccggacaccagctgggcaggggtctggatgctcctcagcctcctgtttcctgcgggcaccgcacatctgaatttcaccattgggagggagggtggcaggccgggtggggatggcgcgctctcaggtgcttcttgagcctgccccggccccgtaagccccaagcgtaggtgccacggacgcccctcgcacacagagggcagctctggccgagggctcctcccaggtgggtggcggcagcttttcgcgtgcgcttgttcttggcttgtggccgagggagggcctgcgagaccacgcgtgctcctggcagctgaggcaggctggcggggtcgggtgtctgcagcatggagcctcaccagctgtgcttggagggtgcagagtttgggtcatggtggaggtccaggggagggaaggacatgtccaggtcgcgccaccctcctcttcctggcagagcctccctcgcagatctgaggtgggagcggagcccgagacccgggacagcagggccgcgccgaggccagggcaggctccttcccgccggctctgtctggggcagtacacgtgggctgcgtcccggcggcccctggggctgtgctgggcatcgggtccagcagggtgtgtctgccgctggcggggctgtggctccttgtcgtggtcagcggggggtcccccctgaaaaatgggaagcagacgtcggggctgggtcttctctcctggggcctgtggaatccacgccactcccttcctgcaactccctgcggactgtggggcctgacccttcctggcccgcacgtctgtgtggccgcctgggtatttgacccgttcccctccggggccgcaggtgggaatctgatgcccattcctcaagctgtgcctttcccactgcaagccctcagcaccgggctctgcccagagaccagccaagggcagccccgaagctacagttgggccgaccggctctgtcctccacccggtgctttgccagctgccgtgagaaaggaggtggctgcttctctctctggtgactggacctgcctcgggtggaaacgcagagagaggaattgagtcttccagtgactcccacttgccctgaggcctgcctgagcggggtcaggaggggcctattcttgcctttgaaatggctcgtgcggtggagaaagagagaacattccaggagtcccgctgagcctgtgcccatgtgctcccctggcccccgtccggttctccccgaccacctgtgcttttgttgttgggatggggaccagaggccgttgggacagaggcacccacagcaccaggactctgagcacccctggcccccatgggcacggtgtgttggcctcaggcagtgcaggggtgtggactcaggactggggtcctgagcgagcctgtaccatcggctcctgacgtccccaagcacgcgacgcctcgggactcgggggatctcggccactccgtctctgcttccccgagcgggcacaacacccaggggcttctttctttctctcagagacgcctgagtggggacagatggtctgctgagtgggcacagatggtctgggcggtcacctgctgcctgggggatggggtggggaggggcagccaagcgatccgcgtgtccaggccaggcagacgggcgcggtgggctctcatgtctgtggctggttatctctgtgccgtctggtgggcgtgtctctctggctgtgggtctggagtcggggctgatggtggctgctgaccggggcctcagtccctcgctgttggctggggagccgccgtgggatcagggagcccgtgaggcactgggcttcctctctgaagtgtgtcagggatctgcggggcctccccacccgaaggcttgtttcaggctccagcaacagtgctctgggccctgcccagaaccaccctgagaagttccgtggctgctaagcatggctgggcatgagcgggtccccagttcgtgagagccccactgtcctcaagggagccagggggttctgatgctttccagacctcaggaggccacatctgcctggcgtctcccaaccaccaaccacagtgaaccctcccctcccctcactgtcgcccggcggacgctggagttgaagaactcgggtgcaaacccatctccacggtcaccaaaaaactcgggggcaaggcaggcccaaggaccccccgagagtatggagctggagacccagccagacacagctgcaaatcctgcttcacgcctcgcaggccgagggggccgggccacagcgctgtggctttggaggctgcctccccctgccctggggcaggacttggatagtgaggcccagctggcggaggagccccgttatccattccttccttccagaagccggaaggagcagttctctgacacggacctggtgggaggggagcctgacaggggaggcctgagccctcctgaagcccatcccaccaggcaggcccccggggtgggtggaaaggccggagtgtggctgaacaagggtccaccgcagacttggcccccaatgtccttgttgtcccctggcccctcgactctggggcagaaggagagggacaggccgtgggaggggaggagggaggctgcttcctgggagcagttacgggtgtgaaaaggccacaggggaaaccacgggcggggccggggcagacagaggtgcccgaggaagagccacagccccggtgtttgggatgcccgttgccctgagtgtcactgggtgaggggctggcaggacagtgtgaggaaggctccggcacctcgtggtggtagcggaaagtgatttaagagtccacagacatcaactctccccacatggccaacctctggccacgcctgagccagccgggggagcttgctgcccacccagcctcccctccctccctcccgccgggtgctcagtgtctgtggcctcccctccctccctcccgccgggtgctcggtccccgtggcctcccctccctccctcccgccgggtgctcggtccccgtggcctcccctccctccctcccgccgggtgctcggccccggtagcctccccccctccctcccgccgggtgctcggtccccgtggcctcccctccctccctcccaccgggtgctcggtccccgtggcctcccctccctccctcccgccgggtgctcggtccccgtggcacctgctctgagccacccgtgtggctggctgttcttcagacctgtgtctccctccggcgcatgggcggcgtcggccatgagcagacacggcctgtgttctttgcagagtgacttctctccctgtttttctgtctgtctgtcggttcccgtgggagcagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaaggtgggtgtggccgcatcctctcctggtccatcctctccggggatggatgtggtggccacgctactgtggccaccctgtggcgtcgcagctgcttttgcttgctcttggagtgggaaccccctatcctttctaaaattgaggtgagacttgtgcaacctaaaattaactatttaaaagtgtaggaattcagtggcatgtagcacgctcacggtggagttgtcaccaccacctcagcctagttccagaacattctcatcaccacagaaggaaaccatgaccccatcagtagtcaccccattccccgcctcagccccagcacccgctgctcttgggccgtgcgtgtctgcggctcccacgtggggccgttgggtctggcttccttcactgagcctcagatgtcaggcctgcaccttccgccgttaacatctgtgcgtggatgcgccatgttctgttcatccattggccagaatgtcctttgacgccccatatcggccactccctgtggccacagcctgccggggaaggtcctgactcgagagcagctgggtgcagatgggtgggtttccagaaaagcaggtgcacccgaggggcaccacagggagcctcgaggggctccctggcgctctgtctagccggtgtgccctgcaggaccccgggaataggtctcccggccccctcggcccctcacggcctgtctccttccccccagaagcaagcctccccggagaggacattgtggatgacaagagctgcccctgcgagtttgtgaccgaggacctgaccccgggcctcaaagtcagcatcagagccgtgtggtgaggcccctgcccagccgggagcctgggggagtgaggaggggcctcccgctcggtggtcctgcctgctgccggtgctcatggtgctggacagagccgcccagagacagagtctactgggaaaagaaagggctaagacacgggtggacctggctgaatgtcctggagtgcactcctctgggactcaggcgggtttcgggtgggatgccggttcagcaagaggcctgaggccgggctccacctggcttaggaagcaactcagccaccttctgcctgctgtggcatggagtccaagggggcatggccaggcctgcaagccccacctgtcccgggcagagcagggccacataaaggcccttctgtgtgtggagctggtgggcggcagacaagaggggcaagtccagccatctccaggcgccgaggtctcagaggtgctaggaaggtcctggtgcctgtggccgggggtctctggcccagggctcacagccccacccacccccctgcagtgtcatgcggttcctggtgtccaagcggaagttcaaggagagcctgcggccctacgacgtgatggacgtcatcgagcagtactcagccggccacctggacatgctgtcccgaattaagagcctgcagtccaggcaagagccccgcctgcctgtccagcaggggacaagaacggggtgggcttctgggacaaagcccactgtggcccatggtgggagtgcagggggtgtgtgggcggggcctcctccccacccacgtcggcctctgtcagcttctgttgtgtcttcacaaagtctgttttaatatttctgctgtctctcccatctctcccccatccacaccgcggtgggcaagtgcgtgcacctgtgtgtgtgggtccctgaaaatgtgtgtgtgcatgtgtgtgtgtgtaagtcacgcatgcacacatgtatgcttctgcacaggtgtatgtgtgtggttgtatgcacgtgtggctctgctctgccatgtatgcacgtgtgtggggtgcatacatgtgtgtacacatgtgtgcatgtgtgttggggatggaataattctgttcagacatgaagctgcagggttcccgtgggccccaccaggcatcagttatgctacttggcaccttttcttctacctgccctccttggcataggtgtcccctaagtccacacacgtgcccacacatgtgcagcctcaggcacatacaaacaaggatatacacacgagtgggtgtttatgttgcctgtaatggggacacacggctgttgagagtctctcctgcagtaggggacatgctcctgcctatcagggtcccctccctctcccaggccccccaaccaaggctgtaccagtttctcagccctggaagcgaggctgggcccctgttacagggagaaggctgggatggtcagggacagcctgggggtcacagcccaactccgggccctccagtgggagtgaagctctcatctgaggaagtcgagagccccaccctggggctcctgcccagtcctgcttcagggggccagggaaggggcgcctccaggccttagcccactcctgctgtgcaggggccactgagccatccccttcaccccgctgggctccagctgtgaggcctctttcccagcgtcctctctggagcagcggccaaccctggctgcgtgtgcgtgtgcgtgtgtgtgcggaacgccctcctgtcttgacttctgtgctttgtctccacatctctctcacttcagctgtttttgttcaccaggatctcttgtcctaaattttccctttccttccctctctctctggaaaaacaaacaaaacaaagcaaacaccccaaggaccccaggagtcctcggccggctcctgacaatgcgtttcccgttgccccgccgcggcctgtctggtaccggctcctgctgcgggcacctcccctgcactccacgctctgggacgtggcacccgggtctccgcagtggggccgcccgccacccgctcccgagtcaaaagctttgcttgaaacacgggaaggacttggcaaatccaaggtccagcgaggcggcgtccacaccctctgtgggagagcacctgtttcgacggagcctccctgttgcttccgtttccgccagttcctggccagctcctcatttcctgtggctttacgatgcgtttcgccggtgtctcttttcttgtttactctgccaggatagatatgattgtgggtcccccgcccccttcaactccccggcacaagaagtaccccaccaaaggacccacggcccctccgagagagtcaccccagtactcacctaggttaggatgccagcgcctctccgacgtgtctgtggaatggccggccccttcgctccaggccacatgacggcagcaccttgtaccaccctttccccgggacagaggggacactcgggttttctctgttcctgaaaaagccacaagagggagaaggcccttcctccaccagggccccaggcaggctgtgcccctatcaggactgccaggggccccactgctcctctcgacaagtgccctggggaagccgggggctctgtggatgccctgtgagatttccctctggggttgggaggcccccgggcagcacctccaggatcagatgccatcagacctgcacagacatccctctggccctgcccgtgccccctggacaggcccctcctggctgagggctctccagcctccccaggcactgacctgcccctcagcacctgcccactgtgggggtgggcctggccacgtgcacggcccagacctgggccctgggtggctccgagcaggtggagccgcatctctgtgtctcttccctctcgtggaagatacagacggtcacagcatctaccccttaagccaccgggaagaagcgtgagaagaggcctgccaggtgcccggcacaggcgtgcgctccagcagctccggtgctggctttcaagctgccagcatcctaattagtgtttttgataagggagctggcgagagccccggctgatgggcagaacagaggtgcggcccagctccacgtgagctggcagaagccagttctttagtgattaactcagactttccaaggccttcttgcctcccagggactattcagatgacggtggttccctgtcttctggcaagtctgattggctgagggagggtagagcccctggggcggaggcctggaggctgagcatagacccctggccttccctgacagctcagggcagacagtttctgggtacagccaatgccagtgtctgggcaaatgaagcccaggcctgagctggtggggacggcgtctggggtgagtctgacccctcctccctctgtggtggggtttctgcctgtgaggccaagtgtctgtgcactggacatgtcagccccgtgctcctcccgtgagaacggagtttctgggagcaggcagggccgtgtctgttactgcccaacccagggtagccccggacggagtttgccgggttccctgctctgtggtgtcccccatgcccaagagtgctgtgccctggggctggtcctccgtcctcctgtgccttgccgcaagagacagcagctgggcatccacagctgtgagctcggacggtcttgtggctaggagacgtgcaggttcacacagggggccagggagacagttggagcgcttgccccacctcacggggcactgagcactcagggatcaagtctcctccagccaggggcccagggcaggaggggcacagggtccttggaggagcccccagcagcagctccaggctgagcccgtggccagggctcctattgggactgagcaggcgggcggcccgtcatgtggcaggggcgaaggtgctgagcatctgcctggactgtgtggatgccccgaacaccagggactcccatctcctccatcgccactggcgtctgctcggagccagagggtcccctcccgccgtcccctcccgccctcctggccctattgcatgagtccagcatgaagccccgcggagcatgaggagctgcactgtggccgacgcgagcctgaaaccctctctgtttctcgcaacagaaagaagataacacccctggcccaccctcccccctcccatcagaggcaggtagggcagcccagtggcaggaagtcccgcccccatcagaggcaggtagggcagcccagtggcaggaagtcccgcccccatcagaggcaggtagggcagcccagtggcaggaagtcccgcccccatcagaggcaggtagggcagcccagtggcaggaagtcccgcccccatcagaggcaggtagggcagcccagtggcaggaagtccctcccccaccatcagaggcaggtagggcagcccagtggcaggaagtgaggacttggccccgtcggctggtgtggggcagtcttcatgtaccaggccccagtccaggggagacttgggagcttgtggcctctcctgggtgggtcctgctcagccacaccccgtcttgagctgcccttgtccagctgggcttttgtagacttactgcagggtctttgtttccaagtgagttcccacgtagctgcaggcctcagcgcacacccaccgtggtggcccctgccagcccagcagtggccgtgactctgtggataccagactggtcagaagcccccgtccctgagggcaaaggagcctccctcccttcttattgtcatgagtgacctgtggcctcattggagatcagctcagctgaattctgcatcctacacacacacatgcacacacgcaaacgtgcacactcttgcacacatgaacacatgcacacgcgtgcacacagaaacttgtgcaatgcacatgagggcacacacatgcacatcgagtgcacacacacgtgcacacacagaccctcgcagctttgtctcccctcttctggtttgtgcgttggttcctgtgctgctctgggccttctctccttgtcctggtgcatggagccgcagctctcacgccttttctgcttctgttgtccccgccgcagacatttaactccgtccccatcagacccggtggggccgacggcttcagtggcacattacgtaggagtaaagctccggggtgggcacgggtagggggaggggcatcctctggagtgggctccaggccctgcagtgggagaccctccgtgggctgtggggccaataggccttgggcagggaagagggtgagcaggtggggctggctggagggggcggtatggagccgggagcccacggagaggagccgggcgactcggccctggtgggagcgtccttactttactcctcgctaatgtgccaggccccttggggacagagcgggcaggagcagaacctcacggtgccagaagacgggctgagaacggggcgcaccccgtccatctgtcctggcacccactgccccctggtcggctctgggctgagcctgcagcctagacccaggggcactgtggcctggtccaggaggagagggcaggggccctgctgcacccacccgaactcatgctttggggtctctgttcccggtagagtggaccagatcgtggggcggggcccagcgatcacggacaaggaccgcaccaagggcccggccgaggcggagctgcccgaggaccccagcatgatgggacggctcgggaaggtggagaagcaggtgcgagaggctgggcgggaggggtgcggggctggagggctgtggtgcctgccgtcaacctgtggcagtgtgggcttcaggggctgggtgccacggagggctcctcaagtctagggtttacatggccctgtcaccactgacagctgctctgtgcagacccctcacaccccaccgtgagcctcccacccccggcctgggtgccttccctcctgacagtacccaagggccaaagtccccaggagtcctgggtgggggctgctgagaggtggatccctcaggggttccttgtggaacgtgccggaagttgtacctgcctggccttcctcctctctgtcctccttgcccgacaccctggccgctgtcttctgggggtgcattctcaggaaccaccgcagaggacccttgttttggggcctgcttctgagagccgggcctgagcagtgagtaaggaactgccaggtcctgccctgtggggctttcctgaagggggttccacggtgggcagcaggagggcctggctctgaacacacgccccaaccgtggagctggaggctttgcccctaggggtctgggaaggaggaagagctgctcctgggcctcctcttcccgctcctccagcttccagggagcagggatcccccctccctgtacctctccagggagcaacccaggtccccccacctcctgggaccagcccaagtcgaccgacttcctgggagtggtccaggtccccccatctcctaggaccagcctgggtcccccccatttcctgggactagcctgggtcccccatttcctgggactagcctgggtctctcctgtttcctggaaccagcctgggcccccccatttcctgggagcagcccgggtccccacatctcctgggactagcctgggtcccccgtttcctgggactagcctgggtctctcctgtttcctggaaccagcctgggcccccccatttcctgggagcagcctgggtccccacatctcctgggacgggccctcgcaccccagcccagcagccccttttgcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtcccggtggggtttccgggcagctacaggcgggtgtggccggccgctgtgcgtggcctctgccttcacacctgacctgcccggcgggctttcctgttccccacctcaggggcgcccaaatacagagctattggttggcgtcttctccctgtaccttctgggatctgagggctctttccatggaagccagccccgaggtggagaccttcgcctgcagccgaggagcgggtggggcctgggaaccaaactggagccagagtggacgtccagccctctggtcttggcctccagagggagggcctggctcacggtggggccagggagccggctccaaagggtcttcaaaaagggggtccttgggggctccagctgcctcgccctggcctttctgtgggtgcgtgagagccagcagcaccccagccttggagaccgggggggcaggaccccaagtcctcccctctctcctgactgccctggccgggtgccggcactgcgagacccacctggtgagcaggcctcacagttcttagccagggccccacctcgcctgtgtcccaccagtgccccgacagacctggggcagggctgggccatgatgcagcgggccaggatagcctccaccgtcagcacagggccgccctccccgcctttccggaggaaaccactcccacctcagcccagctgtgcgccctccctagctctcctgccccctggagctgatggccccttctccactgaccgattccttagcggggcctcttggggtctcgggcctcgggtgcaccgtcccatgcccgtcctgttgtgggcaccgtggcccttggggcaggcggctctaatgcgggagcgagtccctagctccagacttaagaaccagaccccgggagcatctggcatttggcgtgacggcgtcgcaggcgggcctgggctccctggagagtggcctccctgggagtgagcagggctggggtcgtgggcgcaaatactcctgcagagcaagtgcaggggagtcctgggcccgtttctcctccacctgcgttttcagtgcacttggcttggctgggaggtcctgaggccctgaggccagcaggggaaccagtcctgagggagaggactttgaaagcagcatttgagggtcgtacgcccctggctggtgggggtcctggcgctcagggtgttcggggagccatgtctggcgtccattgtggggagctgctgccctggcctctctgcctacccccagcccggccagggcactcccaggccctgtcgccattgaggtgcctccgctgggctgtctcctcacccctccctgtgctggagcctgtcccaaaaaggtgccaactgggaggcctcggaagccactgtccaggctcccactgcctgtctgctctgttcccaaaggcagcgtgtgtggcctcgggccctgcggtggcatgaagcatcccttctggtgtgggcatcgctacgtgttttgggggcagcgtttcacggcggtgcccttgctgtctcccttgggctggctcgagcctggggtccatgtccctttgccgtcccgtcatggggcagggaatccatagcggggcccacaggcaggggtatgagtgcgtcccacccaacgcagcaccagccccggccaccgctccccgtgtccccagttccgtctcagctacctggactccaggaccctggagaagggagacctggcagtggagggaggctgtgctgtgtgtccccctgcaggtgtgaccccgcctgctctttcctcccccgccaggtgtggccccgcctgctctttcctcccccaccagtatggccccacctgctctttcctccccccccaaggtgtggccccacctgttctttcctcccctgccgaggtgtgaccccacctgctctttcctccctcccagtatggccccacctgctctttcctcccccgaggtgaggccccgcctgctctttcctcccatggggccgctgaggcatgagcacctgggcacaggttggggctctgcaggatgaggaagacaggccaatcccttccctcccagaagctggccgcccagcaggagggactgaggccagactcatgtccagcaaggaacgtgtggtgtgtcccctgggaagtctctgggccctgggaagagggaaggtgcacgtcctgggatggttgcggggccctgttttgggagacaaaggggtagagggtctgtcttgggcccccccagactctagcctgagcagtgcagccacctactgccccacctcagagaagtgcagcgggaaggaggctggaggtggtgcggcgctgcctcgggtgtctgcgtgaatgagcgtggccaaggaccagtgccacctcatggcaaagagctcccgcagtgtttgttagagtgcacatccctacgtgcccactggcacacacacgtgctcacatacatgtccgcatacaggcgtacacatgcacgcttgcacacatgcacacagaccacatagcacacatgtgcactgaccacacctgtatagaccatgcacagtacacatacgtgcatacacatgcctgcatacaggcatacacatgcacgcttacatgtacacgtgcacagatcacacacatgcacacacgtgtagctcacacacagtatacacatacacaagtgcacagaccacacacagcactaacacatgcacacacaaagtgcataggccacacagcacatgcacacaggtgcacagaccacacagcacacacaagtgcacagagcacactgcacacatgcacacacacacgcgtgcatgcacactcctcgcacttccagccttggagcccttctgtctctggtctttctctttgaccctgctgagtgtaagctgcctggggaggggctacaaggagtaattgtggctttaggggtcgtggtgatgctggaatgtcaagcgccgtcgtggggtatccgactgtccgggctcctggtccgcagtggcagagcgccaggcagagcccaatcagggtctcgtgctgcccttccctcccacagcctggcagccatccagaggaggggctctaccagatgccaaggtgccccggtgtctgtatgggtgtccggttgggtcctgtgtttggtctgccctggaggtgctgggccctcctgggatgggtggctcagcctcgaatcccaggccccagcccaggcaggtgctgctgcctgttgtggtttcctggcccagcttctccttctccctctgcataaaatcacagtccgtgagtcttccagctgccaccacggctgggacacgctgggggagggctcctcccatgcctcctgcacacagccgtctgagcagggcaggtgcccaacaccccccaccggaggacacgctgcccctcagcgatgcccctaccttttggggggcctcgtctcaagcccccccttggaggctgaaatcaccccaggcactgtgagggcttctccagggggcaccctttgagctgtgggtctgatcaccccaagtcccgcccggaggagaggcacagccagggcgtgtggtttaatgtttgcccccttcggggctggaggtctcagtgtttctagattccagaccctgctgccagagagacctgctgccggagagaaggggaggaggactccagctgggctcggtcccccacagtcagggacccccataaaggacacccccttctctctagaaagagctgggctctcagctatttctagttgcttcccagaagccgaggagcagaaggagctgtgagagctttgcagaaacgcccttgtccccgccctcctgagctatgaatgccgtacagagcagaggctggggcattggcaagatcacaggttgatgctgcacagccccattgacacaaaccctcaaagcagacgtgagagggacggttcacaaagctcggacctgccgtggagggtgcccggcagacgtggcgtgagagggacggctcacgaggcttggacctgctgtggagggtgcccagcagacgtggtgtgagaggaacggctcacgagacttggacctggtggagggtgcccagcagacgtggtgtgagagggacggctcacagggcttggacctgccatggagggtgcccggcagacgtggtgtgagagggatggttcacagggcttggacctgccatggagggtgcccggcagatgtggtgggagagagatggctcatgaggcttggacctgccgtggagggtgcccagcagacgtggtatgagagggatggctcacgaggcttggacctggtggagggtgcccggcagacgtgtgagagggacggttcacaaggcttggacctgccatggagggtgcccagcagacgtggtgtgagagggacagctcacgaggcttggacctgctgtggagggtgcccagcagggggctgagctctgaggggtgggtgctcagtgcacgggtgcccccagtgtcctctgatcctgtccggtgcctcccccaacccccacacccatgcagaactcccaggtcacatgcacgtatgtccagggcatgggggtggcgtgaagaggcctggtcagggcctttaggggctgcaggacggaatggccgcctggggagcctgtgtggctgtgccgggcagccatcctgcattcccacccagcgcgcagtctccacctcggccccagcaaagcgctaagcagccggagagacagccagggcggcttcctgaaggatgtgggatggtggactccggggtcgagggaatacgcaggttcctgtccctccgggagacctagagaagctgcacacccaggagctttccatgacccgggagcatgagtgaatgggggttccagtttgctgaactttgccgtcttgtaagggtgggggctgacggccgaccctgggaggaggtgacatcgccgggggaggttgtgggcaacggtggaggaggagagacgggaggggaccatttgggatggaggggcctcttcagagttttaaaaggcgtttgtggggtggagttgagtgtgctctgggcttggacacttgccgtggtgcccctggctggccgaggagactggctctggccaggggccccgtcctgagaggtcctcagcgtctgactctcggccaggcgccagcaaggaggggccggtccccggggctaccaggcaggcacgtgcacatcgccatcgccacacgccaactccgcctgggttttacaaagtcgttgccttaatgcatgtggacaggaactccctgaggtcgccccatgccccctggctgtgccaggtacggacgccctggaccctgcgaacaggtggggcgggcgaggggcccaagggacgggctccagagacacgcgcagggcaggaggggtctcacggaggggtctcgcactgaggcgcccagagctggtggtcccgctggacgccatccctctgcccgggatccacacggcccacgtgtgcccgccatgcccgcgccccacgccattgcagtctgccatcctctggccgtgacggtggctgcagcttccccatttgcgccgttgcctctggctgtctgcacttttgttcatgctccaaagaacatttcataatgccttcagtaccgacgtacacttctgaccattttgtatgtgtccttgtgccgtagtgaccaggcctttttttggtggatgtgttaccccgcacacttcaatctcaactttgtgcaccgtccattttctagggatagacgcccagggaatgaactctagttttctaacagattagctgagatattaacttactcacacggacaggttgatgccagagccgtaagaatgcgccagtgcgggtttgcgggggacttcgggtgtggggtcctgcggccgcgatggccgtggaaggttctggggatccctgctgccacggggacgagttcggacgccaggtggacctgtgcactcagtaaaacgcagtgattcaacctg

SEQ ID NO: 60 - DNA, 2762 bp, Homo sapiens
  source 1..2762: mol_type = genomic DNA
gtcaggaaggttctttagccactggtttaaggaatgtgtttttacattttgttgcttcttctttgtggtatgtgttttttaccttccctttcctaatattaacccttctcgcataaattataagcaccctttactgatggctatagttgaatgtcagactctaaagcaagattcttaatcatttatgttccatggactcttttggctatgtgataatacaaatggactcccttgtttttaaatgcataaaccaaaatatgctagccctttgggaagccaaggcaggagggtagctggaatccaggagctcaagaccagcctgggcaatgtagtaagaccctggctctacaattttttttttttttaataagctgagtgtggtggtgtgcacctgtggtcccagctactcaggaggctgaggcaggagaatcccttgagcccagaatgtcaagggtgcagtgagctgaactccagcctggatgatagagtgagcctctatcacaaaaaaagagtaaaaattttttaaaaaccaaaaaataaataaataaaagccccaaaaaacaaaataagtagggttacaaaggaaaataattatattaaaaatacttatcaaaatattttttattttattttactccttaatgactatgaactggaatatagaagagaaaaacctgagaaaacatcgacttcctagttatagcccagaattctttgtagggccttgtgggtcctccataacaatgaggcagggcttcccacccaggcctctggcattcaactttaatgatccaggataagcctggaaaattgaccagtatctggaggcatgttgcaaactcttctctgaaaaaattatcaaggcatgattgacatatgaaaagctgtgtatacatctttagtgtgtatatctcaatgagtttggggataagaatacacctatgaaaaaggctattctgctctacttaaatgaaaataattacttagggttttatttaaataacaatatcccctactgtagttgaagtatgattccatataaagtattttctttggctattctatgggactcttgatactcacaactcttggatataaaaattctctggaaattctctagcattaaaaacaaagtttcccttattccccccatttaattttctacttttctattccttaatccctcttcaaagccaacatgtttctgatcctctaacctcttccttttttctctctcactgctgcttcctgtacataatagtccacacagaccacactaaccctcagttggacctcaggatgtcagtgtaatctgtgccgctccattagccccggtaagcgagccacctaagcaaaggtaattacagtgtgtccgctgctgtcactggagctgtgtgtcacactgggcagatgcaagtcttcctgccacgccttgaggctcagccacacaggagaaatcacagcgctagctgtggcctgctggctacccccagagatgcagctgtgctctatgaatgcagcccccaaccagaggaaagcaccctgaagacctgggtgctttacgcaataaaaaagacaaaccttctgatggcagaatatgttttttaaaagactaatgaattctcatgttttatttggttcaacactaaaactggtgttgctgtgttttgttttttgtttttttttgtcacaaagaaaaatatcctagtttgtgtgatattttcccctcgaagtgtcattgcatacccattggatttttctttaaatttcagggagcccaaattaaattttacataccctctgggtctagtatgaaaaagtagatttgatttaacttgatgaaaaaaaattgtaatttaacagaatcattctagatattttaaactttatatcaaatgccagcagccagtaataatgcatttgaattatgattcaaagatatgatagtaatagaatgagcaaaactcaggaagagataaaagttgaacacaatgatactaatataatagtaagagaaatgatcaggcttgctaactatgaaccagctactgtactactttctacaattatctaccaacctcacaattatcttgcaaattaggcattattaaatccatttttcatatatgaaactaaagtctggaaaaattgaataagaactcatattccataagtagtgactaccttataacctgtatctagcttgacagatgaaggtcagcctgatttttaaaaaagtcaaagagagaagcctatgtttatgtacaacaacatgtaaaattttcatccctcacccagtggacaatagagggacgattttcttttctccagagaagagacattgaccagagttaagaatctaactgtttatgagttccagtgacatttacaatcaattctggtttggcttggtttctctcattccctcttaaccctgacttgtgatattgccgtgaaggtgatggagaagctcttccatatcccagggtgagccctcaattctggaataaccacaggaatgttggttggcttggaatggatgaagggaaatggaaccgggccagtaaagagaaggcttggatctgttctaggcctggctgatcctgaattagttcaattcccaaagatctgggtctcaccatgggttcattaccttgactgactttgttacttaaacctccaactatataggagccgagtgtgactcggactatggattgttattcttaattataatgttttccctctcatttttctggtag

SEQ ID NO: 61 - DNA, 5355 bp, Homo sapiens
  source 1..5355: mol_type = genomic DNA
gtaatcccccaaaccccatctcctcccagctggccacctttggtggtagcagctccatgccgatgctgtctgatgtatttatagcctaatttgaaatttcacgggggccagccgtggggctggggccgagccctgcctgtgttccccgacccccgcactggcccccctctgcccaccgtctcctcgctgcatttgaagacctccccccgcccttcctcttctaattgcctctgggatgaacaggggaaggaaatatctcagggcagcatagagagagagtgtgattgtgagacaataaagaagtaattaggcagatgagacacttgggggagggcccagcctgtgcccaccagctcccaggctgtgctgctggagttttggttgtggggggtggggggaggcatggctgagagccctaggccccatttgtctggatccgtgttgcacacccgccaccaccggccaccctgatccggtcccaagcttcccgggcgggctggactgggccctcagctctgtttgaagtttcgggtttctctcccgggggtagggggcttctttgtgtctacccctgcccactgtgggaggtgggggaggcagggccaaatctatcatgggaagagaaaaatctctttgtccctgagggaatgtgtcttagttcccgggcccagccccacaccccggggaggctggtttggaggcgggaaaagtgtgctttttgaggggatgcagctgggcctgggggaatcaagaagaccagctggaggggagggtgcccggggaggtttggtgaaattggggagcgccagagccccgcccaggatcccccagggcccgggcgtctgtcactctcacgcccgcgtgccgccccctggtcggtgttggctgtaatatcacatggcagccaccatgtctggggagcgggccgggggtggcattgtcctggctcagttcctaggacactggctgggagcatcctcactttatggttgaggaaactgaggcccgggcaccggctgctcagggcgagggaacgggccctggggctggtgccctccagctctgtggctcccctactgcccacggcccctccctgtccaaacctgtcactcaggagagctgccacccttgccccctgggggctgatggcccctgtgtgtggctgctgcctgctggtcacaggtttttctagttcatgctctgctgaccccacaacactcaggccagccaccctaattagccagtcagtcagctccaagggaggcagggaggccgagcctgcagggtggcttccaggcagggcatcctctcaggcccgtgggccccaagcatgctgggcaaccactcccggccattctccaagcagcctatggcctctgcaagcagcctatgggggcagagaggaggcccccccagaatagaggacctcaggattgagaaagcagagcaaggccagagggaaatcaccccctcggaccgtgcaggagggcatccggggcctggagcaggttactgagctacggtgggcaggtcctgcgccctcccaggcctcctgtctcatgagggcattgggtggagaagtcagtactaaagagaatctggattaaggatcctgctacctcacccacacttgggtcccagagacaggaaacccgagtctaaatcccaacttttcttcttattgctgtgcaacctcgagcaagttacccaacctctctgagcctccagtactccttgcccaaagtgggaaaacacagcacctccctcctagggcatctaaagcgcttggcctgtctcagggcaagccctcagtcatgcagctgggggtcccatgctacctcttcatgggaggaagggtccaaggtcctctcagggacccctctcaagaaaggctgggctgggctaagctgggtgtgagtcaggggaaacatcgttcctgctgagaggcccggggcacccagagtcccacccaggcacccagagtcccacccaggcacccagagtccagtcactctggaaagaagtttgccccagccatgcagactccccaagggctttgtgctgagggtggggctcaacgtcaggacgcacccttgcatccctggacctggcagccctgtccccctcgggatgagctcaggggaacagagcctggggaacccgtgcccctccccctctccaaaagaagccaggagacctgcggaagggagggcttgaaggcagatggctgagccattttctgcctccgtgagggctgattgaagggcaatgaggcagctaatgcgaagaaagatagaaatttacttgctttaacttcatacggtccacagtgaaagagttcattcagtcgccggcccgccatagctgatggatgaataaaccatttgcggcatcgatcatgcctctacatcatggtttagttcatgggccatttgcttccaatttctccttctcggggcctgtttcatgctttctttcgccctctccccctagcccccaccccgactctctctctctctttttcttcactctcttccctcccccgcacccccccccccccacagatgacattggaagtgagccctcccgctgggagggataaatagatggcattgatacttggcaacaaactatttgtcattagaactgggcttttaggaaggagagtaaaaagaaggcaggcgctcgagccaccgcggaatgcaaagcaaatgtcattttatttctatttagttattttatttaatcggcgctgtcaggtgcctgcccgacagctgcctctgacttccgctgcggtctgcagaaactcgtcctccagtcttcccatcccctctccttccaaatgcacacactgtcagcctccacttcggtctggggctccctcaggaagtgtggcgggagagaaagtgacaagcaacgcattgaaaacagttgacagtcgggcccagcgcaggtggaggtgggagagagctgggcttgggtgggagtggggccctcgtaccggcaccctggttggaggcttgggggagtcccaggcagctggagatggggctgtggagttgtgtggtcaccccaagatccagtccagttcactttacctttttgctgaggatgagccttgggacccgtctgtgcccagggaatgctgcagttggcagggtgggccagccctgatgcctacctgtggctgtgatgctggctggctctggccacaggcctcaccctgtttctcagcccaggttactacagcagctgggaaccagcataaggtggcggaaagagtccctgtgtttagcttccaaagcatggtttggagaagccacctctcagccttggctttccctgtggtccatagaggcatcaggctgggggtccctcagggcccctcctacctcctggagtctgtcttcagggaaggttctgggttcttgttcctgccccacaaatgggcactgatgcagggatacagctggccctgagtcacatcgtaccttggaggtgggggtggaggatccaccacagtccctgtcttagaaggatcaattgtcctggtttgcccaggactaagaggtttcttgggacaaaggactttcagtgctaaaaccaggagaaatcagggcacttggtcactctaacacagagccacaggcaaatgaccacaggtgagcttccaaggcacttatgtagccccatcccatgcagaatgaggaggaggctgggccgagcatgtacccccagagtgaatttcagctgccctttccacctgcagagcatgttcccgtttgtaccaggccttccctgacattttcctgtgtgttttcatgtccaattaaaaaatatatatatactacttaaattgtaagatggccaagggcaggtatcattttccccattttacagatgaggaaactgaggctggaggaagtgaagcttccccaaggccccccagcctgagctcttgatcctggcacggggtaatgcccatcactctaaaatacaatgtgtatttggcgaggacctcgcggggctcctgtcctgagtgccagggaacaagtcccacgtggtctctgcctgcacagaactcacagttgtagctccagtccctcccgctcagcctcaatttcttcatctgttgatggggtaagagcgcttgaccttcttaccaaatggggctgctgagaactcagactgcagatgggaagcaatacgtgaatgtgtgcaaggtgttttttttttttttttttttggtgggggggtgggggacggaatcttgctctctcacccaggctggagtgcagtggtgcaatctcggctcactgcaacctccgcctcccaggttcaagcaattctcctgcctcagcctcctgagtagctgggactacaggcgcatgccgccatacccggataatttcttttgtattttagtagagatggggtttcaccgcgttgcccaggctggtgtcgaactcctgagctcaggcagtccacccacctcagcctcccaaagtgctaggattacaggtgtgagccactgtgcccagccgtctgcaaggtttttaaagcaaagatgagacagcagttcctggatgtcagcaggtgaacaaggaccccaggcacaggatgcccacaggagggacctgagcagtcaggcccaagaggccccagtccccacagtggcaaatgtccaagccacggcctgggggagctggggcctccgaaggtgggagggaatttcgagagtttcaggcaacacgcagcccctccaccactgcatcagacgagaggcccattttccaacacgcccaagaaaaaatatacataaaggttgatgtgttttcaaatgggtttttgctttgctcttctcttttctccctgtgagtattaaccttggggaccctggggacggctcggcttgccagagcacctgctggggtcacaggcagtcattagctttgcggtcagtgcagaataaaccccaatcccgagccggcgagagcgtgcgtgccgctcctgggaagccctcggaacgccgccttgctcctccaaagtcacactttttcctgcctgacttgttcctctccagctattctacctccagctgtgggggcgtcgaagaaaaagatgagatcaagttgaggggaaaaattgtctgatttctccagccctttgtttcccaggcctctggcaagcgaggctggtgctaggctgagggctggggaccgggggatctgccggaccccaccagctggtggggaaatggacagaggagaggggtgcagatccccgcgggaggtgggctgtagggtgtccagggactggtatgtcatctgcccaccactttctgtcttttttcag

SEQ ID NO: 62 - DNA, 1985 bp, Homo sapiens
  source 1..1985: mol_type = genomic DNA
gtaagtttcacttttattctttctgcaagggattctgaacttactctctgatgctgtctgttaagtttgcatgaaagctgtatgttaactgctgaccctccctttgctttgcaatagttggggtggaaagagcagtaaagtaggaatacagccacctgggtcccagttctgcccctgccactgacttcctgggatatcaccatggtgccctctcccagcatgtgggtcttcaaggtctataggactgaggcaggggaatggcttagctctcttccagtggccttgagcaagctacataaccatactaggttgtagtcttactatgtgtgtggtccccaagacctccactaacttcaagttgtagtgcaaaggaaggaaagcattcatatgtgacaggatgacagagctgactataggtcacatcttgtctagccaagatggcagaagcggttcaactgattgagtatttggtgtctcatgcctgtagtcccagcactttgggaggccaaggcgggtgtatcacctgaggtcaggagttcaagaccagcctggccaacgtggtgaaaccccgtctccactaaaaatacaaaaaaattaactgggtgtggtggtgggcacctgtaatcccagctacttgggaagctgaggcaggagaatcgcttgaaccccagagggagggggtagagtgagccgagatcgtaccattgcactccagcctgggcgacaagagcaaaacttggtcaaaataaaaaagatgtgactataaagtaatgagatgtttactggttcatgttgaaactgtttaaaatgtttaaatcaggctgggtgcagtagctcacgcctgtaatcccagtactttgggagggtgaggtggcagatcacgaggttaacagatcgagaccatcctggccaacatggtgaaaccccgtctctaccaaaaatacaaagattagccagatgcagtggcacccgcctgtaatcccagctactcaggaggctgaggcaggagaatggcgtgaaccagggaggcagaggttgcagtgaaccgagatcgcaccactgcactcaagcctgggcgatagagtgagacttcatctcaaaaaaaaaaaaaagaaaaagaaaaagaaaaaaaaagaaaatgtttgaatcgttcatcatgggaaaattgccagatactcttttccattaaaagctttgacctcagctttaacaatggcttgtgtattttagaattggtttgagggaataatgcttagtggagagttcataggtgattggacttgtatcacagtttgttggaacaagttataaagttgtcaggttcgtgcttatgtcattacaccccaaggcagctcccttggtctgatattttcctagtcatgaagagaaaaagagaaaatgagaaaatgagaaaggtaatagaagatttagaagaaaggtaagcttttccctttggaaactggaagtgcagtcctggaccctatagaagtttagaaaagcaaagtctattataaagtgatgtttaggctgggtgcagtggctcatgcctgtaatcccagcacgctgggaggctgagttgggcagatcacatgagctcgtgagttcaagaccagcatgatgaaaccccatctctacaaaaaaaagtacaaaaattaccaggcgtggtggtgcacacctgtagtcccagctacttgggaggctgaggtgagaggatggcttcagcctggaaggcagaggttgcagtgagccgggattgcatcactgcatcccagcctggatgataaagccagaccttgtctcaaaaaaaaaaaaagtgacatttaatcccctctctaaagtgtatttgtacagaatctgtcatgtttaatgatctctttttaaattctgttagtatattacttcaaagtaaaatttcagacttgatcctgaattacataaattaactattctttgcattggtggatttatttttttaaataaaacag

SEQ ID NO: 63 - DNA, 17995 bp, Homo sapiens
  source 1..17995: mol_type = genomic DNA
gtgagccgggcccgcggcccgccctggtcggtggcgccacctcgacggcaggcggcggggagtgggctgggccggggggacgcgaggcggcggggcccgggggtcggcgaaggcccctcgcgggcggacaccggctccgcgccccgccacacactcccgctgcgcccggacgagtccccgctccggacccgcccttgacaggcgtcggggcgaaaggaggccccgggattcggtggcccgggaagcgaccccgcagtggctccggtgccgtccacggctcgactccagggcggaaggccgggtgtccagcgctggcctcgcgctctagggctgggagaggggcggccggcctggtcagctccggaggccccggcccaccgtggcccctgctgcccgctcggcctccgggcccgggacccgcggcgcaccctgctgaccgcggactcgagggggacactcgcaagcttggatggtggttttggggggaattttaccgctcaagttctccaacttggttgaggggtatcttggctactgtcccatgttaggcacccaatgactctggaggctggtgtcaaaacattcatatatatatgtgtgtgtgtgtattttaaattaaaattgtattattgtttgaaagtgctttcaatatgaacgtatcctagtatgatttgtaaaataaaaaacagggtgtgcttctccccagcagtttctagagatctagactagagatctgagactgtcttacagttggccattgccttaccacattgcctcacactggagagaaagagaatgatacgtgtatatttataatggcattcgcttcctgccttgttatggtattaaaatacttaggatttgttaccagtacacaaataactgactaatgatactcttgtgaatacagcagaagtatgtctcatttacatacatgcaaggatatatacttcttaatccccaagagcatgaaatttgaaaatgtaaatttggaatgagtgtgttaattttcaaaaatcagagttagttatactattctttcaattttttataaatttgagctttcaggataaaaagtttttaaaataaatatgttatacttaaagctgaattgttaacgccgtctgggcaagataaaagcagcaaagagctggtaaattattttgaagatttaaaaactcaccaaattaaaactgctgtgtaacccattgttttagaagaaagacctgtattatttcccttcatctttatgcactttttgttttaacaatattgataaaactccggtgcccagcagtgagaccgtgtacaggcagcagtttacatttacgagagattagttgtatatttattcttgaaaattagtacaagaggctgtaattagctgggatgggcacagttacatatacctttttgtgtgtctgttccacccatttttgggtgaaactgacactcatttcaaaccacctttcttaggagtctgcgtggatgtacatgatctttagtgtggtttacaactattattttgaagccttcttcctgtagacatagggatagtggtatctgttggcagcctttgttgtgagtgaagatcaagtttgaacataaacattcccagcactttgttctcagcatgaaacttacccagcaagttgagatcttcctgtacccacctggtgcatgggttaggctgtgatttcataaaccttattaaaagaaaaaaagcaggtttagttaccattattcttgtcagcaaatacaaagaactactaaatcagaagtctgatgctgggaagatttatttgaaaatttcacggtcaaaattttaaagttgaaatgtccttgaagatctcttatgttaggcttctttattttctgaaacccagagagttcaggtgtgactttgaaggtcatccagctagtaccaacaacagggagagaactagtgtcaggaaagtcctaataagaggcagtgtgtctcttcagaagttggaagtgagtgttttgggaaactgaggcatgcaggctagaatacttgattatttttgtgccctcctggccaccaagttattgggtcactgacctctgtgctgaggttgcttggattttgatgatgggactgatgaactcaagaaaagagttccctttaccaagtgaatgacttgagacttgtcagcatggcaccaaaacttaaggagaaaactaacattcagcccatgagctgtttgtgcttcattgctttcaatcctgtgctttgacacacacaatatcaggttgcacttgtgtgagttacaccttactggagactaaatgtagtggaaaatccttgaatatcattttgtatttgaaattggcttctcaatgcataatgagaaaaaggcccttgcagaaaacaaagggcgattttggaggagctgagctgaggcccgtctgagcatcatcatcttcaagaggaaatgctgtcaatcagtaaaaagctgttcattgagcatgaggagctcaagagacgacctctcttttgggggaggactcagcttcaggatgtttaaaatttaatcacgttagtaagaaaatggaaagaaaagactagacctttgtattttatttcgtcttctactgccgtcttgcagttgatcttccgccttctcctgaagtagttaggacaactccctgttttcacagaggggcagagcgaaagcaagtatcttctgtcattgctgaagcaggacggctcccggcaaagatgctgggcttcatccagccccattctaagcagctgggcctccccacctgcagtcttcctggattttgattttctgcacacttgggcttcccactaatttggcaagttcataccagtccaggccctttcctggcagaggatggcattcagtgctggtgcagccactcctccaggctcctccctgaataaacagaggccggatgttctggagtgctgttcccgccaggcctccttgggatgagagggagaccttcctccctcatggagcagggccgctctagctccatggatcttgggggttaccagtctggcactctccagggagtcctgttaagaacacagattgtggctgtgtctcatcgcctccctgccccaaccccatgttcaaatctgaattgctcagtgtagggcccagaaaactattaagtccagaaagcttttttggtggttctgattctgctgcactggcagtgggagccacggatggccagtgatcccattttggggaggaggagctgcggcttagtgcctcctgaacatctatcctgcagagcattttcccaagcctccattttccttcttggggaaactccccaggtacgcgggcttctggaggtgtgaatatggggatgacatgggaagcgagccgagacagcaccttgcaaagtctggcagggtggctggcagtgcgagagtggggaggtggtccagagatcttcctggaccccaggaagaagcaagccagagccttttctttttgtcttgcccatctggcagaatctcaccataatcatttaacagattatactcaggcactgtgacagggagatagaaacatcctttcagataacactggaaatgtttcgagttatgattgaagtagagagacccatttattttgcttaaggttcagcagagcctcctgaattttcttaaagatgagatcgttttgctctttccagatctattgcaagctgttatgcctcttagcagaggcggagcacaatcaggaaatgagtggccgttctctccttcgtatttccagcaagttgcagttgtggctgagcaagttcctgtgcgactgcatgaaagtgatttgttggggggcagatgaacagcatggccagatgccttggagcccagctcatccaggactttcattttcccctctgaagaacagcctgtgttgttcacatgagaaccgactgcacctccgagaacatcatttgtcccgttttgtagggtagatttgccctttatgagggtggagcctgtacacaggacctgcggcagcgtttgacgttggccagggctgggaaggcttaactgttggatgctatcagggctgcttgtgagtcagaaagcttcataccacccatgaggcttgcttagtgctgtcctcgtttctggaatgacacacagtcaccttatataaaccactctacatgtttattactttctattgacatttaaaaatgatgttctgatgtttatcatccaaagtagaaaaccattcatcatccagacctactctttctcctttaagttttgctgttttaatattgctcttaaatgtttaagagagcttacagaagaaactgaagacaaaggccttgcttattaggatctttgagaccctctggcactggcgaacacgagtgaaccctgtgtcacacttgaccgtgttattctccagcccctcctgggttcccttttgttgtgagtcaagtagacacctctgatctgcttctgcctcagagcatagactcagctggccttcttttttttttttttttttttgagacggagtcgcactttgtctcccaggctggggtgccgtagtgcgatcttggctcactgcaacctccgtctcctgggttcaagcgattctcctgcctcagcctcccaagtagctaggattataggtgagcgccaccatgcccatcagccggccgtctgaggcaggctccagagccccttgttttgcaggtgcaggattcatctgtatgcatcatgtggcacatgtgataccatgtgaggtatctggtgttactaagtcgtcacgtatttcgatgaaggtatctttgggaccttggcagccttttaggaagccaggcagcttgcaaaagcttaggaagaatttggggggagaggaatgaatgtagtatttttctgtctgtcaacacacacacatatatatatatatgtgccagatatgagtgggtgcttttggtaaccttatctctaaatcctcaccagctctttgaactagaaactatgaagtgtcttacacatgggacagcagatttggagaggcagtgtgcctggcctgtgataaacagaaagacttctgtggctttacccccatctgagttcctgaaggggtgacagacagacttgcctttagcgggcctggctgctttatactccccaggcacggctgctttatactccccaggcacagcttgaggtgataaacagccctgagtccatctttgtatagttaatcagaaatgttggcctgtttcttgaacctgggtctggatttaggagatgggcccgactctttactcactcctttaccccatctgaaattcactgagtgcccacagtgtgcgagtcacagtgttaaatgccatatagaggacaagtctgcccactttgagactgttctccacaaagcatgtcctgcctctccctggtccgaagcaggctgtctctcttctggaacccatattattttaatttgaatctttttgcttaagctctgcacttttctgctttgtcttggggtcacacccctgttaggagttctggggcagagtctgtgtgcttcatcgctgcctcttgatgcctggcagggtccacaggctcagaaaagatggaacgagtgactgtggagaagggtagaacatgggcctgcccagagcgcgaaggcagatacagaagagctgcccgtgaaggatgcaggtgtgtcccgggaagccttccattggttcctaagaactgcagagttgtcctgggctcctaaaggtccccagaggcctgctcctttttgtcactttgtgaatggccttctctgcacaaaggacttcagtattgattccctaagttcatccttacaggtctggagaagctcttttttgtttctcccaatgacacagcatcttacagcagggctggagaggctgggagctggcagcagccagaccctacttccatagctgtgcagagagcagcccctggcactgtgaaaagagtctcttaaaaattttttttcgtgtggctggcagcaagatcagacaccgtatacgtgaaggttcttattcactgtcaattcagaaaagcctagaatcgcagagtgccagctctgtgcgtcaggagcctgtaaacagctcagctgtccaagagctcccagcacagagctgtgccccagtgaactggggagactttttacggaaaattccttagcattcaattggagaacaaacgtttgctgttttaaagtatcttcctcagtgtttattaaagtagaattatatatttttttcagttatttaaaaaattcttccttgacattgaatgaatgaataaatgaatggatggtttaaaaattcatacagtgggaggatgggaaggccccttcatgtgcagaagaaaagccagccccttcgctggcccaccctttcagggtcagttcagacccccagcatcccagcggggttagcactccttcctgggttggacggtgtcttccccggttctgacagcgctccatgccgggcgtccctgcagtcttggggctgtggtgactcagaattaagctgagtgctctcactctcgtgtaccctgcctggctggcctgatgactcagcatggagcgctggctccctgacccagagcacacttgaactgaatgttccaggtctgagcctcagccgagcgtggctgggcgaaatggaagcctttctctcctgctgcctctcctgctgcattttaccccgggagatgaaggttttggagacgttagtgacacatggatgttatcacagtgtacagctgtgacaggagtagcagaaaggttagcatctacctggccttaccatcagacaaacctgggttctagagatcttaggcaaagcacttacccttcttgagcctcagtctcccgttgtgtgaagtgggcatagcaacacttctgttagcagggttgggagaatcaaggaagatggtgtgtgggaggcgaacgtcccaaagcctgaactgatgcatgcgtggaactcccggaaacatatgcagcctgctctgtggagtagaagtgtgtttgtggataggtgtgtggcctctccacacagcagactgtcctggctgtccgtgggcctttcagctctcagagaggcctggggtcttgtttcttagaagcaaggcctcctcttatcccccttgtatggagtgtagctgactcccccgaccagtgtccaggtggcccttggagccctccctggggcttcccgtgccccttgtgagtggaggatgtaaaggaacagtaacagatgaagctgcggggccttcgggagccttgacccagctgccagaccctgcgccatgcgtccatagatgcatctccccatcctctgcccaagataggctgggtccttgtgtcctccactgtgctgtgtagagcgctggctttactcagcctcagctcctcaaggggagggtctccctcagctgtgtctgtgcagccgcaaagtaccaggcaggagctaggagcgctgcctgtgaggggggacatcagcccaccttactgaggggccgattacctgcacagctcttctggacccagctctcaggggtgtaaatgtcaccgcagatggaaggaaggaggggttttccaagtgccaccaccctcttctggggggtgtggctgctgtggaccgaatgcttgagaagccactgcaggtgggagcagagcccccccgggactcaggggtctcaccgtccatcagagagggtccccttgcctgcatggcagctgatgaactgaggatgtttttcttttggaaattgtattttgtacagaatacacgtccgctgatgtcctgtacactgagacctaacaggcacttgtagggtcgtgtctggaggatggacttgccaggtggctgaccattccatttagcatggaaatgtagcagttgagagaggtccttttccttgactctgtctaaattcagagtttgcttcctgggatggaaatttcagatagtttccatctgtgatttgtgactttggcttgattaaagcaggtggctccgctcttttttttttcccctgaagaagaggtaggtaggttctaacatgccctgaagctaacttcatgtgaccttgggccacattccagttcctacctctgccacatggaacccgtgaggcaggctgcagggctggggctgcagggaggctggatgctgactcaggtgcccccagcaggggaaataccagcagctgcggatggtgcctggcctggagacggctgacgtgtgccctggtgaggggccatcgaggatgttgaggagacgccagcagatgttctgctcccaggcggacccttctgtgccccagcctggcctggcttttctctctaggcctcagggagatgtgtcaaggaaccacagtcagtgcggctgggcgccctgctcagccaggagtttgtctgcagagcaggcctcttccccagagcagcggcccagcctgttggagaggtgggtcgtttagggctcaggtccctagagttgtctttggctctttgcttccaggctgtgaaactttagataaagtcttaagcagagaaagtgacatccttgctaattagtcctcttaagactctcagataaaggggcttctaattctaactgtcttactaccaacttggtgagacagactaaagaattaggctttgttgaacagggcgcggtggctcacacctgtaatcccagcactttgggaggccgaggcagatggatcacttgagcccgggagttcgagagcagcctgggccccatagtgagaccttgtctctaaaataaataaataaataaatatttttttaaaaaaagaattaggctttgtaaacggtaagcccaaccagctagtgctggagaaaagctgagtccatcaataactatttgtggaataaagaaatgcaattgtggctgggcgtggtggctcacggctgtcatcccagcactttgggaggctgaggcaggaagatcacttgagatcagaagttcgagaccatcctggccaacatggtgaaaccccatctttactaaaaatacaaaattagctgggtgtggtggcacatgcctgtaatcccagctactcaggaggctgaggcaggagaatcgcttgaacccgggaggcagaggttgtggtgagccgagatcatgcctttggactccagtctgggcaataagagtgaatcttcgtctcaaaaacaaaaacaaaaattagctgggcgtggtggcaggtgcctgtaatcccagctactcgggaggctgaggcatgagaattgcttgaactcgggaggcggaggttgcagtgagctgagattgtgccattgcactctagcctgggcaacagagcgagactcagtctccaaaaaaaagaaagaaagaaagaaaaagaaacccaattgtttagggcacagagcagctcagagtttacaaagacttgtaccttatttcgtaccttatttcacttaactcttgcaaaaacccctgggaaatatggggatctttacagctgcggaaacagtagcaaggagtcctgtccatggtcacacagctggtgagcatcaaggagggactggaacccagggtggcaccttgaagacccgggctcatgctggttcattcctgtttatttggacacagctgcaaagagaagcaatgttggtttcatcttctaaaaaaattttttttcccattgaaaacacatagggacagtcatctgtttattccaggataaaatgtatatatattttagtaacaggcatattagataaagcctccagtagcctgtgacttatgatagtttatagagtatgtggttggcacacacctcttgtcttaccaggagtctttggacaaagcctaactcctcaggtgtcctgtaagtggaatgtggacttagtttattattcagaattttccccaactctattatgtgcccaaaatagtgctgggggagtgggagagaccctgtattacaatccagtggggactgaagggattttgactttggctgtagggatgttaatggctgtttattgtgtatttcagtatcaaatgggcagtaatacttaattcattcatgcaccccatcatagcaagcagagagcttcggtagggtgctgaagctcgactccagttgcactttgttttttgttttggttgttgttttaattcagagcctcactctcttgcccaggctggagtgcaatggcatgatctcagctcactgcaacctctgcctcctgggttcaagcgattctcctgcctcagcctcctgagtacctgggattgcaggcccccgccaccatgcctggctatgttttttttttgttttttttttttttgtatttttagtagagacagggtttcaccatgttggccaagctggtcttgaactcctgacctcaagtgatccgcccgcctcggcctcccaaagtcttgggattacaggtgtaagccaccacgcccagttccagttgcactttggaagaaagtgtgttttgtttgtttcctgcctgatggaggcgagccaggccacttaattttgatccaggccttagccatatggggagttccaggatttctgtgttcttgcatcttttttctttgttttagaagttttgaagtgttcacttgacccatgtgaaggctcttctggcctaaaaacccagttaatacagtctgtgtcctacttaataccccaggcctgccaagtcggaagtgctacgagacagccctaagagttgcctttgttactgtttctcctagttcagaccagagtgatggaagctgtggtttgtagatgtggagcccactttttaaagagcactgtacctggccaggcgtggtggctcacgcctgtaatctcagcactttgggaggccgagatgggcagatcacgaggtcaggagatcgagaccatcctggccaatatagtgaaaccccgtctctactaaaaacacacacaaattagctgggcatggtggcgggcacctgtagtcccagctactcaggaggctaaggcaggagagtggcgtgaacgcgggaggcggaggttgcaatgagccgagatcgcgccactgcactccagcctaggcgacagagcgagactctgtctcaaaaataaaaataaaataaagagcactgtaccatggagccaagattggggctcacagaaggtgcccattttcgggtttcagtgaccactcagtgtgcagggagtcagttgtgggtgggtcaaggtagattcttctccacggctctttcatgaacatgtgcctggcgtacgcctctctaggcagacaccttgcaggtgcccaagggttgtggttcccaccctgcttttagggcacagggttgggggttagaggcttccttctcttcatttgtttttggttttgtttttttgttgttgtttttttaagacagagtctcactctgtcgcccaggctggagtgcagtgctgcaatcttggctcactgcaacctctcacccctgggttcaagcgattctcgtgcatcatcaacttcctaagcagctgggattatgatgcccaccgccacggccagctaatttttgtatttttagaagagacagggttttgtcattttggacaggctggtctcaaactcctgggaatggatctgacctcagatgatccacccgcctcggcctcccaaagtgctgggattacagacatgaaccaccggacccgggccctcctcttcatctgggacatgaaactttggggtgctctgagttctggcagttctgatatgatttgagtgtagttaggagtagtcgtttttagatttctgtgacattaacttttccttgtttgggggcttgtatagctgttgagagcttgaagggactttggaaatcaggccacgcagagtgtcagagctgaaaggaactttccatcatcgtttttctcactgcggacctttaggcttcctcacacacctacggaatcagacctacttgggttgggcttaagagtctgcaatgtttgcatttcctgggtgcttcgataccccaagtgctggagaaccactgctttctagaacatttttgggcctccccttcattttgcagctgagaaaacgaaagttcacagagggcatgtgagccacttccgtaacacatgtatttaggggcagagccagcgttaggaccaagtgcagcctcttccgagctctcctgctgttccctcagcgcccatgttgctgctaaaaaccactagtgcagtttagacctgctcttaagcaaacgagcccaacagctcaccaaagctcagaacctgacctcaggctttctctaatcataatatcttgtacataatagggcaaattttgactcatctggggtcatttttttcctgctttctatcttggccatctcatggagttgtttggtgccctgagacatgcctcagatttttcagatttttaatgcaatgcacaaacaagggggcagaattagccaattcattttataaattaatatagtgagataagcagtgagagtcaggactgagcccctgggctcttctttcctaattggattttgtataatatgtgttcctgatgtctttagccgagataaggataatgagctctgagctgcaggcgggccctgatgaggtggccatgaggatcagcagtcatctgcttggtcaccgtggttgcatcccagtccctgtcccatgatcacacagagctgtccccccaactttgaggaggcagattccgagctcccgcttgaatcaggaaggggcacatagtaagccttatctgagagatgctggtgtaaccaagaggcattatctggatgtgcttgaacttgaaaacacttagtagactgaagagacatgttttagtcagattctagaattataaatattacacattttttcttttgattcttttatttacaaaatatctctctttgctagattgtgttgaaaacaccatagaagagagaaagggcaatttaactcttccaggtggtgttttttgtgtgtgtgtgagagtttttttggcagagtttcactcttgtagcccaggctagagtgcaatggtgtgatcttagctcactgcaacctccgcctccagcttcaagcgattctcctgcctcagcctcccgagtagctgggattacaggcacccgccaccacacacagctaatttttgtttgtgtgtgtgtgtgtgtgtgtgtgtgtgtgtgtgtatatatatatatatatatttttttttttagttggagtcttgctctgtcgcccaggctggagtgcagtggtgcgatctcggctcactgcaagctccacctcccgggttcacgccattctcctgcctcagcctcccgagtagctgggactacaggtgcctgccaccatgcccagctaattttttttttgtatttttagtagagatggggtttcaccgtgttagccaggatggtctccatctcctgacctcgtgatccacccacctcagcctgccaaagtgctgggattacaggcgtgagccaccgcgcccagcctaatttttgtattttttttagtgaagatggggtttcatcacgttggccaggctggtcttgaactcctgacctcaggtgatccacccgcctcggcctcccaaagtgctgagatgacaggtgtgagccaccacgcctggcccaggtggtgttttttacttagtaaaagcggaagcatttgctgttgtgaccctaatgatagtggatgggaacattagaatgtggcatcagcattcctggcatagacctcattacgggtgggagtttcatttttcattggaattattcattcatgtagaagtgtttaattgcctattttgtgaaattcatgttttttttatttaaagcaattttttgttgttgttgtttttttttaaacaaaaccccaccagagtagaaggggagcctggaacgtcttttagatgcagtgctcacaaggagacacttggttttttattaaatggcaaaaatgggtcattaattcacccaagcccaggaatacagacctcgggactgttggagaagcagccaggccgcccttgcctgtcctgaccgtctctgctttccagctgtgccggcaggcttggcctgttcagtggacctcacgcacggtggagacctttccccttccccccacatgcctctcatttttctgggtgccctttaccctccaggccctctgccctgctttgtgctcatctcctcctccctgacgtccttcttcacttcccagcatgtcctggcttctcctttccagtccctctgtcttgctgaggcatctcctgtgatggttggaacactcagaagggtggacctcagcccccacttccagcctggcccctggtctctagcctcatctccctcagctcagcactgacccccaagcctgccccttgccactgcttcccaccactcttctgacaccactgcccctgcctgcagtgaccacattccttccccgtggaccaagccatgtctctggaaaggttgaatattggctccagcaagcagtctctgctgtcacagtcttgtgtgcagacagagttgtttttccttcctccctctctctcctgtcttattccccttctctttttcaatggaggcacaaaatgtgctcagcgagatgcacgaggtgctcagcgagatgcacgaggtgctcagcgagatgcatgaggtgctcagctcgtggctggctcaagggctttctggatccaggggcttcccccaggaggagctgcatctcctcaaggcctgtctgaggactccaagccctggaagggtctggctataaggggttgggatcagcagctctcccagttaaaaccagagagtgtgggtgggatgtggcagagtgggcagtgtgggggtttgatggagttttacacagccatacacccatttaccactgcccagaaaaagagaatattcccatcacctcagaaagctctttcgagacccttcccagccactaccatctcctccagaagtgaccaccattctggtttctagcaccatcgattcactttgtacttcactttttcttttttttcttctttttgagacaaagtcttgctctattgcccaggctggagtacagtggcatgatctcagctcactgccacctctgcctccggggttcaggtgattctcctgcctcagcctcctgaatagcagggactacaggtgccccccaccatgcccagctaatctttgtatttttagtagagatggggtttcaccatgttggttaggctggtcttgaactcctgacctcaggtgatctgcccgccttagcctcccaaagtgctggtattacaggcttgagccaccgtgcctggccctatccttcacttttgattcctttgacactttggagtctgaaaagcataattttgtgcgtatttagggagaaactcacatttattgccagtcttccgggcatccctcttgatatgcccttataaaacctcacaacatttctccagggcaggtgttggctagctccgttttctagaaaaggaagcgaaggcttacagaggtaagagaattacccaagctcacagaactgttagaaatagaggtacgaatcacacttagaccctacctagggcagcgtctaccctggaagagcctgtgcctttccccatccctcagggcctccgtgctttccaagtaattctgcttcttgtttgtttcctgcccccttagcccatcttctaagcccctgttggcagggagtgccccttgctggtttggtaaccccataggactcctcagcgggtggcaggatgttcccccaggtggtggatgagggtttgctcactgctggtccctgctgtgtggagtgtgcagatggttgaggcttttgtgcgtggctgggaagaaacaatgagcccctgggcagccagcaaaaatgacactgcaggactaatgcaggctccgatttcggctggaaggaggaggacctcagtgagtggacagaatgcccacaggcacgttatgactcaacactgagtagcagagggtttcttcagcgcctcttgctggctccctgtcagggccatctcacggcaggaattcagctctgaatgtgaggcctggacctgctcctgctcttgggtgacctgagagttaagcaggctaatgtaatgccgccgccctgagcacgtggctgttctaatctgagaatgcctgtctgcccatgtccccaaggacacagtgacacccatgcctttcctgtgtgctggaggccctccaagggcagggtctcagcaggagggaggcagttgatgggcctgaaagggctaaaccagggtcagccacctggtgcccacgcctgcacacaaatagaaacatcacagaattaatggtctgttctctcaaagtgcagagcagccctcagtatctgtccttacttttgattgattccgcagcagtagagattgtcccctgcaagctcatagattgttagcctttggcgtttgttcgccgtgcagacagctgccttcgtcaggaaagatcactccccttcttaagagttgccttacacagatatatgcaaatgacacttatcagtagctcccctcctgggaaaggaccctcggtgctcggggactgttaggacttctgttgcgcagcccagcttgctgagagatggcattgcccagtgagtgactggccagccttgttgtctgaaataagatctttcctgtggtacatctggaacttggccttctcaagggtcccaaaatagccaggccactgaagggagaacttcaagagaggacataagagaaggaccccaactgctccttgcccaagcaggctctgttgcgttgaagaaaaagttcttcagtgatacttgttaaagcacagtcaggaagatttattcggggccatcaagataggcacagggaccacggcagtggggtcgtgcagtcatgggtagagactgggcacaacttcaaatacaacacgggcgattgggaatttatagtcaaggagcagtgtggatggaaaattagaagaggaaacatcagggctaagggtgtttctggctatgctgaccaaacaggattcttgccgaagacaggccagggtgattagacagcacctggaggctgtggaagctgatcagatagtgaggctggggagggggtttctggctaaactgacttagcagtgtcttttgctaaaacttgactttacaaggaagtgcacagatgggcctaggagatgcttcggaagcctaagatttggtcaagcagagaatctttgtcagttggcatcgttaggcgacacagttaaccctgggtgcccctctctccctatgctgcctctgcatccctgtccttccccttcctgcaaattgttctaacaatactcctgaggaggcagccctcgctccccagcccacttctctgtaaagattcccaaactgtgtcctgtgtttgggcccagtacaagctctatattgctgggaaatgtgagggcctttttggaaacagagacgcttgctgtaatgtagaggttggagctgacccctgctcctggagctcatcttctgatccgggtctctgaaaatgcgggcatgggcagctctcctacactcaccgcttccctcagtcacccagaaaagaaacctgtcttaccagtttggagaattgggacctttcctttgcttaacagatacttttggctttctcctgatgcccctaattcctaaactgttggccaaatagcaacctctatggggtggggggtttggagggtacaggggctgggagctggctgacgctttgaggcccaagtcactcgggaagatcacaatgccaagcgccacagtgtttcctctgccaggagggttcacttcccagtttctaaccagcctgtgtttctccactttttatttcag

SEQ ID NO: 64 - DNA, 9451 bp, Homo sapiens
  source 1..9451: mol_type = genomic DNA
gtaagtctccctccagcttctctctgggtgactctgggctggacgaggcaggcggcagggggcgggggagcggtcccagaggcagtgtgtcccggaagccatagctgcttgagccagcacttggccatgaccagagagggagaactggggccccggggacaagggcagcccctcaggagggcattgtggggagatgggggtaaccaaagcttggctgtagggccagcactgaggggtgggctttcctgcatcctggcctaggaattaataatgcagatgagtacactgagggaactgagacactcaaaagctctgaaagctgagccggctcccaaacaccaccctatgtcaggagcccagaaagaatgggtttcaagtcaattctgtttgaaccaaccctctcctagttagtgggcaggagagagccacagccctcaggccagtgtggggacaccactcccagggccatagaggggtccccagggtgtcttccctcctctagccccgggcctgggagactctcaacatgggagtctctggacctctctgtggtggccccacaggccacattgcccttctccttttctggaagactcagggccccagaggtcctgtcctagaccctctccttggccatctgccaatgagcccaggcttggggtccctcaggagattggggggagggtagaagatccttgcagggggaagcaatggtcaaaaaagggtgtcaaagccaagggtcaagggtgataccaatgtcatcttactaacaataaaaataacaatagctcacgagaatcgcagccttgctgtgtgccagggaactgtgccaagtggtttacgtggattggctcagggtagaggtcttggtctcagctcgtaagagaattccctcggagggttcaactgaaggcacccaaatgcagacctcactggtggaggggaagggaagggtacccacaagggtggcaaggtgtccagcgaccacccaccgtggggagctgtcacctgcccaggtgctgaagtggggagggaacctgagccggaggccaggagaagccaccaagtgggagctgtcctgtcaatgtggagagacagagaccagggcccaagcaggcagagagcaataggggagaaacaccccaacctttctctcccctcatcccttatctcctgccagagcctcccatggcccaaagtaaaccggaagcaagctgaatatgatgctcagagcaggcagggaagtcaggagaatagatctgggtgtggtcgggcctgaggaagagggtgttgcctcatttcacagatgggaaaactgacctcagctgggcacggtggctcatgcctgtaatcccagcactttgggaggccgaagccggcggatcacctgaggccaggagttcaagaccagcctggccaacatggtgaaaccccatctctactgacaatacaaaaaaattagccaggtgtggtggtgcatgcctgtaatcccagctactcgggaggctgaggcaggaaaattgcttgaacccggaaggcggaggttgcagtgagcgacggtcataccattgcactccagcctgggtgacaagagcgaaaactccatctcaaaaaaaaaaagaaagaaagaaaactgatcttcaatgcctggggaagtgagagacactcccaaggtcacaaagccaggcctgggtgactcctgagagtacactgacagctcctggggtgtcccagtcagatccccctacagaaaaggatctgtttgcctgctcttccgtcctagaaggccaggaggggctggggaactacacaaaagagggggccattctttgatatgtcctacggcacccgcacccaagtgatacacacttatttgccttcagctccagtgagccagaattttccccttcccctcaccctatccctgaaaccttcctctagagggttcttgcccacatgggggctctctccactggggtgcccccacctggtcattctcccctgtcctgagtttctagagagggctggagctccagctggcaatcaaaatatcttgccatccggctacatacaagacagccttgaaccaatgtccctttgggtcaagaggttagaaggatggtccagctccccagaagggcaggtggggtggaggaagttagctgaaaccttcaatcaccagtaagagagctgtagggacagactccaacagcctgttctcctggctggcaggaagatggggcatggggtgttcatgggacatcaggacccttgcagtagccaaacagcccccagccctccctaccagctgtttgatcttggacaacttgcgctatctcttctcatgtagagtggggctaaccattgcaaccaacctcagacacttgcaagactcacagtgatgcatgcactcaaaagacattcattgagcacctactgtgtgcctggtgtgattataagtgctggagacagaacgagaaggaggggtgccaaacaaaacagaccaagaatacagagtgtctgctcccatagagctgacattctaaggagagagacgggaactttttacaagtaaaagcatcaacaggccgggcatggtggctcacgcctgtaatctcagcactttgggagaccaaggcaggtggatcacttgaggtcaggagttcgagaccagcctggccaacatggtgaaactctgtccctactaaaaatacaaaaattagccgggcacggtggcaggtgcctgtaatcccagctactcaggaggctgaggcaagagaatcacttgattctcaggaggcgagaggttgtagtaagccaagattgtgccactgccctccagcctgggcgacagagtgaaactctgtctcaaaaagaaaaggaagaaaaagaaagaaagaaacgtgaagtgcttggcacagaacctgccaggaaaccaggagtttgaaaatggtggttgttaactattactgctgttgttattgttattgtgaatgggtgtgtagttttgttagccagccctgagttacagtcaatttgagggaaagatagggggtgggtgtttgggtccttctgggacaattaactcccaacctggagtagggagaggcatgtcctggcaggcaaggaggtctcagttgcccctttctgcctcccaggtaagcccactagttctgaggccagggcttggccaggctgagacaggaaatgccagatgcttgggcgggcaggtccctggggtttagggggcagagggcatgcggcagtactaaccagtgctgtctcagctgctgcccccaagtggctggggtgatgtgggtttgccctgtgtgcaatggataatgactgtgtttcttgtcttgtctcttttcatgcctgctcttaaaactgtatattggcgcaacgccgtctgaaaaactcatccaatcaaaatgcactatgaaattcatttgttcatccatgacatggtctgtgtgttcatacaccaatgacttatctcccaacccaccgccaccaccacccccactccccgcccgggaaccgaaacccattggttttttggcactggttacaaatcaacctaaaaaatgctgaacacgcctccccaactgcccccgcccgcccgctccccctcatcttcaacatctgcatctagaatccggttggtcttacttctttctgaagtctaaatgccttacattaactgtgaacgcatctcctcgcgtcggcattgcatgccacaccctgcctctccaacgtgggatgcctgacgctctcctcaaccctccgctctcctctgtctgtctgtcctcccgcccccagcccctgtgcctcccacttcctgtagactctgtctctctgtttttatcgggttctgaatgggggttttctgtttggggtggtttgcgtcttttgcagagaaagggatgggttttcccagcgcagcacctctctcttgccccatcccgcacacacatcccctacactcagagacaatagaggcaaatccactcccagccacctctcaccactcctgtcccccattcagctccatggaccccaggccccaggaaagctgccaactgtctcctcgcccctccagctctctccatcctgctgtccccaatcctccatctcaagcccacaagatctttggccttgaccagcagagacttgactctccaagtctgataaaggagacctgaaggccaggcagtgtgccggcaaagactctcaggcagaggaactcagaagtgccagacttggatctggtagcttcatgtggggctggcccactgaggccctctcctggagccttgaactgtacgtgcacacgcagtcacacagtcactgcacacagacactgcacacacagtcactgtgcacacactcagtcactgcgcacacactgtgcacacagtcactgcacacagacgctgcacgcagtcactgcagtcactgcacacagtcactatgcacacacagtcactgcacacagacactgcacacacagtcactatccacacacacagtcactgcgcagacactgcacacacactgcacacacacaatcactgcgcacacacagtcactgcacgcagaaactggacacacagtcactatgcacacactgcacacaccactatgcacacacactgtgcacagtcactatgtacacacactggcactgcatgtagtcactatggacacacactgcacagtcactgtgcacacatacactgcacacactgtcactatgcaaacacagtcactgcacacagtcactatgcacacacactgcacacacagtcactgcacacagagccactatgcatgcacacacagtctgcattcacacattgaacacacagtcgctatacacacacagtcactgcacacacagtctatgcacccacacactgaacacacagtcactgcatgtacagacactgcacatagtcatgacctcttctctttttctcactcattctccaattctctctctctctcgctcttttttttttttttttttagacagagtctcgctctgtcacccaggctggcgtgcagtggcacaatgtcagctaactgcaacctctgcctccccgtttcaagcaattatgatgcctcagcctcctgagtacctgggattacaagcatgtaccaccacgccaggccacttcttgtatttttagtagagacagggtttcaccatgttggccaggctggtctcgaactcctgacctcaagtgatgcacccgcctcagcctcccaaagtgttgggattacaggtgtgagccactacacctggcctctaatcctcattcactgttcctgtctctgtgtctctcacatacagtcatgcatgcatgcacgcatgcacacacacacacactggccctctctgctacatctacccaccctgtacccccactccagtacatactgcacacatctctctccctcccccacttctcagccccttgcacaccccttgttctgttaaatctcaactgcctctgcccctctcctacccaccaatgaggcccttagagggacgccccaatggcatctttgccctggaatcatcccttccctgctggcaatacacatgcattcacccaccaaacatttaatgagcccctatttggtgccacagatggaattatgggcagaagcagacaccattactgtcccctcttaccacatacagtcaggtgggggaggcaggcatcggtcaaataaccccttgactccacttaaaattatacctgcactgcgagctgaaggatgagcagcattaacaaggcagagagagatgcacagagcattccaggcccaggacagcacatgcaaaggccctgtggtgggacggaacctgtgaggggtcaggatctgcaagcgagggaatgtggctgatgcaaagacagccgagaaaggctggcctggagacagccgaagaaggcagaaggggacaggacccggggctggggagggcggggctatattgtggaatatgggctttctcctaagcaccaggaagggcctgggaggataggaagcaggggaggcgcgactggtcatgtgactagacaagctcgctctggttgcagggcagggaacagcttgacaggaggctgggctggaggtgggcaccaggaatcgcagcaagagatgacagtggaggagagagaacagtgggagggttgtcctctgcaggacccagggaaagatcaggtctgaactgagatgaggtgcctgggagcagtcgggtctggcttaaaactgggagataggctgagcacggtgactcaagcctctaatcccagcactttgggaggctgaggcaggaagatcacctgaggtcaggagttcgagaccagcctgaccaacatggtgaaaccccatctctcctaaaaaatacaaaaattagccaggcgtggtggcaggtgcctgtaatcccagatcctcaggaggccgagacaggagaatcacttaaacctgggaggtggaggttgcagtgagccgaggtcgtgccattgcactccagcctgggcaacagagtgagactctcttaaaaaaaaaatactgggtgatagaggtgagcgagtgcaaggaaaggaccaggttgggggaagagaataggtgtgggcatagcaagtttgaggtgcctttaggacatcccgaaataagtcagataggcaggtgttgtgggggctgcagcttggagctgaggtctacaagtagtaggacttttctggagcccttaggtgggtggtctccatatccttctgagcacttgaggaacatctgagcacagcactggaaaagaaaagaccacaaggacgctgtcctcatgtcttccaggggctgtgtcccacccccatcacattctagccaggaagttcaggggaggtgttgaagagaggaagctgcacctcccaagccatggattgaaatgtggaaggcaggaagagggaacttgtcagaagttctgggggcagtggaaagaattggtactgatgcaggaagagatggagggtggatgagggcagactagtacccttcccccactgccccaaacccttcccgtctccacccctacctgcctcatgtgtctcctcccccacttggctccaagaagggaagcatgttttctgcacgcatctccctgccagatccctggcttttttgcatggttgcaagcttcccctgctctcctccaaacccccctcctgaggctgcttccagggtccgcctgccttcgcatgcctggccgagtccacatgttatgatccgccccatgaaagggatggcttgtactctggggttgaacgggagggggctggggatacctgagccatcggccccatccccaggtggagctgggtggccaggcagggatgggggtcagggcagcagggcacagagagtgactctgttagccaagctgggtttggggcttgttcgaggcactggagacattctcacagcacttgagcccagtgtggtcagggtaggatcccccagcccccttccccatcctagaggcctaaggacgcactgatgtgtcccagagagcatcctagacattgccatcaaacccagaggcctcagaaattccttgaactccagtccttgcctctcagctcccaggccaaagccagcacaagacacagatctggcagccagaaagccctctggaagccaccaagtaggatgcccatgtcacccaaactaggacacttttgaaacaggagggaggctgtgactgtatggtcaccctgtgccatttggggggtgaaggttagaccaagttaaatcttgctacgtggcctgtagcaaatcctacaaatcccatagaacaagtctgattaagccccttcccttagtgtggagagaccctctactcctcctgccttcaccctgctgggtactggccagcgaaggagggtttccatgtctgcctgaggctggggtctcaaactcaaatgcctctgggggccaggcagacaccagtcaaccaggaaagcaagtgccatttctaaaacgtgaggaccctggaaaactggagatcatgtggcctgcttccagggagcaatcgcagcaggcctggggttgccagaaagccagattggtgggcaaaatctcttgatttttaaacaatggcaataatttttaattaaaaacaaggacaaatgaaaaaacactgctcgggcccaacaaaacagttttattagctagatttggcccactcgtgacttcgagagtcccaccccccccaccaaggtcccttgaagccccacaatggccacttaactctagctggtctcctccctgactctccaactctctggccccctggttcttctagcttgggtgggaggaggcagaggcagtgactagacagggggtttttgagcagaggcagtggccacccagggaggtcctgggggcagggatggccccacctcccggcccccagcacccgccccttggtgggcccgggctgatttctgagctcacccacccatgggagctgagtgcttcctgcttcctgcaggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaagggggtaagaaaagatgctcttccgcttctcccaattggctcgagccgctgctcctcttggccgtggggtgaggtcagggcgggcaggagcgggtgggcagctcggcagggcagggcagggcagggtgcccggtgagtcccgtgacagatgcatttctggcccggagcgtaacatgccctcggaacccgcacatgtccaccaggcctgactgtgctggcgacctccacccccacccccgccctggtgtttgtgcatcgtacacgtatgatagattccgcaacttgaccggcttgtgtcctttcgtctcagtgcatttggttgttgggagaaacaaaaaccatctcgatttttttcctgattggatgattcggatatattttctttttcttgttcttttgttatttcttccccatccccgttcctttttcctcctttctttttcttttcttttccccattgtgggtggggctggcagggagggcttatgcttttgagttgatgccttttcctccctcccaccctctctctcccaacattattcctttttcgagtttttcctctgcatcattgcattaatagtgctttctctctccctccttatttggggtctggcttgcttttttcctgttggttggcttcatgtaggggcctctgtgagtggtgacagctctgagccttttggggtgggtggatggtcacccctcttcctccatctccccag

SEQ ID NO: 65 - DNA, 2554 bp, Homo sapiens
  source 1..2554: mol_type = genomic DNA
gtaagaagtcaccccgaatcctccagccacaatactcacctctccctggaactggaacacgggctaggtcaggccccagactctggagcactgaactcctggggtcctagcaggggtctcacaggttcagtcaggagagaagatataagaatcatcacccttgcataccccagattaaacacgtagggtgccaaccctgcccaaaccctggactttctgggaaatgagggagggcgtcaaccatgagatgtcctgaagagccctctcctcctacgagtctctcctgtctctcactgtgaagtctccagatggtgaggatgcattagccaggctccagggagaaaaccaacagcatcccagcctcagttctcttgagagtgtggggaggagggctggcctacccttggcagacaggattggcagcaacatcagagtagcagaactcagctcccactgggacccgtgaacctgggagtgagaggacatacaggccaggggaggacgcagagcctcaggggcccatgcatctttgtggccacaaagggagtgggcgctcccatctgggtagacaccagaggggtccctctccactgacgggcaatggtttcagagggtgggttccaccttgtgcacgtgtattgagtgcccacccaacaccaagccttgaaggacactcagaggctttatctgaatacctggaacccaccagccactaactgaggatttagttcaggctggtcttggggcctgaagaagcattactggggggccctcagcagcctaagccccatcttcctctggcctcagcaccagagaggaggccgtcacgaggaaggtgggcaggaggtggtcttggctattcccatagcctcaaacaagtactccatgagaccgagaggctggggagagccgtgggtctggggctgggctttggctggttcctaactcttcctcttttgattttaggtcacagcaattggatgctgtccccaaggcctctattccacaagcccccccccacccctgtagcccatgtagactgtggaggaggcagatgcagagagagccccaggggaggtgccctgcagtcccgaactcgactgacatcctacacccctgggtctccccagtgtctgggaatgtactggggaccttcacttgtccccagtctctcccactccttcaagccagggacaccccagcctcgggcatcatgacctcgctgtgtgcccagggagcccgtgtgaacccattgcctgcactaaccccctttcttctcctttcagcggtcggattcattataaggatatgtacagtttattacgagtaatatctccccctctcggcttaggcaagaaatgtcctcatagggttgcttgcaaggtttgacttccactaaaacctgctagcatccatggaatgagtgtggcttggggttcttcaatatatatatttcatatatatatatatatatatctctctctctctctaaaaaaacagagccatctctctttcttgcattaaactagaaaactctcttagccaacagaatgcagtcatgtagactcgataaagcatggaacatatttcctccttcccttcagccttcagccatctttgcttgctcttagctgaagctgcccatcctggggtctccacggcaccccaaatcagatacatcccctgggggattgtaactttgcatttctcccccaaccatcacctccactctctccccctccacccctcacctcccaaagcccctagccctcctcccctccctggcactggcccctgctccccacctaggccccctcagagaccagcctcagccaaaccagagaacgtgacccaactgtagaaataacagtgatggccgggcgcagtggctcatgcctgtaatcccagcactttgggaggccaaagcaggaggatcgcttgagcccaggagtttgagaccagcctgggcaacatagcaagaacccccttctctataaaaaattagccaggcattgtggcgcatgcctgtagtcccagctacttgggaggctgaggcagaaggattgcttgagcccaggaggtggaggctgcagtgagctatgatcacaccactgcactccaacccaggcgacagagagagaccctgtctctttaaaaaaaaaaaaaaaaaaaaaaaaaggcaatgaacaaaagcatggctctacgtcttccaaagtgagaattctccctcccctccgcatccctccagaactgtagctcagagcccacgctgaatctgacttttctcttttctctctctctccctgctcccgagcagtgaagtaatctttttttactgaccttttcttccattttttttcctcctcttttccattgatttgaaatatctattttatcattctctgcatctttctctctctattttttcggctcgtgtggatttcttttttctttcttctgtttctccccacctctcttcctttggttctctgttcccattcccgttttgtttttttgtttttgtttttgtttttttcattttcggtgctgccag

SEQ ID NO: 66 - DNA, 3926 bp, Homo sapiens
  source 1..3926: mol_type = genomic DNA
gtttgacttccactaaaacctgctagcatccatggaatgagtgtggcttggggttcttcaatatatatatttcatatatatatatatatatatctctctctctctctaaaaaaacagagccatctctctttcttgcattaaactagaaaactctcttagccaacagaatgcagtcatgtagactcgataaagcatggaacatatttcctccttcccttcagccttcagccatctttgcttgctcttagctgaagctgcccatcctggggtctccacggcaccccaaatcagatacatcccctgggggattgtaactttgcatttctcccccaaccatcacctccactctctccccctccacccctcacctcccaaagcccctagccctcctcccctccctggcactggcccctgctccccacctaggccccctcagagaccagcctcagccaaaccagagaacgtgacccaactgtagaaataacagtgatggccgggcgcagtggctcatgcctgtaatcccagcactttgggaggccaaagcaggaggatcgcttgagcccaggagtttgagaccagcctgggcaacatagcaagaacccccttctctataaaaaattagccaggcattgtggcgcatgcctgtagtcccagctacttgggaggctgaggcagaaggattgcttgagcccaggaggtggaggctgcagtgagctatgatcacaccactgcactccaacccaggcgacagagagagaccctgtctctttaaaaaaaaaaaaaaaaaaaaaaaaaggcaatgaacaaaagcatggctctacgtcttccaaagtgagaattctccctcccctccgcatccctccagaactgtagctcagagcccacgctgaatctgacttttctcttttctctctctctccctgctcccgagcagtgaagtaatctttttttactgaccttttcttccattttttttcctcctcttttccattgatttgaaatatctattttatcattctctgcatctttctctctctattttttcggctcgtgtggatttcttttttctttcttctgtttctccccacctctcttcctttggttctctgttcccattcccgttttgtttttttgtttttgtttttgtttttttcattttcggtgctgccaggggccgcatgccttacctggacatgtatcagatgctgagacacatgtctccgcccctgggtctggggaagaagtgtccggccagagtggcttacaaggtagactacccttgccgaccaccgacgtccaggcactgggtttttttttcttcttcttcttctttttttttagtgctgaccagaaacacccggccgactctctttttccaacgtttctcttcttttttgtttttgattcttttttttcttttctcgagtcaactgatcatgaccatcccttgattctaagcagcacactgtgtccgtcctttctgatgagtgtcttcgtgttttgagactccattatggccgacatgccggggggagggggaggggagcgcccaggtccccttgcacctggtctcccaggtaccaaattggaaacaaacacgcttcttcagggagtcaaaacccatgcttcccacttctgcccacccagagcggcccccatgcccaggctggggcaggcgccttgcagagaggggctttagcccccgaaagcaggcgaggtcccgggtccccgcccctgccacgcacacctgaagctgatctctgacctagggccttggggattcgagaccttccaaggagcaccaagaacctctcttcccctcccttccttcccctggagtttcgtccccagcccccgtccctaatccccccaagacaccccaacatgcctctccattgttccagagtgggcaggcggccgcagctggacccctggacggtggcacactgatgcaggccatgcacgctgccttggcggggcctggggcgggcaggcaccatggccgacggggggtggtgcatgctggctgagagagcgagcgtcctgccgccaagcggctggcccgggccacccctccagatccctgtcctggaatctcccttggtgcccaaggacagatgctctgttccctccattcatccacaagaagttcagggatgacctttaaagattctccccacccaaaaagtattaccccatcatcctattctcccatccaccttgatcttccctgcgtccctatccatcaatgctatttgtacctgccccgtgttgccacctcattcctttccttcctctgtgcacccctcctcacctaacctatatgtctcccctccttctcaatcaaagccggggacaaggttgtcccaccagcatctcagacaatgagcctctcctggcacctgtcgctctgtgcccctccctgccgcccccccccccccccccggttttcctcaagtcgcttctctcagtctctgcttagatgaatgtgtgcgcatgtgcaagagagggagggcgagcccttcctctcctggtctttgtgcaggaccaccatgggtccataagacaactttgtgcaaatttgaaaaaggcaccctttccacagaacatgcctgttggaaaattgttgcaatctaccaatgtggtgagaacaagacactttttttctatcacctgggaagctgttatatttaatatacaaatcgggggctgggcgtggtggctcatgcctgtaatcctagtgctttgggaggctgagacgggaggatcacttgagcccagttcgagactagcctgggcaacatagcgagaccccatctctacaaaaagaaaaaatattttaattaataaataagtacataaatctatcatttccaagatgggagccctttgtgcggtgtacaacctgcacaactgtgcacagtggcccagtctatgtgtgtttctctatttcccacctccttccccaccctacccccagtgtcccctccagtgtcctgctctggatttaccatacccctccccatcttcaactctgtgtttcctgcccacttgtgtctgaatccccacccaagttgccctcaccccccttctctgtgccacttcagcctgggctggtgcacaccagcccagcatcctctcccatgccaccaagcatggtggacagagcccctgcctgggacatggggaatcttttcttccctgggctggaagggagtgcccctcaccccttccccctgccattgcacagagagccaagatctggacatgcccctgagatacacttcccacggagctatgaatgagtctcgagattccgtctgcatgcgcccctgtctgtgctgttctgtgtcacagcctcgctgcatgcctgcgaggggcctgccccgtcagtggggggctgcctgcctgctgcttctcagaggaatgatgtggtctgtgcccatctgctctgtcctggtctgggccaagccagggattgggtgtggggagccagtggcaccccccaccagcggctgtggtcctggccccctcagccttggctgttgcatgcactgctcaaatccagcttgtgctctttttctttggggtcagactgaaacggggccatccagaagaactctggggcagggcgggggtggggcaagggttgaggcaaaccctggaaatgccagctctcaggtcaagcaggtgggggaaaaaaggagagggcaggggaccagaagtacaagagagccttttgtgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtag

SEQ ID NO: 67 - DNA, 3369 bp, Homo sapiens
  source 1..3369: mol_type = genomic DNA
gtaagtcctgcttttgatcacaagagggctgatccataacctggagggcaggagtttgttacctggacaccacacagccaggaggacatgaggtgtaaccccctgtagtcactctggattgaggagctgggggtggggccatgccgtgtagatgaggctctgagaggccaaggcctccttacgctgcagcccagcgcctaggccagtgcctggcaagacagtggatgctcagcaagtagttccagaataaataaataaatgtgcccaggtcacatgctttgcccggtctgtggctgcgtgtgcacattcactggaggtgagggaccaggatcctgcctgcgctctcttatttatttattttttatttttttgagacacgagctggagtgcagtggtgcaatcatggcttactgcagcctcaatctcccccagttaagggatcctcccacctcagcctcccaagtagctgggactatgggtgcccaccatcacacccagctgatttttgtatttttaggagatggggtttcacccaggctggtcttgaatgcctaggttcaagtgatccgcctgccttggcctcccacaagtgttgggattacaggtgtgagccaccgcgcccggcccagcctgcacttttccgttaactctaggtcatgaagacttcccgtaggcattacatatttttccataagggctgtttttctggtggcacagactgttcggtgaagaagccatcattttgtaagccctctacggggtagatagatgtttgcagttacctcattttacataactgcaatagaagatacgacacattcatttagccaacaagtctttcctcagcgccatgtgcatttcgtgccctgctcaaggcgcagaagatctatcagtggaaaagacaaatcaacaaaaatccctaccccagcatgaaactgaaatcaagctcactaagccttaggattatctttatttccttagtgtaatcttggaggagaacaaatagatcaaagaatgtgcttcttagatgtttgattcctttttttttttttttttttttgagacagagtctcgctgtcacccaggctggagtgcagtggcgcgatctcagctcactgcaacttctgcctcccgggaagcgattctcctacctcagcctccctagtagctgggattacaggcatgtgccagcacgcccggtggatttttatgcttttaatagagatggggtttcaccatgttgtccaggctggtcttgaactcctgacctcagttgatccactcgcctcggcctcccaaagtgctgggattatgattcctattttgtgtccaccactaccagcgtttatggttgttgatttacagttcagaatgggtgggggtggctgggtgtactctcagtgcagcaatagaaagaaagaagtgacagtggacaaacccagaaggtctgagtgtcaaacatactcagtgctgggagctcaggaggccaagcagatgtgtgggcagccaggaggatgggctcttgctgccaagacaaacccaagagagcagtgggtgagaggcccggtgaggtcgggagtggctgctggagggtggagtgggcagggaagacaggcccgattcctgagggctccgtgagctcctaactctagggcatgagaaggagacgatgccctccaggttgtaaatggcgttgcacctgcacctcacatactggcctcattcatcctccgaagacacccccatcctgagacgcagagccgacgccgcttgtctccagtcggagggcccctgagaatagtggcgttgcggggaggtgctgcagaggtgggtcaggagttggaggttcattctaggacagtggcgtgtcctcccaggagcctcttgggctgtggaagtgggagtccttgagataaggggctccagggctatccctgcaagtcacatcctttttcttgctaagcgctctgggcctggccctgatcacctctgcaaacttctcaggtaacttcacagccaccgaggcccagtgctgagtcagcacacctgctgcagggaggcgggactcttcccgcctggctggccagatgcccgaactgaattaatgaactaatccccggcgctgtcaccctggggcttggctttccacctggccctggctctctacacctgccaagcctggttcccttctgccgagaactgcttctgagggaacctccctggcccctgtacagtttggggacctggcaggactgccttctgctccccgggaagggtgcgattggattccagctgctcttgttggcgcctgttttggccttcagggtagctctccctgcaaatgtggcactccctccatggcacaggacctctgggagctgggttcaccccaggtctaagggtcgcctcctggggggcaggacccaaggaccctggctgttcagcaggtgactgtgctgaagagggggcccagggttagccacggggtgtcatcggagctgcaaggcccagggaggggttgcgggtctggagaccgctgtaagccatgcgtgttcccagatgagtatgtggtgagcttggtgcagatagatagggggtgtcatcagcatctccctgggggaggatggcaggggcatgagggccatttaggaaaccacctggaccagggtttgagggtttacacagccagatgctgcagggcagggcatcacgagcctggccgacagcgcctctgccggggctctgagtctgccacgtgcctgacattttctgtgcagggctagacatcccgcctgcgctttgcagccattgtccctggtctaaggagtctctgccctgacacttttttgcttcctatggtcacatgctgagagatgaaaggaaatgtcatctccagtaaagcctttctgaaaaggtggacctaaacctttgttttggagtcagtatttgcttattttaacttttttatttggaaataatttactactcacaataagtggcaaaaataatagatcctttgtacccttctcccagcttcccactaacaacatctgccacgactgtaggttcattttcaaacctgggaagctggcattggtgcaaataaaccacaggcatgatttgctttttatagatttgtatgtctaagcatgtgtgtgtatgtgtgtttcaggcgtgtgtgtgggatgtgtgttaggtgtatctgtgtacagatttgtgtaaccaccacccagataaagccagttctttttttttttttttttttttttttccagttcttcgagtgttgatttgtgtaagacaatgtctgccagggctggtactattttttttttttttcctgaataattgtggactcctctgtttcag

SEQ ID NO: 68 - DNA, 1137 bp, Homo sapiens
  source 1..1137: mol_type = genomic DNA
gtaagacacggcttccctcccaggtccctgctcctctccatcctgccacccttccctggatgcctctcacgcctcacctgagaaccggcagccagaactgggaggggaggaggccagcggggccctgtgagcaccgcctccactctcctgcccacgtgccctcacgctgtggggcttcccagcctcttaatgctgtgaaaatcaatgcacactcgcagtgacagccctgacaggaggggcatgaaagacggtggctccctctctgtccctcctgtcccttcctctctggtgtctgtccccctcactgctctggggtccgtgagctccaacgggtagccctggccacatggactgacgtcctcttgggccgggccctgtgccacctcctatccaccctgactccctctgctgcttcccccaaactccagattgggaccgagtgctgcccaggtggccccctaggacttgctgtgactgttttgcccagaggcccctcggacagtaacgccacagacctcgctggtcaccgggcagccaggctgagactggcgctgctctgcacctggtctccggaggcggtaccagggcgggtgtctacagacccccatgccctgtcccctgcacctgcagggtttcctccatggcctgcaagctgcagcggctacacagctcccgagagctcagctgcccttggagggccaggcctggctggtgggtgcccccagttgggttccccagtgtggggtgattcacatctggtgcccagggtcaagatgccctgtgcagggctcctgcccacccccgtcagtgcaagaacaccatctccccacatacttggccagcctgccatgtgtacctgtgcgtgtgagtgtgtgaggggcagagagcgagcatgagaggacgtgtttatctgagtgcctgagcgatggctgtgtgcatgctcacacacgcttgttggccatgggggcgggaagtccagcccccaggcttccccctggggcttccagccagcacttgggggtctctgctgcaccagtgaggtccaggagaggggctgggcaggcagtgcgtgccactcagcaggggcgggggcccggtggggccctgcggggactcggtgactcccccatcccgcag

SEQ ID NO: 69 - DNA, 516 bp, Homo sapiens
  source 1..516: mol_type = genomic DNA
gtgagtaggggcccggcggccggggaagcccctgggctgggtgggaggtccaagtcggtctctgagacacgcacaggggccggcgacttggcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctag

SEQ ID NO: 70 - DNA, 5161 bp, Homo sapiens
  source 1..5161: mol_type = genomic DNA
gtaagtagatgaccagtttctatatataataacatgtttctgcattattcaatggatactttacactttgcacttggcaatcaaagttgattgttttcttattgagacttgacatttttgcactgtattatgtctctttctgaaattctttacaactatcctctcaacagagccttttctacattcaacagaatctccaggaatagaagaaatttaatttggatgacagagaacactttaagcctttctcaatatacttcttatctatgtgggcttatattaatgtaaaaactttgaagacacaggatttgtttctctctggggatttaaagatatgcataaacttaggaaatgggttttggtttacttttaaatgttgaaatttgtaaataaccatcattccttattctctcctggctggttacagaattcctacgttgccaggtgtgtttctgagttatatagtcacaaagatcgtatctgggattttagggcttgcgttagaaggaaaatatgtttgccttttgatcgcgctgtgggttggaatgcaccttatctcctgggagccctttgcctgaacaaagagctggctccatgggaccgttcacatcacttcactgaaccacccaagcaaggatcctgctggtttagtgacatgagaaccttggggaaacccggcctgtaggacagcagcaggagtagttcttcccctagatgaggctgcatcccccttttctttatgacaacttcaaggctaaacaaggtagagttagccgtttttatttatttatttattttagagacagggtctcaccctgttgcccaggctggagtgcagtggcatgatctcagctccctgcaacctctacctcctgggctcaagtgatctcccacctcagcctcccaaataactgggtgcacgccatcacacccagctaattttttgtatttcttgtagagacagggtttcaccatgttgcccaggctggtctcgaactcctgagctcaagcaatctgcccacttaggcctcccaaagtgctaggcatgagccactgtgcctggcctagttagccattttgaatggttttggttctagttttacttcatacgtaatttattcttatttatttgaagaggaaaaagacacaatcaaaatggcctgttcagatggacttcactgatttcatctataagtttagtagattagacccagtgtttctgaggccctttctattatgaaaattatagaattatgactcaatgggaagtagattaggtagatgttcatagcaatgtgtataaataacctgaagtaagcatttttatctcacagatgttctagaaatgttaacaaataccttcctagataatctttctagatcattctttcacttgcttgcttgttaaatttatgtatttccttataaaataaatatgagttcattatagaaaatttgagaaaaagaaaaagatcgttttaaatcttaataccctaccacaactagtattaggattttggtatattttcctccagctgtttagcctatgcatatgtttgtggcaagaaggtggggtttttttttgtttgtttgttttttaagttttaaattagagcaatccttttagtacgattttgtattctggcttttaacagtttatctatctatatctacatgcacagaatatgtatgttactacaaatactttattatcttcaatcctaatggctgcataatatttctgaagtagtcattaaaaaaactgcccatatttttaactgaagcttacttttaaagtgtcaaatcaaaatgccactcagtcagatactactataattgttacttaaactgggtgaacaaatagacctgatttaacataggaatacttaaaatgtttaaagtgttaataaaacttttatcattgtctgtagaacatgtttctctatcatgagcgttaaactttggctacctcctgaccactgttatttttattttgtggtttttgttctaaaccacaggtctcctggcattgtggggtgattaagtggtagaaagtaggaaagattaaggaattgaaggtgtttttgtatatagatttagattttgatgtttactgtagagcaacattaaacctaaagtccctggctcactgtggcacaagtagagtatacatgttggctgactttattattcagaatttagttaaattttagatattttagtaatatagattagagtaaaaaggaaaataaccattctctaacatcctctcgacttaaactttttattaggttttcataagtttcctttttgatattaaagtaactgtagaatatctctgcataggccataatgccttaagctttaccaacccaaaagttgtttgtatctctgcatcttttaattaaatgaaacataaaatttaagggctttgggatttccaaagagcgctcagtacagccttccaaacctcagagtcctacgcctgacattgggttaactctgcctactttgaatgagcatttaaactgttaatagtttttcactttctagaactcagcaaaaagaaactacatagaataagcttcaaaagatttaaggcattgtggcctttgcataagattccaaaagaatgaaaatctgatgcccagtgtacatagagacgcatgacatgttaaagctgaggtggatcctaaatctagttgaatttttttattcactggtataggaactgagcccaagcaagttgtgggcttgcttcaaagcccaaaaatcacataatcaactgggagaaccagaactgcgttctcctaaataccaagtccaggctcaattcataccatggacccgcctctgtggggagcctctaggagctctcctctggcctcttcagcgatgcaagttaaactcttcctcgaggttcctgtcattggaacaagaaaatttgtgggatgttttactcaaatccctttttacatatacccttaaaagattacctaaatacttgaataccttcatagacattctagttctctgacaattgagatatccaaaacagggaaaagtggtgacaaaaaaaaataattctgtattgtaaaggtgcctgcttcgactcaagcaaatctggaagctgccttgggaaatctggctttggttacatatccagagttacataagtcctcagagcatatggtgactttgccaacttggtaattgtatcctagttagttagtatctcaacttgtgatgatgcttccatttaaatattgaaatttctgtttcttctctttgaaaaccagtatctgaattgtgctagatgttttccattgggtaaatatttctagcagtacagaacaaggcctcttactcaacattagtatcccaccacagtgatcaatacctcttcctagtgatgttttcaggcttaaaagttgaccaaattcgaaagggtttccagtatgttgggattttttttctcctaataggcaaattacatggtagattttttacttgctgaagtcctctctagcaattaggagaagattgaagtttatcagtagctctttaacacagttctttataaccatatttctgatagtaagtaaaaattatttaacgttttataagcttaatgtgagtaggtgtgtctaggtctcttggcattcctactagaggtattgatcatgatctcacattatatacttagaagaagtttgtgcttgtcttgaatttgcattattgacatcttcacatccaggtgagaattggcacagaagctctagatgcacagcaccgagattctttcagtgactgttaatatttagcaatttgagggcttccaagggctagtagtttcaataagagcacttttttttttttttgcaattagtttatttgtatcttatattgcagacagattccaccaacggggagaatccaagcatcaagaaatccctctttcctctttttaattcaaagaatcatttaaagcatagttcttctttgaaaaagcttcctgtagtcactccacccatggtacccgtttttatgtatggtagccctgaaaactgctccagtaaacttgttttactgatgacaacagcatgtcttattttcatgaggtcatattctctttatgctagttaagtacgtgagccagttccataaattcactgggatataaattcattgccattcttctgaatcagttaagaaagttgaagcacaaagtctattaagcaaacaaactagtgaaaggctagtttgtcatgtctgattagccagttatgggcagataacatttataaaagcctgtattttatgtaaggaattctgttaacatttacagttaacaaatatctttgcatttgactcacagagtttgttaacacttgattggcaatttgtctttttgaagccaagttgaattgaccaaattgaatgagctaacaggctccatgaaaaaacagcttgtttccttgtctggcttgagcttttgctggtcagtttaaaaccagggcttttgcttggcatttgacattactcttctgtgttcaccaaaactggtgaatagagcaattgcattcatctggaatttgtggcacagatttccagcatttctctagtacataatgatagatccagatatatcagacagtggtttgggaatatgatccaaaccatactttctcactttgctatccttgaaagcctaccagacttctttggcactaccatatacagtgtttggatcattttcccagcaggaaaaaatttctgttttattgaactggttcacaacctaactgcaatatggaatgaggatacgacagcaattcctggtacagccctatttaactgctctctcttacagcgactaaaactaacagcatgggaatgctttaagggttgaggtttaacaaagctgcatgacatctgccaatttttcctaatgcagggaaaattattaagagggcagaagaatttaactagcatcacttgcattgtgaacattgggagagattggggttctatttttactgggttatttgagttttggtttggtttgctttttagtttggttctcctcttgggtgtggttgcatatcttaattaggcttctcagtgtgcttattgaatgcttgtccatattttgctctag

SEQ ID NO: 71 - DNA, 2026 bp, Homo sapiens
  source 1..2026: mol_type = genomic DNA
gtatgtagtccatacgaaaagaggtttataattaagatagtaaataggaactctactactttatatatttttaaggttattatatttttctatgagcatttaaaaaagtaatacacaagtacctgaaagtttaactatgatggaaataattaaatctggataccatattatctccttaacattgaaaaatttaaatgaagtataacttctctgatagagtataattatgggagagtgggaaaacagtatgcacatatataagtattcacccaacaagtcttcacgacattctattttgtgcagagtatcatgggagttcaatgtgtcaggaacaataggaattgtaaccaatttatattgtatggtaactgttttgacaggttttataaaatttaaggaaagcaagactttcacctgcttataagttttacttacaactaaggttacttaatgtcccaggtctgcaaattattcttaccacatggattaaaaatactactctttcagaatcattgactctgttccttctaaccaactactgggttttcattgccaaaatcatcactgtatatcctcagtgttattttatcccccttattctctgctagatgaaaaattattttggagaaaaatttatgtatgggaaaaccaggattagatcactataatcgtatacttcataaatataaatgtaaccaaatattacaaatggaataacattattatttccccattttttccttaatttgaagcaataaaatataatagtttaaagcttagtcactggagtaagcctgcctttcaaaactctaccacttaacatttatgggtatttaaaaatatatctcttcactaccatttcctctcctacaaaacagacacattttatgtgcatcatggattggcaggaaaaataaataagacacacatctgcagcccttagaagagaccttgagatatagtagataccaaataagtataatttcttatgaatttattctctccttagtcactacctgagggaggtttttcaaatacatttttagcccttcaatcattactgctgatcttatcacacataaccaaataggttataatatcctggggctgaattttttaatttgctaccttcctcacctctgaaatatttcttttatcacaggcttgtgtcctctctttaagttcagcacttgacttggctaaggagataaaaatgtatagatctgaagcctctagcaatgattgcacattttgcacatgtcccagggaactcatattcaagtagagcattttttagattcaaagggcaggcttgatgggttactaaaattacttaagttcaacattagatggcttggatgagcagatttgactcactgggtattctcaggaaaaaatctctacgatagagatggagagatggaggcaagtgctgaaagtaaatcacacactaacaacttttggctggcactatctttattatgtagaaaccctaaggtgttcagaaaatatcagaatcatggaggacagaaatacggtctaagactggaggagagggaaacataaggttagtcgttggttactatggtatttttagcttttgttttggtgatagttcatggagcttactatattattgaatttagctaattagataattcaatgaaaaataagaatactttgtatgaaacaataatgattttgtcgtgaaccaaggattatgattattttcagtccatgcaccaagaaggagagaaagataaagggagagagaggttaagagatttttcatctatgaaaattagaggaagaagattaatgttctagagaacgttaagaaatctaagacagagtgaaggaggaggagaaggaggaaggaaaaacaaacaagaaacaagaaacaagaaaatgcatatgctgttcattttccttaatatggagtttctggacactcagaatggcatcgagtttaaaactgcatgtaaacacacattatgtcaacgttctgttattttttggttttcag

SEQ ID NO: 72 - DNA, 1095 bp, Homo sapiens
  source 1..1095: mol_type = genomic DNA
gtaagtaaccctaccatgctagagatttctagaagatttgttgtgtaatatttttatatcgattacttatttctaactattttcgagggggcatcaaattagaaattagtatagtcattcttggaaatacttccatctttagcagattgtggcactgtttcacggatgaagataaagggaaaagacagtagccaggtgaaattttggggaaactgtaggagaaatcttaaaattctggtatttaattataggtcagatttcattacaataaatacccaggtgagtttgttaatgataaaagcattccttggccttagttattggccctttgtttaaaagtacatttgaaacaaccatatttcacttcctcacgtaaagattgaatgtcaccttggtattctttgtaatggaattaaacattggctgttcttctcccacaaaatcgagcctcccaccctatctgttgcaagtagcaaggccatggttggagctataagcagggaaggctgactggctcaaattttggtaggatttgctccatgttgtgctcctggcagttcaacagtgctcatcccatctggttttaggagggtgacagcaccctgccttaagcactgagaccagattcagtctggcaagagacccagttgttgtagcaaggaacagatcatgtcctggcgtagctcagtgctctccggcaatgctctaagaagcattttcaatctaaaacgaagctttaacctagctccagggattccctgctcctggaaggaggaaatccacgacggctgggatgctctagcagatgaagccacaagcccctcctacctgagttgttctaccctgttaacagcacaggtaggagccattgggagagctggatttctccatcccattttgtaaaatgagaacggctcgtgagggattttcagtgactgggagccatggacatgagataggatctgaggctttatctatattttgggtggttggggagggaaaggactgtgctcagtttttgttgtctctgtttatcctgatccactaaccaggatgtgggtggtggcgggtgcttctcttcctttcttgttgaag

SEQ ID NO: 73 - DNA, 42007 bp, Homo sapiens
  source 1..42007: mol_type = genomic DNA
gtaagcatattgaacaaaggaaaaaaatgattttatgcttgcatacatgtagctatcacgtatatttgaatatttcacagagatgctggatatgttatctatgatctggggccactgctccctacacggctttccgagcggccaggcctttgagaagcagctctgtccctgtaagccagcattccctggtttggcatgcacacgtgcacacgctggctagcctgctacttaagacgcccatgaagttgtatgttctcggggcctagtgttgtttctgtgcatattggcacatggagtattcttgcataaggcagtacctttgttctctgaatggcagcagttatgaccaacagcaggaagtgctggcctatgggatgcactgctggagcccacagtttggacccacatcctcgtctatgttccctgttgtgcattggagagttctgtggcagagatggctgcaggtgagcgtgaggactgtcatctctagctgcatgcagaaacttcccctgcagggtatatacctgatttctaatagtctttctcctgaggtcaggaaataagggacacgtcggtaaaccaagacagtctgacttgcagaccagatgcctaaaaggcaattattcaggcagggtaagtttctagaagcagtaaaatttctcgttaaactgcatagtcaaataagggatcccagaacatttctgactaataaggtgtcagacctcataaataacatcatgaaaagaaagttatttcctaatcatgaccgctacctttggtcatgaagaaggaagcccaggctttcctgatgcagggaacagtgtgaccaaattgccctccatggtcactcggtgatcccgctggacaagcaatgtgttgtcctacatggctacttccagaaggctgggcgatgctatttcttgtatggacttttcattctgcctctgtctttgcatctgggggccggccacatttcacttgaatcattgggcccgtttctagaagagtatcctcttctcatttgctgccacttttctgcttctcaaattagttcagacaactgagctttgaaaaacgtctaaaataggagtaagtggtcccctgttgaatggatcaaacatgtgcctttccatgcctggactttgggtcttctgtttcttggggggctgtattagtttgccaaggctgctgtaacaaagtgctacagactcagagccttaaacaatagaagttaccctgtcacaattgtggaggccagaagtctgaatgaaggtgttgtcaggactggcttcttctgagcctctctccttggctggtagatggctgccatctcactgggttcacgtgaccttcgcttgtctctgtccgtgccctagtctcctcttcctgtaagcactgcagtcaaattagagtagggccccatgctcatgaccctcttttactttaattacctttttaaaggttctgtcttcaaatagagccacactctgaggcaccaggtattaggatttcaacatgtgagtttgagggagatgcaactcagtccataatgagggcattgtatctgactttttgagggcaaagggtcagggttgaagaagtctccgtgttaattttagctgtaatatttacagtctgtataacctttgagtctcagatttctcctttgaaaaacggggaaagtgccggcttcacagagttcggaggatcgctctgtggatgtgtgtagcacacttagtctggcacttggaaaagagcacacattccgtaaaggcagttgtgtgtttacaggcagaatgatgaggattcctgcttttagaacaagatggtaatttaacaatttagaaaaaaataatcaatgtttttcattttccaattcggattttttaagtttgaaatcaagaataaattttataacattcagcctgagcaatgtacgagacccccatctctaacaacaataacgacaacaacaacaaaattagctgggcatggtgacctgcacctgtagtgccagctactcaggaggctgaggtagaaggatcccttgagcccagcagtgagctttgattatatcactgcttgccatcctgggtgacagagtgagatgctatctccaaatatatatatatatatatatatatgtatatatatatatatacatatatatatatatacacatacatacatacacacacacatatacacacacacatacatacatatacatacacacacacacacagagagagagagagagagcaccccaccatattatatgtataacatgttggtggaatcttattaacacggttacaagaggcagtttatatggcctatgtgtaggatctttaactccaaaatgtaaaatgtttgatgattccaaatgctctggctaatgaggaatttccaagttgtaattgaatttcaaggagcaaagatagagcagtctctacctgacaaatgttaccagggtccaggcccttagaaatgatccccacctccacatgcctgacccagctgccggtgcagaaccccatcgctcacacatctgttgagctctactgaaggatcctgctcgttcctctttcccatggtggacatagaccacgtccgccaggcttcatcatggaggatgtagaggctgcttcaatttctgcttttgttttcctgagacatggaatgtaggactttctttttgaagtaactactaaatatattttgaagtaactgctaaatatatggcccgcaggtccacatgaacccaacgtggaatgaatagatttcagagaatatttaaaccactcatagacacttatctattgctacagaacaaactcctcagaactgagtgacttaaagcaaacaactcagattattcctcatgatgccgtgggctgtccaggcccatgtggctggttgtctctttcacgtggcattgggcacagccatgggctggggctccactgggccgatgtgctgaggggtacacttccacagcggggcaggtctgggctgagctggtggggacgccggccctggcaggaagctcagccattcagctggggactgtgcacccaccccttctgggccttttccacaaggctcggtgtcccccagcttggtggccagcagtgctctgacaggaaggaaggagaggctgctgggactcttaaggactgagcgtgagggtcccgcaacagcccttctccacattctgttggtcagagtaggcaggagcccagcttggagtcaagaaaggggaaatcagcacccctatctagggcaagagggaggccacagggtgctctggggacactagtgatcacagctaaggaaggaaagcggtggaactgcaagggtcaaagtaaagccccaggaaaccgaaagaccagaagaggcgtgcattgtgaaggggaaggcacgctccgccatgtgcctgctgaaattggcaatgtgggaggagaagcaggcaggaggagagagcttctaaacaagacagatcttgtcatctctgcccccccttgctggctggcttccccttcctgcctggacacactgtgcagcccccaggtatgtgctgaccagcctatccctaccctgtagcctcgtccactctccagccctactgcttgtcctttggctcattgatgcaccaatgcttccaggcagagtgtttatatgagcgtcttgcggggcgaggaatgcccaccccttaactcccagttagcaagggaaacctccctgacaccctcacccctgccaagtctagaacacatttctctgtcacgtagaaaaggattcctgtccacgatggcacttagggtctgctacctcttaggggcacctagcagggcacttgatacacatttatgcaaagacaagatggagagaggaagggagggtgcaggaattattaggaggaggagcgaagaagatggatcagtgtaatacagtgcggctaagaacagccagagaagaaagaaagcaaaggaaagaaatcatgtaggcaacctagaaaacattcaactgagactgagtccaaaaattcacacaggaaatagcaaaaatagtcttcactactaatatcctaaccctctgatattctgttattggggattttgagagataccgaatttaatgctttctgccagcttctaggcgtggaaaataatatgttctgcttagtagactcatctgttagttcattatggtctgaatggagtcgaggggcttttcctaaaggagggggttaaatgcatcctgtgtaagccccagttttgaaagcagtgttgatgtagctcagctgaagcctcccaaacatgtctgtcctatttctcactctattctcgtttgatattggagtccccacgtgagtcactattgctttttgagatataatgcattttccatgctttaaagtggctgggtcactgcaaaacagccatctctgcatcatttgtggaatgggctgctgtatttccttgatgggtgggtaacaagtcatgctgctgccagccagctggccaggtcgctctgaggagaggatgggcacgaataaaagcgtctctgtctggtgctgatcccagtcatttctttgttgctttattttgctttactttaagcctgcggctcaaggagttttctgaacaccatcttgcctaaagtgggtagcaattatggatggcttgccgtgattttcccctttggatggaattaaaggccttgctgggatcagcagtccgcttgcagaaggacagtctgaatcccgcaactctgcggatgcccctacaccgtgcagagacaggcaactgcctcaccctctctgggcttctctgtttctgagttgctcggtcagaaaattctattgcaataatggaaatcttttttgatgaagatatttaaagatgtttttgttggctctgaaagtttagaacagcatggggtttcagccatccattttcattgagtgtgcaaagctgcatttgtcatctgcagggttgtgtctttcactcattttcctgaccctgtggctgatagcagaggctggagaggggacctctatgcaggacacacttgagagcagtgtggccaagcctgtaagcactcataattgtgctcatcattgttgccaagcgtcttagggaacctgggggagccaacccaggacaaggattcctgagcatgtagcttatttgggaagggatcctgggaagcaggatgaggggagggggagtgagatagggagggcaggcaagccgttggagtgagcattgaaaagcaaatcatactgcgggcaaacagagcccattcctactggggagctctgggagactgtgtatagcacatctcagccttgttctgaggaaactgggatgcttatctgccagctgccttccatcataggctgagagctgcttccaggggtgtcagctccctggcacctctggcttgcctgccccatgtgtggatcaagtgcagagctgcagatgcttgcagtaggcagctgtcagggccttgggcacaggaggatgattgtcgacatggtctgctacagcgcagatgagccatccactcaagttctagttgctttcaccctgctttgattgtagatccaatctcagcttctggtagggagcatagcaacaatatgggtggaagggagagagtcctaggacttgagggtcctaggggtgagggtgttctcagccagagcagaggaggcaggcaggtggcaaatttcactggactaaagaagagcccaagcctgcatcccagcaaggggtgcctattctacgtgggctgcgatgtatctattatggagtcatggcagtgcacacatggaatggcatcttagggagtgaatctgtgagatgtagtgttgtcatggttaatagctcctgaaattgtggtatccctcagcctaaccgagattggcctgctggtgctcaaaggctcataatgcagtcatggccaggctcttggagggcccaagggcatcactggaaggtgatgtggttgctatagtttgaatatttgtcctttacaaatatttgaatatctgtcttctccagaatttgtgttaaaatttaacccctaatatgacagtattgagaggtgggacctttgaaggccaactgggtcatgagggctctgccctcatgaatgctttaatctattcatggattaatggatcaataggatatcatgggaatgggactgataacttgataagaagaggaagagaggcctgagccagcaccttcaggcccctccccatgcgatgcctggtaccaccttggcactacagagagtccccaccagcaagaagccctcaccagatgcagctccttgacctcggactcccagcatccatactgtaagaaatgaattcttttctttataaattacccagtttcaggcatcctgttataagcaacagaaaacaaactaagacagtagtagttccaggtgagcagaggtaattttgctgctggagatctcagagaaggagttttgaggatgtgctgttacagcttctgtattaatcagatattcacacctgagctggagggaggctgtttctaaatcatgtgttgtgggaagagggggagcagcagcttgttttaaagcagtgagtggagccagccaacctatgtttgcatcttcaaagtcatcctccgaactgtccatctcactctcccaggtctcatcatggtcgctcttgctgtttgtttttaatttgttcattcactcaaccaatatttagtgaaggctccctcagcataatcacacactgttctgggaactaaggattcagcagtgatccagccagacccaaacccaccagagaaacagagatggggaagagaggagggaggcatgggccagattgtaggtgatcccagaaaaatgaagcaggaaagggaatagtgagggctgagccagaggtcagggagagaccaggagacagactagagggctgcaaaggaacaggccctgtgatatcaagtggagagagtgttcctgacagaaggaacagccagtgcaggggccctgtcaagaaggcttgtgaaagacttcgaaatgcaaaaaaaaaaaaaaaatagtgagggaagagaaaaaaagacacctcggttcctacagaatactaggcatggtcacaggcaccttcctggtcatctgagtctgtagtggactgtgcctgtcatggtcttcaaactagttttcaactctaacttctagaaaactgatggcaaaaccaatgattctagtccacggagaagcaaatgtgttttgctggtggaccaattcccctgttgacagattcagatcagtgtgcctggttgtctttgtatgtgtctgcttttaggatgctctgcagaattggttttaacattttcctggttccttccttcattaatgacttaagtagtctttgacacacgatcactttatatttgtgcaagtgtcatgattttatcttttaaaaaatccatcaattgccctgaggcgggaacatgctatccaggtctgtcctaggagcaaattcagctgctgtggctggagagaattggtggatggggaagccagggttcagagagagggtcagagacatgatgggaggagctggggaccaagtcgtggaggccttggctttgactgtgagacaggagaggccctgatacctttgacagaatttttgtttcagttcctttttgctttgaacattttaaaaaaaaatatttattcatattctcctcttgacttgttagcaattgattcccatcaggtgattttgtccagaagttattatctgttcttttctgcttgtacactcctcccagcctgtggcagtgggcaggttttgcttttgttgtttcttctgacatctcagcaagaggaagggaggaagggcaagtgcgtgtgtgtccttaatcagcctctgatggcccagctgtttgcctcgggctaactcggagcccacctgtctgcaccagagtgagtggactgtcgctggctgactgttaatgctgtctgcctcatccggtgcttactgaaggtcccatgcactgcgttcagcctacttgcccgcagctcctggtcttcagcaccctggagccaagccccctttactgggcactcgcccagtgccagcagatgatagccaggaaattgtggctttatgccttctttctggactttatgaagtctgtttgagtgtccacaaatctcagggcgggaagctggtgctcagagaggttcagccacttgcccgaggtcactcagctgggtctgcctgactccatagtctgactcattactggccagtctctcgacacatcaggaaagagctcggtctcttgtgctttattttctaaagttaaaaagcagagagatcccctttccctccctctgagctggctccactttcgcacctgctctgggctgctctgccaggctcagccttccacttcctaaaaagagtgagtttgttttctctgaagctgctgtggggttttcttttcttttcttttcttttctttttctgaagctgctgtggggtttactgtcgcctcttgactgatttcactcagcatctgacattttcttttctttgaccaaatcccctgccagccagtgtgggccacagggcagtgccacagcagagcgtggaatgacagaacccaactgctgtctgtgcaagagtttgagcagaatttcaagcagaggacaggtgctgcggtgaatagaattttgtggggatggtgttgcattgaggtggcctgggtgaggctgtcttctggcatgtggcaacgggccagtccacggagcagctccccaaccccctgcacccccaagggccctgaagctaatcgtgcccaagagcacggcttttggagatgagcttattgatctttgtgatgtggaacacagagccagcacggttgtaagggctgtgtgataaatacatgagacaggaactcaatgggcggttcagtcttcatcatgagctgcctgagggagcagtgcgggcagccaggtgagggccagggtccgccgccaccccgccccttcccgagcctgctgtggggtccctgcgcgtgtccactgcccactagagatgcgctcttcagctgtctgcacaggaggagacttaggaagttgtgtgtgaggcatcagaaggcagctgggcctccccagcatgctaagacctcagcagtgcagggtgtggggcccgagctggatgtgccccattgcttgtatcaaaacctggagaaacagagctttccttgtgggccagggccacatggtcggtggagctgatgctgtcagtcggccgggtggtattttctggggacctactctgtgtaagacactgtgcttctaggaagacgcacattcactgccctcgaggcatgtgtaatcagtagcaaatcagtttaccgtgggtggtctcatctgacgtatttttgtgtccttcagtgaagtcatctaaaattactctgcttcacaattgaggaaatggttcctgaaattaaatggcttgttgacgcagttctgaggccttgactccacatcctcgtgcctttcccagtccttgacaggctctttgtggctgtaagacaagggcacaaagtgcatcttgcagagcagaagatgacgtatgtcagggacataacatcttagaaagatctggaagagagagagcctcatccagtgggagggtgtgggcaactgttcacggcagggtggccatacgtcttggtctgtctgggacagcccgggtttgtgcctgaggtcctggcactgctgttaatggtgccttttttcacttttaagatggggcatttcatggaaagatatgtaagttaggtcatatggcacagggcccttagcggggagggggagagatcaccttggaagggactaaatgtggcaggatcctcaatgcatatgcttggaatgaaagggagagggaaaagaacagaataatcaggtcagggactagctataatctaaggaattgccaccagtccaactggacttctctggaaatctgtccctgacgcctggccacagtcgcctactctgggctgctgtgtaccttggaggactctttgtaaacatcacacgatgctgcggatgtgagtttgatactcttgtttttccccactgtccagtgagctccttgggagcaaccaagttctattcacattttgtaatccccccaagttagtgtgacaagtagcacatggcaagcagcacatcgcagtgggtgagggactagtggggccactaccctgttccaggagggagttgctggaggccagaacctgggcagaaccttggaactcaggctgtctggatcaagagagccatcttctagcacccttagattaaaaataagtaagttctgattgtgtggggcagggatgtagggtatgggtcctatcccgagaagcaaattagtctagaaatgattctcctttctcctccactacccataccaatctatcttgaaggattatgcatttgaaattactctagtcatcttttcacattatttgtggtctttttttaatataaattttacatccttagctaatcacatttttgtgttgtttcctttatggatcctttatggctttggggtcccagaccaggagactatccatttattctactaaatagtttgttttttattgtgtatggttttttttccctaaaatgtttgtgtatgctatgaggtaagggtctaactttacttttctttaagggatagaaaataattctaacagcacttattgagcaatacatctttctccccatggcattgaagtgggatggttatattcatttatgcatgtgccaataccatactgagagctaagcagggtgaataaaaagagacatatgtcttgaatatcttgctgcgattttaaaacactcatgataaaggcaaaacccttataagctctcaaagcaaaaaaaaaaaaaaaatcacaatagcaagaaacagtagcctagtagaggactactttcaaatattgaagggcaattatttttaaaataaaatattttgttgaactgaactttctgggcaaaaatgaaagcagttttaaatatgtaaagactcaagtctgaaagaattactcagaattgtattccagcaaaatgagaagaaaccaagaaagaggcaaacctggaatataatcagcactcgtgagtgatggaatcactaaaaggcatagttcagtctaattatttgatgatgttgttaaatggtttttgttggcaggggactaagaagtagaagaagtaacagcagacgtttggtgtcggccttctttggttcatgcatgataaagataaacctcgttaaatgcacaaaatgaaaaaaagtacaagtaaatatgtatgttaaatatttgaatagctatcagagtaacagaaatagtgtcataacttccagaccactagagataaaataagggaccaaaacctgaagtcgatacctctaatgcaagaacagaaaactgagaaacagtgtaagtatgaggtctctcatggatccctggcatgggtatgaacattattttaaactgaagacatttgagattaaacagatagggaaagaagctttttcagagcttacttatcagactacagcaaaaacttctgggagcgagcctggcataaatctcctttctaggggagtctttactggctggaaagaagatggaaaagaccagttgcacctgcataaacaaaactttcccacagaccttcttatctcccatttgctcccctagaaaccgatttgttcttttcatagaagcccttcctctcccctctctctccgctgtgcagtatataatctcacctttagctgtttgaagagttgcatttttctttgtgcccctgtgcccatgtaggcataaaagtcagttttctcttgctcatctgtcttttgtcagtttaattcctaagctcccccccgccaaaagaatctataagggtagaggaagagcatttcttctctaacatgagaaaatctggccaaaaaaaaaaaaaaaaaacagcctacaaaaaaccagaaaacaaacctactagcagaaacgagttaaaacaatcactaatcacaaaaattcaaatggatttaaatcccataacagttctcaaaccaaaacagactcctagatgggtttcaaaaaatcaaaatccaactatattgtatatacagaaggtagattttaatcaaataatccaaaaggttgaaatgaaaaggatcgaaaaaccatgtctgccaaatgccataagaagaaacagatttagcattgttcttatttcacaaatatagatgaaagacaaaatacgtaaaaagggacaaaatgaatattttatattgattaaaggaaaatttattgagaaaacaaagtgctcatgaataattatgttgcagtgtgactgcaaaaaatacagtcaatgctgatgaaagtcaaaggagaaattaacaaaaaccaggatctcaagaaagggtaagtatgcttacatggaatgaaataaaacagtggttaaaactaacccagaagatatatagaaagatttgtatctaacaaatatttcccaaaagtagtaatattcacaaaaaataaactaagactggaagaaaattcataagcagataaatattactcagaagaaaactggcaaacaaagctgactgttgaaaagtcaggtgaatccacctcaaagtcagagataaggcaaagatgagaaatgttagggactgaatgattgtgtcccctcgagaattagtatgttgaaatcctaacccccaaggtgatggaattagaaggtggggcctctaggaggggattgggtcataaaggtggagtttcatgaatgggattagtgtccttataagaagagacacaagggctttcttcctgtctctgcttatttggccatctgaggacacaaggaggagatgtgtatctgcaaaccaggacagttgccctccccagacatcagatccgtgggtgctttgatcttggacttacaggctccagaactgtggaagataaatgccagaactgactaagacaacagctatcactgctttcaactgccgggtggatgccctagccggagccctatgacagcaagttaaagaaagatatctaaatattacgagaaagaaaaaacactatcattacttccagttggttagtcacctaaaggcagacgcagctgacaaactttgaactaataaaagatttaagaaagaagacaatagctgagctaggtgtgagtgaagaacagtgaagtgaaatggaaagaacagacctcatttacactcatgatgataaccataaaataccaaagaatcaacctggtgcccatgcaccaaacccttctgaggaaaacgataaaaattcaccaaagcacctgaaagagtaaaagagtcaggaagcagcatgtggggtctgccagctctccttcccctgcagctgggccatgtgttggaagcctggagtagcagcagggttactgcctggggtcccagagtcaaggacttagaactgctgtgcccgggctgcctagtagactctagagacgctccgctgcagtcttctggggtcaagaggggacaatcggaaagagctttaaaaactctcaggctgctcagggagttcttagatagtgctttgggctccatgtgcaggatctagatcctgcttgcctggtttgctcttctgattcgatgttccaatatctgctctggctaagaagctgccgagtgattgttaacaatggaaactgcatctttacctcctcagggtctgatacagcaggtgtggagtacagctcaggaatcggtcatacatggtccccctggatcacttgtgaaagactctgtcctgctgggcatgaatgccagcttgcattcctttaattagatggaaactaggaggtatttggtggctggaagtcatgaatttcagcccatacacttccttcaattacatgcttgtctccctcctgctgtccagagaaaaccaactgaatgatgaatagtgctctcaccattggtagctgatagcaaaaaaaaaaaatgatccagaacttcattttgacaaatgaatgcttctccctgatacctagtttgtgcttctcattttcccagggatgcattaatgctagagaactttagtgaatcactacagaattacttatgcattttgtagttaataggcaaaatatgttgtgcctgtaacatagctcctttgatgttcttagtaagcagaacgtagtatggattctactttattgacttccagatggtgcctctaaaggttatgactatgagctagttaaatgttttgtccctaccagtgggttcatggcttcataaagacctgtggtaggtagcatctgagtttgtagtttgcatttatttctgacttttaagtctacattgacacaatctctttatcttggctttgttgaactctgcctcatttattatgaaagctgacttcaggttgagggcaaggcaaagaaagaagccttcgtatttcaaaagaacaagatgggtagccacgacacagtcaaattggttaatttctgttcctcgctccctaaactgctaaatttcattttatatatcttccttcagtccatctacttaatatattttatgtggttagacggactgcatttttcactcatcctgttttccatgggtttttctcatcatcattttaatagtgacataattcatagagatgatactttctagttcaccattgttggatttagtatgtttctaacagattaataattataggtcataagaaatggaaaaaaaattatagggaggtacattttcatattcctcctaatattccccagcagtaacaccttaaataactctagtgtaatatcaaagccaagaaattaacattggtatattccacaaagtttattcagatttcaccagttttacattcatgcatttttgtgtagtatatataattctaagcaaattcatcacatgtattgattcatgtagccaccaacaaattaagataaagaactgttccacgactgtaaagatctcttgcactatacccttatagccacatcccgcttgtccctaactactggcaaacactaatccatctctgtcattgtggcatttcaagaatattttatgtgtagactaatatagtttgtaaccttttgagggtggctgagtagtggtctgtggtatggatgtgccacaatttgtgtaactattaatccattaacagatatttgagatgttttcagtttttcgctattgcaatcatagcttctataacatccatgtccatgtttgtttgtttttgaagatgtttccattcgtctggtataaattacataagcacgcaattgttaggttgtataataagcagatgcttcattttataagaaactgccatactcttttccagagtggccgttcccacctaagtgatcaagtaattccgcatcctccccagaatttggtgttatcactattttttttattttagccacgctagtaggtgtgtagtgataacccattgtgtttttaatttacattctcctggtggctaatgctgttgaacatcttactatgtggtggttcgtcacctgtatatcctcttcattgaaatatatgttcatgtctgtttgcccgttttctagttagattgtgtggggttttgtttgttttatttttactcttgagatttaagagttctttatgctagatatgccttttgtcagatatgtgttttgaaaatatagtttgtctttctgtagtttatctcttcatcttctttacagggtctttcacagagtaaacatgttctttttaaaaattacagtgaagttttttatcaaattttactttgatggattgtgtttttgatgtcaagtcttggaactcatagcctagagtgctgaagatttcctcctatgttttgttctaaaagtttcacatttttaagtcttacatttaagtctgttctttaagttgatgtcaatttttggtatgatatctgagatttacatcaaagtttatccttttgcctgtggattttcagttattccaggtccactcattgagaagactatattcctcttctgaattgctttgaaaaaatcagttgggtatatttgtgtgggtctactattgggttctcaattctgttttattaatctagatatctcttcctctattatagtcttttgctttcatcgtatagtaacgcttaacattgagtagagtgtttcttcccattttattgttccttttcaaaattgttttagctattttagtttctttgtttatataaatttcagactgactttgtgtatccatatgtacaaaactcttgctgggtttttaatgggaattgtgttaagcctacaggttctcgtagggacaattatgttgaatcttccaatccatgatcatggtatgtccctcttatttcaatcttctatgatttttccatcagtattttgtagttttcaacatgtgagatttatgcttgttttgttaaatttatatttgtttcatttttgaccagttgtaaatgatactgcattttcagtaaccacatgtttactgttagtatagcaattattttatgttgatcttgtatttctgaccttgctgaacttactcattaggtttagcagttttttttttaattgtttttgttttgagattcctttggattttccacatagaccatcatgtcacctgaaaatagtaactttttaaatttctttctgatttctaggcctcttacttcctttactttcctggctaggatttctagtattatgctgaattagaatgttaaaagtgaacaactttatcttgtttctgatcttatggcgaaagcatccagtctttcactattaagtatgatgctagctgtaggttttttgtggaattgcttttatcaggatgaggaagtttccctctattccagttttctgagactttttaatatggatgagtgttgagtgttattacttgctttttctgcatcaattgatataatcaggtgatttttcttccttggcatcttaatatggtagattacattgatcagttttcaattattgaactagctttacactcatggaacaaactctacttggtcatgtgtgtaattccttatatatactgctaagttgtattgccaatattttattaagggtggtttatgtatatttatgagagaatgtggtctgtagtttttgttttgcattttataaattttttctactgtctttgtctagttttggttatgaggttaataaaagcctctgtgttttatccttttttatttactgggagacagttatagaattgatattaattcttccttaaatgtttgttaaaattccccagcgaagccattcaggatgtggagatacctttttaaaaaacatttaaaattatgaactcaatgtgtttaattgttttagggatcttcagcttatttatagcctattggttgagttgtggtagtttgtacttttcaaggaattggtgcatttcatttaagttgctaaatgtatgtgttaatttctatgtaaagagttgttcatagctttcctcatcattcttttgatgtctacaatgtctgtgtagtgacacatagaatacattcgtggtattagtttgtcaattttattgatattttcaaagaagattttcatttcattgatttttttttcttttttttctcttctccgtgtcagtgattttatacttttatatttattatttacttccttctacttgtggggcttgtcttctcttttctagtttcttaccgagtgagcatagatatagacttgaatctttttctctttcttaaaataagcagtactataaatttattcttagcactaccagcatgtcatacatattgatacattgcatttttattcagttcagtgtatttttttccatttccttgagactttctctttgactcatggattatttagcaatttggcattcagtttccaagtgtttggagattttcttgtcatcttaatgctattcatgtctagtttgattccattgtgggcaaatatcacactttgtgtggtttcacttcttttaaatgtattgaggtttttcttaggctcaggatatggtctatcttggtatatgctccatgagtacttgttggtagacagtttcctaaatgccaattaagtcctgttgtttgatggtgtaagttcttttatatccttgctgattttctgtctagttgccctgtcatgaattattgagagaggagtgttgaaacctccaaatatagttgtgaacttgtctatatcttttgaaaatttccatcagttctggggtcatgtattttgaagctttcttgtttgagaaaggatttatgattgctgcatcttcttggtagactgagcttttatcattatgtaaatttatatctatctttcataattttcttttctctaagatctgctttatctgataataatatagttactcttgtgttttttgagtaatgtttgcagggtatgtgtgtctgtgatatatatatattatatatatatattcttcgttttttctttcctgcctatgatgtacttaacttttttttagaatttcttttttagaatttttagaatcttttttatttatagtgtttttgagtatgtctctttgtacacctatttcatggttgctcttgatattacattttatgtatgtaacttattacgttactgactactgatataaacatcttactggttcaagtaaagtagataaattttctcttccttcttttattgtttttttctctctttcaagaacttccttgagccatacttcttgggtgattctgctggtcactatttctcttagttttttcttcatctgaaaatgtcttgacatttcttcattattcctgaaagatattttaactggatttagaattttgagtgtacagtaagttatttcagcattcggaaactgtcataccacctcctgctggtctccgtggttactgttgaaaattctgctgtcatttaaatttgttgttgttgtttagttttgtttttcccccttacggatcatttttctctggctgctttcaagattttctctttgtgtttaatttttagatgtttgattatgatgattcttggcattaatttttttgtatttatctggtttgggttttactcagcttcttgaatctgtagatgtatatcttttgctaaatttggaaaatttttaataatttcttcaaacatttttcattctcattttctttctcttctttttctgagactctcatgacacaaatatcagattttgttatggcttcacacccctgcaggctgtgtcgattttttttcttttttttggtctattttacctttgttgctccgattgcataatttctattctgtcttcaagtcagattctttcctttgctatctccactctactattgagcccagcctacatgttggtaatcccagttactgtatttttcagttctaaattttcatttagtttttctttatatcttctatttatttgttgagactttctattttttcactggtttcaaacatgttcttaattgcctaccaaagcattattatgattgaggttttaaaatccagagaattccaactttctgaattatctgttttggcatctgctaattttctcttctcattaaagttgaggtttttttcttgattttggtattacaggtgatttttaaaattatatcctggacattttgggtattattgtttgagactccaagtcttatttcagtgttccttttcactagacctcctctgacactgtgctagcagaggagggaggacaccacccctgctgtcgtgtggttcaggccccccactcagcctctgttgacacctgggagggatggggaccttggtactgctaggtgggagtggaagtccaggctccccaagtgttctccactgaaacagcaggaggcggctgggtcaagatgaggtcactgcttggccttctctgacatcacctcttgcaagtatggggaggagtgtctcccttttgcctggggatgtttgaatctagagtgctccctgggcctttgctgatgaggctgctggtggagtccagctttttcctttggtgtttccctggggcagcgctcttggctagacacggtccagctgtcaggctgcttctctcctgaccatttggcgagagagggcaagctttcctcaggacttctttggtctgtacctgttggggtttttttggtgcattcttctccagaacccagtttggaataggtaagataaatagtaaacctagggatgtcagcaccatgccgttctgcctgtcacaaaggtgtgatcccttctgccttcttctctgaactgttgacagccttcttatgtttatttatggattatgtgaagacttcttagtcatatttagcaagagtaataatgattactcaggtcagcctgtcataacaaaataccatagactgggaggctttaaataatagaaatttattttcacacaattctgggagctgagaagttcaagatcaagggtctggatttggttccctgaagagaactctctctggtttatggcttccttctcattgtgtccttacatggcagagagaaagagagagggagtgggagagggagagagaggggcacgtgctggcttccctcttcctataaggccaccagtcctatcagaatagggctctacccctgtgacctgatttaaccctggtcagctcttgcttatcgtttttagccgtattacctccttatcgtttttcttgtatttatgctgtcatagcaagtggcatttttctgaaagcatatgcttagtttatttagactttatatttattcagattaaggttggtcaatttcttcactcaatctgaaggaaaagctctttaaaaaatcagcctgatcatttttcaatgaacctctggtgtggactttgggcatccgattgtgtaggaggctctcaaggctggctgtttgcccagtcagcattgtcactgggggacgagctggcagggtgcaatgttgttcccttcacctttgtgtctccaagtgaccctttcctcatagggatgaatttccacccatgatgaatagtccttgtgtgcatagtaatcccagtgtcagaacatcttctccttccactgctggggataattagcttcctttttcttttgtttcatacatctggagccagaaaaggcataacaggtcacatagtttagaaatggacatactttttaaaaaatttcatgagctccttcacgtccatttatctaggctacgtaaaactgttagaaggaatgcccaggctacaagctataagcaggcaggagggtggggcccgtggagcccagctctctcccacacgaggccctgggagttcagtcaaccatcctgggtcgcaaaagtcattacccaagaaggcgggagtaaaactcgtgcttctgccctcttgccctgtacgaggtgggttggaactgagaaggccaggaccttcaaaatgctgcattctccctgagaagttggaattgaaaaaaataaaatctaccatccagtgcaagacgatgaaaaagaagcatgactgttttaggctgtgctcagtcagggctcagagtcttccatgggaattcacaacagatgagggaaggggtgcctcctggtgctggtttgatatgtccagcagaacccaggaaattccagcaccaattgtagtggcatgcaaagtggtctgatctgtgaggctctgggcacctggcagaatggagtgcagggcacctggagagaagtccccctccggccaggtccacaggatctccatagacacggtagcaacacaggttggggattcattccagtatgtccagtcagcaaggttcatgtgccatgaacatgctctgcagatggtgattggggtttgagacatgggttttctgcagcctgacaaatattccatgctctgataagtgtccaggtgtgaggccaggtgtgcaggcaatgctgtgagagggcagccaagggctctgcccctttctctcctgcgtcctcctccctccacatccatcctgtcccacccctgtgactacatgtgggtttttttgtgtgttttttttttttctgagactgagtctggctctgtctcccaggctagagtacagtggcgggatctcggctcactgcaaccttcacttcccaagttcaaacaattcttgtgccttaacctcctgagtagctgggattacaggtgcccaccaccattcccggctaatttttgtgtttttagtagagatggggtttcaccatgttagccaggctggtcttgaactcctgacctcaggtgatccgccctcctcggcctcccaaactcctgggattcaggcgtgagccaccacacctggcctgcatctatatttttaagctcttgtgccatttagccttcattaatttttttaagaaaacattacagatgaaaactgtatgaggaatgaaacactataagaaataatatggaaactcaatttttaaaaatcagctaaaaatgaacttcaaattaaaacacatacagaaacatctcactttgagcaagcattcacaaacatagcaaaaggcaggtttggactcttaaacacttaagacaatagaaactgacaaatgatttgaaaataattacactcaagtaagaattaaaaacacaaatgagagaaaccctttaaaaagcaactttgaaaagaatcaagtaaaattaagagagatgagaaataatatagccatcaaaattaaagacagtggaggcatagaatgtcagatgagacacagttgaaggagcagaggcagtttcctgcgtgaatcatagaaagctaaatagatggaaagtaggaaagaatgatttacggtcgtgcaataatatccaacacttctgtagtgcttctgtgcaccaggtcctgtttcaaatgctttacatatattaacaaccttctgaggaaagcgctgtgattattttcagatatgacagctggagcacactgtggccaaggtcatgcagaaagcaggtctggaagcctgcaccccccaggagaggctgtgcctgacaaggagggctgcttcctctcatgccggggataggtgctcccatacacactggctagaatagtagaaggcaataataaattgcatgtgggagaaatattaaaagattattttcagaaaacaggtaaagttatggctcacatacagatataaaaatgagcatgttgaagaatctatttgactcatatcacatgaggaaacaaagcagatgttctcagttcaatgggaaagtcaaactagtacaaatttatatagagtaaaggaatttcgagatgaattctaaatggacacagaacttgtttatctaaaggggcaggaagtcaaggcactaccaattaaatcactactgggcgactgagaacttccgcatctatcagctgcttacggtccgcgcacagtggcaaagcagctcagacagtgaacagggcgagacttgctaagtgagatctatgtgctgtaggggacacatcgttttccattgaaatacaatgatttttttcaacagaagccatgtcccaaaagaacagctgaggatgtaataatattgatgaaaaacatacatcctcagcttcaggagataaaagtctgaggaaagatatgtgataggaaatgagcccaagacatattgtgcaaaaaagctgcaggaatgtccaaagccaaaaaaagatcctagaagcgatgagagaaaaatagatagcttgctaacaaagagatggcaattagactgactgcagaccttttaaaggcaacagtagaagccagaaaaataaacgaaaataacgtcttttaagtatgaaaggaaataattgtcaacctagagttttatcctgagctaaaccattctttacctgatgggcaaaatcaagacattctcgggaaaacatatactaaaggagtttaccgtgcaggggctgtgctactattttaaaaaactaccagaagacgtttaggaactaggcatgagaagcagtgagcgaagcaattggcaaagattcaggtacatgtaaacagatttggttatataaaataataatgatgaatttgagagtattaaaaacaaagtgggacagggcgcaggggctcatgcctgtagtcccagcactttgggaggccaaggcaagtagatcacctgaggtcaggagttcgagaccagcctggccaacatggtgaaaccccatctctactaaaaatacaaaaattagccgggcgtggtggcatgtgcctgtagtcccagctacttgggagggtgaggcaggaggatcgcttgaacccaggaggcagaggttgcagtgagctgagatagcaccactgcactccaacctggaacctgagtgacagagcaagactccatctcaaaaaaaaaaaaaaaaagatggaattaaaatactggaaaatatagcatgaaatagtaacttggacagtgcttggaggtaaaaccctcaggtgtacttatatgactctggaaggccatggagacgtcagctttaagtgaaatatacaaggttaaagtgtgagaataaccaccagaccagacacattaagaatactatatttaacttccaaacaagtaggggtcgaatggggaagggatgaagaaaacaggagaaggccggcgcggtggctgacgcctgtaatcccggcactgtgggaggccggggcgggcggatcacgaggtcaggagatcgagaccatcccggctaacacggtgaaaccccgtctctactaaaaatacaaaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaagaaaaaaaaaagaaaacaggagaaacctaaatgcaatccaaggaggaagaagtcaaaagcataacattagatggtagaaatgaaaacaaatattacagtagacaagataaaagtaaatgggatggccagctggttaaaacacagatctccccaatatatctctatgcatttaaatcgaacgatagactgtttagatgaaactaaaccatatatacgtaaaggatgaacgcaaaaaaggaaaaacaaaaacaggaacaaaaataaaatgtgagtggctatgtttacaacaccccccccccacacaaacacagtaagaaaaacaagtataattaaggttaaataaggtcaggtgatagtgattttttaaaactaaggatatataacaaatcttacatgtatatatctaataaaattgctttgaagaaaaattggtagaatttaaagtttactggataagtccacaattacagtagaagattttaatgtacctcttttagtaattgatagtgtaacaaggggaaaaaaaatgtaagtatgtaggagttttgaacaacacagttaacaagtcttacccaatatatagatatagatacagatatagaaaaaatgcatcctcattccactagaaaataaatatatggaaaactggatatctaaatgtgaataaaaacatttagcatgtgtggtgtgagtttgtgtgtgtacgtgtgtgtgcacacatgcactcacatatgtataggaatgcaggcagacatacatagcctttaaatgcttatgttagaaaagatacttgtctaagcatctttaccatatgatccaacaattgtcctcctcagtatttacccaaaggagctgaaaacctgtgttcacacagaaacctacacacatatgttgatagcagcatagacatcttttttaggaaaccctaaaggcttttaatatcttttttgggaaaatgtgtgagataattaccaaactcaagaagttataaaatataacattaactccaatgaaaaaaagaaggaggaataaagataaacctagaaatgtattaaataagaaaactaaaatagagatcaacgaaggacaaattggttttaaaaaagaactaataaaatcaacatacctcaggaaataattaccaagaaaacaaagaaggcacaaacaaacatttactggatataaaaggggttttcaactacagaaaaatacttaaaaatagaatattgtgacacaattttatgccaaaattttggaaacttagatagatttaatattttctagaaaaatagaccaaaaagggaatagactagcaaaaaaacagactttgttttttaaagcagtttgaggttcatagcataactgtgtggaaggtacaagttcccatgtcccctcccaacccccacccaagcacagcctcccccatcatcaacatcccccaccagggccgtacaattgaaatagatgaactgatgcagacacatcattaccacccagagtccatagtttacatcagggttctctcttggtggcgtatgggttctgtgggtttgcacagatgtataatgacctgtatcgaccattatagtatcattcagaatagcttcactgccctaaaaatcctcggtgctccacctattcatcccgccctctctctgcaatccatggcagccattgacctgttatgttttgttttgttttgttttgttttgttttgttttgtttgagatggtgtatcgctctgtcgcccaggctggagtgcagtggtgcgatctcggctcactgcaacctccacgtcccgggttcaagcgattctcccacctcagcctcctgagtggctgggactacaggtgcacgccaccacgcctggctaatttttgtatttttagtagagacagggtttcgtcatgttggccaagctggtctcaaactcctgacctcgggtgatccacctgccttagcctcccaaagtgctgggattacaggcgtgagccactgcgcccggcctgatctgttttgctgtctccattgctttacttttcctagaatatcatataattggaatcttacagtctgtaatcttttcagattgacttatttcatttggtaatatgcatttaaggttcctccatgtttttttcatggcttgatagcccatttctttttagcactgaataataatccattgtttggatatagcacagttagtttatccatttcacctactgaaggttgcttccaagttttagcaattatgaataaagctgctatcaacatatgtatgtaggtttctgtgtgaacacacgttttctgctcctttggataaatacaagggaaggcaattgttggatcacatggaaagagtatgcttcgttttgtaggaaactgccaaactgccttccaaagtgactgcaccatttctcatgcccaccagcagtgtatgagagttcctgttgctctgcatccttgccagcatttggtgttgtcagtgttctggattttggtcattctaatagatgcgtagtggtgtctcagtttttttttttttaatttgtattaaatatgacaatgtggaacatatttctatgtgcttctttgccatctctatattgtctttgctcaggtgtctgttaaggtctttggcccattattttaattggattgtttgttttcttattgctgagttttaagagttctttgtatattttggattacagttcattattagatgtgtcttttgcaaatattttctcccaatctggaggtcatcttttcattcttttgatcagtatatttttaaaaaagaaattcaaaaaggtaggtttacaggcaagttccacccagcataaaatatcattatgaacataaatgtataagccttttttattattatactttaagttatagggtacctgtgcacaatgtgcaggtttgttacattaggtgtacatgtgccatgttggcttgctgcatccattaactggtcatttacattagatatttctcctaatgctatcccacccccagccccccaccccccgagaggccccggtgtgtgatgttccctgccctgtgtccatgtgttctcattgttcagttcccgtctatgaatgagaacatgtggtgtttggttttctgtccttgtgatagtttgctgagaatgatggtttccagcttcatccatgtgcctgcaaaggacatgaactcatccttttttatggctgcatagtactcatggtgtatgtgtgccacattttcttaatccaatctgtcattgatggacatttgggttggttccaagtctttgctattgtgaatagtgccgcaataaatatacgtgtgcatatgtctttatagtagcatgatgtataatcctttgggtatatacccagtaatgggattgctgggtcaaatggtatttctagttctagatccttgagaaatcttccactgtcttccacaatggttgaactagtttacactcccaccagcagtgtaaaagcattcctatttctccacatcctctctagcatctgttgtttcctgactttttaatgattgccattctaactggtgtgagagagatggtatctcattgtggtttggatttgcatttctctgatggccagtgatgatgagcattttttcatgtgtctgttgtctgcataaatgtcttcttttgagaagtgtctcttcatatcctttgcccactttttgatggggttgtttttttcttgtaaatttgtttaagttatttgtagattctggatattagccctttgtcagatgggtagattgcaaaaattttctcccattctctaggttgcctgttcactctgatgatggtttcttttgctgtgcagaagctctttagtttaattaaatcctatttgtatattttggcttttgttgccattgcttttggtgttttagtcatgaagtctttgcccatgcctatgtcctgaatggtattgcctaggttttcttctagggtttttatggttttatgtcttaggtttaagtctttaatccatcttgagttaatttttgtataaggtgtaaggaagggatccagtttcagctttatacatatggctagccagttttcccagtactatttattaaacaggaaatcctttccccatttcttgtttttgtcaggtttgtcaaagatcagatggttgtagatgtgtggtgttatttctgaggcctctgttctcttccattggtctatatctctgttttggtaccagtaccatgctgttttggttactgtagccttgtagtgtagtttgaagtcaggtaatgtgatgcctccagctttgttgtttttgcttaggattgtcttggctatgtgggctcttttttgtttccatatgaactttaaagtagttttttccaattctgtgaagaaagtcattggtagcttgatggggatggcattgaatctgtaaattaccttgagcagtatggccattttcacgatattgattcttcctatccatgagcatggaatgctcttccatttgtttgtgtcctcttttatttcattgagcagtggtttgtagttctccttgaagaggtccttcacatcccttgtaaattggattcctaggtattttattctctttgtagcaattgtgaatgggagttcattcatgatttggttctctgtttgtctgttattggtgtataggaatgcttgtgatttttgcacattgattttgtatcctgagactttgctgaagttgcttaatcagcttgagatttttggctgagacaatggggttttctaaatatacaatcatgtcgtctgcaaacagggacaatttgacttcctcttttcctatttgaataccctttatttctttctcttgcctgattgccttggccagaacttccaacactatgttgaataggagtggtgaagagggcatccttgtcttgtgccagttttcaaagggaatgattccagttttggactattcagtatgatattggctgggggtttgccataaatagctcttattattttgagatacgttccatcaatacctagtttattgagagtttttagcatgaagggctgttgaattttgtcgaaggccttttctgcatctattgagataatcatgtggtttttgtcattggttctgtttatgtgatggattacatgtattgatttgcatatattgaaccagccttgcatcccagggatgaagccaacttgatcatgatggataagctttttgatgtgctgttggattctgtttgccagtattttattgaggatttttgcatcaatgctcctcagggatattggtctaaaattctcttttttggttgtgtctctgcccagctttggtatcaggatgatgctggcctaataaaatgagttagggaggattccctctttttctattgattggaatagtttccgaagaaatggtaccggctcctctgtacctctggcagaattcggctgtgaatttgtctggtcctggacttttttgggttggtaggctattaattattgcctcaatttcagaacctgttgttagtctattcagagattcaacttcttcctagtttagtcttgggagggtgcatgagtccaggaatttatccatttcttctagattttctagtttatttgtatagaggtgtttatagtattctctgacagtattttgtatttctgtgagatcggtggtgatatcccctttatcattttttattgcgtctatttgatttttctctgttttcttctttattagtcttgctagcggtctgtctattttgttgatcttttcaaaaaacccgttcctggattcattgattttttgaaggtttttttgtgtctctatctccttcagttctgctctgatcttaattatttctttccttcagctagcttttgaatttatttgcttttgcttctctagttcttttcattgcgatgttaggatgtcaattttagatctttcttgctttctcttgtgggcatttagtgctataaatttccctctacacactactttgaatgtgtcccagagattctggtacgttgtgtgtctttgttctcattggtttcaaagaatatctttatttctgccttcatttcgttatttacccagtagtcattcaggagcccgttgttcagtttccatgtagttgtgcagttttgagtgagtttcttaatcttgagttctaatttgattgcactgtggtctgagagacagtttcttgtgatttctgttcttttacatttgccgaggagtgttttacttccaattatttggtcaattttagaataagtgcaatgtggtgctgagaagaatgcatatcctgttgatttggggtggagagttctgtagatatctattaggttcacttggggcagagctaagttcaaatcctgggtattcttgttaaccttctgtctcgttgatctaatattgacagtgggctgttaaagtctcccattattattttgtgggagtctaagtctctttgtaggtctctaaggacttgctttatgaatcttggtgctcctgtattaggtgcatatatatttaggatagttagctcttcttgttgaattaatccctttaccattatataatggccttctttgtctctttttatctttgttggttgaaagtctgttttatcagagactaggattgcaacccctgctttttttttgcattccatttgcttggtagatcttcctccatcccttcattttgagcctatgtgtgtctctgcatgtgagatgggtctcctgaatacagcacactgatgggtcttgactctttatccaatattctagtctgtgtcttttaattggggcatttagcccatttgcatttaaggttaatattgttatgtgtgaacttgatcctgtcattatgatgctagctgattattttgcctgttaattgatgtggtttcttcatagcatcgatggtctttaccatttggcgtgtttttgcagaggctggtaccagttgttcctttccatgttaagtgcttccttcaggagctcttgtaaggcaggcctggtggtgacaaaatctctcagcatttgcttgtctgtaaaggattttatttctccttcacttatgaagcttggtttggctggatatgaaattctgggttgaaaattctttaagaatgttgaatattggcccccactctcttctggcttgtagggtttctgccgagagatccactgttagtctgatgggcttccctttgtgggtaacccgacttttccctctggctgctgttaacattttttcccttcatttcaaccttggtgaatctgaaaattatgtgtcttggggttgctctttttgaagagtagctttgtggtgttctctgtatttcctgaatttgaatgttggcctgccttgctaggttggggaagttctcctggataatatcctgaagggtgttttccaacttggttccattctgctcatcactttcaggtacaccaatcaaacatagatttggtcttgtcacatagtcccatatttcttggaggctttgtttgtttcgttttactgttttttctctaatcttgtcttctcacttcatttcattaatttgatcttcaaacactgatatcctttcttccacttgatcgaatcggctattgaagcttgtgcatgtgtcatgaagttctcatgctgtggttttcagctccatcaggtcatttcaggtcttctctatactattcattctagttagccattcatctaaccttttttcaaggttcttagcttccttgcaatgggttcgaacatgctcctttagcttggagaagtttcttattgccgaccttctgaaacctacttctgtcaactcgtcaaagtcattctccatccagttttgttccattgctggcaaggagctgcgatcctttggagaagaaggggtgctctggtttttggaattttcagtttttctgctcttctcctcatctttgtggttttatctacctttggtctttgatgttggtgacctacagatggggttttggtgtggatgtcccttttgttgatgttgatgctattcctttctgtttgttagttttccttttaacagtaaggcccctcagctgcaggtctgttggagtttgctggaggtccactccagaccctgtttgcctgagtatcaccagcagaggctgcagaacagcaaacattgctgcctgatccttcttcttgaagctttgtcccagaggagcacccacctgtatgaggtgtctgttggcccctactgggagatgtctcccagtcaggctacacgggggtcagggacccacttgaggaggcagtctatccattctcagagcttgaacgccgtgctgggagaaccagtgctctcttcagaggtgtcagacagagatgtttaagtctgcagaagttgtctgctgccttttgttcagctatgccctgcccacagaagtggagtctatagaggcagtaggccttgctgagctgtggtgggctccactcagttcgagcttcctggccgctttgtttacctactcaagcctcagcagtggcggacacccctccccaccaccaggctgtagcctcacagatcgatcacagactgctgtgctagcagtgagcaaggctccgtgggtgtgggtcccactgggccaggcacaggagggaatctcctggtctgctgatcgctaagaccgttgaaaagtgcagtatttgggcgggagtgtactgtttttccaggtacagtctgtcacagcttcccttggctaggaaagggaaatcccccaaccccttgcacttcctgggtgaggcgacgccccaccctgctttggcttgccctccgtgggttgcacccactgtccaaccagtcccaatgagatgaaccaggtacctcagttggagaaatcacccatcttctgcgttgatctcgtttggagctgcagaccagagctgttcttattcggccatcttggaagcaactcctatgtataagtcttaactaaaatatcagcataacaaagtctagcaataagttaaaaataaatcctaacaagtttaggcttctattaggaatgcacagtttgtttaactttcaaaaaagtccattaatataattcattctattaaaagattgaggcagaaaaaaataaatgatcattctggtagctggagaaaaatcagttgatgttatttaaaacccatttgtaattggaagaagtttcacctaacctgacataggggtctcacttaatgctgaaacattagaagtttctaaacgtagaataaaataagaatatcagtgtcatcactttttaaaaatatcttagtgactatatgaatttcagtagtaatacaagtaaaataataaaatgtttatgaataaggaataaacctgttatcatctttataggccatatctgttttttacatagaaaatccctagagactgtctagaaaaaatatatctgatacaaaacaagatctatcgaagtatcaaatgtgtttctatattcttacaacagacagttagaaaatgtaatttcacaaattttattttcaatatctgcaggtgttgagtaccaaaaaataaatttaagaaagaacaacataaatgttgagttgtatcacgtttatgcctgggaaaactcaataccagatgccaaatttttccaaaataaattgagtgtgattaatgtgattccaactaaatttaatgtgattccaactaaagtcttaacagggacttcatgagactgtacaagtaaatttaaaatttacaatgatgagcaaaggatcagtaatgagcaagaatagtaaaacaagacaattttaaagaaaaagaaccaagttgggggactttctgtgccaaatgcaacactttcataatgctgtaaggattaagatgatgttttgctgggtcagggatagacatgtaacacaaggaacaaaaatagggagtccagaaactggatatctgctgtgttaatcttctcccatgttacttatagctttgctgtaatccgtcctatgccatatccagttgttataatatcccatgttacattcaatttaatatgccaactagtggctaaagaaaagatttctgagtgggagctaaacactgggtactcatggacataaagatggcaacaacagacactggagactactgtagggggaaaggagaagggggccaggattgaaaaactactggatactctgctcactgcctgggtgatggaatcaattataccctaaacttctgcatcgcatgcgatatacccatgtgacaaacatgcacatgtatgtcctgaatctaaaataaaaatcaaaatatgaacagatagcacgtgcctgcagtcctagctgccaggaggctgaggaaggcggatggcttgagcccaagagtttgaggctccagtgagccacgatcgcaccactgcactccagcctgggtgacaaagcatgaccctgtctcaaaataaataaataaacaaataatataaataagtaaatattttctttttttaaaaaaaggaaatattcttgaatgcatttttctggaagcctcctcctggtacctcagaattctgcttcctggaatctctggcaggtagaaatgaccataaaagtttgattctactcaagacttttttggtcatggactatgacaagccacattgctgattgcagaccctcaacattttagaataaaatatagaactaaaaagatttatgacagggtgtgtctctccctctgtcttctgttcagaaaatttacccattctcaacagccttgctttccctctgcaatctgggcattgcttccgtcagtggtgtcttcacatggaattggggaattggcagctttttttcccctttcttcagagatttaaagtaaatgacaccttagatcagatagatgagcatcatccttcctcctcccttcctttttggatagatttcatcttcatctctcttgcccttctctctctcagtctttcaaggttgctgagagctcagagggaatgggattgatttcacatgagaccttactatttagggtcatcctgaacccatgcgaagcattttctttgcagcaggacagagtgcctggatttcttcttcttattgttattttattattattcatctttacctgaatgcagaggctcattctggtgaacacgtgccctattgggagttggtcttgctggacttctttgatggctggacccctggctttttctctcaaggttataagagccgggcttctgggtcagatgatgctttctctgtggaggcacaatcactctcttcttttctggctcagtgttgaggcctcccgtgctcagccgtagaggtcaatgctacagagctgactgaggcaggaggcaaggctgagcctaggatcagagggctcttgttccagggccagcagctctgcaggaatgagaccaggcaccattgtgtgaggatcctaggggatgtggaggaaggaaaggtgtgatctcagacccacccacagggtccacctgtgccccatgggctccccctgcctatactgccattgacgtctgaaagcacagcttgtaatcccataaggattgggcttctgaatcctgcctggggggccaagcagtggtttgctcccaagccctctttcagcctcactgcttagggcaacatggtgtaagcaaacaccatgatccaggcaagccagaccttcctggagcctccttcgttctggcttatctccaagtgtgtgatcccaccatgccctccgccaggggcctgtccacatccgtttccgtctttgggagctctggctatcctttaaagcctatgcagacacctctcctcctcctacccccgctaaggacacgtagcttgcgtcctacatgtttgagttacatttgccccagtcaccccctccgtggtgagggtagggctcagagctctcctcacaccaagagtgggccccagtcattgctggctgggggaggacaaaggcagccagataaaggcagctcctgcaaggacggagaggccacaggccggcatcttcacaaactgtggatgtactgtgtcttccagtagtcaaaataaagaatatatttggccattttcagactatttaatacagaacagtttacacacagaagaggagtgaggaggagaatgaatccctgcagccctacccctgtttccacggttatgggtgtttgccagcacagggctgcccagcactggtgagggggtcactgttggctggcatctgtcgggcatccccggggaagctgcgccggtgctgtggccactgaggtcctcataggggttctggccactcacatttccgaggttcttcatttcccacctcagatcactgttttcaaactcagttttcagcaacagggcctttcttcaaactcatcttatctccacccctaatgctcaaaacagataaagtagtattagcacaaatccattacaagagtttacttttatactatgtacttataaaatcaatttgcctatgggaaagaagcgtaaaactaccatcatgggtattaagatttggattttgataacatttatgtgttacaatttcatgtagctcaatattctgtttggatgaaaaacattcagaaatcactgagtcacaaatcactgagtcacaggtaagctgttgctaatagcaacagtttttttatcttgtttttacctgtttgccttgtgatctcaagagtctcttcaattaaattgatccaaatgcttgaaagaaaggcttgtaggaactttttttttttcagagttgaatcactgatctaacagatgctcagtcttgattataaatatgaaaatcagacaggaagaaacccaagcttaaaataagcaaaactttgttccccataacatgcatcaaaccacactattcttaatttttaatttatttttatttcaaaaatatttatgtttttattttattttattagagacagggtctcgctctgtctcctaggctggaggacagtggtgcaaacatagctcactgcagcctcaaactcctgggctcaactaatcctcctgcctcagcctcctgagtagctggaaacataagcttatgtcactgcactgattaattttgtcagtgttttgtttttgtagagatggggtcttgctttgttgcccagtctggtctcaaacttctggcttcaaatgatcctcccctctgggcctcccaaagtgctaatattataggtgtgggccactgtgcccagactatagaccatgctttctatgttgctgctactgagggtgattgatgggggaacgcatcccacgtctggtgcgggttagatgccatgtaattggagggacagactttaattttttaaaagcaatgcaaagctgaaatctcatttggtgactcctttataagagattcaaatgcgtgcaaattcatggccagagaggctttagtttaacttccatgcaaaaaggagttaaacaggacacataaattaacacaacggtagtctctaagagttaaaattttgttaatagtcatttgagtgtgtgacttttattaccattttcaaattcaaaggaactaaaatattggaggtaaatatttccagaaaccttgaggcgcctccatagggtctcagggctccagagaacctagcttgaagatcatgatactatccagagtgagcttgtgcaggtccacattttcagctattttgtgcccaatcaccatttataatgtgactcattaacagtcagatacagactacggtcaagcaaagaatatttacatcttgatcctacctcctcctctctctttccctatgtgtttttggaagtaagggggggggatgtgtcctttcatgacaacttggctctcgccttctctccctctctcctttctctcagtctccccctttttcccccttatccccctttcttccttcccttaaacttcatcacgtttttgcttgtttcatattcaaatcacggctttctcatacaattactacttttttcctagagtttctggttgccttttcttattataagaatgtttaaaactgtgtccttaatcaagtccatgatgtttttcagctcattatatctcctctttcttgctctgaacccatttggttctgtcctcagtactttaacatcttgctgggatttggacccacctttttctaggcctcctgctcaagtcatcctctaaatctcttttatcgatctccaggtttaatctaaaagtgtattctttctcaggtttcactctcattgttccaaagctgaccaaggaaatatatgttgggaacaagctcttcaaggctttaatgttcttgaaaacccctttttttttgccttcatgcttgggtggtttttctgctgtgagaagtgtcttcgtgttatttcttaattttttccctcccactctccctgatggagcttctgtgagtgaggcgagttcccccagccttgtcctctacgctgtcttctttctgtgttacgtttgatctctgtgatttctatcagccaaacctcccacctactcataaaaagttatttcataaatcatacctttaatttccatttttctctcttttttctaattgctatatcctcttgaatgttgtgaggacattacttttttaagaagtgatttttccttcttttcattgactcattctttttggatcttttttggtgtgtatcctccactgtgtgtcgcatgctgaagactgtcctccggtatctgtgattctaagtttccccttgagaaatctcagacatgggagaggctgcctgaggctctgtagtcatgggcagctcctgcaggggccatagtggccaaaatgaggggagctttactctggggtgctggtactttgactggctgcctgtgtttttttgaggtggtttatttttctttaccagtagggctgtgttttaagggtacccagggttggttttaatcaggcatggtgagacacttagacacagaagtgactgtcctgaaggaaagcagttttactcactgttcttagaagcagaaggacaggctaggcgcggtggctcagcctgtaatcctagcactttgagaggctaagtgggggtggatcacgaggccaggagttcaagaccagcctaaccaacatggtgaaaccccatctctactaaaaatataacaattagccgggagtggtggcacgcacctgtaatcccagctactcaggaggctgaggcaggagaattgcttgaatccaggaggcagaggttgcagtgagccgagatcgtgcccctgcactccagcctgggcaacagagctagactccatttcaaaaaaaaagggaagcgtagcacatgcagggacacagggaggcaccagggccacgcgggaggccgagagagtgcgggaaacctgagcaagggccgtccttcattgtggcttctgcaggaaggaagggaggagcagggcacgcaggcttaggtttaggattagctccttagaataattgcagtaggccctggggcatagggactcttcctggttgacttttacctggtcctgcagtgatgagagcaggactggtgtcaaccccagtgtgacagcctgataaaggatgtgtttgggtgggggtatgggttctggattgattgatttgtgtttgaaaggccagagttgtttactatctctccaaggggcctccagagtcagcaaagccccagatgtcaacacatcagaatccagaaaataaaagacaaggctagtacaggctgttggtgtaattgctgttggggctgtgtgtgtgtgggtgtgtgtcctttatcccagttgttaactcctggctgcaggaggctggaacaggggacggagaggggcagtggtgcatccgtctaaaactcgcacttacttctgttgtcttccctcactctccttcttttcatcgctaactgtggagctggaagccctctggggttgtggtgtccagctccctcctgcacctgcagttcagtcattcaagatatatatgtgggccgggcacggtggctcacgcctataatcccagcactttgggaggctgaggcgggtggatcacaaggtcaggagatcgagaccatcccggctaacatagtgaaacccccgtctctactaaaaatacaaaaaaattaaccaggtgtggtggtgtgcacctgtagtcccagctactcgggaagctgaggcaggaggatgacatgaacccaggaggtggagcttgcagtgagccgagatcatgccactgcactctagcctgggcaacacagcaagactctgtctcaaaaaaaaaaaaaaaaagatatatatgtgaagcacaaaccaagtgtgggtccgcttcaagaggctggaactagagctttggacacagcgagtgaaaaccctgccccatgaggctcacagggtggcagcgtgcctcacccaccctctgttcttctagacaccatgaaaatgtcacatctgccgatgtcctccagagttgtttacaggtttcatttggttaagagcttggttttatatacattgtgagaaaaatcaccagttcggtgtgaaaattgaaatgggggtagacactggcccttccaagctgtgcccggggaagacctcccaggccagtcccagtggtgctctcaggcagcgtgtggggttgtgaggacagacaggggcccctctcaaggtctttgctgctccatcaaagacagaccccagggcttcgggaaatccacagcctggtggcactggctcatgcagtccttttcctgtttctag

SEQ ID NO: 74 - DNA, 16028 bp, Homo sapiens
  source 1..16028: mol_type = genomic DNA
gtaatcctcccccatcagccagtccccatccttgcacgttcgccaagcgggggaaggaggcgtaaaaatcctagggccaaggggcgggacggagctcggcgcctggcacgtgatccccgcgcgcagaggaaggtgggcgcgcgccgacgcagctgcctggggaacgcctgtgaggcagtctccgggtgcttgatgccccagggtcttttgtcctcggagttgtctccggtgtcattccgtggcaagataccaggtttttgcagagaaggtgctgagttgggaacaggccagtctctttcatctcctgtcctgctcatcgctctctgtagcgtacttgtttattttaaagcgggctaagtcgtcgttatctaaggcctcatgtaacaggcagccccagctaccggctgggttgtaccctcagcatgtgggtgggagtgtgtgggagagaaatatagacttacacgtaacacgtatatgaccgttttatttagtaacgaaattaggagataacctccattccctcaggttagaattgacctatcataggtggcatttgaggtcatctccgtttctacggtcccggggcccgctgcggtaacttaagttggaagaaagataccttacccaagaaagtattcgaaggccggtatgaggagtgaaatcttagaaaatgaaatttagtgaatatatgtaacgttctatacttaaggaccctcacttaacccacacaactcatgaggatttcacatctaaaggatgaaaatctccagaatgcagtcaacacttgggagattgtgttgagttatgagcatttcattgtaagggggatatttctaaacggaactcagaccgagtaggatggtgaaggaatcagcaagtattgaactcctatgtcctaggttatcagggagtgcaaacatgaattaagataattctgaggtaaatagggttgcttcgccgggaacgttctaaagatctgtagtacctgacctaaaatacagcaatcgcacagctgtctggtagaagaaaaataagatttgtgtagactaaaatatagaactgataacaaattaaccaaattagtgaaggttattgggaggtgaatttcagtctaaggaagatttttttttaaattaaagaatgctttccccaaacaaatgtggtgcttcagtgatagcccctctcaaagatgaaaaaaacaaacaaaaagactctggtggtgggtggtcgatagatttagaagggataaactagatgacaaattctcttccaaatctagagattcattgaattatggtcagacagacgctctgttgagtggattgtgagattttaatattttttaaatattaagagttttagtagaaaacatgcaattgaatagaaagcatggtaacaataataaacattaaaaaggaacattaaacatcagaagcaatgcaaaagtaaaataaaatgaaaaacgtttcacatcaagtgtttataaacatcagatcttttgatcctaccagtttactctgacagaattgcagcaattccataaaattttggctttccccacttcttttacttaagtactttacatattttaatataatcctcattttttccctaacaactaaatacttattttagttttaacatcacaatgggcctaaccattcattcccttacaactggaaattagaaatgtttctattttttaaaattcattatgtaatagttcattggcaagtaagcaaataccagttgtcatatttctcccttttggatgtcttcacttaaatagcaataccaggccaaaacggtatgatcatattgtgacttttgtacccttttgtcattttgacatttgtaccttcttactaatttgcataagttaactgttgaggaatttttaacagtcaagaaaggaaaatgtccaatgaattacctatgttttttccagatggtggctgcatttgtattagtttcgattctctgtaaatcaagtataattgaagaaaattagaaagtatgaaactagatttaatggctagattttagaagtatgctttcttttcttgaggatccctagtgtcaacaaatatttaattcctattaaagacattaagaaaactcaaccaaaaccttttctctcttaagaatatatagtaacttcctcttaaaagttgttaaatatttaatatgaagactgattctcagaaataatgaccattctgagaagtattttaataacatacatttaacttaagtcccattacagtgtggctatagttaatagttctcattttattgctggtttatttaggaaacatgaacatgcttgtaataactggtttatgaaaaacatgagatagccctttttggattggacaaaacaattgcagggtttattttggagtactatagaagaaaaatttcagtggctattttccactctcggtctcccattctgaatagattgtaacagttaatgacatttggctttcttaaatgagttacttgtagaatccataatgtacacttttgttaaaataaaaacctggaagacaactttttagcaattgtttaaaatgtctaggagaccaaaaaatatttccattttcttctatgaaaattagagcaaaaaacaatacagttcacattattattgcctacatttccttccctatttaaatctagctgttttttaaagctattgactctcttatgatgactctgcattcttagaaaccacatggagatctttaatgaccatatactagttaaatacaggcagttctcacctatcagaaacaacttaactatctttgtttatgtcacattttcaagagtgaggcgttcaagataaattactgtgattatctaatttatgtttaacttaggtttttgttttgttttgttttttgagagggagtctcttttgcccacactggagtgcagtgtcggctcactgcaacctctgcctcctgggttcaagcgatgcttatgcctcagcctcctaagtagccgggactacaggcatgtgccaccatgcctggctaattttttgtatttttagtagagacggagtttcaccatgttggccagtctggtcttgaactcctgacctcaggtaatccgtctgcctcggccgcccaaagtgctgggattacaggtgtgagccactgcgcccagccctaccttaggttttaagtggtaatagtaaactcatgcattgaaaatattttatcttttctacagttaagaaatagaaataatttctgtgtttagctacatatgataaatgagaaaatatgttataaaataactagcaaccaagctgccagtattatttttatggtatcataagatgatatggctatattatatgtagatgtttgaaaatttgaaatggaaaaattctgttctagttctgtggaatgtaattcctcattaagatcggagtttgtctatgtcatttttatgtcattttatgtcatttttagctattattaaaaaatgttttaataatagtatttatatgtcataaggaataggtgtcatagctagcctgtgtcactatatataataaaaggttaaacctaattttgtttcccaaagaagatacttcattttgacaatgtctaaactttcagaaaatttatgctaaaattggtagctaccgtattattccgttttcatactgctataaagaactacgcaagactgggtaatttataaaggaaagaggtttaatccactcacagttcagcatggctggggaggccttaggaaacgtacaatcatggcggaaggcgaaggggaaacaaggcaccttcttcacatcatggcaggaagtagtgccgagcaaaggaggaagagccccttataaaaccatcagatatcatgagaactcactcactatcaccagaacagcatgggggataccacacccataatccaattacctccacctggtctttcccttggcacgagattatggggattataattcaagatgagatttcagtggggacacaaagcctgaccaaatcagctattcaagttgctttgaaattttcttttctgactagattttggttttcttttgtgagaaagggtttcactctgttgcccaggctggagtgcaggtggcatgatctctacccactcattgcagccttgacttcacaagctcaagccatcctcccacctcaacctcttgagtagctggtactacaggtgcacgctaccacacctggctcatttttttgtatcttattttagagacggggttttgccatgttgcccaggctggtcttgagctcctgagcttaagctatccactcacctcagcctcccaaagtgctgaaattataggtgtgaggcactgtgagtggcctagattttgtttctctgatggtgctggttctttcattcttcctttttggtcctgttatttatcttaatagtgggatacgtggaaggctgaggcaagagaattgcttgagtcgtggcactacattccagcctaggcagcagagcgaaaccgtctcaaaaaaaaaaaaaaaaaaaaagggatgtaaaagtcaatatgtatattaggtccttgctcagtattgagctcaataagaagatgaacaactcacatttaaaaattggcaaaacaggccaggtacggtgtggctcatgcctttaatcccaccgctttggaaggctgaggcaggcagatcacttgaggttgggagtacgaaactagcctggccaacatggtgaaaccccgtctctactaaaaatgcaaaaattagccgggtgtggtagtgcacacttgtattctcagctactcaggaggccaaggcaggagaatcgcttgaacccaggaggcagaggtcacagtaagctgagatcgtgccactgcactccagcctgggcaacagagtaagactctgtcttcaaaaaaaaaaaaaaattggcaaaacagaaaaatgaacaaaatcttatcctttgcagcaatatggatgcagctggagaccattatcctaaggagattaacacagaaacagaaaaccaaataacacatattcttacaactgggagctaaacattgtgtattcatggacatgaagatggcaacagtagacactgggaactgctaaaggggagggaggcaggaggtcaagggttgaagactattgggtactatcctcactacctaggtgggaggatcagccatatcccaaacctcagcatcacacaatatacccatatgacaaacctgcacatttacctcctcaacctaaaataaaagtcgaaattatattaaaatattttaaaaaggaaatttgggcacacacaaagggagaacaccatgtgaagatggaggcagagattggggtgatagacctacaagctaagggacaccacagcttctccctcagatcctccagaaagaatcaaccatgctgacaccttgattttggacttctcgccactagaactgtgagtgaatacgtttctgttgttttaagctaaaaaagaaaacgaaaatgcaagcacgaacacattgttctctgcagtttagggaatcctagtagagactactgctcacatttgttctctcttctctgctttaatggccactaccttagttttatctcaaactattttcttccagaccatttccatggattttcaacaggttgtcttgccttgtcttcttccactagccctctctgctattcctgtggccctctaatccatcttccatctgataccagagtgacttcataggtgaacaatttcctagttaggctaatattcaaatatttcagtggtttcctattatgcacaggttagattcttacttacctgttgaatatcagagtttgtcatcatacggcacctgctcagttctacagctccctttcattaaattctaacaatactatggtgcttagtttcccagacacttaatgcatgtcatatctccgtacctttgcctatgcagcttcctctgcatggaatgaagctcctcctcccatattcccatgaacttctgtactcttcatctttcagaaacctatttaagtatcaaaacctgtacagtttttgctcatgccagtaaaaagtgaataacttgtacctctgcgttgcttctgtattattgctgatagtacacagtattatgatcgtcttttataggtctgtcttccatactaaatggcaagctcctttctaacagggagtgtgttttataatttttgtatcttcagtacctgtcccaccacctgatacatgtgagtgaggtattacaattttagaaggtgctgaaagtttttttcttaaatattttaagtagtcttcctgtattttaacttacactgtcattattcataagccatgaacaaagacaagtaagtacagaccttgtaggaattatctcaaatgccagtttattggagtacaaactcaattaggctaaaacttactgaggtcttggtttatgtaagtctctgttaaagggtagggagttagggattttttgtttagttggggaggagacaaatatttacctaactatatagttttaaggcagaatgcattaatagtttgaattgtgttctgtagtttttactgagtgggttcctacttcattcgtttctcccagcaatcctatgaagttagaagactctttacttttctttgtgccttgaaaattctgcgctcaagtgcttgagctcctggcttctcattcgttaggtctctgcttaaaggttcttttttcagaaaccttccctgaccccttacctaaaattgcagccaccctactgctttgccccaggttagtttttctcttatgtcatcctttatttcctttataacagttactatagtctgtgatcatcttgtttatttgttcacttgtttatagtctctgtcctctgaaatatataccctatgagagaagggaccttatctattagcctgtatccccacatagtgcagtttgtggagtgtggtaggtactaagtaaatattgttgaacaaatgagcttacagttgttattcctgctttacagacaaaagaaacctggttccaagtatatgaaaatctggatttataccacagataaactgaattagttgtttactgaagtcctgttatgtgcaaattactaagcactggttacatagatataaataagacagctactgtatttgcatttagcacagtatctctacatagtaggtgtattagtctgttttcacactgctataaaggtaactactcaagaggccaggtgctgtggctcatgcctgtaatcccagtactttgagaggccaaggtgggcagatcatgaggtcaggagatcgagaccatcctggtcaacatggtgaaaccccatctgtactaaaaatacaaaaaaattagctgggtttggtgatgcacacctgtaatcccagctactcaggaggctgaggcaggagaatcacttgaacccctgaggtggagattgcagtgagccaagatcatgccactgcactccagcgtggtgacagagtaagactccatctggaaaaaaaaaaaagataatacccaagaatgggtaatttataaaggaaagaggtttagttgactcacagttctgcatggctaggtaggccttaggaaacttacggtcatggtagaagggagcgcagacaccttcttcacaaggaggctggagagagaagagtgaggagtgaaagggcaagagccccttataaaaccagatctcatgcgaacagcatggggaaaaccactcccatgatccaatcacctcccaccagtttcctccctcaacatgtggaaattatggggattataagaggtgagatttgggtggggacacagagccaagccatattattccacccctggctcctcccaaatttcacattcattttgcatttcaaaatcaatcatgccttcccaacagtcctccagagtcttaattcatttcatcattaactcaaaagtccacagtacagagtctcatctgaaacaaggcaagtcccttccacctatgagccagtaaaataaaacataagttagttccttttaagatacaatggcagtacaggcactgggtaaatacacctattccaaatgggcaaaattggccaaaacagaagggccacagggcccatgcaagtctgaaatccagtggggcagtcattaaatcataaagctccaaaatgttctccttgaccccatgtcacatctggagaacactgatgccaggggtaggctcccatggccttgggcagctccttcaagggctggcatcgagtgcctgcggcttttccagatgcatggtgcaagctgttgttagatataccattctggggtctggagcaggtagccgccttctcatggctctgccaggcagtgacacagtggggactctgtgtgagggctccaaccccacatttcccctttgcactgccctagcagaggttctccatgaaggctccacccctgcagtagacttctgcctggacatccaggtgtttccatacatcctttgaaatctagggtgaagttcccaaacctcaattctagacttctatgcacccacaggcccaacaccacatggaagccaccaaggcttgtggcttgctccctctgaagcagtggctcaagctgtatgttggccccttttagccatggctgggacacagggcatcaagtcccaatactgcacaaagcagcaaagccctgggcctggcccacaaaaccattttttccttctaggcctctgggcctgtgatggaagggcctgctgtgaagacctctgacatgtcctggagacattttccccattgtcttggcaattaatatttggctccttgttacttatgcaaatttctgcagccagcttgaatttctccccagaaaatgggtttttcttttttttgggggggcggggggaaggagggggacagagtctcacactgtcacccaagctggagtgcagtgacacaatctcagcttgctgcaacctccgcctcctgggttcaagtgattctcctgcctcagcctcccgagtagaactacaggtgtgcaccaccatgcccagctaattttgtatttttagtagagacggggtttcaccatgttggccaggacggtctcgatgtcttgacctcatgatctgcccgcctcagcctcccaaagtgctaggattacaggcatgggccaccagcacccagctgggtttttcttttctgttgcatcatcagactgcaaattttccaaacttttatgctctgcttcccttttaaacctaagttccgatttcaggtcatctctctctcaagtttcatcagtctcttgggcaggggcaaaatgccaccagtctgtttgctaaagcatagcaagagtgacctttgctccatttcccagtaagttcctcatctccagctgagaccacgtcagcctggatgttattgtccatatcactgtcagcattttggtcaaaaccattcaataagtctctaggaagttccagactttcccacatcttactgtcttctgagccctccaaagtgttccaacctctgccagttacccagttccaaaattgcttccacattttcaggtatctttatagcagtacccaactctctgttgtagcaatttactgtattagctttcacactgctataaaagaaataaaaacataaaataaaaatactaccccaaactgggtaatttataaaagaaataagtttaattgactcacagttacgcatgactagggaggcctcaggaaacttacaattatggtggaaggggcacctttttcacgaggcaggagagaagagtgaagagcaaagcaggaagagcccattttaaaaccagatctcatgagaactcactatcaggagaacagcatgggggagattgccttgatgatttaatcaccaaccaccaggttcctcccttgacgtggggattatgggattacaatttgagatgagatttggatggggacacagagccaaaccatattagtagatacttaataattatatagtaaatatttaatttttatagtaataattatatagtaaaaatttgtttaacaatgagaaattgatttattctttcagaaaatgtttagtaagcacttaataaaaatcagaagggggggattgattgggaaagtactacaagagcaaactttctggggcaatggaaatgtattttgtcttaggtggtgtttataggtccatatagttacaaaactcatcaaactgagcgcttcacaaacacaaagcttggccaggtgcggtggctaatgcctgtaatctcagcactttgggaggctgaggcaggcagatgggagtttgagaccagcctggccaacatggtgaaaccccatctctactaaaaatataaaaattagcagggcgttttggcaggcacctgtaatcctagtgactcagaaggctgaggcaggagaatcgcttgaacccgggaggcagaggttgcagtgagccaagatcatgccactgcactccagcttgggcgacagagcgagactccatctcaaaaacaaacaaacaaaaagcacaaagctcaataaactgaactgtaaattaaacacttcaaacaaaagtaagttaaataaattgagccagacgttatatagacactggggacacagatgatcagacaaataaggtccctgcccttgtatctctctttttcttttattttttattttttttatttttttgagatagagtctcttctctgtctcccaggctggagtgcagtggtgagatcttacctcactgccacctccacttccgggatttaagtgattctcctgcctcagcctcctgagtagctgggattacaggcgtgtgccaccatgcccagctaattttctgtatttttagtagagttgggatttcaccatgttggccaggctggtcacgaactcctgacctcaagtgatctgcccacctcagcctcccttagtgctggaattacaggcgtaagccaccacgcccagcccccttgtatctcttatattgtgagtggggaacatgataggtagatgcagccattaaaatttatgtttccaactgatattaaggagttggggaaataatataataatctgacataccattaagtgaaaaatgcaatatagccttattttttaagcatttacagcctatgtatttacataccaaaaaagagatacatttaccaaataaatacataaatgttattttttataatcctaagacaaaaataaataatatgctgaataaaatacattattttatacaaaaatttgcttggtgtggtggcgcacgtccataatcccagctatttgggtggcggaggcacaagaatcacttgaacctgggaggcagaggttgcagtgagccaagatcatgccactgcacatcagcctgggtgacagagtgagactatctcattaaaaaaaaaatatattttaaattattttatttggtcaggcacggtggctcacgcctgtaatcccagcactttgagaggccaaggtgggtggatcacctgaggtcaggagcttgagaccaacctgaccaacacggtgaaaccccatctctactaaaatacaaaaattagctgggtgtggtggcgtgcgcctataatcccagctactcgggaggtcactgaggcacgagaatcgcttgaacccgggcagtggagattgcagtgagctaacacgacacacactccagcctgggaaacagagcgagacgctgtctcaaaaaaaaaaaaaaaaaattttttttgcacattatttacagttagtaatattttcctttcaaagtatctaaaatatctgtaatagctgaacatatatcaaacagatctatagagactagcacatgtaaaattttttttaagtttcttgtttgattcttctgtattttatctttcttcatataaaatcagccttaattgacagagaaatattctatgtactcattcatatgtgggaactaaaaaagttgatctcatggagatagtcaaatggtagttaccagaggccaggaagggtagggagggagagaatgaagagaggttggttaatgggcactatagtacggttatatagaaaaagttctagtattcaatagcataatagggtgactattgttatcagtaattttagtgtatatttcaaaataggagagaaaatttggaatgttctcaatataaataaatgataaatgaggtgacgaatatcccagttacactgagttgatcattgcacatcatatgcatgtatgcatgtagcaaaatatcacttgtaccccataaatatgtacagttattatgtatcagtacaaaaacagcctgaataaatgtacttacagtcatttgaattgagcttttcaagctgtattgctttcatgtataaagtttttcagtagttaaattgtagttggttatctttaaaaagtagattatgttaagactttggtaagttattactttgttgtaggaggtaatagtacctctcatcactgtatttttaagcatagtgttttaccaaggaattaagtgttcaaaagaatattttctgaagtggattttaaaacagtagtaataccatttgttcttgaggtttgtgggttaagataggaaatgctatatttaagagtctaacattaaggttttcaaccaggcatggtggctcacacctgtaatcccaggacttcgtggggctgaggcaggcggatcacttgaggtcaggagtttgagaccagcctggccaacatggtgaaaccccatctctactaaaaatacaaaaattagccagacgttgtggtgtgctcctgcagttttagttacttgggaggctgaggcaggaggatagcttgtgcccgggaggtggaggtggtagtgaccaagagcacaccactgcactccagcctgggcaatggaagtgaaaccctgtctcaaaaataaataaataagattttcatctttgcgttcccattcactcgctttttgataaatttaagctcttatgacttctaaaatattgtaatatgtacaataatacttaatgttattctacattgaacaaacatttaatgactgctatttcgagttacatactggatgctggggccaattgcaagctaagataattagtcagataaaacagaaggaactccatatgcaaagaactcaaaaaggctgcttactagacagtagctttcgctggcctcaggtacatgaagagaccatgtttgtggaagttgaagctggaaaggtagccttgccattctttggagatggcaccttatagagccaatgatctatagtagcattgtccagtaaaactttgtggtaatggaaatgttctctgtactgttcaatatggtagtcagtagtcacatgtagctagctattgagcctctgaaaggttaccagtgtgtcttagaaacagcattttacattttacttaattttaatttatttacatgtgaatagccacatgtgtttgttttgttttgttttgtttttgagacagagtcttgctcttgtcacccaggctggagtgcaatggcatgatctcggctcactgcaacccctgcctcctgaattcaagcgattctcctgcctcagcctcccaggtagctggaattacaggcgcctgccaccacgcctggataattttttgtatttttattagagacggggtttcgccatgttggccaggctggtcttgaactcctaacctcgtgatctgccctcctcagcctcccaaagtgttgggattataggcatgagccaccacgcccacatgtgtatattaaccgtgttttcaattttctgtattttattatgctttaatatcttaggagccttgttggctgtggagacaatttaattcctagagatactaaataacttgcctgtgagcatgcctttcatatgcaaaccaaccaatccaaagcccatgcccccaaccacctcctttatctaacccttacacatgaagtcagtatttctccagtcaatatttctcctgccctaagtcaccccagggacaggtaggagacgactagggaccactacttttgcccagaacccactgaaattattcaagctagccagtcctgaacagtttcctgccttgccttttccatggaaaccacagtaaaggcctgtgcccatgctttttccctttcctctttcttcctcctgatcaaccctagtacctctcatgtggccctgcattgcatagtgtatcctctcctcttgggaactataagtaataaactgttatttcaagacagtttctacaagtctgttgggtacaaatctaaacagtatggctagtggtgcccatattgaatagcacagatcttatacctaggcctccttctccccgcaaaaacagttctgtgttatctccagagctttaattcactcaaagaacctatttggagtgtctccactttggttatgagaatgtaacagccagcatggcagacaaagttcatacttttacagagttttattctggtaactacaagattatattcctgaagatttttgcccatatagcattgtcaagttatttggcaaaatatttttttcaaaggagttgctagtacttcctcaccaatctctataatctctgaataaaagctaccatttattgtgtcttttttgccagccactcttataggtgctatctatgaaaatggtagataaataggttttttcatttagatttctttggcatgatgttatatcaaaaataattccattttggaagagttcatattgtctttctttcaatagttaaatagtactattatctcctgagagtagttttaccaagataggcacagattttaattttagatctattgggtttgattcatgataactgacaacaggctttggatttagggtgtcctggactaaacctgcttaggctacagttttctcacatgtaaaatggggataataatgatacctaccacatatagttgtttaagctaacatagtgttaaatgagctagtgcccttatactcttagcataacctgttcatttatctttaatgtttattagcatgagttagcatattattttctgtttttctcttttctcaactaagctatttccacatagtgcctagcaaggtatcagattcggcattcagtgaaggaagttaactggtaattctataagaacagaaaagagcccagcagaggcagggtgctagcagacatttgataaatgtatgttgaaatgtttatcttggtttcctggtatttttgtgtccacatgcatagggactgtttcatttgtatcacttatattccctgtccccttaagacaggctaggtactccaaaaggctttaaatgaagtttatggaattagatatatcttaaaatgagaacattcaacatagaaggtttcaatttgttctttaaaatagtagcttttacacaaaatttcagtgttctttagcaacatttaccaaaaatgtaccttaaagcatcagaggacatgttctctctgatattatgaatcagtggtaaaaattctgcagatattctgttgtatgattttgacatagtattaaggagataaaatgttttcttaacttataaaatatacattgaattttgtttatagttatagtgatcataactcctaaaataaaaatagacaaacacaaatagacttgatgtagacaatgagataggatatttgaaatggaacctatttctgaaaagttaggtttctagtttcactggtctcaaattataaataaagtaaggtggtctttggtagagctggctttattgtgttatttattcacagttttatggatccattaaaaaggaattaatgtaaaaagtaacaaagaataagctcaaggatgaaactagacatgctattttgaattcttttccaagagcactgcagattctgacacatctacatgtttag

SEQ ID NO: 75 - DNA, 4227 bp, Homo sapiens
  source 1..4227: mol_type = genomic DNA
gtaccaaacccctgcccctcacttcactcccaccttggctcccagcttggctcccagcttccccaaaccccctgcttcccactatcagtgggaagtgtaaatttttttttttttttttgagacagagtctcgctctgtcgtccaggctggagtgcagtagcgcaatcttggcttactgcaacctctgcctcccgggttcaagtgactctcctgcctcagtctcctgagtagctgggattacaggcgcccgccaccatacctggctaatttttgtatttttagtagagatgggattttgccatattggctggtcttgaactcttgacctcaggtgatctgccggcctcagcctcccaaagtgctgggattacagggaagtgtaaattgtacactatcatttcttagcacagggaaccaaagtccagcagagctccatgtaaaatgtatagcctcaggagccaagcaaaactgagcttcagtactcagccactgtgtgacttagggcaggtctcagaacctctctgagcctcaatttcctcatgtataaattgggtgtggccaatacctatttttcagggtagttgtaagaaatagagatgagagaaagaatcgaagaacaagattttgtagtgtgtgtgtgtgtgtgtgtgcgtgtgtgtgtgtgtgtgtgtgtgtgtgtgtgtgtgttttaagcattgggattgggccgggccaggtggctcatgcctgtaatcccagcactatgggaggctgaggcaggtggatcatttgagcttggtagttcaagtccagcctgggcaacatggcacaatcacatctctacaaaaattagccaggtgcagtggcgcacacctgtagtcttagctactgggaagctgaggtgggaggatcacttgaacccatgaggtcaaggctgcagtaaccaaggtcatgccactgcactccagcctaggcaatagagcgagaccctgtctcccagaaaaagaaaaaagaaaggaaaagtcggaaccttcctctgtcgcctaggctggagtacagtggcatgatcataggtcatttacctcaggcaaagagacaggctttcaaataatgtttctaactataagaaaatgtacagttcttttattctagatagttaattataatagaattggtgactttgaagtcagtgggttatttatcttgagggtggtgagcaaattcaactgcccttggcaaacagtagtttacagctttaagggcgcaaacacccttccttacaacagtctaataaaaggagtttcatataaccagcattcattgtttcaaggttacaaatccacagcccctgcaggtaactgttacaataaactgtcaactgtgacaggaaagtcttctgcctttgaaatttaggaacttggccagtcctggtggctcacacctgtaatcccagcactttgggaggccaaggcaggtgaatcacctgaggtcaggatcaggagtttgagaccagtctggccaacacagtgaaaccccgtctctattaaaaatgcaaaaattagttgggcgtggtggcacctgcctgtcatctcagctactcgctaggctgaggcaggagaattgcttgaactccggatatggaggttgcagtgagccgagattgcagtactgtactccagcctgggccacagagcgagactccatctccaaaaaaaaagacttaggaactcaattctgtgatagcaaaatacagaaatagagattatactttaggctaggtgttgtggctcacacctgtaatcccaatgcttttggaggctagggtgggaggatcactcgaagccaggagcttgagaccagactggacaacatagtgagaccccccacctctacaaaaaattaaaaaaaaaaataagccaggtgggagaattgcttgagcccagaagtttgagagagcagcctgggtaacatcacgagacctcatctctacaaaaaacaacaacagggtgtggtgacattcacctgtaatcccagctactcgggaggctgaggcaggaggatcgctttagcccaggagttccaggctgcagtgagccataatcatgccactgtaccccagcctgggtgagaccctatctcaaaaaaaaagattacactttcatattatggcaaaagcatgtaaatatcctccagcctccttccttatttatctgagcagtgctgcaagcccagggtttgtacccacaaaaccccaaatttataactcagggtgcttgtagataccactgaaacatgtagcttatggttttaagctacatgtttttagctataatgttttttgttttgttttgttttttgagatggagtctcgctctgttgcccaggctggaatgtagcggtgcaatcttggctcactgcaacccctgcctcccagattcaagcgattctcaagcctcagccttccgagtagctgggattacaggtgcgccaccacgcccagcaaattttttgttttgttttgttttgttttgttttttagagacagagttttgctcttgtagctcaggctagagtacaatggcgtgatcttggctcactgcaacctccgcctcccaggttcaggcgattcttctgcctcagcctcctgcgtagctgggattacaggcacgtgccaccacacctggctaatttttgtattttttagtagagatggggtttcgccatgttggccaggctggtcttgaactcctgacctcaggtgatccacccgccttggccttccaaagtgctgggattacaggtgtgagccaccacacctggctagaggtgtgtcctttttaatgctcatctttaagtctacctcagatttaatgaattaggacctctagggtaagccccgcttggggcatttgtacctagatccccaggcaattcttacatatacgaaaagtatgaaccgccacgaggaggcctacacactgcacaagaggcaatgtggcgtggtcagtgctgggaggatggcacctccttgagagactggggcacagaggtgggacctacaccctggggtggggatcgaagaggcttcctggccaggtgcggtggctcctgcctataatcccagcactttgggaggctgaggcaggggggcagcgactgcttgagaccaggagttcgagcccagctgaataggatgcccggctactcccaccttgttttaccatagtgaaccaacggtttttccaataggggcaattttgctgcccagcggatgtttggcaacgtctgcaggcatgctttggttgtcacaactgagggatgctatgggcatctagcgggcagaggccagggatcctgctaaatgcgctgccatatacaggacagccctcaccatgcagaacaaccagcaccaaacgccaagagtgctgcaattgagaaatcctggtttcgatggtcccacttcctttaagaagcctccatttttttttttttttttttttttttttttatgagacaggatcttgctctgtcacccaggctggagtgcagtggcacaatcatagcttactgcagcctccacctcctaggttcaagcaatcctcctgtctcagactcccgagtagctgggactgcaggtgcgtgccaccatgctcaactaatttttaaattttttgtagagacggagttttgttatgttgcccaggctggtctcgaactcctggcctcaagtgatcatcccaccttggtctcccaatgtgctggtattacctgcatgagccactgcaccaggctgaggttgagaattttttttttttttttttgggatggagtctctctctgttgcccaggctggagtgcagtgctgcgatcttggctcactgcagcctctgcctcccaggttcaagtgattctcctgcctcagccttccaagtagctgggactacagaaccactacacccagataatttttgtatttttagttgagatggggttttaccatgtttagtagagaccaggccaggctggtctcgaaatcctgacctcaggtgatctgcccacctcagcctcccaaagtgctgggattacaggtgtgagccaccacaccgggctggtgttgagattttatctagacctggcagccctctccttcaccagtaactcctaaaaccagggacccctggaggggaggccacctctccttccctgccccgccctggtcccaggcttagcctctccccctgttcacag

SEQ ID NO: 76 - DNA, 1924 bp, Homo sapiens
  source 1..1924: mol_type = genomic DNA
gtagactacagttcatatgatgtaacagctagcacaccctactcaatctcaaagccaaacctggtctgcttcttcatgtgggtcactgttaggcacctctctggaactcacaaggatccctagcagggaagagcatggctagctgctctcacctcttttctccttgcatttcagtaccttgatccctgatacaaagaatcttaattcaatttataagaagctacttatcacgaaaaaaggcaaggattcttaatccacaggttttccatttctgatcatctcacacagcacattatcctctgagtttttgtagtgtgctgcttcacaaagccaacctggtcttatgctagtaagtaaaagatgactatttgtgtgctcattacacagggtcttgcatgcatttctgttaagaccagcccaggcgcattggttcacacctgtaagcccagcactttgggaggccaaggtgggtggatcacttgaggtcaggagttcgaggccagcctggccaatgtgatgaaatcccatctctactaaaaatacaaaaattagccgggcatggtggtgcatgcctgtaatcccagctactcagggggctgaggcaggaaaatcgcttgaacctgggagttggagtttgcagtgagccaagatagcaccactgcactccagcctgggtgacagaaagaggcaccatctcaaaaaaaaaaaaaaaaaaaaaaacagaagtgcaattgttagtttaactataaaaatgttgagtgaggctgagccccaacaggaaattggtcctaaacacagtatctcctactatcaggtagccttttattttattctttctttctttttttttttttttttttgagatggagtctcactctgttgcccaggctggagtgtagtggtgcgatctcggctcactgcaacctccatctcccgggttcaagcaattctcctgcctcagcctcccgactaagtggaattacaggtgtgcatcaccactcccagctaatgcttttgtatttttggtagagacagggtcttaccatgttggccaggctggtctcaaactcccgacctcaggtgatccgcccgcctcagcctcccaaagtgctggaattacaggcatgagccactatgcccggcttgggtagccttttatatgaggtattttccaagatactttcatatttattatctcattgatacacacaaatgcacacacacacacacacacacacacacacacacactcatgcatgcacgcaccctgagagatggataggttctggttaagtgaattttccaatagacagtacatggcagagctgaggtttaaagtgttttgatctagctttggtctaacaaggggaagatctgcatactcagtggtgaaaaagcaagcagatatgagttgaaatgatggatcagccatcattagtgaagaaactattcgcattagactcatgtcactaaattactagtgaagtcggtagctggaattctattcttagattctctattaagtattgaatttcagaatcctgaaatgcagctacccattcttatttttaaaacaagaaaacaagagcatcaggaagttaagtagccggccagtgggattaaaactagctaatgcagagccagaaaaatatgctctgagctgggctcctttccctcccccacaccactgcatgtcagcatttgccatgttaggtaaatcccttaagctttctgcaccttaagagctcctcctttaaaagaaacatatcaatgctcttctctaagaaatagctaaaatatgtatcattctaaaatgaaagttaaaatataaatgctcccttacaaatattggaactttgatgggtttagactatttattcatatttatttttagaaaataatttggttttgtgttttcttacag

SEQ ID NO: 77 - DNA, 2357 bp, Homo sapiens
  source 1..2357: mol_type = genomic DNA
gtaagcagttcttcttccctgtcctaatgtacacattttcaaggagagaaagcagttgaatatgcttgaaatataaagtaagcttaacctagtgaattaaagatgttccaatagtaatacaggatatttatcatcttggtcttcaatttaaaatgtttaattattaccatcacaacaaatggaatgaattagaaactgtgattcaattttggaatttcctactaagaaagtcttgaaaagtaaaaaggattcttctgtatatgtcttgctgttgttagcatggtttaaagataccacctcctaaaaggtgaaggtggaactgatgggttctcagtaagcatctgtccctgctgttctgagacacaggagtaatccgaatcctttcccacctgtatcttcataggtctgactccaacccccagatccagcttgcggtccatgctattgtttattaaaggcgacccagagagtctctcaacatctcagacatggcagtttactgaacatgtcattcagagtatttacaagttttttgtttggcaggccacagatctggatttctcatgtcagtgctttacaagataaacagcttcttttaactcttttccattttctagtcaaaccttccaggagaaacatcagattgtttgcacatttcattgacccgtctcagccacgcgtcctatgaatgggagcatttcattagcaaagaggcctaacacactgaagggctctagttattgatgttcacgcaaaccagcaaagagcagctggatgccaatgagaaactcagttgggcaggaaccacctcttgacaaaacagttaaagtgtaaaagtagacaagagctgttctctcccatttgtttcttactggtttgattgttctttcggttgagctcagtcttcccacatctctcagacctctcctttcccaatgaggatgaaggctcttcctgttccacagtgtagctttagaattttggtcaaaaggagagttgctcttcatgttcccagggtaactcacagtttaaccatttggaatgagaacactagcttttaactggaaataaaatttggtataaaacggtcataccttaggtttaaaagccttaaaactaacaaatagcctaattatgtaagtgaatgattatgcacctcaatccctctaggataactaaatatggagaagagttcattgagacttggaaggtatgaatccttttaattagtttattctcccaaatcctaaaaagaaatcatattgcagagcatgtaatcattttaatgaacatgaaatatataatccaagccatcttggtacttcaggtcattgccatgcaaatacagtattacaaagcttggagtgaactgaagtcatctaagcactttcttttaaaagcataaattacaggcattaaaaagctaaaggatgtgaatagacatagggctagatcgtcaatattcatcaattttattttcattgtaagtctttactatataataactccccaagccctcccctgagctattagcctccctctccttctccctctccttctgcacatctatcttccgttttcatgccatttactgctgctagaataacacagagatgggagagcagagggagacattatttgcaattcatacaatatttttcattcatgaatgtcaaagcacaatttcttgaaggttttctaagatgaaaaatattagtattaacctgtgacctttttggagggtctttggtaaatccaaacctcctgccactagtattcctattatggggaatgtgtggggaagttaactaaaggacagaataaagactgcaattttgttgctcctttgtctggatttagctggataatacttcaaatgcacacatcagtgctacgcagtttagcttcttatgctctaatgaattatcagtgactcaacaatgtcaacatgactaagttaatcagctgataataactggcttatatttatataacactttagagcttacaccatgcttttatgtctgtatgttatctcacttgatctgaaagaattagctagaacaggtattaccttcattttttaaaataagaaaatcaaaatttgtaatagtaggtaaatctgaagtgactttgccaagatcagacagctagttggagacagactgagtctcaactcagtttttgtagctctatattgcatttaccagcaatatattataaaatatatattttagaaacatatattctgaatctgaacacttttaagcaaagtacctacattattaaagatagtcaagaactctaacccaagcatatgggcattaaagaaacttattaagccttcttctttgcag

SEQ ID NO: 78 - DNA, 6465 bp, Homo sapiens
  source 1..6465: mol_type = genomic DNA
gtgagtacctcttaccagtcatctttccagttaaaagagacatggtattagtctgttttcacactaccataaagatactacccaagactaggtaatttattaaggaaagaggtttaattgactcgcagttctgtatgggtggggaggcctcaggaaacttacaatcatggcagaaggggaagccggcatgtcttacacgacagcaggtgacagagagcatgaacagggaagagccccttataaaaccatcagatctcatgagaactcactcactattgtgagaacagcatgggggaaaccctccccatgatccagtcaccttctaccaggtccctccctcaacacatggggattatggcgattacaattcgagatgagatttgggtggggtcacaaagccaaaccatatcagacacgtagagataaaaatcgaggtgcctctttctaatttattgtgtgatatatgatttatgttttgaacctacaaacattatgctaatgcctgcaaaaacagtttatttactcatccattcatccatcgtttacttattcaactaattggtattgttaagtgcctgctatgttctaggccttgtttcaggtgctggggatacagcagggaccagagcccagtctctgccctcctagagcttcagagaggacacagaccatctaacagatcagcaagtaaatatccagtatgtcatgtggtgataaacgccatcaccatcgattgtagctggagagaagagagagaggggcagagcaggaaatgaagtcaaggaactggcaggaggttaggaagggctgcagagcatggggctttacagatgggtgaggtctgagcctttactctagactacatgaaacagccaggggagagttttaagaagagtgagacaatagttttaaatggatcactcactctggttgctctgtggagcatagaccatatggataagggacattggctgggagatgagctgggaggctgctgtgtaatcctggtgagatatgacagccaatgccttaatgtggtggtgctgggtgtggtgcaaggtggtcagattctggatatattttgaagacagagccaacatgttggctgttagtttggacataggatataaggaaaagagaagtaagggacagaaccagggttttttgtttgagccactggaagaaggcagttgccatgtactgagatgggaaggcgatggaaggagtgggcattgggtgaggaaagaaagcagtactgtttgagacatttcaagtttgagatgcctattatacagtcaagtcaagaagtcaagtaggcagtaggatgatattcaacttaaggattcagatgagaggtttgggctggggatataaatactggctttgtcagagtttacgtgatatcatgccagagagtggatgagatttacctcaaggtggttctcatttggtgaaagttacagatgaagcaggttgaggcaaagcctctcagctgtctgattgctcataatgcaagcactgcccactggggtactcccctggagactggagagagccctctgtcccctccttattaacaaggctcaatcctgggatggcctggaacttgaccatcaagccccaaaggacttttttccattttccccagaaaatctcatgaaaataaggttccaacccgagggccttaagtgaagttaatgattaaggtgtcccagcagtacccttgtcacatgtacaaagcccactggccacctctgctcaataggaagctaggtccttaatgcatgtatgtgcataagcatggttgcaattgttaagtagtttgcattcaacattttaccatagtcatttttgtgtgtgttggtacttaatcttcttagtgaagattttaatggctctaaaatatttttgcggcttcctgttgagttgctacttagggctaacatctttgagtgaggactgcttgtttatctagggttatcatggctaaggtttacttaattcagttgctctatggggctttcctttgtaggctggccacgtttctgattgtgtatctggtctgttgtgtatatgattctgtccatatggcttctctgcattaaattcattacattgtggtcatagtcagggaccagggtcataccatggggcactagggaaggaaagggtagagaagggagggaagggggaggagaaggggaagagagagaagaaaaggaagggaaagaaagaaaggaaaggaaggagggaagaaaagaagggaaaggaggaagggaaggacagacagaagagcatgaaagacggtgcagactatggggtgctctcgctcttgggggctctccatcctccctacatctcctctctctggagatggtctgcttgtctctggccctagcagccacagattggtaggaaagaagaaaacagaaaactaggcttaagttctttgcaattgtttgtataattgaaccaagtctttgcattcattgccttagcctgacggcgctccctaggatgggatttccggccaggatgctctagtgcaaggcactagggcctaggagcaagtggaccagcttcagatcccatctccgacatttgggagctctgcagtcttctaagttttacttgcagcatttataaaatggatataagaacaccatcttagaggcttgttggtaagaattcaattgagtcatgtgttttgcacactgtataaggtacataccagtgaattaaagtccaggaggctgcagagcgaaccaaaggtcgcaaactgtcacaggctgataacgtttggatgtgtgccccctccaaatctcatgttgaaatgtaatccccagtgtttgaggtggggcctggtgggaggtgttttggtcatgggggtggatccctcacgaatggcttagctccatccctttggtgatgaatgagttcttagttcttgctcagttagttcacaggagatctggttgttcaaaggagtctgggacctcctgctttcctctcttgctccctctctcaccatgtgatacactggcttcccacttcaccttccgccatgattggaagcttcctgagggcttaccagaagctgagcagatgctggtgccaggcttgtacagtctgcagaaccatgagccccttttctttacaaattacccggcctcaggtatttctttatagcgaagcaaaagtggactaatatatgggctatttctgacctgctggaatgtttggttgtgtcctcatggtgtttgtttttgagttattaatgtgaggtttatggcttctcctgagatattagaagtttatgaacacaaggttattgcgttcccactgctgctgtggctgcgggttgattccccccatgcctacccacctgttccccttggactggacaggcgccacccctgtaggcatctgcagttgatgtcccttatctagactgaacaactaggatatgcctggcagagaggaagtgttttttttgtttcgttttgcttttgtttttttttttggtggaatttcactcttgtcgcccaggctggagtgcaatggtgcaatctcagctcaccgcaacatctgcctcccgggttcaggcgattctgctgcctcagcctctcgagtagctgagactacaggcatgtaccaccacacccagctaattttgtatttttagtagagacagggtttcacctttttggtcaggctggtcttgaactcctgacctcaggtgatcttcccacttcagcctcccaaagtgctgggattacaggcatgagccaccgtgcccagcccggagaggagtttttgttgctgctgggcttccgttgttagagtaacacaagtgtttggtgatctcaggtcttaagattgtaaaaagtagctctctgtctgaagctgctgagaacctttgccccaggaatcgcttaggttacacatttatttcactagttaactgctgtattctcagtactcagagtaatgcctggttctttgtagttttcaaagaaaactacagtaatggttttagtaatgtttagtaacatttactaaacaatggtttagtaatggttcagtaatgttttcagtaaatgtttctttaatgaagtccagtaatagttttccttactagctcaaataagtctatgatctactctagtacttaaaattcgacacctacagagcattagagcaattcgtcatacatttgaagtctccaatgtgctgagtaatacactgctcagactcctgggatgggttcattcttccaaggtaccaaagtcttatttattaagcattccacttttttctctttctggaaagaaatttgtccaaatgctatgtgaacagttttctgtcctgataatttattcttcagaagggcattttctttatccatttcttgggcaggataccatatgacatacactttggccaggccccactgctacttatgactagcatatatagtaaaaataagaataaaagaaaacccaacctacattagtactttatgatttctaattctttctaatatattgatttatactaagaaatttgttctacccacctttttgatggttcacagacattgctacaaacaggatgctatactagagtgatatcagagatattgagttatgtgtggacatactttttttctctgcatgaaatggcttccaaccctgttgtccatttgagtttttatgtctgttgtttgcatttttggcttcctcttcactgttactgcctgatgattgctgatgccactgtgcccatctccactggtaccctcctcccctctatagctctcagcttataaattagtacagccggttaaaaaaagatagttaagcttgcttgaacacattgttagattgtgtgaaaataagacaagaccaggtgtggtggcttactcctgtagcctcaacactttcagaggcagcaggatcccttaaggctaggagtttgagaccagcctgggcaatacagcaagaccccatctctacacacaaaaaagtaaaatccaattagccaggcatggtggcatgcacctgcagttctagctaactgagaggctgaggtaggaggattgcttgagcccagaggtttaaggctgcagtgagttatgattgtgccactgcactgcagcctgggggatgaagtgagaccccgtctcaaaaaaagaaaataaataaaaagaaaatacgacaaggtagtggcatctgtgtgagcaaagcaactggcttgctcagtcatttttacctccctccaatttctttgctgtggttttttgattattgatatcactaggtaagtaaccttgggctctgtatagtgtttctataatggtatttgaaatggtgcttggccaccctaatatactgacaataggttcatatatatatattttttgacacagagtcttgctctgtcacccaggctggagtacagtggcacgatctcagctcactgcaacctccacctcctgggttcaagtgattcttatgcctcagcctcccaagtagctatgactacaggtgtgcaccatcacatccagctaatttttgtatttttagtagggacggggtttcaccatgttggccaggctagtctcgaactcttggcctcaagtgatccgccttccttggcctctcaaaatgctgggattatagatgtgagccactgcacccagccaggttcccataattttgacatggtttgatattcagtaatatgtaacacttaaaaagtatgactcaaattattcagatttgagcaatgttgtggttaagagagcatgagcatgtcagccaaaattagctatttacctgttatacagaataaatatattagcttcagaaaaggttcttaattcctcttctcctgctcatcaactttccttagcaggacgtcacttccatgcctttttcatcacaaacttatccctaaatctctaccttcagctctggtggcagctcttgtagttatcccactctcttctttcctctccatttcacattacaaagcccatgataattacaaaaattagttataaattttaatttgaggtagttgactcacaagacgttgcacagtcataaagttcccatgtatgcttccccagcttccccagtgatacatacacataaccatatttacataaccacagtacactgtcaaaaccaggaaatggtcattgatacagtcctcttaactcaggtacagaccttattcagatttcaccagcttttacatttgacatgtagttcaagagccccagctttgcaagacaggactaccttggaaggcagggaagtggaagagaccaagaatgccaagctagaatctttaacaagagatttaggagggaagaagagagagattcaatatgtacagatgtaactgttgatccatcacaattaacctaatttgtttctcttatttttcaccaag

SEQ ID NO: 79 - DNA, 9750 bp, Homo sapiens
  source 1..9750: mol_type = genomic DNA
gtatgagccgcatgctgattgttcattattttcatgatatattgctgaaatgaaattctagatcttttattttgtagctttttatatggagcctaaactactgaggagaaagcatgtctttccctttgcaatttgtttctaccttgatccaaagtacatcaatcatgggctaactggatccacacatcccttctattattttattttattttattttatttttgagatggagtcttgctctgttgcccaggctggagtgcagtggcaccatcttggctcactgcaagctccgcctcccaggttcacgccattctcctgcctcagcctcccgagtagctgggactacaggcgcccaccaccacgctcagctaattttttgtatttttagtggagatggggtttcaccgagttagccaggatggtctccatctcctgacctcgtgatccgcctgcctcagcctcccaaagtgctgggattacaggcatgagccactgcacctggcccatcctttctatttttatgtggaactcctacttaaatctttcattcttggccagcttttggatgtagagttttcaaacctcttagcacaacatggtagatgctccatgaacagtcattaatagctgcctacttgattttgagttaaaaacaattgaattggggcttggtggagcggaaacagagcctgcaagaaggaagtaggagctgttagaggagggatggggaaaaatagggtcttgctgtacgttttggcagttactacatggttaatcactggagcattgttcagtaactgccggggtggcaggatccttattcaagtatttaagcgaaaccattcttttaaaaagtgttctccatttaaaaagtgttctccagccaggcgcagtggctcacgcctgtaatcccagcactgtgggaggccgaggtgggtggatcacctgaggtcaggagtttgagaccaacctggccaacatggtgagaccttgtctcttactaaaagtacaaaaattagcagggcttggtggcgggcacctgtaatcccagccacctgggaggctgagacaggagaatcgcttgaacggtggaggcagaggttgcagtgagctgcactccagtctgggcaacaagagcgaaactccatctcaaaaaaaaaaaaaaaagaaaaaagtgttctccgaatggtttgttttctttccacatatccccactgcattgggtaatttacaaagatattagggagcccagggctgggcatctagaagtcactgttctctttagatccattgatagtagctatgagtctagaaaactcatgggcaaattctttgaaaaggaggaaccaggatgttctctctcctttcaccccccctcactgccccactatgatttggactttttttggttcagggacacaggaattggaagcagaactgaattttgtaccacttgtttttcttgtggttccccaaaaccaagaagttaagtgcccaagagatgttcctctcaacaggagtcagactcgttcttaggtggtgaccaaaacagccctggagccttcctcaaattaatttgggttttcgttgtgtgtgtttattgcattgcatctgtgtttgtgcaccaggttaattgggtgttggttgtagcaactttttttaacggcccgtgagaactgggaattgggccagtctttatttaactcatctttcttgatactccttgcatgcataaagttctgtcagtcggtattactagtcatcaacctcattttaaaaccaagctgccttgtgtatatatttgcaatatccagagctgggtccctccaacttaaaaaaataacttccaacttgaagacgtgacctataactgggttctgcaaattcaattcagtaagtacttccagactccctctactctttgtaaagtatgctactaggtggtatgggtgagtaagatgagtaagatgtgttttccccctccagggtctcataatcccatgaaagaaatagccagcagaatataaataacttaaagtaatggtagattattacacaattcatgttaaaaaggagttgcaagttgggtgttgtggctcacgcctgtaatcccagcactctgggaggccaaggtgggcagatcacctgaggtcaggagtttgagactagcctggccaacatggtaaaaccccgtctctacttaaaatacaaaattagctgagcgtggtggcagatgcctgtaatcccagctacttaggaggctgaggcaggagaatcgcttgaacccaggaggcagaggttgcagtgagctgagatcgcaccactgcactctagcctgggcaacaagagtgaaactccgtctaaaacaaaacgaaacaaaacaaagagttgcaagtcaagggtattgggagaatgggatggtgagaggttaattccagtgtggagaactacaggactgctaggaccccagtaagagctggtatttgactagagccttaacgaaaggttgggctttgaggagccagaattgttcaacagggagatggcgggagcacagactgggctggttggcctaataaccaggcatctaggagttagcaacatccttgctactgtaactgtggtcctggtccaggaactagcagcaactttggtcccgccccagacctacagaatcagaatctgcattttaacaaggtccccaaaatagttgcatacatattcaaatttgagacgccctgttatatgaatgcactccttaaagattcagctaagagtagaacgtttcttagcaaggcagtcctagctgcaggttaaaatcacctggaggatcttgaaagaatattggtacctcggcctaatctcagaccaatagaatgtggaaggtggcagagcctgaatgttaacatttttcaatgccccccaggtgactgtagcaggcagccaaggttgaaatgcactgctccacctcaacatcaaaattgaggccagagggatggttggggtcacccactgtggtggctttaaaaaaataaccaaagaaagtaactaggaagagaaaaatatgtgaatgggtcaattctttacacttgaacatgatagttatctttgacatgaacaagaacaagattctctctccatagactatgagcttctgaaagatggtctagtgcttatgtggcccaggtgtgcttgcctgtaatctctaattcccctgacttagggtttcatgggctcatctgctgcacgtggccacaggagggccttccctgggttcctgtgccctctctttattggagccactgaccctgcctgctggaagtggggacactccaaggccacctctctaacacctacatgattatgatgttttttaaaaagtgccccgtcgttctggtgaagcatcgccttctcttcctatgttctcaccatgtggcccagcttccctggggctcctttttgtcctgtgcacccactcccaagcccttgctttcttctggggcccctcttctctgataggagcctctgggttcctgttacaaaggacctctcttctccgccatgtattcctcggccttgtctatgcctgctgggcacactggctgtattgctcatcccgtccagttactaaagagtgacaggtatattctaagggcctaatgccaaaccctggctgacctgggccatctgtaggccatgttgctcattctctagcatttcctgaaggtattttttcagcagggtgtgaggggccatatacaccactccagcctgggcaagaagagcgaaactccatctaaaacaaaacaaaacaaaacaaaagagttgcaagtcaagggtactgggagaggttaattccagtgtggagaactgcaggacagctaggaccccagcaagaggtggtatttgagcagagccttaaggaaaggttgggcttatataccaccaccacatataccaccctcaagattgggtgctgaaaagaaatggctgccactagaaagaacaatgttcacttaaaatgatgttgttggtatcttcctgttttcccttcagaatcttctcttttctgctcctctacctcctcctcccctccagcctcaagtagacaaaaaagataactactgagtactgggcttaattcctgggtgatgaaataatcatcagtacaacaaacctccatgacatgagtttacctatgtaacaaacttcacacgtacccctgaacctaaaataaaaggtaaaaaaaaaattaaaaaatcttttctttcattgctaagctgattttgtaaccatgtgctacagctgagacttacctaaaaatgaacaaacttctggctctttcctgcccaatatgggtggatgacagccacacgaagtgggtcgattagtccaccacaggaggcctaatgctcttctacacacagatctctttgatctacaacttttccttccagggcggccctcaaaggctgaagcttcctacagtgaactcaaaagtgttttccattttgttttgaactgttcctgcctaatggatgtacccacaccctgttagggttgtgtttctcttcaaggcaacacttgccctctcaggaggtcatccatctaacactggagggtttgttttgatgtttagttttattccttaaaactaattccaagtagggaacaagtccgtaaggtggaaagctctgaacatagagctcaggttaataagaagagccttccttcctgtttctcaggaaatgtcttccgcctgacaatttctctttgcctcaccctaaagggagtaaagcccacgtgataacgtctggtgtgaggactctttttcccagatctatagtgatctcaccatgagtctatacatcaggaggaatccctgctgctgcctgttcagtggaagggagaaactcctaacccataagcactaaggcagccctttctagaatatattgcatgttggaatcatcttgttgggtgagacagagaaaggaatgctctgagctcactgttggggccccatgttccttccaagataactgatactctcttggaaggtggtggagttccagattccaccaggagtgccaccccggggagaggtttctgcccagtcaccaggaagggcagggctcctctcacccagatggggaggcggggatgtttcctttctcacctactgaatggtaaccacatacagcatgcagtccaggacactctgaaataattcgtttctaatcctgggagcacaaaagcataacaggagcatatcggacactgggatgtctgcactgagtgtagctcaaccagcacagggcatggaggggagagactggctggtcgtagggatgtaagaagaaggggacactctcaggcaggcaatatgaggacgtgactttacaatcagtggggcgtgtggaaccgagggcaggcaagtgagacatctacctcattacctgaacacttcaatcccctgcttcagctttggagccagatgatctttgctgcgaccactcaaccctgttgctgcagcatagctgtagataacacgtaaatgaatgcctgtgttccactgtaactggggttactaaaatgggcagtaaatggcccacaggctgtaatttgccaaccactgttatagagaccgtaagaagcttgagggcaggatattgtcttattcagtgtgatatccatacacaggcctgggtcatggagggtgtttggtaaacatttggtgaatgaacacgtgactcctggatgtagcctactgtgtggagcggtttctcaacctcagtgctgctgacatttggggcccgatcgttctttatcctggagggctgtttggtggattctaggatgttaagcagcatctcttgcccctatcctgctagatgccagtaatgacctcttcctccatgtgaggacccaaaatgcctccagacattgccaagtgtctgctggggtgaggggtggggtggggcggtgcagaaccacctaatgttgaagaccatttatgtagggaaggatgtggtaggagatgggagatgtacctttagcctatgggggaggcatttggtgaaggggaagaaaaaaactttattacaaaagaaaaaaaaaggtaacttaaaactaaacacacttttaaaagacacaattgcctgtatatttttccagttttatttctgcacgatcatcctaggcatacttgttggcaaactgttcttaacataaccttacttctatgtcattgcgtattttcctacaatattatctgtagtagctgaggaatattgccttatctgattgtgccataatttatttaaccactaccttcaccaattattgattggtttgctgccagctgctctgctagaaagaagttaatccaacaaggccctgctttttggagccacaggctagcagaaaatgaagacattgagcaagtcagtttggacatgttgagtgttaataaggggtaatgtgggaatttctaacaggggagctgaacctgggggtagggagggggcgtcacaaggaacatttaaggctttggttctcgagcttcatgaaccatcagaatccctgaggagcttgttaaaacacagctcgctgaggtcccccccagacctgatttgttaggtaaggagagggctctgagagtctttatttctaacatattcccaggtgctgccgctgctgctgctggtccagtaactactctgatttaaggagtttccactttctcactacgataagcaactggtaatgatatcttacttatacgcatccctgattatcatgaagaaatagtgtaatggataagaacagaggttctggaaataagggctgggtgtggtggctcacacctgtaatcccagcactatgggaggctgaggtaggcagataacctgaggtcagcagtttgagaccagcctggccaacatggtgaaaccctgtctctactaaaaatacaaaaaaattagctgggcttggtggcgtgcacctgtagtcccagctactcaggaggctgaggcaggagaatcacttgaacctgagaggcggaggttgcagtgagctgaggtcatgccattgcactccagcatggccaacagagaaagactccatctcagaaaaaaaaaaaaaaaaaaaaaagccaggcatggtggcccgtgcctgtagtcccagctactcgggaggcagtacctttagcccttgcaggaggcaggagaatctcttgaactgggaggtggaggctgcagtgagccgagattgtgccactccactccagccagggtgatacagcgagactccatctggaaaaacaaacaaaacacaaaagaaataaaagagcagagattctggaagtagatgacatatgttcataactctggctctaccacataagccatgactcagtttcctgatctgtaagaagggctgattgtgaggattatgtggattcactaacataaaaagcacttagaacacagcctgacacagaataaacagtacttgtgtttgctattattgttgtttctttaaactaaattccctgagtagaatttctggttttaagaataggcagaaatataggattttcaaaatatgccgccaaggtcatcaccggaaagagttttaaagttaaatcatctagagcactggttctcaacgtgtggttcctgggactggcagcatcagcatcacctggggacttctagaaatgcagattctcatgccccaccccgccctaccaaggcagatgctgatttctaccaaagtgtgagccagtgttccagaatgtcattggggttctgttctcaggagcagtaggaccgtgtcattgcactgtttagccctgtgtttcctattgatgttgctcaggtgggttggaggaggaagattgagtccagggttgctctaggcaagttagctactctactacttgtggacgcacagtcggggcctcacctggggccgcagaggggcagggaggggcctgcgtgggaaatcttcgattcttgctagcttgcaacatcaagtcaaacctccttaaacctccatgcatccttttcatgacagggttgctgctttaagggtagagggtttcggtcagcgtctgtgttaacacactcatttaatggttatcaggcaaggctggtccctcagtagggtgggggagggaggctccatgaattcctgggttgactggcatcctcagctttatcatcatcccccagtcactggagggtgaaggcaagaagcaacagtgaaagccacttaagcaagcccctttgatttaatgtttgattttaggctacgtgttggtctgctcgggccgccacaacaaagtatcactgacacagtggcttaaacaacagacaatttttcacagttcgggatgcagaagtccaagatcaaggagccacaacagggctggtttctcccaaggcctccctccgtggcttgcggatgccaccatcttcctgtgtcctcacgtggcctctcctctgtgccattccagggacatgcatccctggggtccgtttctgtgtccaaattttctccttgcataaggaggccagtcagcctggattagggcccagcctaagaggctcattttaacagaatcacctccttaaaggtcttatctccaaatacagtcacattctgagatacggggactaggacttcaacatatgaaatttgggggtacacaaatcagcccataccaggctactctgtggcagagagagagagacagagagagaaagagagaaagagaatagaaaacaagtagagactggaaacctggagaaggctagtaattcaggaaattaggtataatagcaataaactccctcaaagacaatgattgtgtctgctcccctgaccgaagggagatggtggctaattatttgaggccttgacaaaaaagtaactgcatacttaaagaaccccttaaggattaacgcaattgctgccaagtcccccaggttatatccagagctctgcagcttgtcaggcgcagggtctggtggttgatggcctctgcacttggctcccttgggcctaagtttcctctccacatgtgactgctctgtgacttttatgagccccagtctcttcactggtataactggcatgtatgagtacctagtcatatggctgctgagaagactgaattggacaatccacgtaaagggattagcatggtacctagcacattgtaaacactcagtaaaaagctattttaaaaaattgctgcacctatcatgctccagatttaacgtgaccccaaatgaaaccgattaagtttcattcatttctccatctaggctttgaaacaatcattattaaggaaaatatttattataaatgccatacatgttcagtagtttttttttttttttttgaagtcaaatatatgaagactatgaagaaaatgtgaaaacctgtctctcaacacctccctggtctggcttcaaatcctggcctagccctttatgggatcactgactttaattaagcaaattatttgacctctcggggccccagttacgccaactgcaagtggagatagtaaaatcccaacttcatgtcattgcaaagactaaatgagctgatgcattcagtcaaagtgggaaggaagcctggggctggcacacggctggcatacggtataagcacggtaaatgctagcaggtgtcatggttgctttcaccaccagcatcataaacttttgtgcag

SEQ ID NO: 80 - DNA, 4350 bp, Homo sapiens
  source 1..4350: mol_type = genomic DNA
gttttctgccagattcacttgggggtgcatataaaaattgtgtaggaaaacctgaagttcagtagtgacctctaagagagcaaccttgaaaatcttgttttgttttgttttgtttcgttttggttttttgtttgttttgttttgtttttttgagatggagtttcgctcttgttgcccaggcttgagtgcaatggtgtgatctcggctcactgcaaccttgacctcctgggttcaagcggttctcctgcctcagcctcacaagttgctgggattacaggcatgcgccatcacgcctggctaattttgtatttttagtagagatggggtttttccatgttggtcaggctggtctcgaactcccgacctcaggtgatctgcccgcctcgacctcccaaaatgctaggattagaggcgtgagccactgtgcctggcttgttttgttttttgagacggagtctcactctgtcacccaggctggagtgcaatgacacaatctctgctcactgcaacttccgcctcctgggttcaagcgattctcctgcctcagcctcctgagtagctgggattaaaggcacgtgccaccacgtccagctaatatttgtgttttttgtagagatggggtttcgccatggtggccaggctggtcttgaacttctggccccaagtgatcctcctgcctcggcctccctaagtgctgggattacaggtgtgagccaccatgcctggctggttcttatgcttttctgagccaagggaaacaattcacaaattccagaatcttcctctcactgggctggctctatccttggacacagcgtttaagtttattattctgagtgggcatgaacttttctttctttaagtcctgcttttaaaaatttgctctgtggtgttttggtcatatggtagttgttttttttttttttgagacaggatctccttctgtcacccaggctgtagtgcagtgtcacgttgacagctcactgtaacctctgcctcctgggctcaagtgatcctcttgcctctgcctcccaagtagctgagactacaggcatgcaccatcatgtccagctagtttttaattttttgtagagatgaggtctcacatattgccaggctggtctcaaactcctggctgaagccatcctcccgccttagtctccaaaagtgctgagattataggcatgagccactgcactcagccatgtagtagtttttaattgtgatgtagttagatctactcatctattcatttgtgggtcttgtgtaagaaagcactctctaccccagagttacagatgtgtatttcatattttcttcaaatactttatagtcttggcggaattttttttttctttttttttcgagatggcgtcttgccctgtctcctaggctggagtgcagtgctgcaatctcggctcactgcagcctctgcctcctgggttcaagcaattctcatgcctcagcctcccaagtaactgggactacaggcatgcaccaccacactcggctaatttttatattttttagtagagacagggtttcactgtgttggccaggctggtctcaaactcctgacttcaagtggcccacacccgccttggcctcccaaagtgctggggttacagaatgagccaccgcacccggcctcatcttggattttatgcttatgtttatattatttatgttgactttctttttttgtgaatgtgtgaaacagctctagcttatatttttttccctgtgtaccaaatactgtgaatcaattttccatatttcttttttttttttttttttttttgagacagagtctcgctctgttgcccaggctggagtgtagtggcgcgatctcggctcactgcaagctctgcctcccagcttcgcaccattcttctgcctcagcctcccgagtagctgggactacaggcgcccaccaccacgcccagctaattttttgtatttttagtagagacggggtttcaccgtgttagccaggatggtctcgatctcctgatctcgtgatacgcacacctcagcctcccaaagtggtgggattacaggcgtgagccaccgcgcccggccaattttccagatttctttctttttttttttttttgagttggagttttgctcttgttgcccaggctggagtgcaatggtgtaatctcagctcaccacaacctccgcctcccaggttcaagcaagtcttgtgcctcagcctcccgagtagctgggattacaaacatgcgcctccacgcctggctaattttgtatttttagtagagacggggtttctcagtgttggtcaggctggtctcgaactcccgaccccaggtgatccacccaccttggcctccaaaagtgctaggattataggtgtgagccactgcccccgccagatttcttaactctgtagctttaagcgcaactgagtggaagaatattatgtctcttaattttgtggcaaatgaacttagagtgaccacatgattgttttctgcccttttctctcatccagtcctacctgagaaggcttagagctcagaattaagtgctgtcagcagcctctctcctatgtgtggatgctgcttaggggctcagtaagagctacttaggggcttttctttgtagtctttaaaaatgctctcatagttcaagattgattttctttttctaattaaagatgacaagacctggtggtacccaggttgtgtggtctctgaaggcacaaattgtgtcttaattggtgctaccttcacacatggctaagcgtatactggtgtttaaatatttactgtggaaagaacaaacatgtagtcagcacttggaatctgttttcaggctccgtttaagctcttactaaaaaaatccttccaggaggaaagggagcagctctgatgccagaagggcagccccgttggtgggcttgctttttcgttctgagcttttgcttctctatagggcttctttctttttgatccttcttcctgttgcttttagaggttttccccttagggaattttatgttttaataaggctatatatatatatatatatatgcatatataaacttttattaggaaatgttcagacgtgctcaaatagagaatagtatcatgaacagttatcaccatgttgtcagccttgtttcatgacctctcccacgtttaaattttggatggaatattttaaaaacaaatcccaggattggccgggcacagtggctcacacctgtaatcccagcactttgggaggccaaggcaggtggatcacttgagttcaggagtttgagaccaggctgaccaacgtggtgaaaccccgtctctactaaaaatacgaaaaaagtacccaggcgtggtggtgggcgtctgtaatctcagctacttgggaggctgaggcaggaaaatcacttgaacccaggatgtggaggctgcagtgagctgagatcatgccactgcactccagtctgggtgacagagtgagactccgtctcacaaaaacaaacaaacaaaacaaaccccaggcagcctctattttttttcaataatacatacttcagcgtaagtttctttctttttttacatgttatttatttatttagtgtcacccagcctggcacaaagctgattagtatatgtttcaacaaataagaactaaaagaaaacccatcacggtaccattatcattggtaacaaaattaacactaatccctaaatgccctctaatagccagtgcatagtcagttttttgaattgcctcaaaaatgtgcttttgcagttagtttgaaatgggacctaaacaagatccactttttgcatttggttataatgccttttgtgtgtgtgtgtgacagtagaatgtcttgctttctacatttggctgattgttgccttgtagtgtttcagttttcctctattctgcagattccctgtaaactggcaattatctctggaagcttgattagatttagattcaaatttgagggcaagtagacttcttgggcactatgttctttctcccacatcacatcatacctctcttctcattctgtttttagtgatgagagattaatcagtgggattaggtggggtcagcctggagcagtcctttctttacaactatgatcctaggactttggctgcataatgtctgtcatttcccccctctcttatataacatctcaagctgttaagggtgaagtaccgcatacaggtttcccacttgtagatcacactggggatttttgttattgggttccatgtggcttgggctggtgatgggttttagttttaactcaaggtaggacagcatccctcgcttgatggtaactttttgtctcttgcctggcag

SEQ ID NO: 81 - DNA, 5159 bp, Homo sapiens
  source 1..5159: mol_type = genomic DNA
gtgagcaatggcccagagcaccggttggccttctggtcagttggataatcttatataaaaacctgttattaaagttgatgatgttaagtgcaattcatgatgttaagtggaatttagcaaggaaaccaaagagtcttagaatggtaacttccaggtctacatttctggtagacttttgtcctaactctgatattttctggaagcccaggcctcttaatgtcactgggcagcctagactgctaagtattctttatagagaactgaaatttgtttccctggaacattgatccattgttccatgtactgtcttcttgatttaaataggttaatctttgatatattctttgatctgtcagtagagctgggcccggtcactcacgcctgtaatcccagcaatttgggaggctgaggtgggcagattgtttgagctcaggagttgagaccagcctgggcaacatggcaaaaccccgattctccaaaaaattaaaaaaatagcagggcttggtggtgtgcacctgtagtcccagctactcggaaggctgaagtgggagaatttcttgagcccaggtcaaagctgcagtgagtcatgattgtgccaccacactccagcctgggtgacagaacgggactgtctcaaaaaaaagagttcagaacaagactctgtctcaaaaaaaaaaaaaaaaaaagagtttgggctctagacgcagacaaacatgggtgaaattcctgttcttttttttattttgagatggagtctcgctctgtcgcccaggctggagtgcaatggcgcaatcttggcttactgcaaccttcatctgccaagttcaagcaattctcttgccttagcctcccaagtagctggggttacaggcatatgctaccacacatggctaatttttatatttttagtagagatgggattctcatattggccaggctggtctcgaactcctgacctcaggtgatccacctatctcagcctcccaaagtgctgggattataggactgagccactgcacctggcctgaaagtccagttctatcatttagtaatcatgtgactttaacaactgtagaattatcatgagaatttatgagacattaatataaagcagttagcataatgtctagcagttcttaattattattaggattgtctttcagacatttgaagactattatctcctatcttccccaaatcttccctcagctttttctctaggaatcacagcaatattatatctgcctaagacaggtttgagattggggccagtcagcttggttttgtttttcaaccacaggctgtcaagcagcaggtagtaatgaatttatgagtcagtaacctttatacaagccccacacatgctcacaaacaaatgccaagtgatctcaagcagtccaggaaatgggaagtatctccttggggaaccactgcagtggtatgtttggaagaacaagctgcataacttgaatggattttgggggctggaaaggctgtatgtgagacagaagtagaaaaaggagaagtgttgatgaggaagcagtcagggaagagccctcccaggtgaggaaaaataggctaaggagtccatttgtgttatgggagacaactcaaagctgctccaagccaaataagggttttgttttttgtggtttcttttttgagatgcagtcttactctgttgcccaggctagagtgcagtggtgcagtcttggcttactgcaacctctgtctcctgggttcaagcgattctcccacctcagcctccccaagtagctgggattataggcaccggccaccatgcctggctaattttttttttttttttttttagtagagttggggtttcaccatgttggccaggctggtctcgaactcctggcctcaagtgatctgcccacctcagcctcctaaagtactgggattacaggcttgagccaccacgtccggccccaagtaagttttgtttggctcaaaaaaagtcttttttgtttgctttgaaaaacaatttttttttttcagacagagtctcactctgtcgcccaggctggagtgcagtggcacaatctcagctcactgtaccctctgcctccccggttcaaacaattctcctgcctcagcctcccgagtagctgggattacaggcgctcgccaccacgcccggctaatttttctttatttttagtagagacagggtttcaccattttggccaggctggtcttaaactcctgacctcgtgatccacccgcctcggcctcccaaagtgctgggattacaggcatgagccactgcgcccggctgaaaagcaaaattttaataaaaatcctgatgtttggttttcttgcaagatcaccagatccagcaatgttgtgccccagttcctgtgtgtcagcagttggctagaggtcaggaattagtgcctttttttttttttttttttttttttgagacagagtcttactctgtcacccaggctggagtgcagtggtgctatctcggctcactgcaacctctgcctcccgggttcaagccattctcctgcttcagcctcctaagtagctgggattacaggctcccaccaccacacctggctaatttttgtttttgtttttttcttttttccgagatggagtcttgctctgtcgcccaggctgcagtgtggtggcgtgatcttggctcactgcaacctctgcctcccgggttcaagcagttctcctgcctcagcctcccaagtagctggtgttacaggcatctgccaccacacctggctaatttttgtatttttagtagagacggggtttcaccatactggccagcctggtcttgaattcctgacctcgtgatctgcccgccttcgcctcccaaagtgctgagattacaggcatgagccactgtgcccagccctaattttcacatttttagtagagatggggtttcaacatgttggccaggctggtcttgaactcctgacctcaagtgatccacccaccttggcctcccaaagtgctgggattacagacgtgagccactgcacctggccctatgagttccttttttctgtggaaggtaccatcttcatttgactatgcccatcaaaatttttcctggccagacacgatggttcaaacctgtaatcccagcactttgggaggccaaatcgagtagatctcttgatcccaggagttcgagagcagcctggccaacatggtgagacccccgtctctacaaaatataaaaaaattagctgggtgtggtggtgtattcctgtagtcccagctacttggggaattgaagtgggaggacctttctcctcccgaaaggtggaggttgcaaatgacctgagataacaccaccacactccatccaccttgggtaatagagtaagactctgttttgtttgtttgtttgtttgtttgtttgtttgtttgttttgagacagagtcccgctctgtcatccaggctggagtgcagtggcgccatctcggcttactgcaagctccgcctcccgggttcatgccattctgctgcctcagcctgccaaatagctgggactacaggcgcccaccaccacgcccggctaactttttgtatttttagtagagacggggtttcaccgtgttagccaggatgggctcgatctcctgacctcgtgatctacccgcctcggcctcccaaagtgctgggattacaggtatgagccactgtgcctggcctgagtaagaccctgtttcaaagaaaaaaaattttttccttttgctttctagttggagaccaactaaaccaagcctgtatttaagagcatatggttgaaagattaactctggaagcagatggacatcagtttgaatccctatttgcctcttcttaaccgcgtgactgggccgggcgtgctggctcacgcctgtaatcccagcactctgggaggctgaggcaggcagatcacaaggtcaggagatcgccaccatcctggctaacacggtgaaaccccgtctctactaaaaatataaaaaattagctgggcatggtggcaggtgcctgtagtcacagctactcgggaggctgaggcaggagaatggcgtgaacccaggaggcagaggttgcaatgagccgagatcgtgccactgcactccagcctgggcgacagagcgagactccttctcaaaaaaaaaacagaacaaaactgtgtggcttatgcaagtcactagaactctctgagcttgtttttccacctgtaaaatgaagataatactatttactttacagacttgtatgataagatgaagtataagaagcccagcatagtatttggcatgtagtacgtgctcagtaaacacgtaaataaaaataagtaggccagctatggtggctcatgccttttttaatcccagcacttcgggaggctgatgaaggaggattgcttgagcccaggagttcgagacctggttaacatagggaaacacaccatctttttttttttttgagacagagtctcgctgtgtcacccaggctggagtgcagtggcacgatctcaactgactgcaacctccacctcctgggttcaagcgattctcctgcctcagcctcccgagtagagtagctgggactacaggcatgtgccatcatacccggctaatttttgtatttttagtagagactgggtttcgccatgttggccaggctggtctcgaatgcctgacctcaagtgatctgcccacctcagcctcccaaagtgctgggattacaggcgtgagccaccatgcccggccgaccccatctcttaaaaaaagaaaaaaaaaaaaagaaaagaaaagaaaaaaggataggtaggtgtggtggcatgtgctggtagccctggctactcagcgggaggcagaggtgggaggatcacttgagcccaggaggccaaggctacagtcagctgtgatcataccattgcattcccacctgggtgactaagtgagatcctgcctcaaaataaagtaagtaactaagtaagtaaactttaatgtctttttactgagttaaaagcacaaagtacccaattcccttcgtcagggttttcatcacatagcccaaacatatcaccttggggtgtagtgtcttcctttatccctgaagaatatgagacctgttcatcatttgtcttcctattccacag

SEQ ID NO: 82 - DNA, 3155 bp, Homo sapiens
  source 1..3155: mol_type = genomic DNA
gtaagtacattaaaaatactcttaatcagtaaaagtggtttgatttttataggccccagtctgtgaaaatatagaatgtacttttttttaagagacagtttctttaacattcatttagagacagtttcttgctctgtcccccagactgaagtgcagtggtatgatcatagctcactgcagcctcaaactcctgggctcaattgatccttctgcctcagcctcccaagtagctgggactacgggtgtaccccaccatgcctagatatttttttactttttgtagagacagggtcttgctatgttgcccagtctggtcttgaactcccagccgcaagggatcctcttgcctcagcctcccaaagtgctgagattacaggtgtgagccaccacacctggcaaaatgtactttaatatgatagtgaaattatactagattgttatgagtcagtaaaactatgcttttttaaaaagtacttaatttaaaatttgtttttgtatctcaaaaatgttttttattttgcagcatgagtgaatatgcattgaattactagaatgcagtacttgttaaagcaaagaagtctcatgtttattttaaagacattattttagatttttgtttgtttgtttttgctcaagagtagaaactcttagagtccaagttatgtgttaagaaagtgaggaaaagtaaatgttttgtgaagtgtggaatatttaggaaattaggcatagaacaatttgtattggcataaactcagtttttttatatttgcagaaaaataaaacactagtaacaagatgttatattttattttccattcacttacatgagtaaaattaacattaagcaaaagaaacaacagattaccttattctattacgtatttattgaactcttcttatatactgtggttcatactagaaattacatataaaacataacatgttttatgttacctatagtatatgtagtaataatatctagtggcttcccttgagaaaaatagtttcctggcatggggagtggacaatatataaatatcagtattcatcaagactggagacaaaattggtttaatgtacttaacaattttatgtacgtatcttcatttccctattagaagacttatggactgatgaaaaatcacctgtcttggttgtcatgttggttttatttattcattaaatatgtattgagcatctactatatgttggtactggggacaggggtgaaaagccctgcctttgtggggctggcattttagtgagggtgagaaggcagacagcagccatgtaaacaaatgactaaggaggaaataaaacctagaaggtgactgagagaaaatgagagactactcagatgtattggctatgaaaaattttcttctgataactattgccaaagaatctcttcagttggagggctgacttcttgcttgccgtagggaagggaacagggataagtgtttgactgactgacttctgggagtatgcatagaaaaacccttgggtggggcaacatattactatttttaggataaaggtttaaaaataccactctcacttacagatgtaaattttcaagtctttaaaaaatgagctattatgagaactgtaatctaggaggataaagaacctgagatttgcaacagatttcatttgaaatcttcctcgtgctctcttctcctctctaatatgggatgcaatagagtgaatattttacgcagagactcatttctgtattcattgttacgtagccaagaagtatcactttttggtgtagtttatttaaagatatctagtgcagtttgcaaactaagcagacttatttgttgttattttatgtgaattgtggcaaatgtagaggtccagatagaggagaaataagagattgtatctttccttctagttaaaggttacgatgccaaaatggtgacagttactttattttaaagaactaatataatagtgaatattaactatagtgttgctgggagtagttaactatttcaagcttattttcaaccaattcatatcatttttaatgatatttttcaagtaaattcagtaaataattctcagtttgtaaatactttgtttcttatatgctttctgtttcttctttccccatactttaaaattataattttgtttttcaaatgcaaaagccaaaacaaacaaaaatctcatgacatataccaggtgcaggtataaaatgcaaagggatccttcaactctaaaacacctaagcctgtctgtgaatgaatctgacagggccctaacacatgaaagcttataaatagattttagttatgtactgccttaattgttatttgcacataggatgcttatcatagaaaatacttgacataaaaaattaagtttggtttactgttacagtaggattcttgtaaaacattttaaaacatacagaggtcacctctcactggatccttaatctcagtatgtaatgtaatctttctgtaccatctggtgccttaattagagcccaggaaaagaaaagacttattcatgtaagcaggattatatttatgacctgggaaatatttgtttgttcattccaattttttattttaaagatttaatacctaatacaaactgctgtgattggatatttatgttgttgcacatattggtgcagtcggagaggtgagggagagagggaggtgaggggagagggtgggcagacaggcagacacttgtagagaccagttgctacatgaacttacttgcaagtttttctgaggtagtataatgtaggctaagcatgaacaactaaaatcattttacaaagtaaacatcttagttcctctaccaagttgaaaagcacagcagtctgaatgtgcttccagctctgtattcagcagtttgacactatgtaacatctacctatggaatagacagaaaatgttctctaacttattggcactgtatagatagagctttggactctttcttttctatttttccccatggagagatgcttaggtttttcaaacctacttagccattaatgattccatgccttgtacattttgtgcaatatacaaatgtttattttggacttacttacaatgagtataaacccatacaatagtgtcattttggtgtttataacacgctttccctttttacag

SEQ ID NO: 83 - DNA, 1786 bp, Homo sapiens
  source 1..1786: mol_type = genomic DNA
gtgagtgcagtctcttcaccaagataagaacggagcagcttcgtgggccaagagggctggccaggtgctttggttctgcatctgtgtggagggtccctgctggtggggggagatggaggaggggctctggggctgttacccgctcctcatcactgacctttcccagcatccaggcccggcattcactcaggctattatcttgcctcaggtagtgagttgcagactgctcaagttcatgactagccgcatggctccctgcacagcaaattgctttccttcccccaaaggctatgggacaaattctctgagctcagtctgtgagtcagcagttttgaggatagaggccagagggctatgaagggccccagtttgagcacgtggcaggatgtctggttggagtgtcattcaggaagttggagctgttgaaactctcaacctgaagcagagagagaggctggctcagcctgcggcccaaagcacagccctcttccttgtgcacaggtctcctctgctgggctacctgggcacctgtgagctgaggggccagttgaccctgcccctggggtacactgcctctctggaacagctcctgctgtccggggagagtcctttgctgctgggctgcttgggctaagctgactggaggatggggttggggacaggggccgagtcacctgcctcctcccagcccctctcactccccactctcatacactcatgggactgtgctatgttttggcaaaccagctgttgtgcaaaccatatgtctttcagggatatcatgtctggttgactgatggtgccctttcttgtttttttttttttttgttatggatttattcttttgaaaaatctctcagctattacttctgtgcaatgggactgaagatgggaagcagcagctaaggctccacctgccctgtggactgttcttcctctcctcacccttcaccatgactgttgctagtctaggctgttggtattgatgaatatccagcattttttttttttgaggagacatttaggaagataaaacaggcagactgtcccaactggtttttctttcagatttttaattctccgaatggtagatatgcctacagcttgctggctagcccattcagttcatcataatcaacaagcactgatatgcatctgcagtgtgcaagcccttgtccttggcactcgggcagagtccaagaaaatgaggactgggctggggctgtcctggaatgtccacagtctagcaaagatgtgcacacacataactggagcaccagtgggaagcgaagcctgccccagaaggattcaggggaggggatttggagggggaagagatcctgctagagagagcagggagggcttcagggaggagcgggcctcaaagagttgccaggatttgaatacacagggacaagggagaagtcaatcagtataggcgtggtgagggagcctgtgggaactcgggaatggcagttgtgtgtgggaaaagtggggagcctgagaagggaggtggtatcagccacttggtgttcacattccactgtcagtttcagaaagtctggactcctgatttcttatttgtttctcagctgagggctctaaaaacaaatcttcagtgaggatattttatattgcatttggtgctgccattgctggctgcaggctgagctctggatgtgtaaacagtattgtgtgcacactcgtggctccagtgcttggaacagtccattcttcctgaggcatgtgggttgctgatgggatctgttgggtctttcctctgcag

SEQ ID NO: 84 - DNA, 34865 bp, Homo sapiens
  source 1..34865: mol_type = genomic DNA
gtatgtaggtatgttcagaagtcaacatatgtaattcttaaagacttccgaaatgtgacattgtggaccatttaagaaatgtcggctgagcacagtggctgacacctgtaatcccaacactttgagaggctgaggtaggaggatcacttgaggacaggagttcagaaccatcctgggcaacatagtgagtccctgtctctgtaaagaaaataaaaataaagtcacagctgggtgcaggcttacacctgtaatcccagcactttgggaggccaaggcctgtggatcacttgagctcaggagtttgagaccagcctgggcaatgtcacaaagccccacctctactaaaaatataaaaattagccaggtgtggtggcacacgcctatagtcccaactacttggaaggctgaggttgagcctcagcctgagcccaggaggtggaggttgcagtgagccaagatcgcgccactgcactccagcctgggcaacagggccagaccctgtcccaaaaaaaaaaaaaaagtcatcgtcttatgttagcatccttgtaagtgagcctttcctgatattttgcagcctgtctcattctcagtagaaaagtttactctagttacataacttctccctgctgacaatttggatactgtaagcaggcatcaggatattaagatctgaagtgagtagcttataacttttccaaatccagcctagacagttttcctctattaaattattgccctgactttaaaagaagctacttttgaccttgtagcgtttgaacaagttgcactttgtcttcaaagcaagttaaagtttgacctctacttgttttgagcctctcaggtaaagggttatttgaattccctttgcaggttggggttgtgtaccctgtggaggtggtagagtgttatatattgctgctccagggcatttaatccctcctgccttttccattgatgtgctttcaatctagaggaataaaagattgtgttggagacacaatgtggcctgcatagcatctgaaagcctgagaacatgcagggagagacatccctcatccctcagcagcctggctgctgttgaagtggttgtaagaaagtaaaagagaaatgcccacaaaacgttctcagatccagtcattcattagcacttccaaagagagcatgttgactgtgaattgggaaagggccagataaaactagcatagaattctttgaaagactaacggtatttgcattttttaaaaattataaccttactctaccccctaacattgacatcatttttaggtaattaatattttcccatttattattctgtgatctctaatgctttgttcagaataaatagtgtgtttcctttccccacactttcatccaagaagtgtgctagagttcaacaaaaacagcactagaaatcactgtcattctaggaaggccctaattcacagattgtattggtttttagacccagttagtgtgctggaggttggaggattttaacctctgtgggccaactagcctctgtggcctcagtcattcttcctgaccctggctgtgcttgagcctgtgtgttcttatccttcatctccgggggaacgaagtggatcagctcggtccagcgatcacttttggggatcagtggctttgtagatatcgggcaggcacttaccccaaaagaactttccccatatctgaagactgaaaacgtccatatcgtatttggacacactgcccagcaatacgctctagctgtgttcagaagcatgggaatttggaaagatctgctgagcatgccgtttactgtcacagatactatcttcctcaaaaaaaaaaaatatatatatatatatgggggacggggcaggttgagactgggtgagactgaagaggtgccttggccagagcaggccacacccagagaccacaggctccccggtccacctcaggcccctccccttcctgcgccgtttccggcagatccagagtggccaccgccggatgggagtcgggggaagggaggcagagaagcgggccctgaggacaagctctcagtgcttctgtgggaagtggcggcaagacggcagctcccagcgggggatggaggccgagtcagtctgctggtcactggaggccaggatgctgcctaacacagccgtcccgctccgggcctcaccaccagggcggctctccccactcccggcctgctgcccacacagactgcggggttccgggggagcaggacccaggccgttctgcgcctgtcttcttggaaggagcaggccggagcgcgggagcgccgtgtagctgtacctgcgaaggcacaggattccgcgggaagatcccgcagtttcgggccgtcgtcattgtttttatacctgtggcaaatggcatgaccagacacacggttatgtctggagaaacccctgtagaggagcaggaggttgtggacatgctgtggcccggacagtggctgccgagcagttggagcctgcacccgcccaacttggctaaagaagtccccatactctctgtggaaaagatttccagaagctgttgtgtcaatatcaaagcctcaaaacaacaacaacaacaacaaaaacatgaaattatcaacaataaagatcatccttgagtctgctttgaaaagtagggtgaaattctgcagaggcattcaactggcaagataccaccctcatagccagatctgcaggtctcagccatcatgccagggaaaatgctccattcaccactcctcagcttctgcttctggtttcagaggtctctgtattggaggggctttaaagcaagaagggtctttacccacttactcttattcacagatgtgaatatgcaggtccagtggggaaagtgacatgtcctaagtcagaatagagtcaacaagaaaacagggcccaaaatgacttagcctctagtgtataatgggcattgatgagctactggaaatacagagatgaagaaaacacagtcccatcttcaaggagctcaatctagcaagggagacagactctttgtaggtgggaccgggcttccctgcagcagaaggaagcttgaaattggtaacgagcctcagaagggacagaggcaggccaccatgctaccctgagaggatcgcatgtggacacggggctatgacctggccctgctttgacccactagctgtgctgtagggccaggtggagcctggagtggcctgtgctaaggggctactatgagctctttccactcccccaaggcattgcataaataatgtcactttctgtttgcacagcaaaatcagggacacaattttctagaacatggggtgcctcccctccccccagcccaacagaagttctacaatgactgatgggcccttgtttttgtttgagacggaacaccccacagggttccgagtggtgatttgtggcccacaggccactggcaagtggaggcagagctgcagagccctcgggagccacagagggcctgctggccgccacgacatgccaactcagctgctgctggccctcctgtgggcggcagtgctagtgatgtgcagaatcttaggactagtgccaaggaacctataaataccctgggtgacccaggcgtgcactgctgtggtggccttcacagtcagaagatgacaagctgagaaggggagaatcggcccaaggtgagatccacagaaaggccagggccaagatgcggccagcacctcaggctggtggtggtcttacgttgaccatgccagaggccagtccttgattgctccaaaccctctgttcgagggttccaaatgaaatgagcaggtcctcgtgtcaggacctaggttagtttctgaaaaagcatgaaaagcaggcctcctgaacttccccgagtgactgatgcaaagtgcgtcctgcatgcttcacagcaccatggagaggatcttcaggggcaaactgcagactatctgaatgacggcactgaccatcagcaaaccgcagagctgcctgaccaagaaattgcgagacagaagcaatgcttgcaggcgaagaagaaggggccagacacagtggctcacgcctgtaatcccagcactttgggaggccaaggcaggcggatcacttgaggtcaggagtttgagaccagcctgggcaacatagtgaaaccctgtctctactaaaaatacaaaaaattcgccaggcatggtggcaggcacctgtaatcccagctgcttgggagactgagacaggagaattgcttgaacccaggaggcgaaggttgtaacgaactgaaatcgtgccacagcactccatcctgggcgacagagtgagactgtctcaaaaaaaggaggagaagaaggaaaggccaaggcaggaatgaaacaggccatgaatgttggagtgaagcaactggcctcctcgtgctaagcggctactgtgagttctttccactcccccaagacattgcataaataatgtcactttctgacactcaccccgctgaatgtcctgcctctgctcaagggtggtatgatggggacttggcagtggaggggaacagggaaaccagacatggtggtctccccgcttcctggctacaagtccctctgaagaaatccaaaggagtaaagagcttggagagtaggcctctgtagggtgcaagggcacagctggagacggagctcctgaggctgcagctgatgctgcccgctctgcctgaactgcaccaaaaacgtgatgaggccatagcgggagtccacggaggaggatgcctactgcccgacctctagcagagactaagcaaggtgcatgaaaacttgaaccacatgtgtcacacccatgaccactacatgaagatggcccaaaacctggcccaggaattgaagaaagactcttccaatttgctgtaagaaaatggcccagggggcaagcacggtagctcacacctgtaatcctagcactttgggaagctgacgcaggcagatggcttgagctcaggagttccagaccagcctgggcaacatggtgaaaccccgtctctaccaaaaatacaaaaattagccgggtgtggtgatgcatgcctgtggtcccagctactcaggaggctgaggtggaaggattgcctgagtctgtggggcagaggttgcagtgagctgagatcacaccactgcactccagcctgggtgacacagtgagaccccatctcaaaaaaaaaaaaaagaaagaaaacggcccaggaaggctggagggccgccgtgtccattgagagagtgctccaggcactccaaaaagaaaatgaccacaatgggaagaaaccagctgaccatgagaccaagttccaaccttttacaagtggcctgtggctcctggcgccccgcccacagctgacaggggctcagaagtgctagggggaccatgggccaccagggccaccaggagggaggcaggtaacgatgcgagggcttggatgcagaacaccagctggtttgattctgttttccctgtacctgggtcctgaatgcccagaggctcagggaaacaccagccagtgctgctgcctttaaagcacttttgactgatctcttgttaatttagcaactgttattggttgatgctgcagttgctcttattgaagtttgattgatagcattaggatggtaaggcactatttttcaaataaaggttgtttaatataaaaaaaattttgtttttttttctctcagcctttcacattggttcaaaatatctttcatctggctgcatttctgatttttgttttgttttttttttcttaattttatttatttttaattaaaaataattttttttgtcaacatggggtctcactttgttgcctaggttggtctgaaactcgtggcttcaagcaatcctcccacatcagcctcccaaagtgctggggttatgggtgtgagccactgcagcagcctgttttttttgtttgtttgttttttttaatttgacaagttttcaggtcctgtgaaatcagcagtcttacctcccaccttgcgcaccctgaggaggttgcagaataaaggagaattctagggacacgtgggcatcagtgcctgtgctcagagcacctcaggcagtgtggaggggtctagaggttactcaggctctgcctggcaacccgatagcagtatcagagtatagggccaaggggacggtccttgggcttggtgtggtttattagtccttttcctgtgaccctgatggtttggttcactcatttttatctccatactgggaacaggttcaagccccagcatttggttgataatgcaggaatccttgatacttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataagaagacatggcagaagccagcctccgatctgtccacacgaatacagcattcccaaagcaacgtgcatgtgccattattcactggatgagcttgaggtggatgaactagcccaccaggctctcaatgtcatgaatttaacactgaattaagaaaaatatgttttaaaaataatagtttaggtgattgctggggtgctaggagaggaaggaatggggaataactgtttaatgggtatagttggccttgtgtatctgtgggttccacatctgattcaaccaaccgtggatcaaaatatttgaaaataaaaaacaaaacaaaaatgatacaaataaaaaccaatataacaactattaacagcatttacattgtactaggcattataagtaatctggagatgacttaaagcatacagaaggatgtgcctaggttagatgcatgtatcgtaccatttcatatcagggacttgagtacccacggattttggtatctgcagatcctggaaccccttccctatggataccaaggaacaacagcactgggtctccttttggggtgatgcagatgttttgaagctaggcagaggtagtggttgcacaacattgtaaatgtactaaatgccaccaaattattcatttttaaatggttaatgtgttatgtgaatttcaccttaacaactaataatattataggtaaggcacaagttacatctgtagcacaaaaatggccctaatttttaaaacactgctccagcatagcaggtatcacatgtgaggtagcaaaagctggagatcaaagtgtgatacctggagacttatcagtaagggtcaaatgttttttcaggttttgagaatcattcttggaattgttccagaagatatatcgtataactcttcttagatgctaagataagaaggcagatatacactagctcattttgtgttattttctagagctttactccagtcaatttcttgggggcagcatttgtggaatcagtggttcatctgaagggctgtgctgtggaattactatgcatttgttttgtcttccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaattagccgggcatgatggcaggtgcctgtaatcccagctacttgggaggctgaagcggaagaatcgcttgaacccagaggtggaggttgcagtgagccgagatcgtgccattgcactgtaacctgggtgactgagcaaaactctgtctcaaaataataataacaatataataataataatagccatcctttattgtacccttactgggttaatcgtattataccacattacctcattttaatttttactgacctgcactttatacaaagcaacaagcctccaggacattaaaattcatgcaaagttatgctcatgttatattattttcttacttaaagaaggatttattagtggctgggcatggtggcgtgcacctgtaatcccaggtactcaggaggctgagacgggagaattgcttgaccccaggcggaggaggttacagtgagtcgagatcgtacctgagcgacagagcgagactccgtctcaaaaaaaaaaaaaaggagggtttattaatgagaagtttgtattaatatgtagcaaaggcttttccaatgggtgaataaaaacacattccattaagtcaagctgggagcagtggcatatacctatagtcccagctgcacaggaggctgagacaggaggattgcttgaagccaggaattggagatcagcctgggcaacacagcaagatcctatctcttaaaaaaagaaaaaaaaacctattaataataaaacagtataaacaaaagctaaataggtaaaatattttttctgaaataaaattattttttgagtctgatggaaatgtttaagtgcagtaggccagtgccagtgagaaaataaataacatcatacatgtttgtatgtgtttgcatcttgcttctactgaaagtttcagtgcaccccacttacttagaactcggtgacatgatgtactcctttatctgggacacagcacaaaagaggtatgcagtggggctgctctgacatgaaagtggaagttaaggaatctgggctcttatggggtccttgtgggccagcccttcaggcctattttactttcattttacatatagctctaattggtttgattatctcgttcccaaggcagtgggagatccccatttaaggaaagaaaaggggcctggcacagtggctcatgcctgtaatcccagcactttgggaggctgaggcaagtgtatcacctgaggtcaggagttcaagaccagcctggccaacatggcaaaatcccgtctctactaaaaatattaaaaaattggctgggcgtggtggttcgtgcctataatttcagctactcaggaggctgaggcaggagaatcgctgtaacctggggggtggaggttgcagtgagacgagatcatgccacttcactccagcctggccaacagagccatactccgtctcaaataaataaataaataaataaagggacttcaaacacatgaacagcagccaggggaagaatcaaaatcatattctgtcaagcaaactggaaaagtaccactgtgtgtaccaatagcctccccaccacagaccctgggagcatcgcctcatttatggtgtggtccagtcatccatgtgaaggatgagtttccaggaaaaggttattaaatattcactgtaacatactggaggaggtgaggaattgcataatacaatcttagaaaacttttttttcccctttctattttttgagacaggatctcactttggcactcaggctggaggacagtggtacaatcaaagctcatggcagcctcgacctccctgggcttgggcaatcctcccacaggtgtgcacctccatagctggctaatttgtgtattttttgtagagatggggtttcaccatgttgcccaggctggtctctaacacttaggctcaagtgatccacctgcctcgtcctcccaagatgctgggattacaggtgtgtgccacaggtgttcatcagaaagctttttctattatttttaccttcttgagtgggtagaacctcagccacatagaaaataaaatgttctggcatgacttatttagctctctggaattacaaagaaggaatgaggtgtgtaaaagagaacctgggtttttgaatcacaaatttagaatttaatcgaaactctgcctcttacttgtttgtagacactgacagtggcctcatgttttttttttttttaatctataaaatggagatatctaacatgttgagcctgggcccacaggcaaagcacaatcctgatgtgagaagtactcagttcatgacaactgttgttctcacatgcatagcataatttcatattcacattggaggacttctcccaaaatatggatgacgttccctactcaaccttgaacttaatcaaaatactcagtttacttaacttcgtattagattctgattccctggaaccatttatcgtgtgccttaccatgcttatattttacttgatcttttgcataccttctaaaactattttagccaatttaaaatttgacagtttgcattaaattataggtttacaatatgctttatccagctatacctgccccaaattctgacagatgcttttgccacctctaaaggaagacccatgttcatagtgatggagtttgtgtggactaaccatgcaaggttgccaaggaaaaatcgctttacgcttccaaggtacacactaagatgaaagtaattttagtccgtgtccagttggattcttggcacatagttatcttctgctagaacaaactaaaacagctacatgccagcaagggagaaaggggaaggaggggcaaagttttgaaatttcatgtaaatttatgctgttcaaaacgacgagttcatgactttgtgtatagagtaagaaatgccttttcttttttgagacagagtcttgctctgtcacccaggctggagtgcagtggcacgatctgggctcactacaacctccgcctcctgggttcaagcaattctctgcctcagcctcccgagtagctgggattacaggtgcctgccaccacacccggctaatttttgtatttttagtagagacggggtttcaccatcatggccaggctggtcttgaactcctgacctagtaatccacctgcctccgcctcccaaagtgctgggattacaggcgtgagccactgcacccagccagaaatgccttctaatctttggtttatcttaattagccaggacacttggagtgcatcccgaagtacctgatcagtggcccctttggaatgtgtaaaactcagctcacttatatccctgcatccgctacagagacagaatccaagctcatatgttccatcttctctggctgtatagtttaaggaatggaaggcaccagaacagatttattgaaatgtttattagctgaagatttatttagacagttgaggaaaacatcagcacccagcagtaaaattggctctcaaagattttcttctcctgtggaaagtcagacctctgaggccccatccaggtagaagtactagtgcaagaagggcctctgctgtccacttgtgtttctgtgatctgtgggaacattgttaacgccacatcttgacctcaaattgtttagctcctggccagacacggtggctcacacctgtaatcccagcactttgagaggctgaggcaggtggatcacctgaggttaggagttcgaggccagcctggtcaacatggtaaaaccccgcctctactaaaaatacaaaaattagctggccgtagtggcgcacgcctgttatcccagctactcgggaggctgaggcaggagaattgcttgaacctgggtggtggaggttgcagtgagccgagattacaccactgcactccagcctgggtgacaagagggaaactccattaaaaaaatgtaattcccgtgtctgccatcttaagtgtaaaggtggctaaattatatagaaaaataagacaatatcatttcccaattacattcctttcctaccgcactctatgatgctagctgagatttttccaaaagaaaatggcttaaataaaaccctaagagaaagaaaaactttaaatccctccaaagctcaaaagtaatagaaacagatgagtttggagtcaggatttctctgtaagattgcctaggctgtgtactgcacatctccaggtgccactgttgacagagattataactacaatgtgaagtgaatggtgccactgacagttatgcaaaccgtccagagcatagccacctgatcctgctgggattcctcttgccagtccatcagcagttccccttgaaagtttcaccaaacatcccttaaatctgccctctcctgcccgtccccagtggaggtcctcatcatttttcacctgcatttttgcaggagctttcttatatccaccttcctccttttctctcagcccatcatctagctacacagtctccagggtaagctttcagaaaggcaatctcttgtctgtaaaacctaagcaggaccaaggccaagtttcttagcctgaaaaatgtgcttttctgactgaactgttcaggcactgactctacatataattatgcttttctaccccctcacactcaacactttgactccagcaatcccaaatccccagatccctaagtgtgctgtgctattttcacgtggctctcagacttggccagtgctgtttccattttggtctttattccccacatctctgcctggggggtagattctaccctgaaaaatgttcttggcacagccttgcaaactcctcctccactcagcctctgcctggatgcccttgattgttccatgtcctcagcataccatgtttgtctttcccagcactgacctaccatgtgtcacccctgcttggctgtaccttccatgaggctaggactatgtgtctcctttgttgactgctgttgccctagcatcttgcacagttccttgcacacaattagagctctataaatgtcaaataaatgtgttataattatatgtttaagatagttgttcaaataaactctaaataaccccaactccaagagtgttagcaagaaatataaattttacagaagaatggttggaggtggggagggtgtccacggagtgagttacctcacacaggcacggaaaaacttgaacctcctaaggacatttttaagctctctttcccattttctctcctggattcccattgcctggtctcatttctctcttctccaccacaccacttcctcaaaaattcctttagggtttgttcttaagcttagataggtttcccattctgaaatacaaaggcctgataattagccaacttaccttgttggggatgtggaaggcaagactctcagactccatgactcaggtatattgcaacaattaggctgaaagttccttgagagtaagtgtccaaatcttttcatgtttggttcccagggctcactacagttgttggtatatcataggcactctaatatcttcttaaagaatcaatatcattaaaatggccataactgcccatagcaatttacagattcaatgctatttctatcaaactatcaaggtcatttttgttttattttttttctttgagatagaatctcgctattgtcacccaggctggagtgcagtggcgcgatctcgactcactgcaacctccgcctcccgggttcaagtaattctcctgcctcagcctcccgagtagctgggattacacgtgcctgccaccacacctggctaatttttgtatttttagtagagacaaggcttcaacatgttggccaggctggtcttgaactcctgacctcaggtgatccacctgccttggcctcccaaagtgcagggattacagcatgagccactgtgcccggcccatggtaatttttcacagaatcagaagaaactattctaaaattcatatagcggccaggcgaggtggctcacgcctgtaatcccagcactttgggagacagaggcaggaggatcatctgaggtcaggagttcgagaccagcctgtccaacatggtgaaaccctgtctctactaaaaatacaaaaatttgccagtcgtgatggcgggcacctgtagtcccagctactcgagaggctgaggcaggagaattgcttgaacccgggaggtggaggttgcagtgagccgagatcacgccactgcactccagcctgggcaacagagtgagactccatctcaaaaaaataaataaaataaaataaaataaaattcatatagaaccaaaaaagagcccaaatagccaaagtaatcctgagcaaaaagaacaaagctggaagcatcacattacccaacttcaaactctactacaaggctatagcaactaaaacagcatggcactgctacaaaaacagacaggtagactaacggaacagaatagacaactcagaaataaagccacacacctacagccatctgaacttggacaaactcaacaatattaagtaatggggaaaggactccctattcaaaaagtagtgctgggataactggctatccatatacagaagaatgaaactagactgctacctatccccatatacaaaaattaaatcaagatggattaaagacttaaatgtaagatctcaaactaaaaaatcctagaagagccaggcgcggtggctcatgcctgtaatcccagcactctgggaggctgaggcggatggatcacctgaggataggagttcgaggccaggctggccaacatggtgaaaccctgtctctactaaaaatacaaaaattagctgggcatggtagtgtgtgcctgtaatctcagctactcgggaggctgagacaggagaatcgcttgagcctgggaggcagagtgagcccagatcgcaccattacactccagcctgggtgacaggagcaagattccatctcaaaaaaagaaaaagaaaaaaaaaatcctagaagaaaacctagtaaatgcccttcttatatcagccttgacaaagaagttatgactaaatcctagaaagcaattgcaacaaaaacaaaaatttacaagtgggatctaattaaactaaagagattctgcacagcaagagaagctatcaagggagtaaacagacagcctacagaatgggagaaaatattcacaaattatgcatctgacaaaggtctaatatccagaatctataaggaacttaaatcaacaagcaaaaaccaaataaccccattaaaaagtaggcaaaggacacgaacagacatgtctcaaaagaagaaatacaagtgaccaacgaacatgaaaaaatcctcatcatcactaatcatgagagaaatgcaaatcaaaagcacagtgagatatcatttcataccagcaagaatgactattaaaaaagtcaaaaaataacagatgttgcaagactgcagagaaaagagaacgtttatacactgttggtaggaatgtaaatacattcaaccactgtggagaacagtttggagatttctcaaagaactgaattgaactaccagtcgacccagcaatgccattattgagtatatgcccaaaggaaaataaattgttctatcaaaaagacaaatacacccatgtgttcatcacagcactattcacaatggcaaagacatgaaaccaaaccaggtgctcatcaatggtggattagattgtgtacatatataccaccatatggtacatatacactgtggaatactatgctgccataaaaaagaatgtaatcatgtattttgcagcaatatggatgtagctagaggccattattctaaacaaactaacacagaaacagaaaccaaataatgcatgttctgacttaaaagtgggagctaaacactgaatacacatgggcataaagatgggaacaatagacagtgggggctattagagaggcaagggctgaaaaactacctattcggtgccctgctcactatctgggtgacagagtcattagcactccaaagctcagcatcacacagtatacctttgtaacaaacctgcacatgtaccccctgattctaaaataaaagtcgaaggaaaacaacaaaaacaaaaagaaataactcctgagttggggtctccatctcttagttcagcctattggcagtcccctttttcaagttctaaggagcctgtactagactactcttcatttagtcccataataatccctctttcaattattttgccttcaaacctatagggaagggattggaaatgaagtttcagtcattccctaagtaaaatgtatatacatattttaattgaaacaggatttcactctgttgcccaggctggagtgcagtggtgtggtcatggctcactgcagcctcaacctcctgggctcaagcaatgcttccatctcatcctcccaagtagctgggactacaggctcgtaaattttttagagaacaaaaacacagtctttagatttaaacatgtgaaagcagaaattttaaaaatacaatgaaagagttggaagacagagttgaaattgttcagaaattacagtaaaaatactaagagataggaaatagtcaacttccaaatgagaagaatcacgaaagagagaacagaaaagatagaaaaaaaattatcaaagaaataattcaagaacatttccttaaagtgaagggcatgagattccaggtatattccacatatagaaaaatatcccatacaaaatcacattgttatgaattttcataacatgagggacaaaaaaagataatataagtaaccagagagggaaaaaataaataaacaaaacaagacaaataggtcatatacaaagtaatattcatcacaatagcttcatagttctcaataataacaaaaagcctttaaaattctggttgaagcagttcagacaatgccatcacccaaaaatatgccattttggcatactgattattattagctgaaagcacttgagaaacagcagactgtacaggaagggctttccaacctcctcttttctacctaaaaacaggctagaaaatttcccatgataaaggtgccctccctctactagaaagagaaaaacatccttatcaccagagatagggaatcaatgccaaaatggatctgaacaaacttattggaataacccttgtcttccactacttatccccaatatagctcttagtaatttccccaagcccctttgtcttgtcatttcttcacaaatttatcatttctttgtctaaaacatatataaacttgtctgctatggtgacttcttcgggtctacatttgcttgtgaggactcccaggtacatgtaaaattgtaataagacttgcgtgcttttctactgttaatctttcctgtgtcagtttaattcttaggcctagctggaaacttaagagggtagaacagaaatttttcctttcctacatggtgaagggacattctgtaataaaactagcctcaacattaaaaaaatgtgatgtaataaaaaacaaaggaaaaagaaaacaaaacagaaaagcaattaataacactaggaaacacgaggcattgtacaggataggaaacgtcctgttatgttacacaatgcaacagtgggtattgttttcatcattattataatgaaaatgctaaatagtgatttgaccaacaatccagtttaaaacatttggaggaatgtgaatgtttatggccagaaaatggggagaaaaatggttaaggaaacaaaatctcatcatctagagtgggaaggagactgataattcctaatatgaaccaaaaactcaaacttttttttttttttttgagatggggtctcgctctgtcgcccaggctggagtacagtggcacgatctcagctcactgcaacctctgcctcccaggttcaagagattctcctgcctcagcctcttcagtatttgggactacagttgcacactatgatgtctggctaatttttgtatttttagtagagatggggtttcgccatgttggccaggctggtctcgaactcctgacctcagatgatcagtccgccttggccccccaaagtgctgggattacagacatgagccattgcacctggcctgaaaactcattttatttagatatgttaagggaaatctcaaaataatcagctagaaaaattgaaaatggttgcccatgaggaggggagaactgttattatttatgtcaaataaaatttgtaggaagccattgatttggactgtgctcctgcactaggccccaatagaccaaaccacatggagtcactcttgctaaagttccacgtcaccaaaccaaagctaagtagtttatcttaccttctgggaaattaggggagagaaataatagacaaatccccaaacaggccagttttagctggcatataaggaagtcctctctgttttaaccgtattaggagagtaactttgaaaagaccgtccactttttggtccctgtttctgttttcttctgccttttctgcctataaagctaacttcctctgcccagctcactggagtaccttctctgaatttttagaagacaggctgccctgatccatgaattgcaaatgaaagccaattagatcatttaactaaattcattgtaattttgtcttttgacatttgtaaacaagccttgtagtacttgctaaacaatgggctgggcgcagtagctcacacctgtaatcctagcactttgggaggctgaggtgggtggatcacctgaggtcaggagttcgagaccagcctggtcaacatggtgaaactccgtctctactaaaaattcaaaagttagatgggcatggtagcatgtgcctgtagtcccagctactcaggaagctgaggcaggagaattgcttgaatctgggaggcagaggttgcagtgagctgagatagtgccactgtactccagcctgggcagcagagcaacactctgtctcaaaaaaaaaaacaaaaacaaaaacaaaaaaacaacttgctaaacaacatatgtttattatttggtaaattataaacaataaattcaaaactttaaaaagaaaacattttattgatagctcactgaatacaaatttataaaatattatttatgcattaagtttcagttacacattttcacccatcattacagatgtcatatggagttgctagagtatgagaagagcttcttcatcccaacagctttcaaagtgaagaggcgactcatgcctgtaatcccagcactttgggaggctgaggcgggtggttcacttgaggtcaggagtttgagaccagcctggccaacatggtgaaacctcgtctctactaaaaatacaaaaattagctgggcgtggtggcgcacacctgtaatcccagctactcaggaggctgaggcaggagaatcacttgagcccgtgaggtggaggttgaagtgagccaagatcatgccactgcactccagcctgggtaacaaagcaagattctgtctcaaaaaaaaaaaaaaaaaaaaagtgaacatctgggtcccccagatctcttcagagatatgtaatgttctcctttttccaactacataactctttaagctgggttttcttcatatactccaatgaaaacaacatattgcaacagatggaatgaagaggcaagtagaagaatccagctgttttctattaagccaaacattacaattgtcagctgaagaattctgagattcataaatttggaaagaaaagcttcatttctcataaaagattgcagcctgcagggtggccattctgacaggctaagaaatgtagtctctggccagaagccaaaaacagacactgagggtcagaagaataagatgggcatttatgctgaataggatggccaaatatacatattcaataaactacagtcatgaatattcatgaaaggagaaacatgcacatgctcaattgagcttcatgcctctccatgggacgcgtgtgcaaaaaatggcagcattagcatgatcagagggtggagttttctgtcctctgatatcaaaaggtgaaacagaggacacagaaaccctcactgcacatcctctgtaaactggccagaaccactccattgtgggcagtctgttatcaggaaggaatgctggttagttgtgcagaaactgcaaaaggaaggggcagtgtcagaccattggttgatatcagcggtgcagctcgtctttccaaagggctggtttctgtttaacctgtaggaaggaaatcctaatggcgtttagcaatggagagggtataacaacacatcatggcaagaactcagttttcaaggtttctctggggtccccttggccaagaggtggtgcatccgtttagtcagctgggggacttaggatttcatttttatttctcagagttttataaaactctaaaataattatttgacagccaggtgggagggggtccctggagaaactccaaccagcctgcctactagggtggagccttgggagtttgcagcagggaggagcctggcgcctcctcttcctatgtgaacctgggattctagcagcctggtgggaagcactgtagcaggagactctggccttgcagaggatccctgttcccctcatccctttatttccccttttcacttaataaaaccctgctttactcaccctttaaaccatctgcaagcctaaatttttgtggctgtgggatagacaagaaccttctctttagctgaactaaggaaaagtcctgcaatgatcccattcttcacaccaaatatgttttgtttcaaaagtatagttatttatcataaatatgtcattaatattgttaaatcaaatttagcctaaagctgcctccttatatagtttaagcttgacctaaaggtttctctgtacttagtgaattgtagcctacccagatgtgtaaacaagactgtgaactactcttgtgacaaacattggattttggccaatcaaaggaggtcaactcttgacactgctttcaaataaggcaaatattgagctgtaaacaatctggctgtttctatacctcacttctgttttctgtacgccacttttctgtctctgtccataaatgttcttccaccacgtggctgtgctggagtctctgaacctactctggctgaggaggctgcccaattctcaaactgttcaattaaactcggttaaatttaatttgtctaaggttttcttttaaccatataaacaagtgagtttatgattgttatgtcttttttcttttcttttttgagacaaggtcccactctgtcccccaggctggaatacagtggcatgatcacggctcactgtagtctcgcactcccaggctcaagcgatcctccatctcagcctcctgagtagttgggagtacaagtgcatgcaaccatgcctggctaattttttttttttttgtattttttgtagagatagggttttgctacattgcccaggttgatctcgaactcctgagctcaagtgatcctcttgcctcagccttccaaagtgctgggaccacaggcatgagtcaccacacccagctattatttctaaattaatgaacagatgaacattttcaaaatttctcagttttaattttaaatatgattaaaaggatagatataacacacaaacaaaagctctatggagtcctctataactcaagaatataaagggtcctgagatttttctttaaagagaaccactgcactctcctggcctactagctctccgcaatccatcctgcttctccccttggcaggagagacctgttctagaccctcaaggacccctcataacatcacctagctattatctaaggaatctttctccatttggacttcccatttttttcttccccctttaaggtccccttattcttttcatctaattttgtgtgccacctgcagagtccttcttcttcttcttctccttctccttctccttcttcttctcagagtcttgttctgttgcccaggctggattgcagtggcacgatctcggctcacttcagcctctgccttctgggttccagtgattctcctgcctcaggctcctgggtagctgggactacaggtacccaccatcatgactggctaatttttttgtatttttagtagagacggggtttcacaatgttagccaggatggtctctatctcctgacctcgtgatccggccgcctcggccttccaaagtgctgggattacaggcatgagccaccgcacccggcgactaatttttttttttttttttttttttgagacggagtctcactctgtcgcccaggccggactgcggactgcagtggcacaatctcggctcactgcaagctccgcttcccgggttcacgccattctcctgcctcagcctcccgagtagctgggactacaggcacccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcccggccggcgactaatttttatatttttagtagagacggggtttcgccatgttggctgggctggtcttgaactcctgacctcaggtgatccgcccgccttggcctcccaaagtgttgggattacaggcatgagccaacgcacccggcctgagtcctgcttcttccagatctggtgcccagtcctgacgccagaaagggggtcttgttccagaccccaagagtgttcttggatcttgcctgggaaagaattcagggtaagtcgcagagtataatgaagttaagatagttaattagaggctactcaattacagagtagggcatcctcagaaaacaagaggaggaaggcgctaccttaaatgtagtgcttgcttatgtaggttgtataagaattgtgtactttattacaaaggcttgtgatcagcttgtgacaggctattggtactgttattttcctgttactattgatttcagcaagaatttatgagtacactattatatttaaggcaaaacctattccttaagaatgctttttgttcttaaaatactgggacatttccataagttctgagtctttagttagcaacattaactcattccctcaatcataaacatctcatgaccaagagtgcccagttcctggggaatgtaacccagcaggtttggctttattcggcctttattcaagatggagtcactctggttaggacacctctgacagtccctggaaatccaaaggaacccttctgtgtggcacagggaatggaagaaagaaagagatgaggcaggaaaatagggtctggaggcagaaaacataagccgattcacacttcagctatgacaggaaatatcctctccatagggcgtatgcctgtaactttacttcatcctcttcatttacataggacgtatcctaagtaaccaatggaatcgtctagagggtatttaaactcccaaaaattctgtaacagggcctttgagcccctatgctcgggcccgctcccacactgtggagtgtactttcattttcaataaatcccttcattccttccttgctttctttgtgctttgtgcattttatctaattctttgttcaagacgccaggaacctggacgccctcccctggtaatagagagatgagcctttcaaatgacctgactcctttatcccagccaggtgtgtgcccgaccctgaaaggaggaatagggagggggacgttcaacccggcctcccgctctgtgttagcagcgtctggatgggtcagggtggaggtgggggtgttctaccctgctatttgctcctagagaagcttctctgcttcactagtctcacagttctaaaggcaagaacagccctagtgggatcttccaaggattttagaaaagaatgaataagggaaaaattaaaatattgcagggtgccataaaaacatcccagtaaaacaaacacctttctagatgctcattggaacgtaaatggagctcagcccccatcccttcacaccagatccagtcttcatctttgtggttcactgccccctcaccactcaggaggaaaaccccagcttctgttctggctccccttctctcacttagaatttttcaccagagtttcagaaagatttgtcaggaccactccatgcccaaggtaaaaagtgtaagtggtacaaaaaggtagaaactcatcagacccccaaagagtgtcatttaaccatacaaagccctgataaactccagggcagaagaaaaagctgcatccttgactccactggggcattcttatgtaaactaagatccaagaactgcatcaggagagaaatcaagagccctggggatgttaggatgagccctagaggtgctaagacaggttatttgaaaaaccaaaaagtagactgagattcccttccttttcagggaagaattgagacctttcctttcttactgttcagagtgggggctgataagggtaattatttcctggagccactggctactgccctgggaaggaaatccgctgggttgggggagggaggaaggcagaaccaggcattaactctccctccactacatccctttcccgtacccctcccctcctctccttccccccactccctgcccccgccctccgaaaatgacacttggcctgagaaaggaggaaggtagaataggtggacacttcccttgtcctgctccaggggtgtctcagtgacaaggagatgtgaaaaaagaaggaatcccaaggctccccttggaaagaagggagatctccaggggctttgggaagtcaggttagtactgggaaggctgaagactcccagtagatagcgttcagggctgcatttggctgcaatcctataaaatacattcttctctaaggttggatacaagcatttagaagactggccattaaaaaaataaacagtattaataatattaataatcatgagtgtcagtagtgttgaattttttctggaatcctttcccaagttgcctaatgcccagagaaggaaaataacagtgtttagtagacataaattataggattagtgcaagtagctattgagatgatgagccaaggcttgtaaattggttttgttttggttttcctaattagatgtttgcgcctatctgtgtatgtgtgtgtgtgtttgtgcgtgtgcatgctcgcatgtggttaatttcatgacttttgcctctggctcttcctgattaaaaaaaatacttaaaatggtaggaagtggcacacacccttgatggacctgtgtttatattaaagaattggcttagtaaatttaactgggacaaggaaactgtgaaggactgtatttttgccattatttaataattcatatattcaaccgttactgattgcctattttgaaccaggccacgtgctaggatacaatggttaacaaacacattccctcccctcaaggaattcatggtctagtgaaatacagagatagaaaagaaatagaaaagtatatcaataaaatgcattgtggaaagagttatggtcatagtgtgtactatatgcttatagaggctgcctttgtataaacatacataagactgctttttaaattataaaaggcagtacataggccaggcgtggtggctcacacctgtaatcccagcactttgggaggccgaggcgggtggatcatctgaggccacgagttcgagaccagcctggccaacatggtgaaaccccatttctactaaaaatacaaaaaaaaaaaaaaaattagccaggtgtggtggtgggcgcctcatcccagctatcaggaggctgaggcgggagaatcacttaaacccagacggaggttacagtgagctgaggtggagccattgcactccagcctaggcaacaagagcaaaactccatctcaaaaaaaaaaaaaaaaaaaaaaaggcagtacatagtacaaactgcttgggttttgttgttgttgttttactgtaccatataggttggagatcattccacctagtagctgaacattttaagcagatcatctggctacaggcagtgagtaggatgaactgggagagtgatgagtgagttagagagttagggagggagggtgctgtcggagtgttaccggaaaggggtcccgatccacaccctaagagagggttcttggatctcgcacaagaaagaattcagggcgagtccatacagtaaagtgaaagcaagtttattaagaaagtagagaaataaaagaatggctactccatagacagagcagccccgagggctgctgttgcccatttttatggttattccttgatgatatgctaaacaaggggtggattattcatgcctccctttttagaccatatagggtaacttcctgacgttgccatggcatttgtaaactgtcatggcgctggtgggggcgtagtagtgaggatgaccagaggtcactctcgtggccatcttagtgttggtaggttttggccggctccaacaccggcttgttgttttatcagcaaggtctttatgacccatattctatgcccacctcctgtctcatcctgtgacttagaatgccttaactgtctgggaatgcagcccagtaggtttcagccttattttacccagctcctatttaagataaagttgctctggttcacacgcctctgacaagaacatcttcatgcctgtgcctggttgagagagggaggcctctgcgctgctgctggatctagtgaagattcactcagtctctcaaattcctctacagtttctctaatggaagagaaaagtggtgttattgctgctagggagcaacctagaagttattttatttatgccatagatatggtgggctaagcactgtgccaacgttcaataagtcactgcagattctccataaattattgtgacaagtacaattgtttgtaaggcttagatctaggtgtgtaagtccaaagaagggtgtgaagcatctgtatttctgttatgtagttattaggaaaaaggatgttggggccttaaaatggccatttttaacatttccaaacttgtgttgaattctaagattttataattgtatgtttccagttgagaagagctttgatattggtagctctaaataaataaataccgttgacctggaagagaaggtaaagtttagggagaggcctttttttagctttatatttaaacattttttataaatgtgattcatgggccaggcctggtggctcacacctgtaatcccagcacttttggaggccaatgcaggtggatcacttgaggctaggagttcgagagcagcctggccaacatggtaaaaccccatctctactaaaaattagccaggtgtggtagcacacacctgtaatcccagctactcaggaggctgaggcaggggaatcacttgaacccaggaggcgaaggttgcagtgagccgagattgtgccactgcactccagcctgggtgacagagtcagactccgtctcaaaagcaaaacaaaacaaaatgttattcataatgctcgggttgtaactatagtacttatctagcaaaagcttgcttttttttttttggctttgactaattgaaactgcaagagcttactggcagagtggtgtactggtcaatatttaaccaattctccaaaggggaaaaaccctgatttgtatgtaggatttgtcagtttccatggtataaatagtcttcccacagctggtagggtgaccaacttgttctggtttgccaggggctttcccatttttaggcctgaaagtcctgaatcccagaaaattcctcattccccaggaaatagcttgattggtcaccctaatggctggttgcaagctcccgatatgacagaactggacgagaagttgggcagagatgtgcacatggtaccagcctatgccaggagcagcggcctccagcaccccactgtcagggagtccttggcccagtagaggatggttagcagggcccggctgttgttcatattagctctcaaatttaccaccaaccctgtattagtttcctggagctgctgtaacaaagttccacaaacgggggtcttaaacacagaaatctattatctcacagttctggagggcagaaatagaaaattaaggtatgagcaggactctgctcttttgatggctctagataatccgttgtatgtcttttcctcagcttctggtttcacaggtaatctttggcgatccttgacttgcatctgtgtaactccagtctctacctccatcatcctgtggcattcttctttatttttctttctttttttcttttcgagacagagtttcgctctgttacccaggctggagtgcagtggcgtgatctcggctcactgcaacctctgcctcccaggttcaagcgattctcttgcctctggctcccgagtagctgagattacaggtgtgcgccaccacacccagctaatttttgcatttttagtagaggcggggtttcaccatgctggccaggctggtctcgggctcccgacctcaggtcatctccctgccttggccttctaaagtgctgggattacaagcgtgagccactgcactcggcccatggcattcttcttttggtgcctttgtcttcactgacttcttgtaaggaaatcagtcgtattggattagaggcctaccttattccagtatgatctcattgtcttaatttaactaaaacatctgcaacaaccttatttctaaatgaggtcacattctgaggtattagggtttagtacttcaacatatcttttttttttttttgagacagggtctcattctgtcactcaggctggagtgcagtggtgcaatcacacagctcactgtaactttgaactcctgggctcgagcagtcctcctatctcagcctcccagataggtaagattacaggtacatatcaccatgcctagctaatttttcaaattttttataggggctgggcccagtggctcacaccttgtaatccctgtaatcccaacactttggtaggctgaggcgggcggatcacttgaggtcaagagtttgagaccagcctggccaacatggtaaaatcccatctctactaaaaaaaatacaaaaattagccggatgtggtggtgggtacctatcataccagctactcacaaggctgaggccggaaaatccctggaacccgaggggcggagatcgcagtgaaccgagatcacgccatgcactccagcctgggtgacagagcaagacataaccttaaaaaagaaaaaaaaaaatgtagagatgaagtcttgctgtgttgcccaggctagtctcaaatgcctgggctcaagcaatccttctgcctcagtatcccaaagtgctaggattacaggcatgaggcactgcaccaggcctacatcctcttttttttttttttttttttttttttttgagatagagtcttgctctgtctcccaggctggagtgcagtggcacgacctcggctcactgcaacttccacctcctgggttcaagtgattcttctgcctcagcctccagagtagctaagactacaggcataatatctctcttagatatgacaaataatatcacagagtgtacacccactgtgatgttaggagtaatacctccctatgatattacaagtaatactgcctttagatactacaaataatatcacagggtgtacatctactgtgatattaggagtaatacctcccttagatattacaaataatatcacagggtatacacccacggtgatattaggagtaatatctctcttaagcgatcctcccatctcagcctcacagaattaaaggaattacaggaagagctgctatacctggctggatctatgttttaaaaatataacccagataaccctgtggtcagtgtctaagatgaattggattagaccaagggagaaaaactaaagatgggaatactagtttgggactttgcttgcttgcttgctctcatttagaaaacatttagtagttctacaatgctcaggcactgttctgggagtcacaaatataggattgaataaagtaaataaagcacttgctctcctggagctcacttttcactgggggaatgcagatagtagacacatacatctatagtatcagtaagtgctaatagaaaaatgaagcaggtgagatggatcatgctgagtagaatgtatcttcttttccttccttccttccttccctccctccttccttctttccttccttctttctttccttcctttcttcttttctctttcttcctttctctctctttctttgctttttattgtcttaaaatgtacataacataaaatttaccctcttaaccatttttaagaatacaattcaaggccgggcatggtggctcacacctataatcccagcattttgggaggctgaggcaggcggatcatgaggtcaggagtttgaggccagtctggccaatatgatgaaaccccatctctactaaaaaatacaaaaattagccaggcttggtggcacatgcctgtagtcccagctacccgggaggctgaggcaggagaatagctggaacctgggaggcagaggttgcagtgagctgagatcgcaccactgcactcctgcctggacaagagagcaagactctgtctcaaaaataaataaataaataaataataataataataataatacaattcagtagccttaagtacatttgcattgttatgcagccatcaccaccatccatctccagaatttttttgagtggagctctttttaatagagtagttgaaggcctctgtgacacagtagcatctgagcagaagcttgaatgaagtgagaaaagaatccttttgcatagtttaggggaagtatgttccattcctggtcctggaaatagttaagactatcacaatagtgcaggagaaagatgatacaatacagtttgtgtagctgaaaccccgtcttcagaatgtaaaggagaacagatgggaagtcatgttcctcccagaagtaattcatgtagcagagaagccaatgcagatccacgagacagacaattcagtgctctgcacaagaactgtgctttaagcatggagaggatttttgtatctgtcctgggatcctacatcaaacagcatgtggtgattgtgaacacaaacgtacaagactgtgaaccctaccaagtttccttcttccattagatatgaataaggagtcatgagtttcctttggaatgtcctttagcctgttggtacatgttttgcctgtgacgaatgcagttactcataaatcattgagcacattgggtacagagggcaaaagataaattcctgtatttcctctattcggtcaacagaaatacctctaggccataatccattcatccaatctaataattttgccatccataaaaccttcaggtgttctgaattcaacatctttttttttttttttttttttttttgagacagagtcttgctctgtcacccaggctggagtgcaatggcaggatctcggcttactgcaacctccgcctcccagattcaagcgattctcctgcctcagcctcccgagtagctgggattacaggtgcccgccaccacgcccagctaattttttgtattttcagtagagacggggtgtcaccatgttggccaggctggtctcgaactcttgacctcaggcaatccacccgcctcagcctcccaaagtgctgggattacaggcgtgagccaccatgcctggctgaattcgacatcttgcacctaattcctgttcagttaaagacccaaatcatgatctctgacttacctggatatttgaaagattaacttgctgtggtgataccatactagagtcacaaaatcaagccctaccctgccacagccacctaaaggaaattaggtgatatacaaaagaaattgaccatattgttgtccttttagtgactctcctaattttcttcccctgaaaacttacagagaaatttgagtatgtttgccttaggtggatgcttgtttttttattgatatgaaaagcagtaagaggaaatggagttttttggcctgttaaggaagggcagccactgtaaacacagttgagtgcaaattcacagtgttagaatgttgaagtgtatataatgattttgcaaaattttctacaaggctgatacagtatccaatcaggactaggattagatatattgtcatgtatgtttgcgcaggaaatgcagagactctaaggtgctacaactgcaatttgacatgtgggatagttcactggtaactgttgatctccctgaggtttaagtttacagttccacagctctttatctgaaactcttgggctatgtgttatggaatttagaattttttccgaaatacgttgcatatattgtatattatgacatgatacctccaagaaagacttggagtcacatcctataaacaaacacatgaatatatcccagtgaaatgtatgactatttttactaaaacaaatgagaatcataaatagacttacattacttcaggtcagattttgctgccgaattagtttgggcatcgaacttttggtttcagagacaaaactgtgaaattttagattatattatggggttgtggacccatgtaaccctcctctccgtaattcctaaaagcaagcaattgcatcaaccagtctcatgagtagctgcgattctagaaatcaagaatccggatctgaaattagccgggcatggtggcaggcacttgtaatcccagctactggggaggctgaggcaggagaatcgcttgaacccaggaggaaactgcagtgagctgagatcgtgctgctgcactccagcctgggcaacagagtgagactctgtctcaaaaaaaaaaaaaaaaaaaaaaaaagaatccagatctgggcaggaccgaattgctgacatgcccccggtatagcagagacgttttgcctacatgttacacacctgagtaatagttgtcagcagctgatgaagaagatgaatgtgctcttaatgtccatctttgatttccagtcattttgcttctgggtcttggcttcctgaggaaagaagtctccagtaggtgaatgcagtgatatggagaatactttcttctggctgcatgcagtaactcacacctgtaatcccagcacattgggaggctgaggtgggcagtgcacttgaggttgggagttcgagaccagcctggccaacatggcaaaaccccgtctctactgaaaatacaaaaattagctgggcgtggtgacagacacctgtcatcccagctactcggtaggctgaggcatgagaatcacttgaacttgggaggtagaggttgcagtgagccgagatcgtgcctctgcactccagctgggcaacacagcgagactctgtctcaaaaaaaaaaaagtgtgtgagagagagtactttcttcctgtttcctcataggccagttctctctggcatgtgagtttaacatcagtcacctccttcacacacagcgggtgcattcgtaataggaggtccttagctgggagtttttatggcacatcagtggggcgtgaaaacaccacataggagctaatatatctttgctggctgctttctccggctccgcagcagacagaaaccctatgaatcatatccaggggtcaggtgcaggcaacagacaactaatatctcccaagtgagttgaaaaggatcttgttacccagcatcctaaggaggttgtagccttgggaaccacaggcaagaataattaactcagctcctcggttagtgcctcttcagttcgagatggaatttatttgcaggcatggctccttaatatgccaaacccatgctcaagacatactccttctcctggaag

SEQ ID NO: 85 - DNA, 384 bp, Homo sapiens
  source 1..384: mol_type = genomic DNA
gtgggtgcaggctgggcacggtggctcacgcctgtaattccagcactttggaaggccgaggtgaggagatcacttgagcccaggtgttcaagaccagcctgctcaacacagtgaaaccccatctctacagaaaaatacaaaaattagctgggcatggtagcccatacctgtggtcccagctactcgggaggctggcatgggaggatggcttgagcctgggaggtggaggttgcggtgagctgagatggcaccactgtactccagcctggacaacagagcgagactgtcaaaaaaaaaaaaaaaggtgagtgcaggcaggcaggctgagggcattgccaaggactaaaaccagtagagcaacctctggccatgtcacccctgcag

SEQ ID NO: 86 - DNA, 20916 bp, Homo sapiens
  source 1..20916: mol_type = genomic DNA
gtactttcctccctcctattttttcttgaacttatcattttctttttatcttgtttgccaagtttgatttaaactattagaatgtacaactgatgcatgataattgtgggagaaacagtctaaatgtacaaatagagggaaatttaggaggaagtcttgagttgaactgggttagattagaattgtttggctggtaaggaaccaaacttagttgtattattatcacaagtttggaaacattatataagaaatgatatattaaaagtgattttgagtaattgtaaaactttagcttgggaaacggaaagtttaatggaaaaatgaaacctgtcttcaaatcagccaatgtagagaggatttttatctgtaaagaggtcgggtgaaattgatgtgggaggggatgctgtgttggacgcgcatgcattttggagactgcttcttctgcttcttcctctttctggcctctgacatgctggtggtatggtcttgtttatcatattcttctgtgataaagccacctgaattagcccaggggtctccctgttggaggcaggctgagcgtcctccacactccctctgctttcgttgaccatgtggttttgcattcaaggtctgcagagcagttagagtcggctgctcttgtctcatcaagggatgtctgaaggatgggttccaaagtctggattacagatttaaggcatttgattataagagaagcgatctaaatcttttcacacttacttgattttactccatggtcatataattatataatatttccatgtcccttgtgtcttccttccttagacatttaccatgataaatcctatgattgagttgtttttattggtatttgttatttaacaatattaactcagagttacttaaatatattaaatcaaaatgcacagtatgtttattttgtaggttgttaaaaatattttataaataatgaaattataagtgtatgtaaaatttaataagatattgccacacattataatagtaagcagagaagaatattgtttgggataagaagatgtttagcaagagatggcagtcaaggttccttttaatctatagtgaaaaagagaaaaatactgacagtatacaataagaggaattaaaatttaatataaataatcccctttccatgtcagtataagctccatgagagcatggcctttgctgtgtgtgtgtgtgttttttttttcctactcctgtatactctcaattctttgaacagtgcctggcagagtagacactcaaaagatatttattgagtgttaaagccattttgagactcagtctttgaagaagtaaatcaaataatttgattcttcgatagtttataagggctaattttatagaaactgtggcaaggcaactattattgttttcattgctgctttaagtcttaatggctgtttttttaacctttgttttaggttcggaactttttttgagaactgaacttactactttttaaaaagtgttgcaggaattttttctgcctgtttcctttttatttttttgagataattggcagattaactttactgagtttttacttgttacaatcaattaactaagagaactaatctaaatagcaaacagctccttggcaccagctgcagctgtgaaatctctgaattccttgattctgtgaccctcaaatgttctagttgaagccgaggaaagttcccaatcatagtggagctttggttgcagggttacactacagtctatcacctcataaggttgatttttagctgccgagttctatttattcatattttcactagttcaacaaatatgtgttgagtatcttctgtgtacctggtactgtaatatgcatagggaatcagaattttaaaaattactgcctttaaggaaataatctaataaatgagttatttttaatttttatctgctccaataagcctaagagctaggacacagtccactcagtagaagcagcttcctgtggaagtaactatcaagctaaggagctaggtgtgtggaagaggcaggatgggctgtttcaagtttttaaatttgaaaaacagattttccttcttttggtggagaatcactgtaataaacataactaaatagacataaagctcctttccctctcaaagagggctctgtatgattatattattaaacactcattacctcattactagacccagcatcatctattaaaagataagaataaacagctcatcgatttttttgctttgttagctcaagtaggaggcatgaaaaataccaacataagcagctaccacttactgaatgtttcccattgacagctaactaatttacatatattttgtcattgactcattacaagaactcgatacagtaagtacttttattactggctcaccctacattctgctttgcctgaacagtaccagtgtatacctgttatcttaattattattatttttgattaatatagctttattttcattttttattttgattttactttaagttctgggatacacatgcagaacgtgcaggtttgttacatagatatacgtgtgccatggtggtttgctgtacctactgacccgttctctgagttccctcccttcacccccaccccacaacaggccctggtgtgtgttgttctcctccccgtgtattctcattgttcaactcccatttatgagtgagaacatgcagtgtgtggttttctgttcctgtgttagtttgctgagaatgatggcttccagcttcatctatgtccctgcaaaggatatgatctcatttctttttatggctgcatagtattccgtggtgtgtatgtaccacattttctttatccagtttatcattgatgggcattagggttggttccatgtctttgccattgtaaatagtgttgcaataaacatatatgaccatgtgtctttagagtagaatgatttccctgatgaacatcaatgcaaaagtcctcaataaaatacgggcaaaccgaatccagcagcacatcagaaaagcttatccatcaagatcaagttagtttcatccccgggatgcaaggctggttcaacatatgcaaatcaactaatgtaatccatcacataaacagaaccaaggacaaaaaccacatgatgatctcagtagatgcagaaaagacttttgataaaattcaacatcccttcatgttaaaaactctcaataaaataagcattgataaaccatacctagaaataataagagctatttatgacaaacccacaactaatatcatattgaatgggcaaaagctagaagcattccctttgaaaactgatacaagacaaggattccctctcttaccactcctattcaacatagtattagaacttctggccagggcaatcaggcaagagaaagaaataaagggtattcaaaaaggaagagaggaagtcaaattgtctctgtttgcagatgacatgtttctatatttacaaaaccccatcatctcagccccaaaactcctttagctgataagcaacttcagtggagtctcaggatacaaaatcaatgtgcgaaaatcacaagcattcctttacaccagcaatagacaagcagagagccaaatcatgaatgaactcccattcacaattgctacaaagagaataaaatacctagaaatacagttaacaagggatgtgaaggacctcttcaacgagagcaacaaaccactgctcaaggaaataagagaattttaataatcattgtaagaaatgagtagcattctgtctctagttcagaataatattaaattttaattttcaaataacaatcagaaggtacaaattttagtagctgacatctgtcatctctaaacctatttttcaaaatctaaatactataagtcttttgtcacatttttattctacaattgagctctctaaaggagctggaacagctttcattttattattgtagatcatgatatttttcatagatttaactgtgctttttaggcaattaaaatcataaggctaaaataaacacataatttagagtttttccttaaaattattttctagataagttctgtatttgagtagatcatttatgtgtcacattgatatgtttgtggcagtgaagttatatctccctcttttggaaagccaaggcatggcattttggttgagtttaaattgttcttttcatattttcagtttacatagtttcctgaacttacagattgaaaaataatatttttctctggaatagattttcctttgaaattttttacattaataaaaagttaaactttcatacatatatgcacatgtatatttctttggatgtgtggaaaacaacaggacatttgacatgtgtttcaacccaggaaaactttttattttgatatttgaaatgcctttatttttagttgaagagagtcagttttactttttctgtaattatgcaacatgattcataatgtctgtttaaaaaataggacttaatttaaaaaatatggaaagaaaagtagcccttcttataatcattaatggcctggccctccaggctaccatccactcttgacagattttatgggtattcttgctcatcagtttttaggcatttgtaaactgtccttgcccttgtcctctgcctccctgtatttatatgctttttattatcataaaaatatgattatactgtgcctattagtcttcagtttgctgcacccctcctaatatatcatgcaaatctcaaaaggtacattattatgttagttacttgaagaatcaagtccatacccattactaataagagtgatgtctacaaggtataaattagcatttattctggctaagcattcgactataaaaagaaataaaatgtattaatatactcattctagatcactcaagtctgtttcttataatagctaacataattttataacaattgtatgctttcttgaggtattaaaatcagggctgcaccttcattaccactgcttagaagaacaaaatgttcattttctaccctccctgcttcctgcatttgggtcatagaagtgctctgaatttaccctgtaaattgttcaacaatgttgagtgttttgcgggatgtggtttttgttttttctgtgtactcctttgtaactttgcctacagattataaagaagtgcttgagatttaaaatttaaaattaaccattaacatatcccaagaagaccacttatatgtaatgtagaaagaaaatgtttacaagagctaacagtaggttattttagtttaacaagtctcatgtctttttttttttttttttgagacggagtctcgctgtgtcccccaggctggagtgcagtggcgcaatctcggctcactgcaagctctgcctcccgggttcacgccattctcctgcctcagcctctcgagcagctgggactacaggcgcccgccaccacgcccggctaatttttttttgtatttttagtagagacggggtttcactgtgttagccaggatggtctcgatcttctgagctcgtgatccgcccgcctcagcctcccaaagtgctgggattacaagcgtgagccaccacgcccggccaacaaatctcatgtctaacatcaatctagtaattttcatttgtttaattttcataaattacttaaagaacttatttaatcagcatttctaagaggttagaaacactacttcaacccacagaaattaaatggatgtgtagtataatatatgtgaatatatgtgtgtatatataaatgtgtattactattatgaaacactgttgcaaacttcctttgaattaaaaaattctctcagaataggcattatttcatatacaaactagaatgtaatgaaataatataaattgaagaatatacaggtgatggcttttgtttgttgcctttgtaaataacaatgccattgacatttgcatacttatattaaacaaggtttactctgtcattatgctaaatatagttagtttgtgattgccaattctatgtcattgacttaagaagtcacatttacagtcatgttgagaggtttgaagtgataataataatgaaataataatccgtaatgttttgcactggtaattacagtgggtgatttttgcaaatatctgttcatgtgaatagaactataagcaatctcatgaacacattgttctcagctgagcagcacctctttccatttgatcctgagacatgaactcattttaaaattaataatgagttattatataaaaataattttaacatctgaagaaattttgttggttttctttttcttttcaaaatgttggggcgttttaggcccagctgctctcaggtttggacatatctgtactatttgtcttcgtagtgctggcaggtttttttttttttttttttgacacattcaagttttctatttttgccatttaattttccaggctctgtcatttccttaccattctttaagccttcaatccaggttctgcctccagctttgctcatgtgaaccttattccacttcttctctcaaacttattttgattccaaactttctgatattccagatgtgttgtgttcttctgaaatgaggtcctaggttaagtcaaattatgttcttcttatttttcataaaaagagtactgcttctcatcttagttgaaatacagattgaccctcctcttcatcctctctgcccctagcattcctaggtattgccaacttctgtgtctttttgcataactgtaataaactctgcttataaaaaataaattttaaaatttgaattttgaaaccaaatgcacggagaaaatatttttttttctatgcacagcccctttttatgattatttctcatgaaaaagctgattccgaatgtgcacataattatgtgtaggaaggtacaaatggaaattattagtgtcatgaactaattaatgatgacattgaaatgggaaaggttcccttgtcccctcacagggcgcgcgatgggggtgtggctcactacttcagtgccccgctgctcaaacctctgcgagaactcacagacgggcaggctgtggggctccaaccccacggcagtgcctgggggtgaatgtttacagctcatgaagccccagtgggcgtgtgctaccgtgtgcttttagtttgctgtctatatgctgcttgtgttaaccagctcaattagaccctctgccctgtcacaaggacagagggttttctgtatcccgggttcttgccttggtatactggaagaataggatcacatctgggcttggagaatgaatgcaaggttttatcgagtggaagtagctctctgctgatggcagagctagtagggaggtggttttcccctggagttgggcccttcagtggctctggctctcctcagattgccccggccaaactctgtcttgtcccaccagtatatggcctgcgggcatgctgatgtctgttagggtgctcttcagctggcgtgccccctccgcgtcctcctgccttccagctgcttacgctgatgtggtcctctcgacgtctggccacctatgtgtctgcccactggggtcttgggtttttataggcccatgatggttcctggcgggccagggtggtattggaaaatgcaacatttcggctggaagggcaggagtgcttgtcctcacctaggtccatgagagtggagccctagccagggacccagctttctctacccagcacttcccttccctcttctgtattatttaaagggaccatacttttcccttcctagcacttccatatcagctcgataattatctttgagttttccactctttgtgactatgtagataatggattttattacattaagcatcactctgcattctcaggcaaaaccaattgatccctatatgatctacctcacgtacttgcttcttccttccgtttcttatatgagttcattaaccatgttgaaatctagctgcaagagagggagaaaaatgtgatttttaagctttccatgttctctaatacaaggaaagaaagcagaaaggcagtttgactgactaaagagccattatctgctacaattttaaaataaaaattatgtattgagaagaaaagtatcaagttttagtaatggcatttaaagtaacattggtaactttcattttcttttttctttttttttttttttacaaaactgttaatgtttggcaaaatgattgatgtgatgcatagtatggaaattgcaaaatttaaaaaatattgatgggttagaacaacagggtaagatcagaggcttgagtaaatttaccagactcttttatgacagcattcccaagtatagtggaaactttttcataagtaaatgatgtgagtttaaggacaatcataggtatgctcaggaccaccgatggataaatttctgagccagcatggaagccttcaatgatttgagtgagattaacttaagtttataaagatatttaaattttattatttgagaataataaaatagcaggaagggccgggtacggtggctcacacctgtaatcccagcactttgggaagccgaggcgggtggatcacttgaggtggggagtttgagatcagcctgaccaacatagagaaaacaggtctctgtaaaaatacaaaaattagccgggtgtggtggggaatgcctgtaatcccagctagtcggtaggttgaggcaggagaatcgcttgaacccgggaggcggaggttgcggtgagccgagattgtgccattgcactccagcctgggcaacaagggcgaaacttcgtctaaaaataaataaataaaattaaaaaaatgaataaattagtaggaagattaggcaatgaaggattaaatataattgtaaatttttgttaaaacataaatatatttaaaatgcaaagtagagattgagacaaattttattgtgaaatatttctgatttgcaaaagtattattaccagggttttaggaaatatattccctgtaacctgatgttttctttcctttatgataatttattattattattttttaaaaataaagatctatcattttgttactggaacactggtacttgtagctactctgtcttttaccttctcaggtctagcttttatctcctaaagcattagactgcaggtcacaaaatctgaatcaagaacaattggtaggatggtggcagtggttagaaatcagtctaaggcatctttaagatattcctcaggagttcctactgcttttcagggttgaaaactgctgtccaagatacatataaaagcctaatattttcttactgaattaaaggggaaaatgtttgtattccaggcacgtcggagtatacaaatcaatctcaacaagtgtttaatgcgacaggtggttgtgggatacattttagaaaaataattataaaaagcattctttttctctgttttatttaatgcttgtacaaatgaatcaccattatctaaaaaattatactgtccataaagttctgtttcctgattgatcccttaatgtaaacattgattccatagatattttaaatgtattagcaagcttacttttcttgtatctgtgtactgtgaaatatgttgtattttatcatctttttttctttcttccttcaatgtgggcatagtatattttaaatatgattataaaatctggaaaattgaacactttctcacattttttttagaaatactttttttaaaaaataaaaatgtttcatgcttttttcttctaaattatgtagtcatccaattttttttcaagagagcttttgtttggtatttgatcttttattggtgtgccagaaaaaggaagaaaattacagtttgtgactgtttaggtgggcattatttttggttatgtttaataaaagtatttgcactttgaccaagtataccttcaaataatgatgaataaaggtatgcctacaggaaataacctttttctcctgataaagtacatactatacaatctcattcatgatttaaacatttacatttaagctgggttcttttattgaatatcacagttaagtttttgttaaatgtcaaaattaatgtttaactttcttcaatttaaagtgtgtggttcagtgtatgtgtgtgtgttttttttgcacttcagtatgttcatctttatccatcctaatatgtcagtagcattacatttccccacgtgactagtgctcaaattgaaaattatatgttctcatgaacatataattttttttaaatggtcagccataggtcactgcgtctcatcttacgaatattccccatgcctcactcattggtcaggtgagtaattcccagacctgtgctttattgactgaattatattcactagtttattcagtagttttctctacttttccagaggagttgtcacatttagagatcaagctcaaagtttgctgccttgtgccttggctttatctacacaagatgggggcatttatgtttaaatatttagatatatctgaacaaggaaggatgaaagtagcaagcttcattgtgtagaatcctattatttaccactgtttcttcccatcatcactgtttccacctctagtgcctgagtccattatccaaaggtcactccaattcttgaccatcttttataacctactggaatgctgttaaaaaaatcaattgacaagaaattatccaaatgcatatctagtgctacttcttactgatagtcattatctctttcccataatacaaactatttcatcgctttcttatttcttgatggttgtatttactttcatcattgtacatacatatctatttccagttctttttactctaaaatcacctatacctggcaaaatacagattttttgtagaagaaaggagagaaaagaatgatagtgttccaacctgtgagaccttaatttgtaaagaatatttaaagattcaagaggaattcatctcatcattaactgtttatttaatagtcattaactatattcttggatgtaatagtcttaatgtttattgaatatgtaattgtatgttttcttaaaagatcctataatttttagaattatgtattctgtgtgtagtcttcggaatttctctagatttcttttaggggttgagttatttcttttttttccctccatgctttatattttacttcattgcaatggcacttagaatgattgcttaggggccgggtgcggtggctcatacctgtcatcacagcactttgggaggccgaggtgggcggataactagctcaggagtttgagatcaacctggccaatatggtgaaaccccatctctactaaaaatacaaaaaaaaaaaaaaaaaaattagccgggcgtggtggcatgcacctgtagtcccagctacttgggaggctgagacagaagaatcccttgaacctgggaggtggaggttgcagtgaggcgagatcacgccactgcactccagcctgggtgacagactgagactgtctaaaaaaaaataaaaaaaaaataaaaaaagaatgattgcttaggaatcatatttttttcttcaaatgattgaatttattaccacatagacttttgtaattatacttaataaaatatttttaaaagaacttcaactcatcctatgatagtgcttcccctatcctatcacttctgaaaatacttcttagatttttttttattggctttataccagattataactctgtttacttaatagaattctaaccttcactgcacatggatgagtctctttgaagcacactctttcagtaatgaaaactcactgattttttccccttttcatagcctttttcttttattacgatattgatctttcaatatcttggatgtttaaatcccatatttttgtatcatgtgtaattcatttgttttctagtctaagacacctaatcaatctttacatgattacaacatctcagcattgttccttttcttttcacttaggagtgtttattctcacttgttcagggatatcgttttcaatgcctgcttcgtaaatctcaaataatccctttggactttgtctttttgtagtgacctcactttgtaaggtttttgttcaggtaatgtacttgaaatgaagcaaacactttatcagtcctacttagttgtttctttatttctttaaagatttgcctcggtagaaaagcagagaaagaaaaccatattacaattgtaatactccttaactaggctagaagataggggaactagggtataaaccttgggggataatactcctttttataggtgcagaagcttctgtctctctaaatcattctaagtcaggacctggtttcagaagtgactactgacctttatttactttcacaatattctgcagtttcttctttctcatgtgtaagtattacagaaatgagattgtaatatatttataattctctaattggtgttgtcagggacaaagaagctatgtgtattatacctcaaaaatagtctttttttttgttctatacattggtgtctgttatcccaaagttttgtataaactggtctgacactcatttgtatcacattacagatttatttttcatagctaatatactcagtcttttcctttaatgaagttttaaaattatgatttgttagtatttatttttgttagagaaaccctttgtcctattcaagctgttgctatggattcaaccttggaaaggtttcttgttttttattaaagaaaaaaaatacattatgatggcatgttttaaaataagaaatctaaaataatggtatctagtgaaatttgatctataggttattgctttagaagtttaactaatttctatccttttttagttaagctactagccaggatatcttcttttctcctgtgtagtgtccagtcttgcataatataagagctcaggggcaaaatctaatcatttaatctctctctatccacctctctcaattcctgaacattgtagatgtaaagagcctcacaaggatgattttatatgcatatgtcttatataagtttatttgattaattgaaaactatgaactaaattatgaggcaaagaaagagatttctaaaatatatgaactttattatccagataaaattaacagaaaattaaaataatttcaagaaaacagttatgtttatttggtacccatagcaggcttaattaaataatatataatgtcatttgtagcctaaatattaccctaatttatataatcttaccgattaactatgtacagttttagaaaaattcacccaggaagtggtcttttatatattaaggtctgtttaattttagtgatctctttattttaattccccattaatagaaatataaactcaaagttcacaatgaactagcagttacgatgaagagtgtttctgattttcatcttcctagttaggaaattcagaatgcaattttttcaatagatattttttttttgttcactgattatctgtttacttaaatagtttcatctctgtttaatgaagcaaatatgtcaggtattgggtaggaaaaaatattccctttgcttttccatatggtaaatttagaggcttcatttacatcacgtatgcagtgattgtttttgtctaatctttgaaaatacttacgtgggaagaaggctaggtataaaaactgtgtattacaaatttattgtttttttttgttttgttttttttttttttgagacggctggagtgcagtggcgtggtctcggctcactgcaacctctgcctgaaaggttcaagcaattctcctgtttcagcctcccgagtagctggaactacaggcacctgctaccacgcctggctaatttttgtatttttagtagagacggcgtttctccatatggatcaggctggtctggaacttctgacctcaggtgatccacctgccttgacctcccaaattgctttgattacaagcgtgagccacacacccgggcacaaattcacatttttaaagtcccttctctcaagtctggaactcagcaatgtttattttgaaggagtttgctttacctgggaatcgtcaaggagacttaccttgtttagtgaagttcactgtaacgtattagtacatatttgtctactttttgggagtaagaacacaagacaaatgtattatttagactactcatgaagataacttatatctttaaactctttccagtactgacaaatttcaactaagtttatttccattttattcatagaaaaattattgtttccaaattttcccttattggctgtattagtttcctaaggctactgtgtaaatatgttggctttaaataatgtaaatgtattctctcatagctttgaagtgcagaagttaaaaatcagtatcaccaggctgaaatcaagttgttgtcagggccatagtccctctggaggttctaggggagaatgtgttccatgacattttcagcttctggaagtggctggcattccttcgctagtatcctcgtcactccactctctccctcctgggtcacagtgtcttctcctcttctatatgtaaaatctccctctgtgattgcccccctgcagaatctggaaatggagtaagaatctctccatttccagatttgtactttaatcacatctgcaaagaccttcttttgtcacagaaggtatcattcacagattcttggcgtagggtgtggatatcttttgggaggccattttcagcctcacacaatggcaaagagattcttgcccacatactcttcacataagcttcattaatgttaaattggctcagcagaaatgacaagcagagctgtggatagaatttatacaaataggtcctgttttaaacaaaacaaaacaaaaacaaggataagtagtgaaagattagtttggttgaaatgaaatttatgagctttactttaaattgtattaagttattttaaagttttagcgattataaattctatctatgcattttaaaataatgtttacactagatatttgtgactattaaaaacacacatttggctgggcgtggtggctcagccctgtaatcccagcactttgggagaccgaggcatgtggatcacctgaggtcaggagttcgagagcagcctggccgacatggtgaaaccctgcctctactaaaaaaaatacagaaagtatctgggcgtggtggcaggtgcctgtaatcccagctactcaggaggctgaggcaggagaattgcttgaacctgggaggtggaggttgcagtgagtggaggtggcaccattgcattctagcctgggcgacaagagtaaaactccataacaacaacaacaacaacaacaataacaaaaacacacatttatttcttcgggattcaggtcattggtagaattgttagcttttcatctggaatatcacttatttttctacttaattacaaatttttgattacttttttcttttttatgttccttccaccctcttctacaaattacttaaaaattaattataggccgggtgcagtggctcatgcctgtaatcccagtacttttggaggctgaagtgggcagatcacctgaggtcagttgttcaagataagcctggccaacatggtgaaaccctttctctactaaaaataacaattagccagacctgtctgtgtgtctctgtgtgtgtgtttcagtcttattggaaatacacatatacatatatatgcacacagaatactgatattcagcattgtacactggtatggctatacttattattaaaataaaaatattttaatatttgataaataggtactgctcagggacttgtgagtacaactcctaccaccctcatgtttcttccagaacttccagaactcgggacaactcagctattaaaggattaacagctggcaaatactctgtggccatcatctcatctgattggtagaaacaaaaaatatacatgttgttaaaatatgttgggtttatgtgtacatatatcaaaacattgttttacaccttgaatatatacaatttttgttaattataactcaataaagctgaaattttaaaagtgaaataaaaaagaagtggaagtagtatttttctataaattagaaatcacttgtttgataattcactttgacctgtagcctatcaaatagttatcttgatcaatatgttttttttcactctgctttaagcaaaaattttttaaagaaaagcttctcctcacaacattaggagatatttgtagtataattggggcaatttgaattatatgattcaataactgtgcgttttctgttagcctgctacactttccttcatgaagcctagagctacattcattaccatctttcaaaatatgctaacagttacttctaaccagctgaacacatccgattttttatataaaactgttggccacctaaggaacatattatctcagtaattttccagtacatggaaaatttgtgttttgcaagaagcactttaaaatatattccaagcatgaatgaacacacacacacacacacacttttttgtcttcaacatttactgttttttatattgtgtatttgagttttaaatgacatgttctaaataaaatttgactttaaaccattcactaagttaatttgacttttacacagttagaagtttcttttattaaattatttatgtaatctaataatgtcttttgatgataacctcctataagtcaaataaataatttggctcattaaaaaggattattatggtattatttggtattattatggtattattttcattatatttctttcaagtaatttgatatattttgttaagttgtatttcttaatgtgttaatatacttaaggtacgcaagatgtacaccttaagtagcacactctgcagatgtatgtgtgattagatgattcatatatttgtaatccttactaaaccgcttatatttttggaatctagaatctgtacaagtaaatgaagtgataatatcaaaacgtatagctaaaaaataaaaactactaacaatccccttacccataggtaaccatattgatatttttatatcttttaaaatactttaggctgtgagtttttgtgcatttacattagaaagatacaatatattctttcatataacttagaagactttttctgcaacctttaatatgcttaaatagtatattttttaacaactatacattattcagtcactctgtgtttgctaatagaagtagcaccaagactgatagacaaggctattgttttttgagcacatatcttgattgtttccatgaggcaagcttttataattagtattgctgattcattgaagttacttttttcttttagctttattttttttttgtagacagggtctttctctgttgtccaggctggagtgcagtgtcatgatcatagctcactgtacccttgaactctttggctcaagctgtcctcttgcctcaccctcctaattaacgaggactgtatgcatgcatcatcatgccgtttaatttagcttaattttattttatttttcattaatcttttgtagagaccaggtctccttatgttgcccaggctggtctcaaattcctgacctcaagtgatcctcccatctcagcctcccaaagtgctgagattgtaggtgtgagccactgtgcctgacctggaattaatttttctgaatttttgatgcagattgtcaaattgctattcagaaattttatactgctttatactcacactagcagtgtatcagacctcccatttgacagtatcaagtgaactcttttaaacattagctaccagacttattgttgaaagatcaatcaagccagttctttctttcagtttgctccatagcatgctgacattttgaggttgtgagttaaatgacataaagttttctctaaaaatttttccgactggaatttgaactcattggagcataacacaaatgcaggatgtaccctccccctcaccaaaagagttttgtgagcaaagtttagtccgtaaaggctatagtctttactctttgcattgtctctcaaattaaatttatttagatttattatgatactcttatttggttatgaagattacaagaatttagaaacagaaagtgaaaagcaaggtgagacagctactatagacaaatgtactagtaagtaaaacctaagttactataacaaaaatacttgcaaaatccaggggcctaaagagtagagatatttattatgtaacaatcacaggtcagtgttccggatttggtagaaagctttgctctccttaacagttggttgcaattccatgaataagagagaaggagaaaatggagaaattaaaatactccactcaacaagcaaccctagtagaaatgactgttagagtagcagaagacagaacctttggaaacaaaatattgaagttattcagtgaatgagcaaatactcctttgtcaagtctgtgatttgattttaccctacctacaaacttagaagttaacctgttaccatattgtcgattctggcccaggactcctagaacagagaacaattattttattactcatggcacagtaggtatcatattttcattggctccccttgtcctccaagccccataggggtgacactatatgacccagatggctgctgctcacacgttgggttcacatcatagctggataatattgagcctggagaatcccttcttttgtagcagctctgtgtcttcaagggcatcattatgttatccttgaaggctgcttgctagaaggacagccctaagaaatggctcccattaacaatggtcagggccttgccttcttggcatacccagcaaaagatataggagcatcagagaaccatgcaggtattgttcctttcaacattcaacacccatcactcagtagcctctggagacatttgtgtgtacagcaagatgaatggattagtgttccaaaggatgtgggggttaaattcagcatgaagtagattcttcatgtcttaaaattgcaagtattttctctgccaacagacacctttagaaattattattagtttatgatgggcctttggaggtattatagagccgtttacaaaacagagaaagcataggtggatagattagccaaagtggtagtcacggaaaactggtttatagtattttgtttcctcataccttgttctgggttgatgagtgagcaaaaggccctttcttaaacatattactgtagcatattatgctacaaattcatgtagcttaagggagttttttttttaagcttaaaatagttgaaatagattggtcttattgattcatgttttgtgataatggcttgaataatagcaacacctggcgatgattagctttaataggtgggaggcataatgaaggagaaataattgtattcatgtaacttagacattcctttcaccacttacttggcctctccgtcataaaccataatttattattttttggcatctgaaggaagtgctgtggaagcctgttcagagaagagaagtgagtattagaagctctgcgttgagcttttggctctgccgcttggttattttgggacttctggcaacttatgtaatctcacttaatatttaggtcacaaagattttctggaatcaagtgagataagaatgtaaaagtctttataaactataaggcattatacaaatatttaattactaagaattgtgagtacttaacctttctctattagaggagactgaagaatacgttctcctcaatgatgaggacataatatagcttttaatctggatttttaaaattgtattctacctccttttagaaagtttagtaaaaaaggcaactttgtgtaaaagctacaatttcagcctgctgcattggctcacgcctgtaatctcagcactctgggaggctgagacaggaggatcacttgagcccaggagctcaagactagcctgggcaacacagagaaaccccatttctacaaaaaaaccccagacccccccaaaattagctgagcatggtggtacatgcctgtagtcccagctcctcgaaaggctgaattgggaggatcacctgagcctgtgaggttgaggctgcagtgagctgcgatcgcaccactgtgctccacctgggtgacagagtgagtccctgtctcaaaaaaataaaataaataaaaagctatcatttcaatcatttggaagttccatttatatggctggataaattcaaaatcatttattcagttctaagtcttaatggtagattcagttaaaaaaataaatttgttattttttattatcaaaaatagtcatattgctggcaaatatgtgaacggatgattaaaggagataatgtttggttttatatggtaaagaatacaacaaataggaggtaaaagaagttgagaaggtgtggaaaatgtatgtgtctgtgcgtgcacattgtgttaatcaaacctgtttttcttctttagcttcctgaacatgttttcattagttgctatagaaagcaaatgaaagagatggttatataactcactaattgctttttttaatggagtaggatgattttctcccattgattgattaattgacagaagcttccaaataatattcttgtctttttagtatctactgttcgtttaagtaagcactcttatggctggtttgcagtggtggaaattgccagaaagccataaaatgttcaagctggaagttactttaaggatgatatagtaacagcagatgagaaaaccaacattgatagaattatgttcctgaaggtcacacatctgtatggtggtctagattcttaagatcagtcctcctttcctacttgtagcagtgctcctaaaccattatgtattatcagagttctggatgtattttaaagcaataacatgtcattctctttttag

SEQ ID NO: 87 - DNA, 29187 bp, Homo sapiens
  source 1..29187: mol_type = genomic DNA
gtaagaccccgggtgacccctttctttagggggacttgagaccctcacactcgctttgtttgctcctgggcttcccagtggatctttgcatgatgagtttgctccctaaaaatatttactgagttcctgtcacatgaaaccatggttctttaggttgcttataatggaaagcaattctagataactaaatttaacaaacaaaagtattctaaggatacagtctctctcaggggatttaggaaagagttaaataggtttagaaaaagacaagagccaggacagtcctggtgccttaagtgggaatttataggtcttctgtctagggcagtggttctcaaagggtgaagggcaattttgtccctcaggtgacatttggcaatgcctggagacacattcagtgatcacggctgggaatctgcttgctgatctaatgggtagaggccagggccagaagatgcaggaaaacaccttacagggtccaggacagccccctacatcacaaaacacaaaattatccaacctcacatgttggtaggctgtggttgagaaacgctgctgtacaaaattacataactaggctgtaatcagtcccaatttcactccagagaaaggatttctgatgcattttgaggtcaaagactctttcctagacttatcaggcatgactcacggtggagtcatgttgtaccaacatggcaactcatgttcttatcccgtggaggaatgaaggaaaggcaatctctattgcagtctaatgagactgtggcatttatagaactgtaaagccgcttgggccagctgtgtcaccagaagcatttcctcctgtctgccctttctacttcatagctggtgatctcactatagcccggggtttcctggcatggcctctagaggctggccgtggcttggaatggcaggttggtttcctttcaattgccaacacggaggaaataggaaaagcaaagtcagctcagatagcaggttaacaccaaaaatgagctcggtatgaggaggatagaaaggctcaagccagagggcagaagccccgttcaaatagtggaggctatattcagagatgattacagaacgtgttatgccaggctacaggtgggagagaaaaatctagttaccactacagtgaaatgcaatatcaaaataggcagaggttagctagtgcatagggttagtgtgaattcgaatgaagtgcacaattacttgtggcttcttatcttctttctattcacagagttaaatcctagattctcacagtgccatcaggcattctaaatgtgttttatatttaactcccaaatgagaacatgtgagtctttgaattctccatagggcatttgtaccttcctcagatcactggccatgttctctgctgtgtaataatgatttgtggctgtgttggtcagctttttgctgtgagatcttagaggcgtacaacagtaagcatttattttcctcatggtagtgcaggttgagtggagaagctctgcctggggtggggatagtgcctctgcttcctgccacaagcgtacgaatcagtggtgtggtctctgctccacacgtgtttctgctgtgtctcgggctgaaaaggtagcagctacctggggaagctcttttcctggccatggcagaagcacagaaaggaacgcctagctgcacatgcacatttcaagccactgcttggtcacgttcacgtctgctaacatccttctgtccaaagcaggtcaggtggccaagttcagggtcaagggattgcaggtatactctgcctttcatgagataggtcttgaagttttatggcaatagtgtggacactgagagtatgctgaagaattggggccaaatgttttgcctatcacaggggtggataatcacccttacaggggatgaactattcagcaaacaggagtcttatttccagcattacaacaaaacactgaacatcacaggtaaattggtcaataaaggtttgaatgaataaatacatgtatggatgaatgattgattgatgttaagatgtatttcatttggctggaaacttttaaatgtgataggtatctgtcaaataagtgagttctaactctagccccacccaccattggtgtcactctcgaagcatctattataaaacagctaacatatttagggacttgggtatgtcaatcatcatactggatgcattacatacgttcctcaatgtaatcttcgtaaccttatgaggttaaatgttgcttattcccactttacagaggaggaaattgaatctcagagggcaaatcccctagctagtaagtggcaaagcttctacttcagggaccttactctggaagggggccaattagggaagactgttgttatatttaattctctaagttatctatcaaagatgactaaactcttgagatgtataaatcctttaggaaggagtaatttagtgcacatctgaactaaatctactgtcccatttacaaatacttctatgaaagaagtgatcttttttagcctcggtttattcatctgtgaaagggtacagaaataattacctaataaggctggtgtgaagatgaaatgggagaatacatgtaaagtgcatagcttagcttagcatagaccctgtaacatacaagtggttcaataaatgttagccatcaccattgtagttacagaaaaggggtcccaatgcagacctcaagagagggttcttggatctcatgcaagaaagaattcagggcaagtccatggagtaaagtcaaagcaagtttattaagaaagttaaggaataaaagaatggctactccatagacagagcagacccaaggctgggttatttcttgatgatatgctaaacacggggtggattattcatgcctcccttttttagaccatatagggtaacttcctgatgttgccatggcatttgtaaactgtcatggcgctggtgggagtgtagcagtggggacgaccagagatccctctcatggccatcttggttttgttgggttttggccagcttctttactgcaacctgttttgtctctcagcatggtctttatgatctatatcttttgcccacctcctatctcatcttgtgacttagaatgccttaagccatttacgaatgcagcccagtaggtctcagcctcattttacccagctactatttaagatggagtgttctggttcacacgcctctgatatcattattatcattatcatcaccaccaccatcaccgtcatcatcatcatcatcatgaccattgccatcatcctcattaccacgatcatcaccaccatcatcatggccatcaccaccaccctcctcctcctcttcatccttctccttctcatcatcaccatagttgcccgtgcacaactctagtatcaaacacaacttctttagtgttgcactggcaataatgtagtcaagttagtaacacagaaacaacttttgtggtgctaaacagaaaaggtcttctttgcaccaaataaaaaataaacagtaaaagcatccagatgggccaggggtttgttcatgtacttacagaacatctaggttctcatcgatattttctgttctggctcattgccttcctggtcagacttgggtttgggaaatgtctctattcagcttcatctcttgaggccatcgggaggcataagacttgggagagaaaatgccattggtccagggggtgtctccagatgatcttcccggaaagccatgaccaattctgaatgtctctctaggagtaaatacatgaattaacacagctgcataaatatttcacttatcgtatgcagcttcagcaggattaattatgctctaaaattagacgtgtaaagagcacagtgctgagcagtacctaattattcatcctctagaatggagtgtttatctcttgttacacagtagcttcagtggacgattatgagtctaatgagtgtcaaaagtataaaaaattttcctaatgagctgtgtaaatataacctttgaatggagtgtttggttattgagggaacctcttacatgaagcctgccatgcatttccctaggaaaaaggctgttcatctgcctggaagcatacacaagatcctagcaagatgttgccttccttttccatctaattgtctgtggtctttctaaaatgatagagtgcaccatggcatctttggctctcagtactggagtaacaatgctcatgcatatgtttcagcattgctcagcatcgatacccaacatttactgagaaacagatgttttcgtaggcactgatattcccagaaggggttatcatggtctttttcttcttaccctcaatgaacttacagtccagtaggctgacaaatgtataaatgcaaaatatctaatcctaaaatcgaaacgtttctagtaattcacatatataaatttatatcacacgtgtatatatacacatatgtagacatacatatacacatgtgttatgtatgtggtatatattcttatgtatgtgtatatatatacatacatatatattcttaggtgtgttgggtagataagagaatggtcaaggagaaatacgagacataactagtatctttaagaataaaggacagaatgattcataaagaaaacacgtgtggcaagatttagacaaagaatagaatgggccagggttcacagaagactcagccatttattcatccagcaaccagcaactctttattgagtacctcgattctgcttggtccctaaaaggtaacacttgagtgagaacctgaagactgggtaagccttggacttaaagaatggcatttctggctttgaagtaaaggtgaacaggggatcccataagtcccatctatctcatgcattttgtgattttcaaaaaaatgattgtggggtttgaagaagcagaagaaagaccataaaggtcaaacccttctcatatctgggggccagaacaaaagatactgagaagaacaagaatgcctaattttattattcagtcacaagtgatgctgagaaaagggaaggaaaaaattgttttaggtcctctcatctatggttcagcactatgccaagcacatcacatataatatcctagtaagcctttatataatattctggagtaaatcttattatctcccttgcacaaagcaggaaaatgaggctccaatgagtaaagtgaactgcagcagagctcattcagctttaccatgagcaagaatcacgtgaggatcttcctaaaacaaagactgtttcagtgggtctagggtggagcctgagacccagcatttctaacaagctgccaggtgatgctgaggctaccagccaatggacaacaccctgttcagacttttatagaggtaacaattggctctagttcatctgagtccaattctgatcatttcctactaaaccaagctgcaaggagaaacctggtttgcaggcggccaggtcagcttagctataagtaatactttttagtattgagaagcgtttaatcttcttctttgtattttgctcagttttaatggttgtggatttatttttaaactccaatagacattactcatccctgacatctagtctgaggtcatttaacacataaaattaaatgtatatatttatcatgtatgttaaaaattatgtatatggcatattcaattgcacctatatcatatttaggtatatataatagatatgtgaagtatttgaaagatatggtacacatatctctcgcattgatattatattaggctaggtgcagtggctcatgcctgtaatcttaactactcaggagcctgaggtgggaggtttgcttgaatccaggaggtcaagatcagcccaggcaacatagcaaaaacccatctctacaaaaaaattttttaaattactgggcatggtggtacatgcttgtaggcccacctactcaggaggctgaggcaggaggattgcttgagctcaggagtttgaggctgcagtgagccatgatcatgtcactgcactgcagcctgggtggcagagtgagaccttgtctccaaaaaataattacattaatagagtgaccaactcaaccaatgttgcctggactgtccaagttttaaaactagtgagtgaccccagttatatcatatttgtacatataatcatatgttaaatatttgaaagatacacacacacacacacacacacacacacaattttacttcatcaggttccctctgttccttttgtactgcaacttttgccagcaataattttaaagactcatctagattgttaacagattggagaggaccacaaaccctgctctcatgttaataaggaaacttcctgcaatggactctagagttttaatagcaccattcagcataatgatgctcacagatcttggagtgggggagccttggaagtcaatggagaactcactttctccctctgagtgggtcagtgttggcatcctgagtcctttttttgttggccttgtatcttccactgaagcatacaagatagcttttgacggcaggggaccccgtgctggcaggcagaatagaaagtgtttgtgtggtcacagaagtccttgtatctaattagaattctcataaattgctctgggccgctggatgggttgctaatatcctcaacactgcccttgatcaacttcccagcttaatatctttgggctgacatccgagtctggggtagagctggacagtcccacagctcaggcagtgatgaccacacatgtgtccattctgaggacggcgtatccctgagaggccttcacagccagtcttcttagggctggcttaggaatggtatgacagtgtggactggggaaatccttgaatgccccttacccctgaatatttttccctttcaactttctacagcatccagaatttcaccatttgaaattttttttttagataagtgtggattgctgcatgcaacaccctataaaaatggaattcctccttccctcttttcctaaccccatttcctgatatgacatctcatccatccttcagcctctgcgctcctctgtgaatactcccataaagacctctaagctagataccctgcctgtgaactcccttatctctacacttgtggcatttagcaaagcaagagaagtgaaataagtaagatgaaggttctgcagtttcctagtggtgtgacctggggcaaattaatttcttagagtctcatttttctcattttaaaatcagaattctttaaggattaaatatgaaaataaacataaagaagctagtccatgcctggcacacattagatgccattgttggcctctccatgtgccctgggccacttgagtgcactgcattatagattcctcgagggcatacgctatccatgtccacccctgttgctgttcccttactgcaggactcagtggagcttggcataaacaaaatttgtttaatgaatgaacaaatgaatgaattagaaaatactgcagatacacttttgcaagtcttatgtcatcgatttaataccttctttaatgaaagggaccttattttctttagaaaggacactagatacctctagagagagagatgcaaggaggtaatcactgaatcactgccaatcttttgacagtcttcccaggcatcttacctctgtattcaccacaagatagaggcaaattcctccattgtcttatttgtatattataatagtcaaatatccctgtattatgctctttaatgcaatatatgcaatatgcatatgaggcacatatatgcacatatttaatatgtgcaatatgaggcatataaccaacagaattatatattccctggcttttacaactgtagtggatcataaattgctacttagtccagtaatatggaaactgaagccacagaggggatatgacctcacctaaagatgcacagcgagggagtgcagagttggggctcaaacccaggttctctgcctcctagacaaattatatattaaaaacaaaacaaagggaacacaaaaccagtgatggtcctttgttctgtttctttgggaaagacttgacctctgcagtagaagtaatggtcgtagaggacagttggggtatctccaggcatattggtcagcagccccatccaaatcataaaagcctccagtagaatgagccttgctgtctcccaggcaccctccttccctgcagcacagtagaggcaagacaggagaaacaatgtggactccaaaacatgtgctttgtttatttcaggcaagactgcatgctaatgggagaacagtagacaagtttcatatccatagtgttcccaggcacacaccactggtttatgtctttctttgacaaaccagccctgttcacagtttctccctttcttccatgcaaacctcttccaaactgtagctctaatgccttccccaaggaggggcttgtgaaataaagctgcgttgctccacccttgacttttgctgttcttcactgatgtggttttgttcattgcaatgtcattagcatgaatagagaattctaaaaccccaacaaccaggaatgataattgcacagttttgacttagccagaccctttgccaaactggatcgagctcctactgtgttctttgctaaacttgctgctgcagtcctaagaatttaaacactcaaaagcgtcctccttaatttatttatgtgtttgtgtgtgtgtgtgtgtgtgtgtgtgtgtgtgtgtgtatgtatgtttcatatatcttatcaaccaaggtttgttttccaaattctctaaactcagacaggaattcaggcgttcccacataatagtcagcaacataagtcagaactcatggttcttccatgtccaccagatctagggagggttctggaatatgggattcagtctctttaatcaagaacctgggagagagggactgtaccttcaggggcccagaaattagtaccatgaggctgaaatctgttctttagtctgctggtttatgatgaagagggcgaccaagaaaaaatagtatttcccttagcatttatcaaaacccatgacccaaatcccggttactgcctggttttgaaaatgaagttttattgaaacccaatcacatgtaaagcctagtcattgcaacagaaaccataaggcctgcaaaggccagtatgtttattatctggccttttacagaacaagtttgatggcacctagtctagactgtctggagacagataagaagggcagagaaggctgggtgcagtggctcacacctgtaatcccagcactttgagaggccgaggagggtggatcacgaggtcaggagttcgagaccagcctggccaatatggtgaaaccccttctctactaaaaaatacaaaaattagccaggtgtggtggtgggtgcctgtagtcccagctactcaggaggctgaggcaggagaattacttgaacccaggaggcggagtttgcagtgagtcgagttcgcgccactgcactctagcctgggcaacaaaatgagactctgtctcagaaaaaaaaaaaaaaaaaagaagacttaaagttggttgtccagttctcctaagagaagggagaagatgaagatgagaacaagaagaaagaaagacaaatagtgtggggaaggaaaaagggatagagatatatgagggagaaattagagggggaaaaaaggagaaggaggtggtaataataaaggataaagaagagaaaagaaggccaggcatgatggctcatgcctgtaatcccggcactttaggaggccaaggtaggtgaatcactcgaggttaggagtttgagaccagcctggccaacatggcaaaaccccatttctactaaaaatacacaaatcagccaggcatggtggtaggtacctataatcccagctactctggaggctgaggcaggagaatcacttgaacccaggaggtggaggtggcagtgagctgagatccacaccactgcactccagcctgggcaacagagcaagactccatcccaaaaaaaaagaaaaaaaatagagtcaaaaagtaaggagagagaagagaaaggaagagagagaaaaaagggaggagtaaagggagagagaggcaaagaaagaaggagtgggagaggtaagaaatgtttgctaagtgatagttcaggcaatgtttagcctgtgcatccacagagcaggctagttttattaaactgagaattagccatgctgcagatgaaattgaagatgtctcagagccatccgtgcttctcctcggctccggtgtgttggtacaaggcacagaccaccagatgactcactcctgccttggagatgtctaatctgtctttcgatggcttccctgccagcaattcttcctgacataggtccctgtgtcctcagatgactcagcaacacccattacaaccagcagcctcagcccaattaaagagataaatgcaaagtaaaaatagaggggagaggaactgcagagcatctgaaaacctcgtttgagaggatgggacagttttccatttctccacatggaagtagttcaacagctaccatgattgttatagatatttgtcataataagtaacacgagaaggataactacatgtcacaaaatcatctcagtccttgtatgtatttatccatgaagagagccaaactctgtaaaatattcgaagaaatctattctgagccaaatgtgagggccatgacccaggacacagccccccaggaggtcctgagaacaagaacatgtgcccaaggtggttgggctacagcctggttttacatgttttagggagacaaaagacatcaatcaatacctgtgaggcatgcattggtgcagtctgatagggcgggataacccgaagtggggtagagggtggggcacaagtaaaaggtagagtcaaagtccaaagattttctgatttgcaattggttgaaagagttaaattattatagaaatgcctggaatcaagagaaaggactttctgggttaagagaaggagttgtggagactagggttcttatgtgcatgaagcctcagtgtttctattcagacctctaaaagatgctggattctcagatagtctcttcaagattgggagggcctggaatggggaaagatcttgttatgttaatagagaatatatatataagatgcatttttccccaacaagaatggctttgcaggccatttaaaaatacggcaaagaaacatatttggaggtaaaatattttgacttcctcctttatctgtcatgtgatgttctgccaaagttggaaactaagccatgttatatagcatggaataaaacccctctgacaagactttattgtctgtaggatgtgactcttcaggtcccttagatagggctttgggcaagagaagaaaatggtcggagtttggtccttatattaatttcatttgcccctcacaatgactaaatggcatggagttataattattcattcctatttacatatgaggaaactgagtcacaggtcagttaagtaaggtgtccaggattatccagctaagtgggagatctgagattggtacaattggtacctatgcaggagggcgccaggatctttgctttaatctttacatgatgttacttctttagctgctataaaccctcatagacatcttggaagacaggtggttttctcatctggaaaggggcaaggctgtgatttaaacacaggtaggtcacaccccagagtcagtgctccttcctcttttactaatgaaacagcatcattaccctgcagaaggtactgggcaaaatcactttgcgacagaagtttagggtgggagagaaaatgacctacactttttttccattgttcatggtgaaggagactcgtccatgcctcaggccccagcaccgtgggagcaggcccagcctaatttttgagatcattcaaccctgccagtttggggaaaactaaggacccagaagcaggagatgagaaggaatgaaacaaggacagaatgtaattaagagaagtcagatgtttggcctcgatacaggcttgcaaagcagcctctccaggttcacaaagacctgtcttggttgctggaattgcttgttccccacagagcttcttggagctgcataatctccagaatttcagaaagttattgttccttgctaaacgtgttttaatcaaattgagacttcaaaggcagaaatcacagttggggatgagctgggctagtctgtaaattactaactttctaatcaagttaggaagaactgggtgccattgacaacccccttcccatgtattcacccatttgttcattcattcattctcccttctagtcatcgattcaacaaagaacaactgagcagcttttaaactccaggtggtgggatataaaaatgattaaacactcctgctctattgcccttgcctatggagatgcttttgacattttgcatccaatagaatcacttggcaagaaaatacagacacctaattttcacctcctgtggggcatttctacatcctttctgggtgattctaatacacattaagggttttttttattgaaacttatactttttatctagtgttctaaattgaatctccatgtacataattttataatattttataacttttaagtgaaaattcttaaagcaggcatttgctccctttacattatatatatatatatttaattatactttaagttttagggtacacgtgcacaacgtgcaggtttattacatatgtgtacatgtgccatgttggtgtgctgtacccattaactcgtcatttaacattaggtatatctcctaatgctatccctcccccctccccccaccccacaacagtccccagagtgtgatgttccccttcctgtgtccatgtgatctcattgttcaattcccacctatgagtaagaacatgtggtgtttggttttttgtccttgcgatagtttgctgagaatgatggtttccagcttcatccatgtccctacaaaggatatgaattcatcattttttatggctgcatagtattccatgttgtatatgtgccacattttcttaatccagtctatcattgttggacatttaggttggttccaagtctttgctattgtgaatagtgctgcaataaacacacgtgtgcatgtgtctttatggcagcatgatttataatcctttgggtatatacccagtaatgggatggctggctcaaatggtatttctagttctagatccctgaggaatcgccacactgacttccacaatggttgaactagtttacagtcccaccaacagtgtaagtgttcctatttctccacatcctctgcagcacctgttgtttcctgactttttaatgattgccattctaactggtgtgagatggtatctcattgtggttttgatttgcatttctctgatggccagtgatgatgagcattttttcatgtatcttttgactgcataaatgtcttcttttgagaagtgtctgttcatatgcttcacccactttttgatggggttgtttgtttttttcttgtaaatttgtttgagttcattgtagattctggatattagccctttgtcagatgagtagattgcaaaaattttctcccattctgtaggttgcccgttcactctgatggtagtttcttttgctgtgcagaagctctttagtttaattagatcccatttgtcaattttggcttttgttgccattgcttttggtgttttagacatgaagtccttgcccatgcctatgtcctgagtggtattgcctaggttttcttctagggtttttatggttttaggttttttgtttgtttgttttttttttttggttgttgttgttgttagagttttgctcttgtagcccaggctggaatgcagtggtgagatctcggcttactgtaacctctgcttcctgggttcaagcaattttcctgccttagcctcccgagtagctgggattacaggcacccaccaccacgcctggctaatttttgtatttgtagtagagactgggttttgccatgttggccaggctggtcttgaactcctgacctcaggtgatccacccacctcggcttcccaaagtgctgggattagagctgtgagccaccacacccagccatataattctttttaaaaaacttttgttggaagttcatgggtacatgtacgggtttgctatataggtaaacttgtgtcatgggggtttgttgtacagattatttcatcacccaggtattaagcccagtacccattatttgtttttcctgatcctctccctcctcctatcctccaccctccattaggccccagtgtgtgttgctcccttctatatgtctatgtgttctcatcctttagctctcccttgaaagtgagaacatggggtatttggttttctgttcctttgttagtttactgagaataatggtcttcagctccatccataaggtttaagaatcactctttaaagtaacaatatttaccatttagaaacattttatcctgtgattggcagacgttgagtacacatatcagttgccatccaatcactcagttggggtccatgatattgaatctttgccctgagttttattcattctctttctctcagggcttctaattgggtttacacagagcccttggtgattgtgaaaactagaggcataaatggtttggcacttctaagcgttagtccacatgccaaccacaataaagaacataggagatatgagggtaggctatgaatggaagacgtagtcagataagctttaatgttaagcttcctcatccaggaaggatcgaaatagacatgaaagcctttattgcttccaaagatttcattttcatttattgactataataacagtgttaaaaataaagcaggcaaaactgaaaaccccacatttgggtaaagactgagccagcacttctatcgattaaatcggatctggaactagatttggacgcaatggctatcctgattccttatacgtgtagacggggtctcatgtgaaaccacggggaaagtgcagctaaagaccgttgattgagtctaattttttatgtggatttcattattgctcccacgtatgtgggtgacttttgcatgtacataaacctcatgtatacacaaagataatacactgatgatatagacatcagaagggggtgatcattaataaccattctgatgccccaacaactaagtcacttactctcctatgacccaaaaactgtctagggcaaaccatttattcagaaatgcaacgttttcaaataagagatatgtcagttctaagcatagattagcaataaaggacttaactgcttctccattggcctgtgaccagatgataccataaaaattagacttgtttatttccctcctaattttaactagagacatatttggaataataatggaacagtacttattaagaaacagataatatccataaatatcctggagagccactgagtcttcctcagtggtaaaactccaggggatttaatctgcgtaaatttgcagtgaattccctaatgggcctgttgagattcagaatcttagtgtctgttatcaatccaacaccaggattagtacaaggtcagcatgccaggcccatgcctgacaagcagtgaattgctcaaaccagagaaagtcaaatgtcaagagaaccatcaaagtggaaataagatataatgaatggcttgttggtaagtcaaacattgatgtcacataggctcgtgcaaaatttatggcatggataaacagtggccccaaatccctctcagtctatattttttaaacactttaatttggaaaggcaatatattatatatacagttgtccctcagtattgtggaggattggtttgagggtctcctacagacaccaaaatctgtggatgctcaagttcctgatataaaatggtgtagcatttgaatataatctatgcacatcttatactttaaatcatctctagtttacttataatacctaatgcaatataaatgcgatctaaatagttgttacaccgtatggtttaggaaacaatgacaagaaaaaaaagtctgtatatgtttagtgcagacaccattttctccccaaaatattttcaatctgtgatcatttgaattcacaaatacagaaagggctgactgtacatataatcaccccaatctactactttaacataattgtttttaatttatgtattatctcctgatccctgttacttgcagacacatttctttaattataattattggttatatatacttttatagtccatgatttttcacttattattacattttaagcattcttatgtaactatactatctgctttcacaattattttaattttttgcataaaatgtcatcatctttattaaaccagaaaccattacattattttccaaatgctacacattttgatatttggctagtatagataacgatggaagaaatttcttcatgcctatttcttttttcttttgaactatttgcaacaaactcttagatgtagaatttaaaggttactggttctaaagatctctaggagtcttgatatatggcgtcatattgatgcccaaaaggtttgttaaccctgggtgcagtgactcatacctgtaatcccagcactttaggaggccaaggtggggggattgcttgagcccaggagttcaagactagcctgggcaacatggtgagaccccatctctacaaaaaataaagacattatctaggcatagtggcatgcacctgtggtcctagctactttggaagctgaggtgggaggatcacttgagcctgggaggttgaggctgcagagagcagtgttccttccactgcactccagcatgggtgacagaacaagaccctgtctcaaagaaaaaaaagttttgtttccatctaaagtaatagtaatagtggatcaatgtaccaattttaccactatctagcagcattaggcattacagttctttttgctattttagaaggtgcaacatgctatctcttttatataaatataaaaagttatttcatgtttcatgttttgattggttaaatcagaattctgcaaattatggcccattacatgttttttataaagttttactggaacacaaccacactcattcctgtattacgcattgtctatggctgtttttgtgctacaaaggcagagttgagtagttgtgatagagaccgtatggcctgtagtgctgaaaatatttactaattggccgtttaccataaaaaaaaaaaaagattagtgacctctggcttaaacaataaaagtgacatgttattttgaaacaattccaacaattggaagaatttaactaaacatgactggtttccccttatccttaaagaaattttctctttttgtaaagaaatatcacgcttaaaaaagtttgtatttttctctcctctggtttagaaagtctgttttcttcaactttccttattattacctcacttaacccccaaagtaaaagaacacttatacctgtactatgccactcactgtttttttctatttgttaccttctataaactatgacatacattcgttatattgcacaaatcccaatatccagttaatttttgtacagctgtgcaactcccacccagattgagctataaaatgtgaccactatcctagaaagcttcctcatggcccatgccagtcaatatgccccccacaagtaatcaacattctgtcctccatgaccatggggtggttttgtcttcttttgatcctcaaataaatggtggaatcatacaacatgtattcattgatgtctcttgtgacattgatacatattactgcatgtaaccacagctcattattttttttcgttgctgggtggtattttatcgtacaaatttatccattttgctgctgatgggcatttacatcacttttagtttttgtctgctttggatatttttgtacctttcttgtgcacaaaggcacttattggtttggaaatatacctaggaatgaaattgctgggtaatagagcgcgtctactcaactttagtagatactttgaaccagtgttctgaaaatgtaaaccaatttacattcctgccagcagtgcaggtagtttctccaatttgcaagtgctccttttcgactttctgtaagaggtaaagctggcttgtgcaacagaactctaggtgtcttcatcagtggctgtgtggttggctgttgccaccagtcatttagagatccagattcttgccccaacatcaacattgccttattttgtgaccttggttcatgtaacctgacctcagatttaatgtcagtacaatgggggcagaggactgtggagtctgccccacttactttcctgagttagaattgatatctagcttctctgccacccgcatgtgctcttccactcatccctggccactgtctcaccccatctggtgccttagacttgggaaaagggagaggaggtcagaggagcacctccatacctggggagcgggaggatgtcatcaaaggaagagctgagagctctcctaagtcataacccagccctgcacaccaccctattaccctctatggaaagaaaaacagggtcttccttctgctttagttacggatggttctgacagctgatatagggtcccttctgtaatagttttatttctcactttctgtccttctccattcccctttttcttcctcctccttctcttccctgtcctcttttctttcctttccactctctccttctctcttcattccacaactaagtctccgatgcccattaagctccttgtgtatactaagcaatggggaatacagatcaaatggaagtgatccatttcgcttctggattttacagcttcaaggaacttgttgacaacacttcgataaaaaagaaactgaaaagcagtgagataattttacttgctgaaaagaggagctatttcttggcatgtagaactgagcaacacagcataggttaccttggagttacaagagaagcatcacacccaaatggctgaagcccctggccagagataagaactcagaggcatctccccaacctgggagaccaggctccatgctttcccactgcttcctttaaatggatcattcaggcatttgcctgcaaacttaaagtgacccgcacgctattcccttttatgtaccactagttggccacattctctctttctcgggctgactcttcattcttgccttgtgtgatgcaggagcagaaaactgtcctcttgattcattgcaccctccctgcccaggatgtgtaagtaataaatctttgagcttattttctatatggtggtgtattgaatttgcacctttcatctgaagacctaggaactaccgcagactgggttttccctcggggagactacaaggttgggcttccagtgccagagcgatgatcaggcagacataaactggacatgggtcagacaagagctgcaagggcatcagcagttataaataagttcctcctgggagagatcccctggtcatggataggaaaactaggcatgaggttgtctactaggtaaaagaagcatcctgtgaaaggcacgtgtaaacacccagatttacttcccctcgttggtcattagggcagggttgttagctgctgtagtactggaaacccagtttagccagtggctctcaaaacagcacgggatctgaagttattgctatccttttttttcttaaatctgtatgtgtttaaaacacaagaactcctttgtgatattaaaaagtcctcataaccttcccatgataagtcatcagattttgaggactattgattgagaaaatatgcaatggcaaaaagtcactatgaattcatttgtgctcacaaatgcatgtgccttttaagccatgtcagcttgaccgtctttatttgtgtgaggcagattggttaagcagattccagaagtgcttggtatataataaggtttcctggattcctacaaggtttctgccgtcttacttcaaagaattgtatctctccaacttcatccagtaatggaaaattatgaccatgtgtattgtttgatgtttgatagagttgtccaatcttttattgtccaatcctctttttaatttttcttctgaaagagacactggttgggaagctgcacaagttgtagttgggttttttgttgttgttgtttttgagacagtttcactcttgttgcccaggctggagtgcaatggcgcgatctcagctccctgcaacctccacctcccaggttcaagtgattctactgcctcagcctcctgagtagctgggattacaggcgcccacgaccacgcccagctaattttttgtatttttagtagagatagggtttcaccatgttggccaggccggtctcaaactcctgaccccaggtgatctgcgtgcctcggcctcccagagtgctgggattacaggcgtgagccactgcacccggccagagttgggagattttatggttgggaacctgtgtgcataaaatcccccaactccatccaacttgtgcgactaatcacgtggcctgtgaaatcctgcaatgtgacaagtagcaatgaacttaacaatactcaagtttcatccatggagcagaaatctcagttggaaggtggcggtgaaacatttatgccaaagacagcctgtccctgcctctaactggatacatttaagcctagccctatttttattttggttttgtgacttctcagcattatacagaaatggaatattctgacatttaaataaggaatatttatctcccaaattcaatctatttgtgtccagaatcttgtactatttcctatcaccaccaccatcaaaagtattttttcacttcggcaaatagttcagtgaccctctgagatcgtgagaacagaggtcacaggctccagaatattatttctgaacccagggttacttgggtcttatttttctctagctcatttttttttcttatttgtcagatttattgggcctttgttttgtccttttgagagtttttaaatttgtctttaaaacaacatgggtgttgggtcaccacagggaagagagaaaggaatgagtttctcactgctgcatctgggagggtggacttgcctcacatggctttgagtcaagatggtggaattaatgaagttgggccctcaaggtcaaagctcagatggtctagctgatcttactctgctccaaggccacagaccacatccccaaatctgatacacaacttcctttcatctacaggacaactgggcaaggagaggatttggccccaattctgtgtcccccaggccatcctcaattgcaggaccacaactcagaactcagaatgaccaagtctgttgtcatcgagaacatgagcctgccaatgaatctgtgccctagatttcccataaaaaagttgttcctttgccatttccaattccaatcgggcttctgagaaacccaaagtacccaacccctgggcaagacatgaaacaggattgaaatggggtcagttaccctctcggtgttcacagcgaacccgaatgagatcagcagcaacaaccttctgacgtctttcagctatagatggaagtctgttccctgtaggaaaccaccaggctctattgctgggatctttgatgagaacatactcgcccaagagccagccttgatttctgggtttcagaatctattcctcacccctttgcctggggcttctcaaacttcttcctgtcttgggctctgaccgatcctcagatctgtggatcacaaactaatcaaggagacaggagccttgtgttatccacagttggtgcaatgtcatgaaccacatgtaccaagacctgtgccacagactgggggtacaaggagaataaaacaagatccctgccctgaataaactcacctcccagtgacaattacgttccactgtgacaaattctatacaaaaaaaaaaaaaaaaaatccaggatgttatggtagaggaaaccatggcgtcatatttacattcctgtgccttcagggaagacttcctgaaggtggatacctctgagctatacaccaaagatagctattgccaagttttcagcacaaataccatgcagctggtatatccagagtagactgtaatgggttatgatattggtgacagtttacaatgaatccttgccagcagtttcttgtaagtgcgtttctcccagtcactgcataacctcggaacaggaaagcttaagctgcgtcttctgtctgactctgaaatcaggacaggactctaatagtgactgtgtcaccaggatagagttgactggtgaccttcctccacatggtagcaccattgtacacatttgcaatttgaatgagacattgcacactcactcatcacagcttacctcctattgtatgtgaggagacactggatttccaatcagggggccatgactggagaaacatgagcaacaactgaagaaccttgggtccactaagaaaatagttgggtgttcactacagatgtacatctgacggccttgctgttccctgggtaccccagacttgttagaatgaaaatcaagttcttagcattctggcttctactcttcgggctcctcctttgatcccttcttccttcccagaaatcctgaactgctctctgatctcaacactccttgtttcttcctgcctccagccctatgcaaatccaatcatctcattttgccgtaactactggttttcatgactgtctctctcacaggaatgagctcttagaggccaaagactatctgtaattcatctctatatgaaaatacagagatgtttgccacatgttaagtgctttacaaattttctcttttcaatgagtgaatgaatgagtaaagaaaaaaaacaaatgaagtcctcggaaaaccaaaaagcaacagcttccttgaccagacatgaaatagaacatcgaactcagcttctcagaaccacatactctctcttttcatctttcatcactgccttgggtcaggtgctttggcaagaaaccaagaaaaaaaaaatatgtagacgtgtgcctgtggaagctgattttagaagatatgtttcagcaaattttggacaaagcctaaagggtacaggttcaaaatggatttttcacaaatgacctcaggggagaggtacttgggaagtttgaaggctagtcacattgcttgctataaaatccattcccaaaaactgcagttcctctggaagtgctgagaatgagtcttagggcaaatagagaactaatttctcttactttggatataagagagtctccatggagagctgaaccttctccctggacttgcgttcttggaatcatagatagagtgagttagaagggcacagagagcattatgtggtccatcccaccccccagcttccctgatttcaggcaataataatatctccagaaatactgattttgtaattagtgtatgccaggcactgtgtgtatgcaacatcgtttaattctaacaaaactcctatgagataaattctgatgtactcccatttgctcgatattaaaactgaagcttagagtgattaagcaaactccttaacctctctgcacctgcgtgccctcatctgtaaactagacaagccatattaagtttacatgagttaatttttttaaactctagtatagtacctgaaggacagtctattttatgtaattttgttaaatagaaaaataaatacatgaatggatgagtagttggatagattaaagtagagtacctggaccatgatcaaagagccggtacctgtggaagccaagagtctaatgcaggccgtctgactcagatattgagtgtattaatacctgagtgtattaatacctctgtgttactatctagaccttaccagatgactggatgtgctccccaaaatcttaagggaagggtgcttccttttatatctcattctagtgttttctacctgaaacattctttcttgtaatttgctggacagtatctagttgaattttctttcattcctttttgcaaatataaaacccctggcttccaccttgtcagtgggtggatgggtaatgggagaaactcctccactgtctgcatcctgtctgtgccttttgtctaaccagccttcttacagcctgacccaagcagccagtggaatggaatggaagcaagttggagacacacacacacaacactgcctcaattatccttgcctgttcccttttaaatggaatggaagcaagttggagacacacacacacaacactgcctcaattacccttgcctgttcccttttagattctgcatctctctgacggttgactcctgaaactctattactctgtcttttaatgttgtcagcattaggaaaagagtgaccttgacaccttgctccttctactgaacttacagctttcctcacgatggtgcagaactaagtggttagtagagatacttgtggctggaaacatctcccctgaaaacagatataggaagaacaggtgcaagttcccatgggcgcaaagaagttctgcaaatgtgcatgagcttactgtcactggaggaggtggaaacacaaaaggagagggctttgagtgctacatggggaccagtcctctccggtggggagacaaaggcagtgtggtttgactgcaaccccaaaacttcccaggctccatctgttcccaagagagcatttagcttgtgtgttcccagcaagaatgagtctgcttcaggaaagagatttaattgccccatttatcagctctggttcacaagatcacactgacaaagatcacggcctctttttaataggagaaactggcagcagaataaatatcatagagccactccttggaaaaacgacatttgatgcttcaccctacctaaaggatgcacatttcccagccttttactctcaagcccgctgcaagttcccctttgctttgtattccttctatttatatggcagaataactcactaaacagatttgaacacttctgcaatgctgcccagtttaagcctggggatgtaagaaaagaaacagaaacagaaaatatggattcaatgctcactacgtgctgcaggccacgaaaaatatcaaaaccataaaacatggtccctgatctccctccaggagattacaatatacttgagtaaattaaaaatgaaataagaaagtatttgaactacagttcagtacgctagtcaaagagggccacgaggcaggaaatgattaatttgaaaatgattggaacaggctgtaattggtaatgagaaatgtgcatttgctctttttttttttttttttttttgaaattgaagtctgctttaccatgttgatttcctctaaaaagaggtattgtttgggcaaagggcagaaggaaatctttttatttacatcctgaaaagaatcgagatgatgtttcttatatcagactgccctccttacaggcttacaaacctggcttggtttgaggcaacaccgaaaggaagatgttctgggaatctgatgagtcatagtgagaagacccatttttgtgtcctcccagactccaaagggtctgagcacggtggctcacgcctgtaatcctagcactttgggaggctgagccaggtgggttgcttgagcccaggagtttgagatcatcagcctgggcaagatggtgaaacctcgtctctactaaaaatacaaaaaattagcacagcatggtggcatgtgcctgtcgtcccaactacttcggaggctgaggtgggaggatcacctgagcccaggaagttgctactgtagtgagttatgatcgcaccactgcactccagcctgggcgactgtagtgagaccccatctcaacaaaacaaaacaaaatacctccaaagggaggggggacgtcaacagcacattgtatttccaaagggatggcattggtgtttttgtgagaagaggaagcagccgtgcaggtctgaggtacatggtgggcagagaaatctggatgagtttgagatagtgttggtggacagtgagatattatttcaaagtctcccatgactttgtgactgtgcgaaagcatgggaggctgttggaagaaaaggaattgaatcaagataccctcttctcatccctttacctacacaaccgattgatcagcacccatttttgtgggtgaggaactggaaagggatggatttcctatttttttaaaaaaaaactcattaacatgtatgcttttttttctggttaatacatttgagaactttaatgagtcacttagtctgtaaaaagaaaactaggaaaatctctgtccatcaaagtgaagaaaatgcaaggaggtttaccatctgtttgaagctgtcagtaagaaattaaagcccaaatgagcatgtgagttcaaatgtatgctacttaaatggtgtagtaatcaaagtaaaaatttttccatacaaaaactcatacattgaaaattcctggaaccatggcagaagcaaacccagaaactctctatagggatgtttctgtagcctagtgttcttgggagtcccatggggcttagagggaaaataattctgcagaagattagctcatggtcaaaagttacagacgtcacaaggaagtaacccaccatgagagtcagaacacacagcaaacagaggaatgagaatcccaagaactaaggtgggggtgggggggagtaatctgaaagactagaggtttaaaattattaaatatatgaaagttttaaaaacttttaaactttatataacaaactatataacaaaaggatgggatattatgataaaaagaacaggcagaactgtaaaagaaccaaatgaatatcacaattaaaataaataaaattaaaacataaagctaaatattaccaacaaaagaataaattaacgggaaaatacatctattggaaattacccaaatgcagcacagagagaaaaaagaatgcaaatattaaaacaaggtaaataacctagaggagagaatgaaaagttccacagtattttaaagttttcaggaaaaaaaaaaaaaaagatgggactattatataccattagggaattgcaaattgaaataatgagctagcactacatccctatgagagtggctaaaaccccaaacactaacactaacactgacaatgaaaagggtggtgaggacttggagcaacaggagctctctcattcattgttgatgggagtgcaaaatagtacagccactttggaagaaagtttggcagtttcctacaaagctgaaacacagacttactgtataatctagcaataatgctcctaggtatttacccaaatgaactgtaaaaactgtaccacactaatgcaagatgttaacagggaaaaccgaagggagcggggagaggtagtatatgggaactctctgtactttctgttcagtttttctgtaactataaaaccactctaaaaaaataaaatctattaactttttaaaaaagatatgatagggagaagtaatattcaaagccatagcaggtgaatttttgccagaactaaagttctaagtattcagattgaagaatcgtactaagtccagagccgaaccaataaaacaaacccacatctagacttcacaccaaagacaaagtgaaattctcaaaagcaactagagagaaaatatagattgcatagaaagtaacgacaattagatgattagccaacttttcaacaactgccatccagatcagaggaaaatttaacatctccaaaaggtcaaggaaaaataattgtcaactttgatttttatattcagccatatcattcaagagtgagaacaaaccaaaaacaatacatgctaatttcacataacttaaaaaaagaccaatattaaatcattttgattgacttcttcaaagagaattgatataaacatttggagtatttcgttaatttttctctgcatgtccccattacatcttagagatcatgtatatacatataaaatatagtcatacttttcatttagcatacacatcttgatttttactgtccttgaaagatcatttttaaaggctgaatcatagtctaagtgccatagtttagtgaattgctagacagtataattgctagacatatagatcagagaattttctcctaaatggcaacaggataaaatgcacataaaagagggacagaataattctaagcatgcctactcttttcttccccccattggaaaaaaccacctggttctttaattgcctactgaagttggggggtgggtatagtttagtttgcaaggggccattcagagccagctggatgtctcttttcaattaaagttttgtgccctaagtatgctgctcatgtgtgacttttctaagtaatcctgaatgttctaaagagagagagaaaaagaaacacacatatttgaggattgccacaggccaggcactgtgttaggcattttcttcacaacagtaaatagtagcaaacatactgcttatgaaaacttactatgatctgggtcctttagggattttatacattctcatctcattcaatcctcatggcgactctaggaagtatgttctattattatgcctatttcacagacaggataactgtagctccgaggccatgcagctagcagatgatcaagtcagaattgcaatgaagtctttctattgtcacgttctgcccttttattcccatgtcttgttccaagcttgggtgggtattgggggcaggggtaagggaaagcaaggtcagaaaaacataataatgaccaaaaaaaaaaaaaaaaaaaagacaaaactccaaaaaacaaaaccaggaactgtgctaagttatatatattatatatgtatataatatataatatatatacatattaatagagaataagtttgctatactctctctctatatatatattatattctctatttttatatataaattttgtcctcactgcaacaatattaggtaggctatgtaatcattattatcttcactcaagaagtgagcaaatggaaacccagcaaactcagaaacttgtcttaaggttacatagctgtgagttgcacatcgtctgttccaaacccagaagcgtctgccccaaagtgcatgttctggtcctcactgcctgtgaatgttgtgatctgtccag

SEQ ID NO: 88 - DNA, 3823 bp, Homo sapiens
  source 1..3823: mol_type = genomic DNA
gtaggagagcggccgcgcagacctctcgcctgctcctgcccaggggcccgccagggccatgtgagcttgaggttcccctggagtctcagccggagacaacagaagaaccgcttactgaaactccttgggggttctgatacactagggggagttttatgggaaagaggaagcagtaattgcagtgacgccccgttagaaggggctttctacctccccagcattcccccaaagcagggaccacaccattcttgacccagctccacccctgtcggtaggtgctggcttcttcccctctcctggtggtggtgggtggttcccgcggcggcctggagccggaggggcgcgcgaccctgggctgggagctccgagggcctgggaacgagacctgagaccttggcttctcgaaggtagtagggacttgggagtggtgactgaacctggtctggctcctccttacttcctcttgttgcgggtgggacgagctagcttccgcctctcccagccactttttcctgctcatttgcagctaggttggctccccttttgggaatttcctctccccttggcactcggagttggggggtgccacctagtggaagataacggagctagggtcttgaagaggctgctgtcccctctggctgttttggcggtgtagggtggcatgagagactgcgactcgcctcctcatccctgtttctgtatgcgagtgcttgtattcagtagaagcatacactatactccctcaatttagggtaaacaggaggggccacatgcacaggtaattcaccagggagccgaacactcctgtgcagacagactccccttcccagcaagccatggcagcggacagcctgctgagaacacccaggaagcaggcggtgccagctgcaggtgctttgcctgggagctgtggggctgaggagagggtccactgtccaggaccagtgaacttcatccttatctgtccaggaggtggcctcttggggatgctgagttaggggaggggcacttgaggaaagccaggtggagcagagaggatgtgagtgactgggtgggtgagatttcctgcccctccccccgcagtggtatccacacctagactcgtggggtaactgaggcacagacagagagcaacttctcaggccctcacagttggcaattctaggattaggacccaagtgcgattttcaggcagtccctgtaccctgtttctgttgtacctgttgcaccattcccaggcactgcccatcgtgccactagtgatatgaacccaggtccaatacgctctggggccatcaaagcctgacgtcaccatgacctgatgtgtgacgtgttataggtgtcccttggtatcttcacggaactggttccaggaccccaaaatctgtgggtgctcaagcccctgagataaaatggtgtaatatttgcatataacctatacatactttaaatcatttctagattacttatacctaatacaatggaaatgacatgtcggctgggcgtggtggctcatgcctgtaatcccaccactttgggaggccgtggcaggtggatcacctgaggtctggagtttgagaccagcctgaccaacatggtgaaacccccatctctactaaaaatacaaaaattagccaggtgtggtagcgcacacctataatcccacctacttgggaggctgaggcaggagaattgcttgaacctgggaggcggagttcgcagtaagctgagatcgcgccactgtactacagcctgggtgacagagcaggactccatctcaaaaaaaaaagagaaaaagaaaaagaaatgccatgtaaatagttgtgatcctgaattgtttagggaataataagaaagaactatctgtagatgttcagtatagatgcacccatcgtaagcctaactacattgtataactcagcaacgatgtaacattttcaggggtttttttgttttgttttttgagacagaatctcagtctcactctgtcacccaggctggagtatgttggcgtgatctctgctcactgcaacctccacctcctgggctcaagcgattctcctgcctcagcctcttgagtagctgggattgcaggtgtgcgctaccacgcatggctaatttttgtatttttaatagagatggggttttaccacgttggtcaggctggtcttgaactcctgaccttgggatccgcccacctgggcctcccaaagtgctgggattacaggcgttagccaccgcgcccaatatattttgatccctggttggatatggagggctgactgtacttaacatctctaagcttcagtttcctcctttaaaataaaggtgtggctgggtgtggtggttcaagcctgtaatcccagcacttagggaggctgaggtgggtggatcagctgaggtcaggagttcaagaccagcctgaccaatatggtgaaaccccctctctgctaaaaatacaaaaattagccaggcgtggtggcgagcgcctgtagtcccagctacttgcttgaacttgggaggcagaggttgcagtgagctgagatcgtgccactgaactcgagcatgggcaacagagcaagactgtctcaaaaaaaaaaaaaaaaagggggtgagcagacgtggtggcacgctcccacagtcccagctacttagtaggaggccaaggttggaggattgcttgatcccaggagtctgagtccagcctgggcaacatggcaatacctcatctctaaaaataaaataaaagtaaaggtattaattactactttggatggttgttgcaaagaaatatatataaaataatggagagtcttgtaactggctcccaagaggctcaacagacattactgtttttgcttcttcattatgagttacctctctggccaccccactgaactagctgggctagctgagcctgggagaagagttgtttaggaagtgagaggctgctctccacagagactcaaggctcagttcctcctggtgactcagatgggcagcccagtgggcacacgtggtctctctccacatgtggctgagtttcacttccagaatagatggagaggcaagggcagggtttagcatgcttgaggaatctcagagggccctggtggtgtgggggaccctcagaacacaggtgtctcaagggctgacccagcttctgtgtccttttctctgggtgaggaggggacattcatgggcagatggtgacctctggggaaggcagcccagactccactggccaccatatttcctttttcacaactttctcacccctgtggtttcccatgtcatcatgtggccgcttcccgcaaggccttagcggggtgcaggtatgaacatagtgtcaggcaaggaggcatctggaggggaaccctggcttttcctggggggactccctccctgcaccctagccctgtcctctcccatggctactgatgccttcccctcaccccagaggtggcccacatctgcacagatcagacccacaaaaatcacgtcttcctgactctcataagcctgcccagtgaggcccaggcattaggccatgtgctggggactcagacccacacatatacgcatgtcagcattcatgcttacaggtccgcacatgctggggcaagtgtcacacacggggcgctgtaggaagctgactctcagcccctgcagatttctgcctgcctggacagggaggtgttgagaaggctcaggcagtcctgggccaggaccttggcctggggctagggtactgagtgaccctagaatcaagggtggcgtgggcttaagcagttgccagacgttccttggtactttgcag

SEQ ID NO: 89 - DNA, 900 bp, Homo sapiens
  source 1..900: mol_type = genomic DNA
gtaagtaccatcctgttccctgtcttagaagagcaaacacttgtctgaagctgtaactctggatggcctggcctaaactgctgatgctcggcctggagtcccccttgaccctggggaccgagggtcaccaagtgctgagagccatggaagatgagtttttcctatgcagaaacttaaccagtgctaaaggttggctgtggaacatcacactggctcttcactgagtcccacaggacttctacctggtgtactgaatacatttctattttaggaaagtgtatactttgctacttttctctaatagaccctacactggggaaagcaggggttctggtcacttatactgagatgaagttaagtcattagtccagtgactgcctcctgtcttccctgagcagcatttggggacttctcagtctccaaagtgaacagttgagtttggctccttcctcacattcttggaggaagtagctgaagcatagaggaaggggaaaggagggtgattacaaaggcattgggagcatcgcgtgctgcactcacccctgcaggcatccctgttccctttgccaggagaagacttctttcatctttctgctgtggaaactgacccatgaggtaggtggtgctttgtacagacctccactccagcctgactcttgctgtacatcatcatccagggtctacagagtcactgtggtgaccaccctcccactctggccccagaccaggccatcctacagctgtcttgctctggggacatctcctcattgaaagattttttaaaatatatggtcttactgttttttttttttagtccagtgatttatatagaatatctggtctataatctgagaatagaaaaccttaaccaactaaatgagttcatttctgtcatttcag
